United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 42

SEQ ID NO: 189388 - protein, 161 aa, Glycine max
  Coding DNA Sequence Number=SeqID_72610
  Gene Ontology: Mol. function=RNA-directed DNA polymerase activity; Biological process=DNA integration
MKKVVTIIGANEDKVVVEIEEDDKVGGYMTTTTTTFKEEEVQQEVVDKLDESMSSNVAFGDESKVEVKGKGNILIRLKNGDRQLIPNAYYVPNMKSNILSLWQFLEKGYDIRLKGNSFSIRDNASNLITKHLRFEHLNFGGLELLSKKKMVKGLSYTSHPD

SEQ ID NO: 189389 - protein, 520 aa, Glycine max
  Coding DNA Sequence Number=SeqID_72611
  Gene Ontology: Mol. function=transmembrane receptor activity; Cellular component=membrane; Biological process=defense response
  Homolog annotation: Hit_ID=Q1T1A2; Match level="QueryCoverage=99%, HitCoverage=58%, E-value=1e-116, Identity=44%"; Hit description=TIR; Disease resistance protein; AAA ATPase
  Pfam annotation: Domain name=NACHT; Domain location=212-366; Score= -32.0; E_value=0.018; Accession=PF05729.3; Description=NACHT domain
  Pfam annotation: Domain name=NB-ARC; Domain location=174-470; Score =156.2; E_value=8.3e-44; Accession=PF00931.13; Description=NB-ARC domain
  Pfam annotation: Domain name=TIR; Domain location=16-148; Score =160.9; E_value=3.4e-45; Accession=PF01582.10; Description=TIR domain
  Pfam module annotation: Pfam domain module=NACHT::NB-ARC::TIR; Domain location=212-366::174-470::16-148
MASSSSCHVTEIKHDVFISFRGTDVRKGLLSHLKTELRRRQIDAYVDERLDRGDEISSSLLRAIEESQISLVIFSKDYASSQWCLEELAKMIESMEINKQIVLPVFFNVDPSHVRHQCGDYGDALAKHEEKLKENMLKVKTWRSAMKKAADLSGFHYPTNFEDESDLVHGIVEDIWEKLSKFCPRESNGLVGIDQNIARIQSLLLMESSEVLFVGIWGMGGIGKTTIARAVFDKFSSQYDGLCFLNVKEELEQHGLSLLREKLISELFEGEGLHTSGTSKARFLNSSIRRMGRKKVLVVLDDVNTSEQIKDLVGEPTCFGAGSRVIITSRDQNVLTSGGVHQIHEVKEMDSRDSLKLFCLNAFNESQPKMGYEKLTEEVVKIAQGIPLALRVLGADFRSRSTIDMWESALSKIKKYPNKKIQSVLRFSFDGLEELEKKAFLDIAFFFEEDSKDYVITQLDAWGFYGAVGIEVLQRKALITISKDNRIQMHDLTRQMGCEIVRQESITNPGRRSRLRDSEE

SEQ ID NO: 189390 - protein, 185 aa, Glycine max
  Coding DNA Sequence Number=SeqID_72612
MPDELICLRSTYYVKLYEKTTGQDTKLHILFDGFRFYERVSARELDKAAGVRGGMMLILYCTAALFLFQLLERPSTDTLVPCRVRHASVSMSDTDTRPAGLGDIEKRIALDRDCSFDHISVDEDMTKSKGKDPLEGLGGPMTRARERKSKEALQQVLSILFEYKPKFQGEKSKVVSCIMAQMEED

SEQ ID NO: 189391 - protein, 87 aa, Glycine max
  Coding DNA Sequence Number=SeqID_72613
MENGRTPTGTAASKQFSLHTSISLSRITSKLESKEQGMQAKNECHNPAYKRRTTQNANGISDLSRHKSPMGVAFPRQTCRASFCSCT

SEQ ID NO: 189392 - protein, 86 aa, Glycine max
  Coding DNA Sequence Number=SeqID_72614
  Gene Ontology: Mol. function=RNA-directed DNA polymerase activity; Cellular component=chromatin; Biological process=RNA-dependent DNA replication
MGLGDFALIITPGTPLQNRFPIPTIDELLDELGDASWFSKLDLLQGYHQILMKEEDISKTAFRTHHDHYEFRVIPFGLCNTPSTFQ

SEQ ID NO: 189393 - protein, 417 aa, Glycine max
  Coding DNA Sequence Number=SeqID_72615
  Gene Ontology: Mol. function=serine-type endopeptidase activity; Cellular component=periplasmic space; Biological process=proteolysis
  Homolog annotation: Hit_ID=P27028; Match level="QueryCoverage=100%, HitCoverage=59%, E-value=1e-169, Identity=69%"; Hit description =Prolyl endopeptidase precursor
  Pfam annotation: Domain name=Peptidase_S9_N; Domain location=4-404; Score=529.0; E_value=4.9e-156; Accession=PF02897.5; Description =Prolyl oligopeptidase, N-terminal beta-propeller domain
MTYPKALKGNQTDTYFGTAVADPFRDLENDSQPTKKWVDEEVAFSQNYLSKIPFREKIKNQLRDIWNYEKISAPSNEGDFTYYNKNDGLQAQSVIYRTNNKTKTTEVFLDPNKFSEKGTTSLSQLSFNKKGNLAAYSISEGGSDWNKIIIIDAITKKQIDDTLTDVKFSGISWQGDEGFYYSSYDKPKEGTVLSGMTDKHKVYFHKLGTKQSSDQLIFGGDKTPRRYIGANVSEDQRYLIISAANTTSGNELYIKDLKNGGDFIQINKGFDISAGIVDTEGDNLFVFTDKDAPNMRLVKTSIKNPSPENWIDVIPQTENVLGISTGGGYFFATYMVDAIDQVKQYDKTGKLLRDIVLPGKGNISGFGGKEDEKELYFSFTNYITPGTTYKFNADTGKSEVYQKPKVKFNPEDYISEQ

SEQ ID NO: 189394 - protein, 222 aa, Glycine max
  Coding DNA Sequence Number=SeqID_72616
  Gene Ontology: Cellular component=membrane
  Homolog annotation: Hit_ID=Q2XEN1; Match level="QueryCoverage=83%, HitCoverage=50%, E-value=4e-41, Identity=50%"; Hit description =Membrane protein, putative
MAQHRGGSGNFAEDRERAAEAGRKGGKNSGGNFRNDPQRAAEAGEKGGRSRAKKYKNVRQSSILVRYVCFHFPPQPAYYASGAGAYFYHDGLGWHLSGGASRHGALGAVLFCRAAFRYRLAAAGLFLSPLFAPHYLAGNQSGYADWRGDCRWLRIANLGYANHFQQSVGVSDGALRAGGATVAVAVSAPAAGPDGVAGYFACVHRSGAGGGAAGWQPDAECR

SEQ ID NO: 189395 - protein, 81 aa, Glycine max
  Coding DNA Sequence Number=SeqID_72617
  Homolog annotation: Hit_ID=Q1SWQ8; Match level="QueryCoverage=78%, HitCoverage=22%, E-value=2e-08, Identity=42%"; Hit description =Nucleic acid-binding, OB-fold; TonB box, N-terminal
MDVMLFLCCGGEILSCTLWENYCTQFLSYLNECGDDGPMIIILTHARIKDAQGSYPALVSNSFKASKLLINDPILEIQEFK

SEQ ID NO: 189396 - protein, 135 aa, Glycine max
  Coding DNA Sequence Number=SeqID_72618
MGPLLERITSEMPHAPSHRFILIRRWEESVGNGSEVCGYDEEVMVGSFGSNSLGLDSSTLVGESSTKRESSDFSTFINQLPERVGENITTLVAVVAAQLRPLTEVRSQPKEHLALKEASVPLPIMLLRYTWVDGE

SEQ ID NO: 189397 - protein, 58 aa, Glycine max
  Coding DNA Sequence Number=SeqID_72619
  Subcellular localization annotation: CTP_CleavageSite=50; ConfidenceScore=5.25e-01
MFSPSSIENSLEISEKNCFRGKNPSRGASITLSRHFRKRFRGDSSSFFVRSSSFFGFN

SEQ ID NO: 189398 - protein, 68 aa, Glycine max
  Coding DNA Sequence Number=SeqID_72620
MVAHGGHRWSWVVERKVLGELISLSGSPLFALSTTIRVEHNSPCVKCENSRLAQFPLKLELRLARFLQ

SEQ ID NO: 189399 - protein, 115 aa, Glycine max
  Coding DNA Sequence Number=SeqID_72621
  Homolog annotation: Hit_ID=Q0SFS7; Match level="QueryCoverage=97%, HitCoverage=6%, E-value=6e-35, Identity=65%"; Hit description =Probable glutamate synthase large subunit
MSAEGVGDGAGVSLDLSLSFFRKLTGEHGLQAGRFGVGNFFLPQNSAFHDEAVGIIGSALQEQGFSVLTVRDVPVNDAAIRAAAIPYQLPIRQWVFSAPAECATLAEFDWRIHSH

SEQ ID NO: 189400 - protein, 78 aa, Glycine max
  Coding DNA Sequence Number=SeqID_72622
MKNDDDVYTMLIYSEQYSCVGPIELLCTIIRTPDAILNLLQSTITPTHDVLQREVEHTTSRFCIPSGCDMEKLKDLIK

SEQ ID NO: 189401 - protein, 61 aa, Glycine max
  Coding DNA Sequence Number=SeqID_72623
MAKKPVENMPFEITSDEPLKSMSLSSSSNAYNVPWVEKYRPIKVADIVVNEDAVSRKLFSN

SEQ ID NO: 189402 - protein, 73 aa, Glycine max
  Coding DNA Sequence Number=SeqID_72624
MKQGRCRKDFRELNLHIFELSFLTASNSTPTYLTPLLPLTMMTTRKSPTPSGSSPLSMTYDKTSSTLPRMGHQ

SEQ ID NO: 189403 - protein, 97 aa, Glycine max
  Coding DNA Sequence Number=SeqID_72625
MHERQSNSWGSEKGREWRIALRNHYAWLQTHGWWMHDRKRNSWGSEKRGCMNENAIHGAPKRGREWIIALSNHYAWLQTHGWRMHKRKRNSWGSEKG

SEQ ID NO: 189404 - protein, 59 aa, Glycine max
  Coding DNA Sequence Number=SeqID_72626
MAHNDHNMTLRAIRHDRLRMAERHGRLRMAKRFGMTIICLGMSSGLSPLDDKRSIMIII

SEQ ID NO: 189405 - protein, 103 aa, Glycine max
  Coding DNA Sequence Number=SeqID_72627
MQSADKREYHMVIRTFHQPGANEPVDAQRLTSSSAPSVILTHEVYFSRPKIFKPNDARDSSLLGGDDQISKEGQLPYPNFIRGPLFGGMQPSLDHLEVLNTLR

SEQ ID NO: 189406 - protein, 89 aa, Glycine max
  Coding DNA Sequence Number=SeqID_72628
  Gene Ontology: Mol. function=RNA-directed DNA polymerase activity; Biological process=RNA-dependent DNA replication
  Homolog annotation: Hit_ID=Q6L3P1; Match level="QueryCoverage=83%, HitCoverage=9%, E-value=4e-12, Identity=41%"; Hit description =Putative methyltransferase family protein
MCEHKRKDKIQNDCMQGVIGAASIEKNMTKIRLRWFGHVQRKSREAPVRRLDCMNYSPMKKRRGRPRRTLENLVKWISWNRTSAHKDSS

SEQ ID NO: 189407 - protein, 217 aa, Glycine max
  Coding DNA Sequence Number=SeqID_72629
  Gene Ontology: Mol. function=sequence-specific DNA binding; Cellular component=intracellular; Biological process=regulation of transcription, DNA-dependent
  Homolog annotation: Hit_ID=Q1I6J1; Match level="QueryCoverage=47%, HitCoverage=39%, E-value=4e-38, Identity=71%"; Hit description =Putative transcriptional regulator, AraC family
MPAITGTLPSAASLATSITASFSCTVIEAGDAVAHQVFDHRMSGVEIQREIVAELGRHRREYAAPAYGFMAHRGGLTLFADCRDEIGTMPAERGREKSGRRRTLKRGGALSGKRQAEIARRGAGHRFELTAEGAVIGVAALQRDVGDRQIAGQQFRGLFQPHFMDHLARGEVEDTFAVAFDLRHRQPGQRRQLLKRDRPGIVAADVYVDRRQPLVGR

SEQ ID NO: 189408 - protein, 291 aa, Glycine max
  Coding DNA Sequence Number=SeqID_72630
  Gene Ontology: Mol. function=protein binding; Cellular component =apoplast; Biological process=response to biotic stimulus
  Homolog annotation: Hit_ID=Q9CA24; Match level="QueryCoverage=77%, HitCoverage=63%, E-value=1e-100, Identity=71%"; Hit description =Thaumatin-like protein; 12104-13574
  Pfam annotation: Domain name=Thaumatin; Domain location=39-244; Score= 280.3; E_value=3.7e-81; Accession=PF00314.8; Description=Thaumatin family
MVPSPNTTVTCLIKNTFYFVDEDSGQRTCECARVFTIVNYCKETLWPAVTPGENFNGGGFVLKPGQSTVFTAPVSWSGRIWARTGCKFNQNGNGNCQTGSCGTTLKCSASGKTPASLAEFTLAQVDYYDVSLVDGFNVPLFVKPINGKGNCTTAGCDSDLRATCPNELAVKVNGKTVGCRSACDVYNTDEYCCRGNYGNPSTCNPTFYSKKFKEACPTSYSYAYDDPTSIFTCSGTDYVVAFCASRKQQVCSYHSNKLHCSGSLGLKSLTGRWWIVMMITVFSVLSLWIGF

SEQ ID NO: 189409 - protein, 38 aa, Glycine max
  Coding DNA Sequence Number=SeqID_72631
MEDNNSRKMCDEVDMSMDDIVENEGCSKFFTIMEVLMI

SEQ ID NO: 189410 - protein, 46 aa, Glycine max
  Coding DNA Sequence Number=SeqID_72632
MEHMSRVGSPLRRCSLSSNKVGLPVLLPYCTTLQVWFNYQFLEFLG

SEQ ID NO: 189411 - protein, 132 aa, Glycine max
  Coding DNA Sequence Number=SeqID_72633
MDRCSWRLAVMVVLLLLLGLLWEFSATLVTAKFKHGGGPLEVWIRWFLVWFNGSGSGRTGLLKWIPFGTLAGNKSAASVMVALAGAIKSPIEVSKEFSNRSLIIINSHARLITQTVPGAHSYSQGRPNWDKL

SEQ ID NO: 189412 - protein, 187 aa, Glycine max
  Coding DNA Sequence Number=SeqID_72634
  Gene Ontology: Mol. function=chitin binding; Cellular component =extracellular region; Biological process=chitin metabolic process
  Homolog annotation: Hit_ID=UPI00006A17C9; Match level="QueryCoverage =83%, HitCoverage=100%, E-value=6e-16, Identity=34%"; Hit description= UPI00006A17C9 related cluster
FPTSNVQSFEFGIIDPLNESISCFLIKVDPWVLVPVTFRGLHVLAFKGLYAFAFRGLHALTFRGLYVLPFRGLHVLTFRGLHVLTFRGLHVLTFRGLHTLTFRGLHILAIKELHALVFRGLHVPTVRGLHVLTFRGLHALAFRGLQAFTFRGLHVLAFRRLHICALREFKGSHPQDTQWTRRSPTGS

SEQ ID NO: 189413 - protein, 211 aa, Glycine max
  Coding DNA Sequence Number=SeqID_72635
  Gene Ontology: Mol. function=ATP binding; Cellular component =chloroplast
  Homolog annotation: Hit_ID=Q2PMM5; Match level="QueryCoverage=100%, HitCoverage=9%, E-value=1e-115, Identity=96%"; Hit description =Protein ycf2
MNSIGPKIDTLEESSESYNINWVIVPLLYLPKGKKISESYFLGPKESTRVLPITKKYIMPESNWGSRWWRNRIGQKSDSSCKISNETIAGIEISFKEKDIKYLEFLFVYYMDDPIRKDHDWEFFDPLSPRKRRNIINLNSGQLFEILVKDWIYYLMFAFREKIPKEVEGFFKQQGTGSIIQSNDIEHVSHLFLRNKRAISLQNCAQFHMWQ

SEQ ID NO: 189414 - protein, 52 aa, Glycine max
  Coding DNA Sequence Number=SeqID_72636
MVDDIFVKVKMEVTRTSIVLNVFGSRRSSDKWVYDPNMVGSWYRIYATKNAS

SEQ ID NO: 189415 - protein, 233 aa, Glycine max
  Coding DNA Sequence Number=SeqID_72637
  Gene Ontology: Mol. function=3-deoxy-manno-octulosonate-8-phosphatase activity; Cellular component=cytoplasm; Biological process =lipopolysaccharide biosynthetic process
  Homolog annotation: Hit_ID=Q3RBL8; Match level="QueryCoverage=62%, HitCoverage=86%, E-value=5e-36, Identity=61%"; Hit description=HAD -superfamily hydrolase, subfamily IIIA:Phosphatase YrbI precursor
MQDVIHADFLAATGRALVTVAQRRPTAQQGGQQQADAEHGAPVQGGQVHAPNLASTASTWPWAASRMSHSSRAAPSPPSARVCQCTRSAIHGWALAGATARPTAPSGARSGRSSPMNATCSRPMPCCAHNACTLASLSPTAIWVSMPRSAPRLSADWLLRAQFQAQAILHEVRLALVAVLVVVQPTVGEGAVHVEAGQADTGRGGMQVGGEGGQGGPGHQGGRLVGGRCGVTD

SEQ ID NO: 189416 - protein, 113 aa, Glycine max
  Coding DNA Sequence Number=SeqID_72638
  Subcellular localization annotation: CTP_CleavageSite=34; ConfidenceScore=5.04e-01
MSTRGNPNPEACPFSPKKSTTGCFKFKYLIPGVLAKLRDSKITNNRRITQISASDELVLVPPASTQQDQTLNQENRIPSFALPTYHNRPSCLNRKKKLFAVTPTFTPANTHQS

SEQ ID NO: 189417 - protein, 42 aa, Glycine max
  Coding DNA Sequence Number=SeqID_72639
MDGTWIHSIGDMHCEEVVVVGGGATCEEIWVVHSGGNTLFYE

SEQ ID NO: 189418 - protein, 126 aa, Glycine max
  Coding DNA Sequence Number=SeqID_72640
MEVIEVDAETETERCYENSNVEEAPGNGDKVVRVQQQSQSMLLFDLEMTNAKLKVASGEKVWGYETQRDLESVRPLVYVAAGCNEVSLWNVENVSCHRQDVEVGIPSPKANEVLLIPEAISINPID

SEQ ID NO: 189419 - protein, 64 aa, Glycine max
  Coding DNA Sequence Number=SeqID_72641
MREMPNEKLKGQKVKFFGVPEPSPTYPKAEAFLLGQKVKFYGVPEPSPTYPKAEAFCWVWPFFA

SEQ ID NO: 189420 - protein, 331 aa, Glycine max
  Coding DNA Sequence Number=SeqID_72642
  Gene Ontology: Mol. function=catalytic activity; Biological process =metabolic process
  Homolog annotation: Hit_ID=Q2HW42; Match level="QueryCoverage=33%, HitCoverage=12%, E-value=2e-51, Identity=90%"; Hit description =Phospholipase D/Transphosphatidylase; Pleckstrin-like
MEVILGNVTSYFDSAKQLVNGIPLPLDLGSNIDDVKVKVTTTADSLSKKAKENSRMIHKVIDGVRLALVTVAVVMIFVAFLGLCMFDFVFSLLALPCPVYSLVVIGWILVTGTLLLCAAFLFVPKFISREPLVSIADLTLFIYEELAVNVHYMECFGSFAPIRGLTEDGSQAQWFVDGQATFEAIATSIQDAKSVIFITGWWLCPELYLRRPFDSFSTSRLDSLLEEKANQGVQIYVLLYKEVSLALKINSLYNMRRLLKIHENVRGSILGVEVNVSRKSYSTQLVVMEDENGNQNSAPPQNEGFLIPNVFTLAIPQVDGGSNLSIKVWWS

SEQ ID NO: 189421 - protein, 215 aa, Glycine max
  Coding DNA Sequence Number=SeqID_72643
WTRVTRCHIGFVCPGQYISLPSSESVCGQKRLSEGDEFVKPSKCGRVLSGVGRGSLDKCESYKSMWLVKPPSLVMCCPSCFCQVVRDGRVSACVALARYSCVHVTHEVGTTGVTIVREWRELYGTSFIMSSFLFDFAIGLGSSDSRGSIEQSIRDREVIPIGGSSSEHTRRGASDSKSSSLEKEPVRVTVILPPSTFGSVRRVGGDGDVRSSPYV

SEQ ID NO: 189422 - protein, 306 aa, Glycine max
  Coding DNA Sequence Number=SeqID_72644
VGSGHRLLLLRLLKKGDQTAGEVGLIVVVEDPMSLRAMRQVARLMPTAGRLPIEQDVLSTTSAIEALAVAAVEVAIPVIPAPSPYRAIDVVREVAPATAEVVVSATQAGSEWLVLVGAATTGASTMSPPSSTWVALPVVVLAIMALPSSSLRLPGSFVGWGAESTDSAKVFLQRSLVILEENELRHQEAVQKIASLEAEYPKVVGATVAFAEAVRANRQLSFKVDGALAKLMCTRLDSDDLFRRCNGLTRLTKLESELQVTKERKDLDLGLFDPFMDVKDDILLDEEEEAVDEGQGVVEQGDDVVV

SEQ ID NO: 189423 - protein, 55 aa, Glycine max
  Coding DNA Sequence Number=SeqID_72645
MEVLRTSFAATDHCNARRQYLHLHAGTLNAATLTNKTQCRTKKRKREKAQRTKME

SEQ ID NO: 189424 - protein, 82 aa, Glycine max
  Coding DNA Sequence Number=SeqID_72646
MKEEKATIEVPAPASNVIIEEPFLAKEKKEEEIKGKKPAMELAALDEATVKSVKAMFKDEVICTSEDIDDRGYLVSDARSIG

SEQ ID NO: 189425 - protein, 96 aa, Glycine max
  Coding DNA Sequence Number=SeqID_72647
MDELKDLIKQVAPRGILPYDVDETQMVTRLFFWKPSHHEYSEKVIKFEIIELKTNENVMKVLIESNYWKKFGPIEILAVFSKPLPQMEDELCLSQN

SEQ ID NO: 189426 - protein, 62 aa, Glycine max
  Coding DNA Sequence Number=SeqID_72648
MACMALHDAGAGNPSPLSVPEPYHAPRPRFLWWGIFYPVLVPRLPVRPTETPFYIKNVKNYK

SEQ ID NO: 189427 - protein, 64 aa, Glycine max
  Coding DNA Sequence Number=SeqID_72649
MRDRHKPSMTTEAHDIPQQRPCNIVETFDDGCESLIQDFFKIKHCLTMKGFKSFKAHVIDYQYM

SEQ ID NO: 189428 - protein, 70 aa, Glycine max
  Coding DNA Sequence Number=SeqID_72650
  Subcellular localization annotation: CTP_CleavageSite=59; ConfidenceScore=5.14e-01
MVPPLTSSPLSSPTIPWLKITIEAQRSSLHRSFSSKLIYSNKGNKGWIALKVNLRKCMIASSGSSFMRLY

SEQ ID NO: 189429 - protein, 104 aa, Glycine max
  Coding DNA Sequence Number=SeqID_72651
MRVLKDKALIHLIGSDLEAKVISFIRPVGSCDLPKFHYVPSHIYDIILTLVPPVITNFENVLAWKFNADGDLSLSSAYQVAFRDMVQSDSILKLIWRNLVDTDL

SEQ ID NO: 189430 - protein, 38 aa, Glycine max
  Coding DNA Sequence Number=SeqID_72652
DGESGGAGASASESSGMSIKGGAGGAGGRDSISTSGEA

SEQ ID NO: 189431 - protein, 166 aa, Glycine max
  Coding DNA Sequence Number=SeqID_72653
  Homolog annotation: Hit_ID=Q9LVE6; Match level="QueryCoverage=76%, HitCoverage=33%, E-value=1e-38, Identity=62%"; Hit description =Similarity to senescence-associated protein
  Pfam annotation: Domain name=Senescence; Domain location=1-124; Score= -109.6; E_value=8.2e-06; Accession=PF06911.3; Description=Senescence -associated protein
MTERLTKSLLDGVGIMSGSVMTPVLKSQPGQAFLNMLPGEVLLASLDAVNRVFEAAEAAEKQTFSATSQAATRMVSNRFGEEAGEATEHVFATAGHAVNTAWNVSKIRKAINPASSANAAGALRNSAKNRNTLEETNYKKCPHEKAPNPERTSFPPVGPMIITMRK

SEQ ID NO: 189432 - protein, 222 aa, Glycine max
  Coding DNA Sequence Number=SeqID_72654
  Subcellular localization annotation: CTP_CleavageSite=22; ConfidenceScore=5.51e-01
MAESSRKRKGSSTSTTATRTPRLGATGASPTQIPPSLSSSTLFSSDEQRICQGAPFEGTIVDDWKFDYSSLDARRMVNNDQAHMTGRLLAGSLTFDCRIMHFIIVHILLPRSSNLAQASEEDLILMWAFLTGRPIEWAHLIRYHMHKALRPNAPLPYPQLVTLFLHHFQIPLDNEPFVKVKCSFAIGAGAVTSLGYHKDMDGQWLKKDAQPSQDEHTPSPPP

SEQ ID NO: 189433 - protein, 112 aa, Glycine max
  Coding DNA Sequence Number=SeqID_72655
  Gene Ontology: Mol. function=protein binding; Biological process =protein metabolic process
  Homolog annotation: Hit_ID=Q9LU73; Match level="QueryCoverage=65%, HitCoverage=12%, E-value=6e-08, Identity=34%"; Hit description =Arabidopsis thaliana genomic DNA, chromosome 5, P1 clone:MUL3
MVLGEKEKDKKKKKAKTLTAEVALVLKQSLGLDRRRGHAQVTPLHVAATLLSLRGSSLRRACLKSQPHQTSHHPLQCKAFEAHQRRGCIEQQQQQPLLTIKKDKGIKGDQEG

SEQ ID NO: 189434 - protein, 88 aa, Glycine max
  Coding DNA Sequence Number=SeqID_72656
MELEQLDVKITFHHGGLEEEILMQQPEGCLTCAMVCTRLDIAQIVNIVSRYLKSTTDIGPIYQGDISCVLAEYSDSDYTVDWMQDNLL

SEQ ID NO: 189435 - protein, 79 aa, Glycine max
  Coding DNA Sequence Number=SeqID_72657
MSSVGLSALVEVVGIGNGKEDLKLAVEETKVGGCNEEEAEKGSYKVHDKLEEIHPDDEQVNDVVIQIIEKGQVGPPNQQ

SEQ ID NO: 189436 - protein, 172 aa, Glycine max
  Coding DNA Sequence Number=SeqID_72658
MPLKGKQLVVYPCKTLWRARLKVVKGGRDYALANLEELFLVPNIITPPKFKVLDFDKYKGTTCPQNHLKMYYRKMGAYAKDEELLIHFFQESLTGVVVTWYTNLEPSRVHSWKDLMVAFVRHESFKEYTQRWRDLPAQVVPSMTEKEMITIIVGTLPVFYYEKWWVHTFKLC

SEQ ID NO: 189437 - protein, 121 aa, Glycine max
  Coding DNA Sequence Number=SeqID_72659
MVGVLLKRRILMQHGKSQGNRDTTTYTTTLHHNIQSMAQGMTQVLCAGEHLHRVMDSKDCSLDWRIQFYMSPYAHTQKQHVCSYHNNKLHCSGSQGLKSLSGRWWILMITVFSVHSLWIGF

SEQ ID NO: 189438 - protein, 74 aa, Glycine max
  Coding DNA Sequence Number=SeqID_72660
  Subcellular localization annotation: CTP_CleavageSite=53; ConfidenceScore=5.32e-01
MADWPSFRTKPPSLKFSPKESNKVASKDKHGFKINTRLLQQTKPCFKINSRSSLALKRSVFKTCKALVIDYQAV

SEQ ID NO: 189439 - protein, 168 aa, Glycine max
  Coding DNA Sequence Number=SeqID_72661
MVRLTRERKYQSIYGQEICLKEIGIEEVVDQQVPEPTVVFPSGLKDLSLLTSYADHGAWEVWGGMERGDIKLVSHGRKLQSNIVLHDQILDVRDGTKKETFHLPVREMSITLDDVASLLDIPITDAFYDFEHMDKEAANPLLVDLLVVEYKEAFNETKITRGGLVHLS

SEQ ID NO: 189440 - protein, 69 aa, Glycine max
  Coding DNA Sequence Number=SeqID_72662
MGCCVRHHHDGGEELHVQSLEGGDRAHHGGDEIEWWRNLEVVSGDNGYMTVVRGWVVMFLVLSGDWVRR

SEQ ID NO: 189441 - protein, 111 aa, Glycine max
  Coding DNA Sequence Number=SeqID_72663
MRGRVFLEIENVGGVNSDEVGTNSNFQTTIVAQASQRIQADTSPNPLQASNSSLVSGDINKHLPTLFVLDASNFSLFSASFSGHKGKAQASLNDNKKVARHVVGPTRDFTQ

SEQ ID NO: 189442 - protein, 139 aa, Glycine max
  Coding DNA Sequence Number=SeqID_72664
  Gene Ontology: Mol. function=transferase activity
  Homolog annotation: Hit_ID=O82193; Match level="QueryCoverage=99%, HitCoverage=26%, E-value=1e-51, Identity=71%"; Hit description =Expressed protein
MVWLLATCTLISLFSMWNLTRIEVLLCNILSPEAPRLSLTSYNWFKVFIAMLVGNFLYPISAVRSHFTQSINWSGIIYHLKDGKINKIDRIPKRQDVAPVFTDLGGKHLYGKKGMPTKVSFLSSMNKRLFQWRQPKKFE

SEQ ID NO: 189443 - protein, 334 aa, Glycine max
  Coding DNA Sequence Number=SeqID_72665
  Gene Ontology: Mol. function=transferase activity
  Homolog annotation: Hit_ID=Q946Y1; Match level="QueryCoverage=97%, HitCoverage=61%, E-value=1e-152, Identity=77%"; Hit description =Ceramide glucosyltransferase
  Pfam annotation: Domain name=Glycos_transf_2; Domain location=29-195; Score=8.4; E_value=0.00028; Accession=PF00535.16; Description =Glycosyl transferase
MRNGNNYAFLCQDINELEHSNQAGLPKVTVIMPLKGFGEHNLHNWKTQLTSLYGGPQEYLLVVESTEDPAYNAVAKLIEELEDSVKARVIVAGLSTTCSQKIHNQLVGVETMHKDSKYVLFLDDDVRLHPGSIGALVREMEKNPEIFIQTGYPLDLPSGSLGSYCIYEYHMPCSMGFATGGQTFFLWGGCMMAIFLQMHSEDFRQDNCGIVSALRDGGYSDDMTLAAIAGAHKKLISSPAVAVYPHPLASDLNFGRYWNYLRKQTFVLESYVTKVNQVMNRALFAVHCYLSWGFVAPYCMAVIHVAAALRFRAREYSLEGINYTSGGENTTFPS

SEQ ID NO: 189444 - protein, 114 aa, Glycine max
  Coding DNA Sequence Number=SeqID_72666
  Gene Ontology: Mol. function=transition metal ion binding
  Homolog annotation: Hit_ID=O22704; Match level="QueryCoverage=69%, HitCoverage=46%, E-value=2e-15, Identity=82%"; Hit description =Putative Cytochrome B5
MEITSTRKLKFSNHTSLEHYNPGATDLAIAPNLQCRSLQSCQRLELHAEVNSDKNLQYSVEISNQQWAKGTNEYPKNPSVESSPACARMASPPGCSSTYEVTSYTYSGMKPQEM

SEQ ID NO: 189445 - protein, 172 aa, Glycine max
  Coding DNA Sequence Number=SeqID_72667
MKLMITRELDTTTLNPIRVMQDPYPGVTQIHTCIFVPLAPTIVREGILDQQIWFDGGVVNGGGGGWVWLCGGWWWFYVVNLDCSMARPWEQTILPSDMAAMRITCISLGTWNKILDVGCGHTTNENYSHIIQCTSTDSMSLALESRNGVVGSCDLTGLWVFKSHDGNVVKEN

SEQ ID NO: 189446 - protein, 48 aa, Glycine max
  Coding DNA Sequence Number=SeqID_72668
MLTELGHTVHTSLCVKAYLTRLMFRLGVMRSGLHSLSTSWFLFINWED

SEQ ID NO: 189447 - protein, 76 aa, Glycine max
  Coding DNA Sequence Number=SeqID_72669
MAAIDDSNPFILHSYDNLGIALVSHPFIVFSVDVVLWMNWSGAVAVLVYATALWYLFERVGYNFLSFVTKVFANKL

SEQ ID NO: 189448 - protein, 1011 aa, Glycine max
  Coding DNA Sequence Number=SeqID_72670
  Gene Ontology: Mol. function=protein serine/threonine kinase activity; Cellular component=integral to membrane; Biological process=protein amino acid phosphorylation
  Homolog annotation: Hit_ID=Q1SND5; Match level="QueryCoverage=99%, HitCoverage=99%, E-value=0.0, Identity=62%"; Hit description=Protein kinase
  Pfam annotation: Domain name=LRRNT_2; Domain location=27-67; Score =30.2; E_value=7e-06; Accession=PF08263.3; Description=Leucine rich repeat N-terminal domain
  Pfam annotation: Domain name=LRR_1; Domain location=119-141; Score =11.4; E_value=2.1; Accession=PF00560.23; Description=Leucine Rich Repeat
  Pfam annotation: Domain name=LRR_1; Domain location=143-165; Score =15.4; E_value=0.2; Accession=PF00560.23; Description=Leucine Rich Repeat
  Pfam annotation: Domain name=LRR_1; Domain location=167-190; Score =7.4; E_value=12; Accession=PF00560.23; Description=Leucine Rich Repeat
  Pfam annotation: Domain name=LRR_1; Domain location=192-216; Score =5.2; E_value=30; Accession=PF00560.23; Description=Leucine Rich Repeat
  Pfam annotation: Domain name=LRR_1; Domain location=218-240; Score =2.6; E_value=93; Accession=PF00560.23; Description=Leucine Rich Repeat
  Pfam annotation: Domain name=LRR_1; Domain location=242-264; Score =14.4; E_value=0.4; Accession=PF00560.23; Description=Leucine Rich Repeat
  Pfam annotation: Domain name=LRR_1; Domain location=266-288; Score =9.3; E_value=5.3; Accession=PF00560.23; Description=Leucine Rich Repeat
  Pfam annotation: Domain name=LRR_1; Domain location=289-311; Score =18.8; E_value=0.02; Accession=PF00560.23; Description=Leucine Rich Repeat
  Pfam annotation: Domain name=LRR_1; Domain location=313-335; Score =11.1; E_value=2.4; Accession=PF00560.23; Description=Leucine Rich Repeat
  Pfam annotation: Domain name=LRR_1; Domain location=337-359; Score =4.7; E_value=37; Accession=PF00560.23; Description=Leucine Rich Repeat
  Pfam annotation: Domain name=LRR_1; Domain location=361-380; Score =6.3; E_value=19; Accession=PF00560.23; Description=Leucine Rich Repeat
  Pfam annotation: Domain name=LRR_1; Domain location=409-431; Score =11.7; E_value=1.8; Accession=PF00560.23; Description=Leucine Rich Repeat
  Pfam annotation: Domain name=LRR_1; Domain location=432-451; Score =6.8; E_value=16; Accession=PF00560.23; Description=Leucine Rich Repeat
  Pfam annotation: Domain name=LRR_1; Domain location=454-476; Score =7.6; E_value=11; Accession=PF00560.23; Description=Leucine Rich Repeat
  Pfam annotation: Domain name=LRR_1; Domain location=478-500; Score =6.9; E_value=15; Accession=PF00560.23; Description=Leucine Rich Repeat
  Pfam annotation: Domain name=LRR_1; Domain location=502-524; Score =12.6; E_value=1.2; Accession=PF00560.23; Description=Leucine Rich Repeat
  Pfam annotation: Domain name=LRR_1; Domain location=526-548; Score =16.8; E_value=0.078; Accession=PF00560.23; Description=Leucine Rich Repeat
  Pfam annotation: Domain name=LRR_1; Domain location=550-569; Score =9.3; E_value=5.2; Accession=PF00560.23; Description=Leucine Rich Repeat
  Pfam annotation: Domain name=LRR_1; Domain location=571-593; Score =16.3; E_value=0.11; Accession=PF00560.23; Description=Leucine Rich Repeat
  Pfam annotation: Domain name=LRR_1; Domain location=71-93; Score=1.8; E_value=1.3e+02; Accession=PF00560.23; Description=Leucine Rich Repeat
  Pfam annotation: Domain name=LRR_1; Domain location=95-117; Score =2.6; E_value=93; Accession=PF00560.23; Description=Leucine Rich Repeat
  Pfam annotation: Domain name=Pkinase; Domain location=687-969; Score =148.6; E_value=1.6e-41; Accession=PF00069.15; Description=Protein kinase domain
  Pfam annotation: Domain name=Pkinase_Tyr; Domain location=687-969; Score=85.9; E_value=1.2e-22; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=27-67::119-141::143-165::167-190::192-216::218-240::242 -264::266-288::289-311::313-335::337-359::361-380::409-431::432 -451::454-476::478-500::...
  Pfam module annotation: Domain location=502-524::526-548::550 -569::571-593::71-93::95-117::687-969::687-969
MTVPFYYCYYLSIFLILSHVHSQTQLQDQEHAVLMNIKRHLKNPSFLSHWTTSNTASHCTWPEITCTSDYSVTGLTLVNSNITQTLPPFMCDLKNLTLVNFSRNFIPGEFPTFLYKCSKLVYLDLEMNDFSGTIPDDIDNLVNLQHLNLGSTSFSGDIPASIGRLKELKMLQLHYCLFNGTFPYESIANLFDLEFLDMSSNLVLPPSKLSSSLTRLKKLKFFHMYSSNLFGEIPETIGEMVALENLDLSRSNLTGHIPRGLFMLKNLSTLYLFQNKLSGEIPGVVEASNLTEIDLAENNLEGKIPHDFGKLQKLTLLSLSLNNLSGEIPQSVGRIPSLIYFQVMFNNLSGILPPDFGLYSELKTFLVANNSFTGRLPENLCYHGQLLNLTTYDNYLSGELPESIGHCSSLKDLKIYSNEFSGSIPSGLWTFNLSNFMVSYNKFTGELPERLSPSISRLEISHNRFFGRIPTGVSSWTNVVVFKASENNLNGSVPKGLTSLPKLTTLLLDHNQLTGPLPSDIISWQSLVTLNLSQNKLSGHIPDSIGLLPVLSVLDLSENQFSGEVPSKLPRITNLNLSSNYLTGRVPSEFDNLAYDTSFLDNSGLCANTPALKLRPCNVGFERPSKGSSWSLALIMCLVAIALLLVLSISLLIIKLHRRRKRGFDNSWKLISFQRLSFTESSIVSSMSEHNVIGSGGFGTVYRVPVDALGYVAVKKISSNRKLDHKLESSFRAEVKILSNIRHKNIVKLLCCISNEDSMLLVYEYLENCSLDRWLHNKSKSPPAVSGSAHHFELDWQKRLQIATGVAHGLCYMHHDCSPPIVHRDIKTSNILLDAQFNAKVADFGLARMLMKPGELATMSSVIGSFGYMAPEYVQTTRVSEKIDVFSFGVILLELTTGKEANYGDEHSSLAEWAWRQIIVGSNIEELLDIDFMDPSYKNEMCSVFKLGVLCTSTLPAKRPSMKEVLHILLRCGEGFAFGEGNVRQYDGVPLLKNSKWESSLDAVDNDSDSD

SEQ ID NO: 189449 - protein, 76 aa, Glycine max
  Coding DNA Sequence Number=SeqID_72671
MTSMAMREKKKESTRHSKELNHPHEPPDVGLATRPLESGLDATKRRLTALSTPSSRTTNNFNRKQETRKQKLLIPY

SEQ ID NO: 189450 - protein, 59 aa, Glycine max
  Coding DNA Sequence Number=SeqID_72672
MVERVLGQGQAKYLRRCNTYCLAVDKDLRLERGMLGNMMVIPLRIQNGSSLDAVDNDSE

SEQ ID NO: 189451 - protein, 1013 aa, Glycine max
  Coding DNA Sequence Number=SeqID_72673
  Gene Ontology: Mol. function=protein serine/threonine kinase activity; Cellular component=integral to membrane; Biological process=protein amino acid phosphorylation
  Homolog annotation: Hit_ID=Q1SND5; Match level="QueryCoverage=97%, HitCoverage=97%, E-value=0.0, Identity=64%"; Hit description=Protein kinase
  Pfam annotation: Domain name=LRRNT_2; Domain location=35-75; Score =35.8; E_value=1.5e-07; Accession=PF08263.3; Description=Leucine rich repeat N-terminal domain
  Pfam annotation: Domain name=LRR_1; Domain location=102-124; Score =5.8; E_value=23; Accession=PF00560.23; Description=Leucine Rich Repeat
  Pfam annotation: Domain name=LRR_1; Domain location=126-148; Score =20.6; E_value=0.0057; Accession=PF00560.23; Description=Leucine Rich Repeat
  Pfam annotation: Domain name=LRR_1; Domain location=151-173; Score =13.8; E_value=0.65; Accession=PF00560.23; Description=Leucine Rich Repeat
  Pfam annotation: Domain name=LRR_1; Domain location=175-197; Score =12.6; E_value=1.3; Accession=PF00560.23; Description=Leucine Rich Repeat
  Pfam annotation: Domain name=LRR_1; Domain location=199-223; Score =8.3; E_value=8.1; Accession=PF00560.23; Description=Leucine Rich Repeat
  Pfam annotation: Domain name=LRR_1; Domain location=225-247; Score =3.1; E_value=75; Accession=PF00560.23; Description=Leucine Rich Repeat
  Pfam annotation: Domain name=LRR_1; Domain location=249-271; Score =17.0; E_value=0.069; Accession=PF00560.23; Description=Leucine Rich Repeat
  Pfam annotation: Domain name=LRR_1; Domain location=273-295; Score =11.3; E_value=2.2; Accession=PF00560.23; Description=Leucine Rich Repeat
  Pfam annotation: Domain name=LRR_1; Domain location=296-318; Score =16.4; E_value=0.1; Accession=PF00560.23; Description=Leucine Rich Repeat
  Pfam annotation: Domain name=LRR_1; Domain location=320-342; Score =5.7; E_value=25; Accession=PF00560.23; Description=Leucine Rich Repeat
  Pfam annotation: Domain name=LRR_1; Domain location=344-366; Score =3.9; E_value=54; Accession=PF00560.23; Description=Leucine Rich Repeat
  Pfam annotation: Domain name=LRR_1; Domain location=368-387; Score =4.0; E_value=52; Accession=PF00560.23; Description=Leucine Rich Repeat
  Pfam annotation: Domain name=LRR_1; Domain location=392-414; Score =5.4; E_value=28; Accession=PF00560.23; Description=Leucine Rich Repeat
  Pfam annotation: Domain name=LRR_1; Domain location=416-438; Score =11.2; E_value=2.3; Accession=PF00560.23; Description=Leucine Rich Repeat
  Pfam annotation: Domain name=LRR_1; Domain location=439-458; Score =5.9; E_value=22; Accession=PF00560.23; Description=Leucine Rich Repeat
  Pfam annotation: Domain name=LRR_1; Domain location=461-483; Score =7.6; E_value=11; Accession=PF00560.23; Description=Leucine Rich Repeat
  Pfam annotation: Domain name=LRR_1; Domain location=485-507; Score =6.7; E_value=16; Accession=PF00560.23; Description=Leucine Rich Repeat
  Pfam annotation: Domain name=LRR_1; Domain location=509-531; Score =12.6; E_value=1.2; Accession=PF00560.23; Description=Leucine Rich Repeat
  Pfam annotation: Domain name=LRR_1; Domain location=533-555; Score =16.8; E_value=0.078; Accession=PF00560.23; Description=Leucine Rich Repeat
  Pfam annotation: Domain name=LRR_1; Domain location=557-576; Score =5.3; E_value=29; Accession=PF00560.23; Description=Leucine Rich Repeat
  Pfam annotation: Domain name=LRR_1; Domain location=578-600; Score =15.9; E_value=0.15; Accession=PF00560.23; Description=Leucine Rich Repeat
  Pfam annotation: Domain name=LRR_1; Domain location=78-100; Score =4.4; E_value=42; Accession=PF00560.23; Description=Leucine Rich Repeat
  Pfam annotation: Domain name=Pkinase; Domain location=694-975; Score =164.5; E_value=2.7e-46; Accession=PF00069.15; Description=Protein kinase domain
  Pfam annotation: Domain name=Pkinase_Tyr; Domain location=694-975; Score=88.2; E_value=2.5e-23; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=35-75::102-124::126-148::151-173::175-197::199-223::225 -247::249-271::273-295::296-318::320-342::344-366::368-387::392 -414::416-438::439-458::...
  Pfam module annotation: Domain location=461-483::485-507::509 -531::533-555::557-576::578-600::78-100::694-975::694-975
MELFTPPCLKLLFHSLVILFLLFNHANTQSQSQLHDQERATLLKIKEYLENPEFLSHWTTSSSSSHCSWQEIKCSNGSVTGLTLSNSSITQTIPSFVCDLKNLTIVDFYNNLIPGEFPTSLYNCSKLEYLDLSQNNFVGSIPHDIGNLSNYLKYLNLGYTNFSGDIPASIGRLKELRNLQLQNNLLNGTFPAEIGNLSNLDTLDLSSNNMLPPSKLHGDWTRLNKLKVFFMFQSNLVGEIPQTIGNMVALERLDLSQNNLSGPIPSGLFMLENLSIMFLSRNNLSGEIPDVVEALNLTIIDLTRNVISGKIPDGFGKLQKLTGLALSMNNLQGEIPASIGLLPSLVDFKVFFNNLSGILPPDFGRYSKLETFLVANNSFRGNLPENLCYNGHLLNISAYINYLSGELPQSLGNCSSLMELKIYSNEFSGSIPSGLWTLSLSNFMVSYNKFTGELPERLSPSISRLEISHNRFFGRIPTDVSSWTNVVVFIASENNLNGSVPKGLTSLPKLTTLLLDHNQLTGPLPSDIISWQSLVTLNLSQNKLSGHIPDSIGLLPVLGVLDLSENQFSGEVPSKLPRITNLNLSSNYLTGRVPSQFENLAYNTSFLDNSGLCADTPALNLRLCNSSPQRQSKDSSLSLALIISLVAVACFLALLTSLLIIRFYRKRKQGLDRSWKLISFQRLSFTESNIVSSLTENSIIGSGGYGTVYRVAVDGLGYVAVKKIWEHKKLDKNLESSFHTEVKILSNIRHKNIVKLMCCISNEDSMLLVYEYVENHSLDRWLHRKNKSSTVSGSVHHIVLDWPKRLHIAIGAAQGLSYMHHDCSPPIVHRDVKTSNILLDSQFNAKVADFGLARMLMKPGELATMSSVIGSFGYMAPEYVQTTRVSEKIDVFSFGVMLLELTTGKEANYGDEHSSLAEWAWRHQQLGSNIEELLDKDVMETSYLDGMCKVFKLGIMCTATLPSSRPSMKEVLRVLLSCEDSFSKGESIIGHYDDVPLLKNSKREHKLDIDNDS

SEQ ID NO: 189452 - protein, 133 aa, Glycine max
  Coding DNA Sequence Number=SeqID_72674
MCVSRLRMLALKGHGSGVANVLLGHMYNIGWCIVGRQAIWWKKVLALDLHKMGTTRTSQCLPSLTYHIRNWTTYLIHTRWVGQIYLSGGTCSGNRNSFGHLVFHGLHVGHHMFLNFLYLAHDSSLGTCSVRVS

SEQ ID NO: 189453 - protein, 565 aa, Glycine max
  Coding DNA Sequence Number=SeqID_72675
  Gene Ontology: Mol. function=protein serine/threonine kinase activity; Cellular component=integral to membrane; Biological process=protein amino acid phosphorylation
  Homolog annotation: Hit_ID=Q1SND5; Match level="QueryCoverage=99%, HitCoverage=61%, E-value=1e-139, Identity=45%"; Hit description =Protein kinase
  Pfam annotation: Domain name=LRR_1; Domain location=117-139; Score =4.8; E_value=37; Accession=PF00560.23; Description=Leucine Rich Repeat
  Pfam annotation: Domain name=LRR_1; Domain location=141-163; Score =15.4; E_value=0.21; Accession=PF00560.23; Description=Leucine Rich Repeat
  Pfam annotation: Domain name=LRR_1; Domain location=165-187; Score =12.4; E_value=1.4; Accession=PF00560.23; Description=Leucine Rich Repeat
  Pfam annotation: Domain name=LRR_1; Domain location=188-210; Score =19.7; E_value=0.011; Accession=PF00560.23; Description=Leucine Rich Repeat
  Pfam annotation: Domain name=LRR_1; Domain location=19-41; Score =18.5; E_value=0.025; Accession=PF00560.23; Description=Leucine Rich Repeat
  Pfam annotation: Domain name=LRR_1; Domain location=212-234; Score =14.0; E_value=0.53; Accession=PF00560.23; Description=Leucine Rich Repeat
  Pfam annotation: Domain name=LRR_1; Domain location=236-255; Score =0.1; E_value=2.7e+02; Accession=PF00560.23; Description=Leucine Rich Repeat
  Pfam annotation: Domain name=LRR_1; Domain location=260-282; Score =8.4; E_value=7.7; Accession=PF00560.23; Description=Leucine Rich Repeat
  Pfam annotation: Domain name=LRR_1; Domain location=284-307; Score =11.4; E_value=2.1; Accession=PF00560.23; Description=Leucine Rich Repeat
  Pfam annotation: Domain name=LRR_1; Domain location=308-327; Score =6.2; E_value=19; Accession=PF00560.23; Description=Leucine Rich Repeat
  Pfam annotation: Domain name=LRR_1; Domain location=351-373; Score =13.2; E_value=0.93; Accession=PF00560.23; Description=Leucine Rich Repeat
  Pfam annotation: Domain name=LRR_1; Domain location=375-397; Score =16.4; E_value=0.1; Accession=PF00560.23; Description=Leucine Rich Repeat
  Pfam annotation: Domain name=LRR_1; Domain location=399-418; Score =10.4; E_value=3.3; Accession=PF00560.23; Description=Leucine Rich Repeat
  Pfam annotation: Domain name=LRR_1; Domain location=422-444; Score =17.5; E_value=0.049; Accession=PF00560.23; Description=Leucine Rich Repeat
  Pfam annotation: Domain name=LRR_1; Domain location=43-65; Score =17.3; E_value=0.054; Accession=PF00560.23; Description=Leucine Rich Repeat
  Pfam annotation: Domain name=LRR_1; Domain location=67-89; Score=9.4; E_value=4.9; Accession=PF00560.23; Description=Leucine Rich Repeat
  Pfam annotation: Domain name=LRR_1; Domain location=91-115; Score =7.2; E_value=13; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1; Domain location=117-139::141-163::165- 187::188-210::19-41:...
  Pfam module annotation: Domain location=:212-234::236-255::260 -282::284-307::308-327::351-373::375-397::399-418::422-444::43-65::67- 89::91-115
FSGILIPGEFLKSLYKCSKLEYLDLSQNYFVGKIPDDIDNLANLSFLSLSGNNFSGDIPTSIGRLKELRNLQLYQCLLNGTFPAEIGNLSNLESLYVFSNHMLPPTKLPSSLTQLNKLKVFHMYESNLVGEIPETIGHMVALEKLDLSKNGLSGQIPNGLFMLKNLSILYLYRNSLSGEIPRVVEAFNLTELDLSENILSGKIPDDLGRLNNLKYLNLYSNQLFGNVPESIARLPALTDFVVFLNNLSGRLPENLCYHGSLVGLTAYDNNLSGKLPESLGSCSSLNILRVENNNLSGNVPSGLWTSMNLERFMINENKFTGQLPERLSWNVSVINNLFNGSIPLELTSLLHLTTLLLDHNQLTGSLPSDIISWKSLITLDLSHNQLSGVLPDVIAQLPGLNILDLSENKISGQIPLQLALKRLTNLNLSSNLLTGRIPSELENLAYARSFLNNSGLCADSKVLNLTLCNSKPQRARIERRSASYAIIISLVVGASLLALLSSFLMIRVYRKRKQEMKRSWKLTSFQRLSFTKTNIASSMSEHNIIGSGGYGAVYRVVVDDLHYVA

SEQ ID NO: 189454 - protein, 65 aa, Glycine max
  Coding DNA Sequence Number=SeqID_72676
ISLNMYASGDYDIYGFLEPQSIQRSGQSQFESESYIKSWMQSSQRDVYLGAYLNGTDNYLKGIIN

SEQ ID NO: 189455 - protein, 85 aa, Glycine max
  Coding DNA Sequence Number=SeqID_72677
  Homolog annotation: Hit_ID=Q09WE7; Match level="QueryCoverage=50%, HitCoverage=7%, E-value=3e-07, Identity=65%"; Hit description=UDP -sugar pyrophosphorylase
MTLESRTMYNLATSVAHVPKGNPYHNATSREMVIYRANNIILRKEMMQSYPPRTLDRRLQEDWAKDAREGTRVLMSLRVDFRPMG

SEQ ID NO: 189456 - protein, 351 aa, Glycine max
  Coding DNA Sequence Number=SeqID_72678
  Gene Ontology: Mol. function=structural constituent of ribosome; Cellular component=intracellular; Biological process=embryonic development ending in seed dormancy
  Homolog annotation: Hit_ID=Q2HTU1; Match level="QueryCoverage=65%, HitCoverage=76%, E-value=2e-40, Identity=34%"; Hit description =Tetratricopeptide-like helical
  Pfam annotation: Domain name=PPR; Domain location=107-141; Score =23.3; E_value=0.00084; Accession=PF01535.11; Description=PPR repeat
  Pfam annotation: Domain name=PPR; Domain location=142-176; Score =48.5; E_value=2.3e-11; Accession=PF01535.11; Description=PPR repeat
  Pfam annotation: Domain name=PPR; Domain location=221-255; Score =14.1; E_value=0.16; Accession=PF01535.11; Description=PPR repeat
  Pfam annotation: Domain name=PPR; Domain location=256-289; Score=2.9; E_value=3.4; Accession=PF01535.11; Description=PPR repeat
  Pfam module annotation: Pfam domain module=PPR::PPR::PPR::PPR; Domain location=107-141::142-176::221-255::256-289
MELVEPTVQEINWERRALFSWEEEQLAQLESKIAHYNLQHQLDNEIGYSFSLPDVLLQFYKLFATMVKGKKSTKSKHLLWHCACCNLWKMRNEAYDGQKLLQHSKIIWLGLMMDGLCRNHMLSDARGLMDLMMRNGVYPDTIAYSTLLHGYCSRGKVFEAKSVLHEMIRNGCQPNTYTCNTLLQEMVVIFAVITILSLASVKEERQRMPFPFYMKCWIKNFMYKDLIARLCQDERFADANSLLYKLIDKGYGFDHASFMPMIDGLSKRGNKRQVDELAKRMMKLELEDRLVDRTYSNRKRVILGKLHKDGGSDWQDIINSTIDFPEMTAGALFETPISAGSTMAKITPNGI

SEQ ID NO: 189457 - protein, 138 aa, Glycine max
  Coding DNA Sequence Number=SeqID_72679
  Homolog annotation: Hit_ID=Q6CQF3; Match level="QueryCoverage=40%, HitCoverage=59%, E-value=2e-08, Identity=72%"; Hit description =Kluyveromyces lactis strain NRRL Y-1140 chromosome D of strain NRRL Y- 1140 of Kluyveromyces lactis
LVPSEVSLRIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRVKIPEPGRGG

SEQ ID NO: 189458 - protein, 157 aa, Glycine max
  Coding DNA Sequence Number=SeqID_72680
  Gene Ontology: Mol. function=nucleic acid binding; Cellular component= intracellular
RNLEVQEATAVFALLLRSLQEFVSEDSNDNKREIQQLNEVQTEAMDADSEYRENSDSSFVWDENSQLYFHASSGFYHDPNAGWYYSSKDGCKFEDGNYVLLGSNKDDNVETYPCDETTTENPQQIYDGNNDEDHPSFLESKYETHQQAGTLVDEAPA

SEQ ID NO: 189459 - protein, 158 aa, Glycine max
  Coding DNA Sequence Number=SeqID_72681
  Homolog annotation: Hit_ID=Q47522; Match level="QueryCoverage=40%, HitCoverage=86%, E-value=2e-22, Identity=74%"; Hit description=LacZ protein
VPPVQLLTGWCVTAKAPPDISAGKCSGHAARRVPFAIQAAQLLGRAIGAGLFAITPAGERGMCCKAIKLGNARVFPVTTLMNDIVIGDSKRAKSGRGSKFAPIAIPMYEWASAEVNSYPSWLQTLVSIEGLKGRVDITTLGDSKLLIVEPYSVEKRVS

SEQ ID NO: 189460 - protein, 73 aa, Glycine max
  Coding DNA Sequence Number=SeqID_72682
  Homolog annotation: Hit_ID=Q6Q2Z9; Match level="QueryCoverage=68%, HitCoverage=5%, E-value=3e-12, Identity=71%"; Hit description =Phosphoenolpyruvate carboxylase
MIDLILALKIEICGLKIWWERKLQYGRQMNLGVQNPLQLMKLGQLFLRMVYGHFDQVFKSFVLVIPKGTYMNT

SEQ ID NO: 189461 - protein, 224 aa, Glycine max
  Coding DNA Sequence Number=SeqID_72683
  Gene Ontology: Mol. function=protein transporter activity; Cellular component=mitochondrial inner membrane; Biological process=protein transport
  Homolog annotation: Hit_ID=Q41050; Match level="QueryCoverage=55%, HitCoverage=87%, E-value=1e-46, Identity=72%"; Hit description=Core protein
  Pfam annotation: Domain name=Tim17; Domain location=15-143; Score =107.8; E_value=3.1e-29; Accession=PF02466.9; Description =Tim17Tim22Tim23 family
MPSARLSGSPRLDVAIDMGNPFLNLTVDGFLKIGAVAATRSAAEDTYHIIRNGNISSHDFEKTLKKMCKEGVYWGTLAGVYLGMEYGVERIRGTRDWKNAMIGGAVTATLLSVATTNNKDKIVPDAITGAAIATAADLRSVIASIIFPSPSKTSCPQGVSCRKIEPRSKIRMGVGMSECILVAQRQNYGRDGNVGGQCETPPTKSLVPQLVSSTEGAPPFLFWP

SEQ ID NO: 189462 - protein, 160 aa, Glycine max
  Coding DNA Sequence Number=SeqID_72684
  Subcellular localization annotation: CTP_CleavageSite=52; ConfidenceScore=5.71e-01
MTKEVIHGHNFVAPQLHFSSSPSSSTFFSLVLGSSPFFLFPCMAIYRKQPLSAGKGNSPKLAACLGLCWISPIVTFWEKEESKEFSDCVVLNSLTREKGDTKEFRRLVLGEFFLAKGEEMKRMNNTSFQGLENQKTLESFWYKEEEEVSKRFKACKGLYE

SEQ ID NO: 189463 - protein, 159 aa, Glycine max
  Coding DNA Sequence Number=SeqID_72685
MGGVTKVLPYCLRKWALTANQDGVDDTVCEKYDISKEKGAQFCQTCRDPSWEMCGKRQRSSRSRTLPPHVLSRGGYEYLEHKLLAEKTRKKLEEAAQSGSVDGVIDPPSPVRRHVKWKMARTKKIGEMTTEAAKEIAEKIASHFQLTIRIIFLYFVNAM

SEQ ID NO: 189464 - protein, 315 aa, Glycine max
  Coding DNA Sequence Number=SeqID_72686
MQSQGLTLPPELEVGHSAARVSTKESCVDNSGNDPDTGDSEKCGLYVEENPPHLVSLRRLYEGSTTVHNIPLRHDQVIPFMYPLKRFSALNTFVAWPTHLVKHLSEHGAMGLVKPADRPNHDVDDPLYLITLTIQQLFLNSLQVMRDLTVFGVFNDNFPLHMIETSMRAGDADVYGFLEPQSIQRSGQSQFESKSYIKKWMQNSKRDVYLGAYLNGPDNYLKGIINRSVLFFNTFALALVGNIDISIVQYASMFVLKSTLKGFNDTPQSKSKVAARWIVVKYFNDARPLEPKRLKALHIQWATYYLKVKNETISV

SEQ ID NO: 189465 - protein, 166 aa, Glycine max
  Coding DNA Sequence Number=SeqID_72687
  Homolog annotation: Hit_ID=Q9LJA5; Match level="QueryCoverage=49%, HitCoverage=27%, E-value=5e-07, Identity=36%"; Hit description =Arabidopsis thaliana genomic DNA, chromosome 3, P1 clone: MTO24
LLETEKLPSCGQLYIETHKRKDESFVNEAAKTIAEQIEVGLTQSIVEEYEVSPLDVVGRVLGLEHSGRVRCMGLGAVPSNTFRNTRLRAFSLSSSSSGVAFPSSNQWQEKYNNLESAFKAYMIMKEGRIPEELASYFTPDQTHPNDASSVPNTPLDARGSSGASNP

SEQ ID NO: 189466 - protein, 360 aa, Glycine max
  Coding DNA Sequence Number=SeqID_72688
  Homolog annotation: Hit_ID=Q1T1Y0; Match level="QueryCoverage=45%, HitCoverage=47%, E-value=1e-13, Identity=32%"; Hit description =Ankyrin
  Pfam annotation: Domain name=DUF1723; Domain location=51-100; Score =30.6; E_value=5.5e-06; Accession=PF08330.1; Description=Protein of unknown function (DUF1723)
MCWVCLDTSGGARAGAYKPRWLGATAPYSSPGEGLCESVMVNSPCYNTISCWDNNLVNVFLERWHQETSFFHLPIEEITITLDDVSCLLHLLVVGRPKDHVPSLFDREAVKILLMSHMDILTKTKASVVANASARMRLKWLEHLYHHYVESNSYTSGVAALMLYGHLSCASQYSSKQCGGYMKLLLSWVFAHLLTVGYSEAEDYVVNNLSIFSGFIRCETDVRLYRSERSNNNISFILVMLCHLVAQPPRGPVRLLPVKVQPLAGYVLGGDYSCKAWNSNKSFWSIGNENKNSNWSFGGPRNKDSNWGKKSNWNYGSSDANQSTIWRRNSSWNIANASSDEGSNENSIGVGGGNSQWLPK

SEQ ID NO: 189467 - protein, 244 aa, Glycine max
  Coding DNA Sequence Number=SeqID_72689
MQLKGVPQGFSSLVIDYTTLVIDYQRPNSSYTASEHGNLGHINFLTPFLSLVIDYTPFVIDYQRPYFNYHSRSIAGQPPRKPPCFVVFVLLSVDYQELACLAWFWAIAPHLTSPRSPDPCDISPGGDRVMLQVDSPHPQITHKPTIFSCPPSTELTYSHVALILVPLKTGSPSISPSFHNIQAIQHTNIINYPKPRKQGRGRKLCPKHNQYHGFPYSNTPVTFSSFQFVHRWIDSKILLEFPST

SEQ ID NO: 189468 - protein, 108 aa, Glycine max
  Coding DNA Sequence Number=SeqID_72690
MRYFSKLNNPGVGERQGVILLCVPKKLLDKRLKGKERTEYTTLWFLRSSHPELCLELDRKHPLGTKFFPAIEIFWDDGVKGAPWSKIVSDNDKMVSDRITQEKNNLVW

SEQ ID NO: 189469 - protein, 78 aa, Glycine max
  Coding DNA Sequence Number=SeqID_72691
MKRKGANKQNMVSREEDEAKLMISKVKPPKFHLRSSKRLHFLNAGRFTKEHWQDSYFEIQKPLPCKNGCTYHCASTAI

SEQ ID NO: 189470 - protein, 97 aa, Glycine max
  Coding DNA Sequence Number=SeqID_72692
MSDHESSTYSKDLVLSFPLLKVFEAKGCEWSTKQNLCIQAPLLESPQNLTQKNDHLGLIHRWIVVKFEYHVRNPISSILTIGNRKIMSELRGKSFAL

SEQ ID NO: 189471 - protein, 371 aa, Glycine max
  Coding DNA Sequence Number=SeqID_72693
  Homolog annotation: Hit_ID=Q8L868; Match level="QueryCoverage=23%, HitCoverage=20%, E-value=2e-25, Identity=64%"; Hit description =Putative glucan endo-1,3-beta-glucosidase 11 precursor (EC 3.2.1.39) ((1->3)-beta-glucan ...
  Homolog annotation: Hit description=endohydrolase 11) ((1->3)-beta -glucanase 11)
LVSESSNYSEDLILNFPVLKVLEARGCEWLTKQNISIKAPQLERFSIAIWNSLSNESHKSAIKIFAPNLTDFSYEGDLEQHIILLNSASIRSASVVVVIDEDNKERMENLGFKVHNLLAQIREVERLKLLFYKVSVKVNKYTRSSAPTLSPSLLIFERGFVEVATDIGCERFSSEQQGLIIKWKKRGSISLIARCWKPFGHGDDADNATIVGRECKDDLLCQIESDGFGNFVDVYDGQGMVDPKQVPLDHVLFQPNKGMVDPSSNLHYDNMLFTQIDAVYSALDSLAYRKLPVHISETSSPSKGDLDETSVNLENAKNYNGNLIKISLSLPPFRHYLVVPVVHIPTVKYLQRKTDDYYLGKETDSCCHFGI

SEQ ID NO: 189472 - protein, 120 aa, Glycine max
  Coding DNA Sequence Number=SeqID_72694
MPNENTNHSTPVLLEGQQPQLGHAPFVQPMEEAHKELWDHALGEFEPYPTYVIEGPMFGGMPLPIVVGAIQPRPLQPLHFSGRRLPPAIEEREKFDLIVETMRAIGGSMIIHFSTWKSYA

SEQ ID NO: 189473 - protein, 129 aa, Glycine max
  Coding DNA Sequence Number=SeqID_72695
MGTTISHINDQTKLREVAQGTRTTTTTTTIRVLTEDCWSASKRNDNHGSGAKVDYKNNNRVKPKVERKVFGRAGLRRQHLMISFKKAHVMRIMKLAKYRLKAQVEKDEGPSGEGQSPRVEKDEGPSGEG

SEQ ID NO: 189474 - protein, 293 aa, Glycine max
  Coding DNA Sequence Number=SeqID_72696
  Gene Ontology: Mol. function=protein kinase activity; Cellular component=membrane; Biological process=protein amino acid phosphorylation
  Homolog annotation: Hit_ID=Q2QZ78; Match level="QueryCoverage=94%, HitCoverage=49%, E-value=1e-71, Identity=47%"; Hit description=AT hook motif-containing protein, putative
  Pfam annotation: Domain name=DUF889; Domain location=208-293; Score= -63.1; E_value=3.2e-07; Accession=PF05970.5; Description=Eukaryotic protein of unknown function (DUF889)
MNLVLLEVEQLLQANQRSLKDYPSMPYPENANLLTHADNGLILSELNFNNEELRSEFLNLFSQMTNQQAKIYNQIIQAVNKNEGGMFFLYGYGGTGKTFIWKTLAASLRADNKIVIMDASSGIVSLLLPGGRTTHSKLKIHVPIFEDSTCNIHQGTQLTELLNEASLIIWDEAPMAYKFCFEALDQSLRDVIKAKSSSDKIFGGKVMIFGGDFRQILPVIPRGSRSDIVNATINSSYLWNHCHVLALSKNMRLEANIDATDREETLAFAQWILNIGDGIVGQQNDGYGSIEIP

SEQ ID NO: 189475 - protein, 92 aa, Glycine max
  Coding DNA Sequence Number=SeqID_72697
  Subcellular localization annotation: CTP_CleavageSite=44; ConfidenceScore=5.10e-01
MSISSCESIGWSVSSRDRGRAHKTPSGPGKVQQGPGVSSSGIVPARHLVDPKKANRGVPAAPSKVIRPPTNRAFIKKYCAPRQAQGETPQQH

SEQ ID NO: 189476 - protein, 127 aa, Glycine max
  Coding DNA Sequence Number=SeqID_72698
MAKFDSEIVMEFYANAWPTEEGARDMRSWVRGQWIPFNTDAFNYQRRSQVFGFDEDAIAQLLCILGSQLAAWRRVRIMHTSMTIYQFAGTTPMRHPMDPERSNRNDRPLPILRSARRPQQGHSASYY

SEQ ID NO: 189477 - protein, 294 aa, Glycine max
  Coding DNA Sequence Number=SeqID_72699
  Subcellular localization annotation: CTP_CleavageSite=36; ConfidenceScore=5.43e-01
MAPPPPLPTLLLTTLLSLFSSSTSAPPTTTACRDTCGSTQVKYPFGTGHGCGSPLFSPYVTCGSNGTGDQLFLKSHTGSYPVSSISYTTSTITLSPPSMSTCSSMHPSSTNFGLDWTSPFQIASSTFLLLSCQPPTTSLSSPICDPSFDYLCASLYSCPAVVALGLPLFPPSNTCCVYSPANLDGKGELDLKAMKCGAYASVVSLGDNPTDPTHWVYGVALKYSFGGALDNNYGTTKCSGCESSGGVCGFAPPGNGFVCVCKGGYNTSLDCSTTFNQNQDYVWDSSSANHIFFT

SEQ ID NO: 189478 - protein, 350 aa, Glycine max
  Coding DNA Sequence Number=SeqID_72700
  Gene Ontology: Mol. function=hydrolase activity; Biological process =aromatic compound metabolic process
  Homolog annotation: Hit_ID=Q4PSG2; Match level="QueryCoverage=94%, HitCoverage=96%, E-value=1e-106, Identity=56%"; Hit description =Hydrolase
  Pfam annotation: Domain name=Abhydrolase_1; Domain location=78-330; Score=89.1; E_value=1.3e-23; Accession=PF00561.10; Description =alphabeta hydrolase fold
MAAGCISFTATRDRCFRFSFSNAGLKSVTTDLGDGTIMHCWAPKAHKDSKPNLLLIHGFGANAMWQWNDFLSPLTRRFNVYVPDLLFFGDSHTTRPDRSEAFQAQCVAALLQAHGLQRTSVVGISYGGFVAYSLAAQFPERVEKVVLCCAGVCLEDKDLDEGMFQVKTVDEAADILLPQTPEKLRQLVQLAFAKPVKTMPTCFLNDYINKGKKVRRTIIEIGTLGTGRASACDLNVSPRYSACLVMCTDNRQERKELIETLHKDRKLSNLPKITQPTLIIWGEKDLVFPMELAHRLQRHLGENAQLVVIKNAGHALNVEKPKEMYKNLKSFLIDPATPTPTAQKNHSNGS

SEQ ID NO: 189479 - protein, 585 aa, Glycine max
  Coding DNA Sequence Number=SeqID_72701
  Gene Ontology: Mol. function=protein serine/threonine kinase activity; Cellular component=integral to membrane; Biological process=protein amino acid phosphorylation
  Homolog annotation: Hit_ID=Q8RWK7; Match level="QueryCoverage=96%, HitCoverage=95%, E-value=0.0, Identity=71%"; Hit description=Protein serine/threonine kinase-like protein
  Pfam annotation: Domain name=LRRNT_2; Domain location=19-59; Score =44.8; E_value=3e-10; Accession=PF08263.3; Description=Leucine rich repeat N-terminal domain
  Pfam annotation: Domain name=LRR_1; Domain location=111-133; Score =18.2; E_value=0.03; Accession=PF00560.23; Description=Leucine Rich Repeat
  Pfam annotation: Domain name=LRR_1; Domain location=135-158; Score =9.0; E_value=5.8; Accession=PF00560.23; Description=Leucine Rich Repeat
  Pfam annotation: Domain name=LRR_1; Domain location=87-109; Score =16.0; E_value=0.14; Accession=PF00560.23; Description=Leucine Rich Repeat
  Pfam annotation: Domain name=Pkinase; Domain location=262-536; Score =132.4; E_value=1.3e-36; Accession=PF00069.15; Description=Protein kinase domain
  Pfam annotation: Domain name=Pkinase_Tyr; Domain location=262-536; Score=109.5; E_value=9.8e-30; Accession=PF07714.7; Description =Protein tyrosine kinase
  Pfam module annotation: Pfam domain module=LRRNT_2::LRR_1::LRR_1::LRR_ 1::Pkinase::Pkinase_Tyr; Domain location=19-59::111-133::135-158::87 -109::262-536::262-536
MDFIFVLLLLGCLCSFVLPDTQGDALFALKISLNASAHQLTDWNQNQVNPCTWSRVYCDSNNNVMQVSLAYMGFTGYLTPIIGVLKYLTALSLQGNGITGNIPKELGNLTSLSRLDLESNKLTGEIPSSLGNLKRLQFFLLDSNNLSGQIPEQLFKVPKYKYGCFTGNNLNCGASYHQPCETDNADQGSSHKPKTGLIVGIVIGLVVILFLGGLLFFWCKGRHKSYRREVFVDVAGEVDRRIAFGQLRRFAWRELQIATDNFSEKNVLGQGGFGKVYKGVLADNTKVAVKRLTDYESPGGDAAFQREVEMISVAVHRNLLRLIGFCTTPTERLLVYPFMQNLSVAYRLRELKPGEPVLDWPTRKRVALGTARGLEYLHEHCNPKIIHRDVKAANVLLDEDFEAVVGDFGLAKLVDVRKTNVTTQVRGTMGHIAPEYLSTGKSSERTDVFGYGIMLLELVTGQRAIDFSRLEEEDDVLLLDHVKKLEREKRLEAIVDRNLNKNYNIQEVEMMIQVALLCTQATPEDRPPMSEVVRMLEGEGLAERWEEWQHVEVNRRQEYERLQRRFDWGEDSVYNQDAIELSGGR

SEQ ID NO: 189480 - protein, 395 aa, Glycine max
  Coding DNA Sequence Number=SeqID_72702
  Gene Ontology: Mol. function=protein dimerization activity; Cellular component=nucleus; Biological process=regulation of transcription, DNA-dependent
  Homolog annotation: Hit_ID=Q1SIQ3; Match level="QueryCoverage=82%, HitCoverage=84%, E-value=1e-113, Identity=67%"; Hit description=CAMP response element binding (CREB) protein
  Pfam annotation: Domain name=bZIP_1; Domain location=190-249; Score =20.9; E_value=0.00079; Accession=PF00170.11; Description=bZIP transcription factor
  Pfam annotation: Domain name=bZIP_2; Domain location=193-239; Score =9.8; E_value=0.069; Accession=PF07716.5; Description=Basic region leucine zipper
  Pfam module annotation: Pfam domain module=bZIP_1::bZIP_2; Domain location=190-249::193-239
  Subcellular localization annotation: CTP_CleavageSite=58; ConfidenceScore=5.79e-01
NWEQMQDPSSNPNSNPNPNPHNANAASQLPRPPPATTAGAGASSSSLFARSGGPHHRRAHSEVSFRLPDDMMDLSPSDPFAGGSSTASMEEIGSEDDLFSTYIDVDKLGGANGSGASGNGADPTGETEKSPARPRHRHSSSVDFGEIMDAKKAMPPDKLAELWTIDPKRAKSICCGFDFVYCYSHGGGGVTNRILANRQSAARSKERKARYIQELERKVQTLQTEATTLSAQLTLYQRDTTGLSTENTELKLRLQAMEQQAQLRDALNEALKKEVERLKVATGEMMSHTDSFNLGMHLMPFSGSNFVPIPPQSGPSGHQNMQMPPFGLTPSTMPSHLLHQTSSHPYSEILQNDQLGRFQGLDISSKGSTLVKSEGPSLSATWHLVFLGAGILGMK

SEQ ID NO: 189481 - protein, 91 aa, Glycine max
  Coding DNA Sequence Number=SeqID_72703
  Gene Ontology: Mol. function=structural constituent of ribosome; Cellular component=ribonucleoprotein complex; Biological process =translation
  Homolog annotation: Hit_ID=Q9FJP3; Match level="QueryCoverage=50%, HitCoverage=26%, E-value=5e-15, Identity=84%"; Hit description=50S ribosomal protein L29, chloroplast precursor
MTLLCSMLGAWPNALQFLYQVVCNVFNSCSQIARMLTVKREREIEEGINKRLSRKLDKKWKKSIVVRPPPSLKKLREEEAAAEAAEAEKAA

SEQ ID NO: 189482 - protein, 187 aa, Glycine max
  Coding DNA Sequence Number=SeqID_72704
MAMVLPEELIVEILSWVPVKPLRLGIPLSSGRGNFEYWVRFWNPARMILSQESPHLRLRRRDYILLEDYVKFGFDYGDWSDTYKVAALCFNTKSQNWEVRLHCMGDTCRINILTCPAFPISRRSVAPLTVIFSYDLKKETYNLSMPDGLSEVPDYLLKVGVLKGCLSFGHSQEKNPFRCLANEGIWS

SEQ ID NO: 189483 - protein, 53 aa, Glycine max
  Coding DNA Sequence Number=SeqID_72705
MGQEALKGIHSGAELGEVAKGNMERLEAVVVMEFFSGVWHVFLLLIVGWCETQ

SEQ ID NO: 189484 - protein, 775 aa, Glycine max
  Coding DNA Sequence Number=SeqID_72706
  Gene Ontology: Mol. function=RNA-directed DNA polymerase activity; Cellular component=chromatin; Biological process=chromatin assembly or disassembly
  Pfam annotation: Domain name=zf-H2C2; Domain location=651-692; Score =18.4; E_value=0.0013; Accession=PF09337.1; Description=His(2)-Cys(2) zinc finger
MKLEVPRFDGTEPLSWIFKINQYFEYHATLNSPPSPEIRREVQALQPLTLVQAAGLARLQEEKLADVRPPPRPRPSPPPPSLIRTNPSHTSDNPRSPPLPPLLLAPPRQPPVMKRLTSEEITLRRERGLCFNCDERYHRGHRCASRVFLLITEEEEPSTANIDPNDPQPNPPDAPNPYPTQIRLRSLAGHLASETLHFEGVITDLHLLVTKLGLPCRSTLPLRVMVGNGHHLECTTICEAVPISIQDIEFTVELYVLPIVGANVVLGVQWLKTLGPILTDYNSLYMQFFYQNSLEPVSYFHITVLTEPHTSPSTPPPFPQPIQDLLQKFSALFQEPQGLPPSFLCASKMAAGGSALTIEPSTQSSSETGYHQIRMHGPDIPKTVFRTHHGHYEFKVKYLGHMVSQKGVELMASKVEAILQWPVPQSTWVVRSFLGLAGFYRRFIKGYATIAGPLLPFTVETDASGIDMGAVLSQNNHPIAFFSKPFNPKLLRASTYIRELFAITAVIKKWRQYLLGQCFTILTDHRSLKELLTQVIQMSEQHMYLARLMGYDYIIQYRTENHNQAADALSRLPEQDPSLFMILSIPSLTFLEELRHQLNAHPDYTQRRQEITQNPANFPTFTVSQDLVMNNGRIWLPRGLPITSTLLMEYHTTPTGGHAGIVKTLARISKNFSWSSLREDVKQFVTKCLDCQVTKYETQKGNTTILVMVDRFSKRIHLGMLQTSHTARMPFLEKCIEKKRKVSMVSNSLENYSLVEVIVADNGKCKSELEIVSKS

SEQ ID NO: 189485 - protein, 166 aa, Glycine max
  Coding DNA Sequence Number=SeqID_72707
MEKLNEFKNIHRNEGCVVLGHKHDACHEPKIWASSDDVRMVLRKLLLAAKLGRKTRNQERHLKKMIEETKEVLKNTREEYMKKEIANFPEDMEKMLEMVDMYTKEIEREMMEADKDDEDIHDQATVVDHHGAAKYKGKKRVVVEGGEGLKLLMEAVNAIEIKDMFN

SEQ ID NO: 189486 - protein, 136 aa, Glycine max
  Coding DNA Sequence Number=SeqID_72708
MFIKRRVKLVLILTNKSVRQESFCRKKKSIMGKLKEVRTVKSDQEQQRRRTKSKEEMHMEKMIKEAKQELRKLEEENRTKELLIHMFNVRAETGSFPVLKGLTEKELKGLQDLINMNVNKINQELEELKKDEATAV

SEQ ID NO: 189487 - protein, 39 aa, Glycine max
  Coding DNA Sequence Number=SeqID_72709
MERHACLSASSKDVVPLHCSMRKGTPTQSLFMDLHRIIK

SEQ ID NO: 189488 - protein, 141 aa, Glycine max
  Coding DNA Sequence Number=SeqID_72710
  Homolog annotation: Hit_ID=Q2QLN8; Match level="QueryCoverage=49%, HitCoverage=28%, E-value=5e-12, Identity=53%"; Hit description =Expressed protein
MDEKYLVIVNSRPRVISWEIGEEILKFPNGLGNVEHISISSDAKNLVTSDFKDQHEAAEGVLLDDDLNEPTMGEKLASLSVLDGNKSRSDIEQESSIPTKPPSADSVHVLLKQALNADDRTLLLDCLFTQIEKVLFLSYFY

SEQ ID NO: 189489 - protein, 111 aa, Glycine max
  Coding DNA Sequence Number=SeqID_72711
  Gene Ontology: Mol. function=cysteine-type peptidase activity; Cellular component=nucleus; Biological process=ubiquitin-dependent protein catabolic process
  Homolog annotation: Hit_ID=O24454; Match level="QueryCoverage=69%, HitCoverage=21%, E-value=1e-36, Identity=91%"; Hit description =Ubiquitin carboxyl-terminal hydrolase 3
MGAAGSKLEKALGDQFPEGERYFGLENFGNTCYCNSVLQALYFCVPFREQLLEYYGNNKSILDGEENLLTCLADLFSQPYPCICKEAVSGFEPMTNKSPRHNFTAAPGLAL

SEQ ID NO: 189490 - protein, 119 aa, Glycine max
  Coding DNA Sequence Number=SeqID_72712
MSECNKQAVAMTNTIIKPLGYCNGRNRKQSLITDYTLKASDFSYSTLCLRYWGLIFAKIPLWVMKCREAVHIILTTDNDPLGQALAEELARRLGRERLYILSFIFHVKQSVYACKGVHI

SEQ ID NO: 189491 - protein, 1064 aa, Glycine max
  Coding DNA Sequence Number=SeqID_72713
  Gene Ontology: Mol. function=transcription regulator activity; Cellular component=nucleus; Biological process=regulation of transcription, DNA-dependent
  Homolog annotation: Hit_ID=Q8GSA7; Match level="QueryCoverage=95%, HitCoverage=90%, E-value=0.0, Identity=47%"; Hit description =Calmodulin-binding transcription activator 3
  Pfam annotation: Domain name=Ank; Domain location=716-748; Score =39.4; E_value=1.2e-08; Accession=PF00023.20; Description=Ankyrin repeat
  Pfam annotation: Domain name=Ank; Domain location=755-789; Score=6.8; E_value=3.2; Accession=PF00023.20; Description=Ankyrin repeat
  Pfam annotation: Domain name=CG-1; Domain location=1-93; Score=189.5; E_value=8.3e-54; Accession=PF03859.7; Description=CG-1 domain
  Pfam annotation: Domain name=IQ; Domain location=890-910; Score=21.6; E_value=0.0028; Accession=PF00612.17; Description=IQ calmodulin -binding motif
  Pfam annotation: Domain name=IQ; Domain location=913-933; Score=22.4; E_value=0.0016; Accession=PF00612.17; Description=IQ calmodulin -binding motif
  Pfam annotation: Domain name=TIG; Domain location=480-566; Score =11.5; E_value=0.066; Accession=PF01833.14; Description=IPTTIG domain
  Pfam module annotation: Pfam domain module=Ank::Ank::CG -1::IQ::IQ::TIG; Domain location=716-748::755-789::1-93::890-910::913- 933::480-566
MHLPYFSLTLGGSLFLFDRKVLRYFRKDGHNWRKKKDGKTVREAHERLKAGSVDVLHCYYAHGEENENFRRRTYWLLEEELSHIVLVHYRHVKGTKANFTCAKENEETLPYAQQTDKIMPKTEMETSLSSTLHPHSYQVPSQTMDRSMNSSQASEYEEAESAFNNHASSEFYSFLELERPVEKITPQPADSYSPRPLTNDQEKSPVIPGVNYISLTQDNKIKDIHNFGLTYESPKPLGFSSWEGILKNNAGSQHVPFQPLFPGTQPDNMGINSKFSQGHEIMVPYLTTSIAKQHENGSLIQAEGNWQAYDVDSLRMSSWPIDSAYSGSSCDITCSNREQEVNDVDLQKSLEQCLLHPYKQNKVFMQNDPQEKLLNEKEKIKSDLEANRILDGIEDTYFTFKRTLLDGSPAEEGLKKLDSFNQWMSKELADVEESNKPSTSGGYWDTVESENEVGNTTIPSQGHLDTYVLDPSVSHDQLFSIIDYSPSWAFEGSEIKVIISGRFLRSQHEAEQGKWSCMFGEVEVPAEIIAKGVLCCHTPPHKAGRVPFYVTCSNRLACSEVREFDFQVNYTPEVNTTGENRGSTFDTFSIRFGELLSLGHAFPQNSDSISVSEKSQLRSKINSLLREEEDDWDKLLKLTQEEDFSPENLQEQLLQNLLKDKLHAWLLQKITEEGKGPNILDEGGQGVLHFASALGYDWALEPTIVAGVNVNFRDVNGWTALHWAAFCGRERTVAFLISLGAAPGALTDPCPEHPSGRTPADLASANGHKGIAGYLAESSLSAHLTTLDLNRDAGENSGAKVVQRVQNIAQVNDLDGLSYELSLKDSLAAVRNATHAAARIHQVFRMQSFQRKQLKEYDDDKLGLSDERALSLVKMNMKSHKSGPRDEPVHAAAVRIQNKFRSWKGRREFLMIRQRIVKIQAHVRGHQVRKSCGKIIWSVGILEKVILRWRRKGSGLRGFKPEANSEGTMIQDVSSTDDDYDVLKEGRKQTEQRLQKALARVKSMVQYPEARDQYHRLLNVVTEIQENQVKHESSYNNSEEPREFGDLNDLEALLDEDIFMPTAT

SEQ ID NO: 189492 - protein, 53 aa, Glycine max
  Coding DNA Sequence Number=SeqID_72714
  Subcellular localization annotation: CTP_CleavageSite=28; ConfidenceScore=5.01e-01
MSGSPSNAEMSRAHFSYAAKFFNSCSVRCKEEARSFAVPTKTGLLTHQRMPNY

SEQ ID NO: 189493 - protein, 374 aa, Glycine max
  Coding DNA Sequence Number=SeqID_72715
  Homolog annotation: Hit_ID=Q8GSM4; Match level="QueryCoverage=32%, HitCoverage=36%, E-value=6e-11, Identity=35%"; Hit description=Ovate protein
  Pfam annotation: Domain name=DUF623; Domain location=313-372; Score =114.2; E_value=3.7e-31; Accession=PF04844.4; Description=Protein of unknown function, DUF623
  Subcellular localization annotation: CTP_CleavageSite=35; ConfidenceScore=5.51e-01
MGNNKFKLSDMIPNAWFYKLKDMSRSRKRNGSHVMKSKVSSPTTSQRSLPRYSQYFSTEPIRAGKLYNTPIHTKDLDLPFTDSPRRSSKRRARRKTIYKPSPTVVPSSGYDSPNHWIKPCQVQSPDYDVSSAESSSESDLHEYAYSESECDSFSVPDLLNGVDTNCSCRVSSSTNDIIIDMNSESFIGNPEKQDGFDAISQLGLAPILTRPMKFDDKVIEAAELRSSTDLDQLQDDQSFSIEILKEECNRIQRRRKSSHRKPFANSAGIRLRVHSPKLASRKIQACARSVSPISSKAPRSTGFLDGFAVVKSSFDPQSDFRESMLEMIVENNIRASKDLEDLLACYLSLNSSEYRDLIVKAFEQIWFDMTQLRM

SEQ ID NO: 189494 - protein, 500 aa, Glycine max
  Coding DNA Sequence Number=SeqID_72716
  Gene Ontology: Mol. function=transferase activity
  Homolog annotation: Hit_ID=Q2RBE2; Match level="QueryCoverage=73%, HitCoverage=50%, E-value=3e-13, Identity=26%"; Hit description =Nucleotidyltransferase family protein, putative, expressed
MIIGNFYRIRSAFKYGARKLGWILMLPEDRITEELIRFFTNTLERHGSTPGNVNKSFLSLSTASRKDRKPENQHNYDCRDERERYVVQDAGEFFDSSRYGNAVGSLKLCEDSKDVATSGVLDSASTNGWSYCSNGQFENNISDSEPALNSVIDDEKEKQGVAGNSPRSHTDEKNMAVSEASKSLLDLTGDYDSHIGNLQYGHMCNGYPVSPVVPSPPRSPKFPNRNPWETVRQCVQINHSIRSQANSNSVMGQQVYVINHPSLPMTSFGSEEKRKVRGTGAYFPNMTSRPYRDNRPMPGRGRGQAPGTHGHLQRHTRNNGFALAPQEMNLSAEGTFEHALEGYPGLGSTKIRSSETYFPQPSTWGSHYANGFVHSSEKHESVHVSPQLQVVPRNETSIYPESVISTPRGTVPNTGEVMEKSDSLSVVDSKSINSNDQYMETIKTLPTFQQVLPKDGDFMFLVLSGKQIDDLYAVFKPGYSVFGGVHGHSNCRDDAPEKHA

SEQ ID NO: 189495 - protein, 100 aa, Glycine max
  Coding DNA Sequence Number=SeqID_72717
  Homolog annotation: Hit_ID=Q60DJ5; Match level="QueryCoverage=94%, HitCoverage=33%, E-value=6e-10, Identity=34%"; Hit description =Expressed protein
MALPGGVERDAVLGEESKVGIGRVIDERDGKEAVNGRDKGWGGTKGGWEGWKRRICPIGGELDISVGEEEKGNFGKGFFGGEVEEFGRVGMGIGGMGNGI

SEQ ID NO: 189496 - protein, 613 aa, Glycine max
  Coding DNA Sequence Number=SeqID_72718
  Gene Ontology: Mol. function=protein serine/threonine kinase activity; Cellular component=cytoplasm; Biological process=protein amino acid phosphorylation
  Homolog annotation: Hit_ID=Q6EIX6; Match level="QueryCoverage=94%, HitCoverage=91%, E-value=0.0, Identity=60%"; Hit description=Mitogen- activated protein kinase
  Pfam annotation: Domain name=Pkinase; Domain location=16-280; Score =171.9; E_value=1.6e-48; Accession=PF00069.15; Description=Protein kinase domain
  Pfam annotation: Domain name=Pkinase_Tyr; Domain location=17-280; Score=9.8; E_value=4.5e-13; Accession=PF07714.7; Description=Protein tyrosine kinase
  Pfam module annotation: Pfam domain module=Pkinase::Pkinase_Tyr; Domain location=16-280::17-280
MGENCYVEIDPTGRYGRFGDILGKGAMKTVYKAIDEVLGIEVAWNQVRLNEVLRTPDDLQRLYSEVHLLSTLKHQSILRFYTSWIDIDSRAFNFITEFFTSGSLREYRKNYKRVSIQAIKNWARQILQGLVYLHCHDPPVIHRDLKCDNIFVNGHLGQVKIGDLGLAAILHGSQLAHSVIGTPEFMAPELYEEEYNELADVYSFGMCVLEMLTSEYPYSECSNPAQIYKKVTSVNSDSGGKLPMAFFRIEDMEAQRFIGKCLVPAEKRPSAKELLLDPFLVSDDPSSTMKFAIQKPFLNVNEMEKLQLSDDLPRTGMKVIGKLNPENDTIFLKVQISDKDGSVRNVFFPFDILSDTPIDVATEMVKELEIEDGEPYEIANMIDREISALLPHRRQSSCSDAFHTFNYLDDDCDDDGPHHHFRSFSSSSSFQESMSDLVSKGEEISSGYYWLHDDLHDDTSSRCSSQGTYSNLNYYSVDDHQEYNVPSLRKDKLPITTSHNKGKKISTGEDLSNFNQGKLMVGSQVPLTSKSKMMINNHHRLTRNRSLIDIRSQLLHRSLVEEVNKRRLFKTVGAVENIGFQAPCDVTTKWSQHACVAPNENSPRSGRNGKIKR

SEQ ID NO: 189497 - protein, 188 aa, Glycine max
  Coding DNA Sequence Number=SeqID_72719
  Gene Ontology: Mol. function=nucleotide binding; Cellular component =membrane; Biological process=small GTPase mediated signal transduction
  Homolog annotation: Hit_ID=Q9LFT9; Match level="QueryCoverage=89%, HitCoverage=81%, E-value=9e-82, Identity=89%"; Hit description=GTP -binding protein
  Pfam annotation: Domain name=Arf; Domain location=1-151; Score=-87.3; E_value=0.005; Accession=PF00025.11; Description=ADP-ribosylation factor family
  Pfam annotation: Domain name=Miro; Domain location=12-106; Score=6.4; E_value=0.0013; Accession=PF08477.3; Description=Miro-like protein
  Pfam annotation: Domain name=Ras; Domain location=20-153; Score =184.2; E_value=3.1e-52; Accession=PF00071.12; Description=Ras family
  Pfam module annotation: Pfam domain module=Arf::Miro::Ras; Domain location=1-151::12-106::20-153
MKREIERKMKWKHFVGVCMKATIGIDFLSKTMYLEDRTVRLQLWDTAGQERFRSLIPSYIRDSSVAVIVYDVANRQSFLNTNKWVEEVRTERGSDVIIVLVGNKTDLVDKRQVSIEEGDAKSREFGIMFIETSAKAGFNIKPLFRKIAAALPGMETLSSTKQEDMVDVNLKPTVNSSQTEQQGGGCSC

SEQ ID NO: 189498 - protein, 179 aa, Glycine max
  Coding DNA Sequence Number=SeqID_72720
  Subcellular localization annotation: CTP_CleavageSite=95; ConfidenceScore=5.48e-01
MVIVQLKTALLHSLNAYIVRSKKPVFIRALKFRAHKSTFPKASFPRKPTMPSLLQSMFRSPKKSKHADMLQGLRSPSNVHETPLFPSPLTPAFVTAREVEKREEALRQEVEDACRSFENYLVEMIVEEGKTRDLMDVEELLYCWKNLKCPVFIDLVSRFYGELCKDLFSPDSEEGDSSK

SEQ ID NO: 189499 - protein, 56 aa, Glycine max
  Coding DNA Sequence Number=SeqID_72721
MAKKHQWSSGRIVPCHDTSSAVIEWAMSEMMENPRVMTKAQDEVTINFASNNEIPY

SEQ ID NO: 189500 - protein, 529 aa, Glycine max
  Coding DNA Sequence Number=SeqID_72722
  Gene Ontology: Mol. function=signal transducer activity; Cellular component=membrane; Biological process=response to light stimulus
  Homolog annotation: Hit_ID=Q9LFU0; Match level="QueryCoverage=95%, HitCoverage=79%, E-value=1e-155, Identity=55%"; Hit description=Non -phototropic hypocotyl 3-like protein
  Pfam annotation: Domain name=BTB; Domain location=48-148; Score= -11.4; E_value=0.044; Accession=PF00651.21; Description=BTBPOZ domain
  Pfam annotation: Domain name=NPH3; Domain location=213-489; Score =302.5; E_value=7.8e-88; Accession=PF03000.5; Description=NPH3 family
  Pfam module annotation: Pfam domain module=BTB::NPH3; Domain location= 48-148::213-489
MKSLQVGQAQQDYGSHTDGSDKVSDKSILFPNKFIAIADSFKGEHSWFIAPQIPTDFSIQVQETTYNVHKYPLISKCGYIGQLEIQPLISNSGNVLKLENFPGGSETFETILKFCYGLPIDFSPDNIAALRCASEFLEMTEELEDGNLISKSEAFLTFVVLSSWKDTITVLKSCENLSPWAENLQIVRRCCDSIAWKASKDELTSEDATPNQESWWFNDVAAFRIDHFMQIISAIRAKGTKPETIGKCIIQYAKRWLPGMEVELEGLRGYGHEKCNLQFSIFSGKKKESSGHSKEQKTIIESLISIIPPQQDAVSCKFMLQMLKMAMMYSVSPALTTDLEKRVSLVLEDAEVSDLLIPRYQNGDQGKTVISMTISSEECTMLDIDVVQRIVEYFLMHEQQQIQQQQKTRKFNISRLLDNYLAEIARDPNLSITKFQVFAEFLPENTRSYDDGLYRAIDTYLKTHASLTEHDRKRLCKIMNCEKLSLDACLHAAQNERLPLRTVVQDNTNPPHKQKNENKTEMLPKSIPP

SEQ ID NO: 189501 - protein, 75 aa, Glycine max
  Coding DNA Sequence Number=SeqID_72723
MGKLIVMKEVMSMSELVLYHGGMPIFISLIMCGSNFNLFAQVCFFPNCANAGRQMGEIKSSDLSDEPAVAPFPQY

SEQ ID NO: 189502 - protein, 157 aa, Glycine max
  Coding DNA Sequence Number=SeqID_72724
  Gene Ontology: Mol. function=nucleotide binding
  Homolog annotation: Hit_ID=Q38HS8; Match level="QueryCoverage=64%, HitCoverage=53%, E-value=1e-26, Identity=61%"; Hit description =Ribosomal protein L23 family protein
  Pfam annotation: Domain name=Ribosomal_L23; Domain location=51-137; Score=61.5; E_value=2.7e-15; Accession=PF00276.10; Description =Ribosomal protein L23
MEDTCYFTRQYENNRKGTTHKRVLIGFKEARRPLSSKKCSLFKSKSMAHITNLPMTPLMPSTSSNDIKEIAFKTAPSASKVEIKRFLETFYGFEVEKVRTLNMKGKKKRYAGSLVAKPDYKKAYVTLKKPLSFSQDPYHFRSTVEDKKKEKMLTTHC

SEQ ID NO: 189503 - protein, 152 aa, Glycine max
  Coding DNA Sequence Number=SeqID_72725
  Gene Ontology: Mol. function=protein transporter activity; Cellular component=membrane; Biological process=intracellular protein transport
  Homolog annotation: Hit_ID=Q1RVE7; Match level="QueryCoverage=84%, HitCoverage=97%, E-value=1e-35, Identity=66%"; Hit description =Syntaxin, putative
  Pfam annotation: Domain name=Syntaxin; Domain location=43-143; Score =17.7; E_value=0.026; Accession=PF00804.15; Description=Syntaxin
MNDLMTKSFQSYAELKKQAEKDNLEDSHDIEAGKLNNPTDYHNLSQFFQEVEAIKVEMEEVATLLFDLLQLHEETKCTDSAKVLRGLRDRMVSDMVTLFCKARIINSRFEVLDQSNITNHTLSESCKEGIQIDDQNVCHKSFCWPGSCGQCW

SEQ ID NO: 189504 - protein, 167 aa, Glycine max
  Coding DNA Sequence Number=SeqID_72726
  Homolog annotation: Hit_ID=Q2HRE1; Match level="QueryCoverage=80%, HitCoverage=43%, E-value=1e-24, Identity=33%"; Hit description =Lipopolysaccharide-modifying protein
  Pfam annotation: Domain name=DUF821; Domain location=56-167; Score= -186.7; E_value=1.7e-09; Accession=PF05686.3; Description=Arabidopsis thaliana protein of unknown function (DUF821)
  Subcellular localization annotation: CTP_CleavageSite=37; ConfidenceScore=5.56e-01
RMFSGASSSKSAQSTTPYGTSPFTVSIRKPIAPLNCTAYNLTGTCPTNLQDHQSTPATATCPDYFRWIHEDLRPWARTGITQDMVERAKQTANFRYPGKIPDLELMFDCVDWPVVLSDRYNGPNVEQPTPLFRAEINIKPWHILLGELKEGTTRIPWLNREPYAYWK

SEQ ID NO: 189505 - protein, 69 aa, Glycine max
  Coding DNA Sequence Number=SeqID_72727
MALSGGVERDAMLGEESKVGIGRVIDERDGKEAVNGRDKGGELDINVGEEEEGYFGKGFFGGEVEKFGK

SEQ ID NO: 189506 - protein, 83 aa, Glycine max
  Coding DNA Sequence Number=SeqID_72728
MVFSTTIMEAYLEMTWVCYFTTKRLPEGRVPPERDTWRDLTGRWDRGGSGGLPGATSSGGAPGATTSGSLSGASTSGGPRRVH

SEQ ID NO: 189507 - protein, 83 aa, Glycine max
  Coding DNA Sequence Number=SeqID_72729
MGFGGGGLWCLAGDFVFCDTTVVVRGGGLRQDNGGGLRHLNGGVCLWLWVMVVVHNGWVTKEIDGKRETLNLGVRITCFYKYM

SEQ ID NO: 189508 - protein, 290 aa, Glycine max
  Coding DNA Sequence Number=SeqID_72730
  Homolog annotation: Hit_ID=Q1RYS5; Match level="QueryCoverage=31%, HitCoverage=58%, E-value=3e-07, Identity=32%"; Hit description =Peptidase aspartic, catalytic
MVQKAIDKGRLKFKEKPMKVDTNPFHIQANYIEPMQIMMMGALIGTPKMSTPLSKEEGNEGSSSRFKAFEVSDLELRRGGTTEGSKKGFYEYRNSPWVNRNMSITQWRRHQRMTRDAILEMQQRNDSLEAIYGVIWILPAEYAEDDQNRHILRDYVKEDYFDDPCLRPKNATVFDPPSDDMSYHMKSLHLTTMVEDQVINKILVDGGDAFNILPRSMLWRGVICLDVSIGSRRRPTMLLKLFFWNKDGKLEMVEAGSGQVVARTALFKVEDSFYVNNKSSDKKDKFFCWD

SEQ ID NO: 189509 - protein, 42 aa, Glycine max
  Coding DNA Sequence Number=SeqID_72731
MKAYLDEHLQGTTTKGHEPEVTVVRKSGTRHAELKGVRQPRV

SEQ ID NO: 189510 - protein, 86 aa, Glycine max
  Coding DNA Sequence Number=SeqID_72732
  Gene Ontology: Mol. function=RNA-directed DNA polymerase activity; Biological process=RNA-dependent DNA replication
MCGLSRELVEHRLPIYKGRKPVKHAPRRFAPNVMEDIKAKIERLLKANFIQTIRKLLVCIDFRDLNVETPKDEYPLLVVDMLVHST

SEQ ID NO: 189511 - protein, 151 aa, Glycine max
  Coding DNA Sequence Number=SeqID_72733
MQEAISKIKVEILLINGKEKENDKVVESWDVCKSKGREKKKKGDEGGAPEAGCWVRLRFIGSYISSRSKVDTSVSGTGTNTHYGSKRHKYKEISSPFPKVDIQFQALDLIATIIESRLHLSCLKIVAFLSISNQLGYSCLKIKIKRSNPAK

SEQ ID NO: 189512 - protein, 556 aa, Glycine max
  Coding DNA Sequence Number=SeqID_72734
  Gene Ontology: Mol. function=ATPase activity, coupled to transmembrane movement of substances; Cellular component=integral to membrane; Biological process=transport
  Homolog annotation: Hit_ID=Q1T1V6; Match level="QueryCoverage=98%, HitCoverage=88%, E-value=0.0, Identity=59%"; Hit description=AAA ATPase
  Pfam annotation: Domain name=ABC_membrane_2; Domain location=1-232; Score=68.6; E_value=2e-17; Accession=PF06472.5; Description=ABC transporter transmembrane region
  Pfam annotation: Domain name=ABC_tran; Domain location=344-546; Score= 78.9; E_value=1.6e-20; Accession=PF00005.17; Description=ABC transporter
  Pfam module annotation: Pfam domain module=ABC_membrane_2::ABC_tran; Domain location=1-232::344-546
MASLLLTLDCEASPWGADSFDPTSSQELLKKQCILQVPVSPTIELNNNIYLQVFHMASKNVDADQRITHDLEKLTTDLSGLVTGMVKPSVDILWFTWRMKLLTGRRGVAILYAYMLLGLGFLRTVTPDFGDLISQEQQLEGTFRFMHERLCTHAESVAFFGGGAREKAGSNMRKCEVGLSLTGKMVESRFRELLLHSKYLLKKKWLFGILDDFITKQLPHNVTWGLSLIYAMEHKGDRASVTTQGELAHALRFLASVVSQSFLAFGDILELHRKFVELSGGINRIFELEELLDAAQSENFTSVSAIPPVRDVHSSDVISFSKVDIVTPSQKMLARELIFDIKHGGSLLVTGPNGSGKSSIFRVLRGLWPIASGRLSRPSEVVDEEDGSGCGIFYVPQRPYTCLGTLRDQIIYPLSCEEAEVKVLKMYGKDEKHADTRNLLDTRLKAILESVRLNYLLEREGSNWDANLKWEDILSLGEQQRLGMARLFFHKPKFGILDECTNATSVDVEEHLYGLAKDMGITVVTSSQRPALIPFHSMELRLIDGEGNWKLRLIKQ

SEQ ID NO: 189513 - protein, 268 aa, Glycine max
  Coding DNA Sequence Number=SeqID_72735
  Gene Ontology: Mol. function=ATPase activity, coupled to transmembrane movement of substances; Cellular component=integral to membrane; Biological process=transport
  Homolog annotation: Hit_ID=Q1T1V6; Match level="QueryCoverage=97%, HitCoverage=67%, E-value=1e-134, Identity=64%"; Hit description=AAA ATPase
  Pfam annotation: Domain name=ABC_membrane_2; Domain location=1-169; Score=123.7; E_value=5.1e-34; Accession=PF06472.5; Description=ABC transporter transmembrane region
MVYYKISHVDGRITNPEQRIASDVPRFCSELSEIVQDDLTAVTDGLLYTWRLCSYASPKYIFWILAYVLGAGATIRNFSPAFGKLMSREQELEGEYRQLHSRLRTHSESIAFYGGERREEAHIQQKFRTLVRHINRVLHDHWWFGMIQDFLLKYLGATVAVILIIEPFFSGHLRPDSSTLGRAEMLSNLRYHTSVIISLFQSLGTLSISARRLNRLSGYADRIHELMAISRELSLDNGKSSLQRQGSRNYISEANYVGFYGVKASEFY

SEQ ID NO: 189514 - protein, 97 aa, Glycine max
  Coding DNA Sequence Number=SeqID_72736
  Subcellular localization annotation: CTP_CleavageSite=84; ConfidenceScore=5.14e-01
MPPSLIPPSSIQPHSHAHPPGRLYLCQTFHRSKATQGCRFEASEKHCCICPCPSPTQMCNPKLSFVTPMHMTMVMVALSERMPRANMWQRIVGLREG

SEQ ID NO: 189515 - protein, 232 aa, Glycine max
  Coding DNA Sequence Number=SeqID_72737
  Gene Ontology: Mol. function=ATPase activity, coupled to transmembrane movement of substances; Cellular component=integral to membrane; Biological process=transport
  Homolog annotation: Hit_ID=Q1T1V6; Match level="QueryCoverage=64%, HitCoverage=11%, E-value=1e-59, Identity=78%"; Hit description=AAA ATPase
  Pfam annotation: Domain name=ABC_membrane_2; Domain location=78-221; Score=-116.0; E_value=0.028; Accession=PF06472.5; Description=ABC transporter transmembrane region
MSSLQLFQLTHHGRSFLASRRKTLLLATGILVAGGTAAYVQSRFRGNRDDLLGDSYERNNDKELTKEEVMKGTSAPKNKQKKGGLKSLQVLAAILLSEMGQLGAKNLLSLVSIVVLRTTLSNRLAKVQGFLFRAAFLRRVPLFLRLISENILLCFLLSTMQSTSKYITGTLSLHFRKILTKLIHSRYFEVDIADLYPLCICKSKAAYNIPPPYLRIAKSLWAMGYEVNRGKT

SEQ ID NO: 189516 - protein, 644 aa, Glycine max
  Coding DNA Sequence Number=SeqID_72738
  Gene Ontology: Mol. function=binding
  Homolog annotation: Hit_ID=Q6L4Y6; Match level="QueryCoverage=89%, HitCoverage=96%, E-value=0.0, Identity=84%"; Hit description =Putative tetratricopeptide repeat (TPR)-containing protein
  Pfam annotation: Domain name=TPR_2; Domain location=405-438; Score =11.5; E_value=1.5; Accession=PF07719.7; Description=Tetratricopeptide repeat
  Pfam annotation: Domain name=TPR_2; Domain location=444-477; Score =5.3; E_value=7.9; Accession=PF07719.7; Description=Tetratricopeptide repeat
  Pfam module annotation: Pfam domain module=TPR_2::TPR_2; Domain location=405-438::444-477
MDKVSSDCPYPGCFFCVMKEGNPSKRRASVLKFFRELPCQDDDGQVLPISGLWNTAMAHPNDPEFLELGIFECMSALIWKGLKNRRWLSHDQNIYIPYYAAHIIGSYTMNMEEFAESAVHAGVIPPLVELLRGRLTWVEQRVAVRALGHLATYASTFPAIASHGEILELSIQLAMSSLEIVYSHFYQYVDRRLSYHCDLLTRGMGGVEMESRKAEEWASQLQCWSLQLINCFAFKHEFLPTICKPEFLIKLPGMWGGLVNENSPAGIGLLRTICHQKLGRGPVASCPGIIDALCNIARSSDDWQYMAIDCLLWLLEDPNTCHKVIDKVVPALVDLAEITTLGDHKKLGDLVVNVLQECIQSQGSGRSSISSHTKEQIEDILNSKQRLKWEKNMPKEDLHIKQAAALVVKLEGNSLFSSGSIAGAASKYSEALALCPMRSRKERVVLYSNRAQCHLLLQQPLAAISDATRALCLHKPVNRHAKSLWRRAQAYDMLGLAKESLLDAILFINECSQSNDPDLSLRQNKVPDYAERLVKKQMRAAWLFREAAIKHGGVHSQGDGGDMYGPETDDSEWETASESDIGNDGRDDMGEDDDGDWNNDDERKNYDKPSMKALVSTFRLLEKNWSPMRLWILGNQPFLVCSIT

SEQ ID NO: 189517 - protein, 72 aa, Glycine max
  Coding DNA Sequence Number=SeqID_72739
MRQANSSNGTTQRVKMGWHFLLCNFILDVDNLQAFKVVSHMAPLAKDKRPPKGAILDGVSSCLHRKETLASK

SEQ ID NO: 189518 - protein, 190 aa, Glycine max
  Coding DNA Sequence Number=SeqID_72740
MEDIVRMEDLFKRWIEYLDSIQSRVSHSPPINCDFCGGEHCNDNCHLYSMNNSWWGQELLPYNQYEEERTPNLEGVFAEFMAYHASSKANQNSMQNQEIHVGKSYSMENYQWEQELQPYNQYEEERVSNLDNLLKQFKESTEPTQRAFKSLEIQVGKLAEEMAKFVATSEENYVEVEAHEESLVEEHYST

SEQ ID NO: 189519 - protein, 112 aa, Glycine max
  Coding DNA Sequence Number=SeqID_72741
MALSSFDEFPNEGEDLSKGSSLNAWRVVVVVIVRKIGHQGVEHEFLDDGGGSCDACFMLSDEPASIWTTCLKVESNLEMVLGVRGGVGIWMALLLLLLMQLLALLVGDFIGE

SEQ ID NO: 189520 - protein, 259 aa, Glycine max
  Coding DNA Sequence Number=SeqID_72742
  Homolog annotation: Hit_ID=Q9ZVD2; Match level="QueryCoverage=88%, HitCoverage=88%, E-value=3e-21, Identity=28%"; Hit description =Expressed protein
  Pfam annotation: Domain name=Hin1; Domain location=106-234; Score =78.9; E_value=1.5e-20; Accession=PF07320.4; Description=Harpin -induced protein 1 (Hin1)
ILLHTARARAIACMPMEGHADVSATFPPPPGHHGADTYIVQLPKDQVYRVPPRENALIVEQYRNPATAKKRRGGCCCCCSRRVFLTVALIVVAIVAVVGITLATLYFIFSPSGPKFTVSHVAVNRNKSSRAAPQYEVSLRARNPNEKLAIEYQDGDVSLLFDDTKVAEGKFPTLEQGRGEASEVTVELTGSSGALPRRMNGGDAAVDLKLEMKLAIRIRTAGLETWAMRSDVACEFKVSALGNDTRVLSQQCDTKFKQY

SEQ ID NO: 189521 - protein, 463 aa, Glycine max
  Coding DNA Sequence Number=SeqID_72743
  Gene Ontology: Mol. function=binding; Cellular component=thylakoid; Biological process=photosynthesis
  Homolog annotation: Hit_ID=Q1T1X0; Match level="QueryCoverage=85%, HitCoverage=82%, E-value=1e-125, Identity=54%"; Hit description=IMP dehydrogenase/GMP reductase
  Pfam annotation: Domain name=TPR_1; Domain location=150-183; Score =12.2; E_value=0.19; Accession=PF00515.18; Description=Tetratricopepti de repeat
  Pfam annotation: Domain name=TPR_1; Domain location=328-360; Score =3.1; E_value=2.3; Accession=PF00515.18; Description=Tetratricopeptide repeat
  Pfam annotation: Domain name=TPR_1; Domain location=361-394; Score =33.2; E_value=9.3e-07; Accession=PF00515.18; Description =Tetratricopeptide repeat
  Pfam annotation: Domain name=TPR_1; Domain location=395-428; Score =8.1; E_value=0.58; Accession=PF00515.18; Description=Tetratricopeptid e repeat
  Pfam annotation: Domain name=TPR_2; Domain location=150-183; Score =19.2; E_value=0.015; Accession=PF07719.7; Description=Tetratricopepti de repeat
  Pfam annotation: Domain name=TPR_2; Domain location=266-299; Score =2.6; E_value=16; Accession=PF07719.7; Description=Tetratricopeptide repeat
  Pfam annotation: Domain name=TPR_2; Domain location=328-360; Score =1.1; E_value=24; Accession=PF07719.7; Description=Tetratricopeptide repeat
  Pfam annotation: Domain name=TPR_2; Domain location=361-394; Score =22.2; E_value=0.0019; Accession=PF07719.7; Description =Tetratricopeptide repeat
  Pfam annotation: Domain name=TPR_2; Domain location=395-428; Score =17.2; E_value=0.062; Accession=PF07719.7; Description=Tetratricopepti de repeat
  Pfam module annotation: Pfam domain module=TPR_1::TPR_1::TPR_1::TPR _1::TPR_2::TPR_2::TPR_2::TPR_2::TPR_2; Domain location=150-183::328 -360::361-394::395-428::150-183::266-299::328-360::361-394::395-428
  Subcellular localization annotation: CTP_CleavageSite=46; ConfidenceScore=5.41e-01
GCEDVTFSGTASSNNSSARSGSKPLHMPNPVVNRTHQRNHPKVSPREGYVNSGRRVPKEAIGISGELESMITDRQKGSSSLVRASSSNVMMFGNLGNLRQGGNTNTYSQNPVASGRYTNQTVENVSKGSKEQPDALALYDAAIAIHPNKASYRSNRSAALTALGRLLEAVFECREAIQIEPRYKRAHYRLGNLNMSDLTREKDGEMDKAHYHYKQAGPEADTDQIAKVKKIQVHLNKCTEARRLGDWNKLIKETNYAVSFGADSAPHIFALQAEAFFMLRRHQHAEEAMLKGSNFDVDHCIQFFGPICNANTLVTQAWVHLAAGRAVAAARSNRNELFKASKFSEACVAYGEGLENDPYNSVLLCNRAACRSKTGQLEKAMEDCNAALSLHPSYSKARLRRADCNAKLKRWETSRQDYEILLKETPEDEELRRTLLEAKSILSNSEDDRKSTLVVNDQYSNPL

SEQ ID NO: 189522 - protein, 88 aa, Glycine max
  Coding DNA Sequence Number=SeqID_72744
MALPNGVERDAVQGEESKVGIGRVIDERDGKEAVNGRDKGWGGTKGGELDISVGEEEEGNFGKGFLEERWKNLGGLEWELVEWEMAFE

SEQ ID NO: 189523 - protein, 191 aa, Glycine max
  Coding DNA Sequence Number=SeqID_72745
  Gene Ontology: Mol. function=copper ion binding; Cellular component =mitochondrion; Biological process=electron transport
  Homolog annotation: Hit_ID=Q6H4G4; Match level="QueryCoverage=79%, HitCoverage=48%, E-value=3e-40, Identity=53%"; Hit description =Putative SenC
  Pfam annotation: Domain name=SCO1-SenC; Domain location=22-190; Score= 56.2; E_value=1.1e-13; Accession=PF02630.5; Description=SCO1SenC
MMRGERFPKACFLESSLHRKGILTGHQGGGLRNVANGPIIGGPFTLINTEKQAITEHNFLGNWVLLYFGYTSSPDCGPEQVQIMAKAIDILESKQNLKILPVFVSTDPQRDTPSQLRAYLKGVLMIAEVEGANTVEFDSRIIGLTGPVAAIRQMAQEYCFYFKKVEEDGSDYLVDCSHNMYALVLPLFILL

SEQ ID NO: 189524 - protein, 78 aa, Glycine max
  Coding DNA Sequence Number=SeqID_72746
EEAPSKMALPGGVERDAMLGEESKVGIGRVIDERDGKEAVNGRDKGVCVDVNVEEVGKGEVDKFGRVGMRIGGMGNGI

SEQ ID NO: 189525 - protein, 99 aa, Glycine max
  Coding DNA Sequence Number=SeqID_72747
MKDSQLKQRGWHCEGVPLRVSVVAHDKDSREATRRASDKRARVRLVCLSSPTILKLFTIRYISDPSDGTQNLAGNSYIFTSNFSENWEFQREYMGDSLV

SEQ ID NO: 189526 - protein, 50 aa, Glycine max
  Coding DNA Sequence Number=SeqID_72748
MEIIILQAQGSSQLIIFKLKMGARDSSFINKVWKGHPGLAKMSLVLEWAR

SEQ ID NO: 189527 - protein, 153 aa, Glycine max
  Coding DNA Sequence Number=SeqID_72749
  Gene Ontology: Mol. function=protein serine/threonine kinase activity; Cellular component=integral to membrane; Biological process=protein amino acid phosphorylation
  Homolog annotation: Hit_ID=Q7XIM0; Match level="QueryCoverage=97%, HitCoverage=42%, E-value=6e-37, Identity=77%"; Hit description =Putative calcium-dependent protein kinase 2
  Pfam annotation: Domain name=Pkinase; Domain location=1-146; Score= -81.5; E_value=0.001; Accession=PF00069.15; Description=Protein kinase domain
MHHLAGHPNVIQIVGAYEDVVVVHVVMELCAGGELFDRIIQIGHYTERKAAELARLILNVMEAYHSLGVMHRDLKLENFLFINHEEESPLKTIDFGLLCSLDKLYKKRIRGHPWVQVGGVAPDKPLDSAVLTHLKQFSAMNKLKKIAIRVSIQ

SEQ ID NO: 189528 - protein, 65 aa, Glycine max
  Coding DNA Sequence Number=SeqID_72750
MEEALELSRVKDMKERMVGMERLHQLLEASRKSLSSCKTSSCCIELANGGLEKYFTEWYLLRTFC

SEQ ID NO: 189529 - protein, 761 aa, Glycine max
  Coding DNA Sequence Number=SeqID_72751
  Gene Ontology: Mol. function=nucleic acid binding; Cellular component= beta-galactosidase complex; Biological process=DNA integration
  Homolog annotation: Hit_ID=Q1S4N1; Match level="QueryCoverage=82%, HitCoverage=78%, E-value=1e-100, Identity=47%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=LRR_1; Domain location=27-48; Score=0.6; E_value=2.2e+02; Accession=PF00560.23; Description=Leucine Rich Repeat
  Pfam annotation: Domain name=LRR_1; Domain location=3-26; Score=9.7; E_value=4.4; Accession=PF00560.23; Description=Leucine Rich Repeat
  Pfam annotation: Domain name=LRR_1; Domain location=59-81; Score =11.0; E_value=2.5; Accession=PF00560.23; Description=Leucine Rich Repeat
  Pfam annotation: Domain name=zf-CCHC; Domain location=132-149; Score =16.4; E_value=0.0019; Accession=PF00098.13; Description=Zinc knuckle
  Pfam module annotation: Pfam domain module=LRR_1::LRR_1::LRR_1::RVT _2::zf-CCHC; Domain location=27-48::3-26::59-81::459-651::132-149
  Subcellular localization annotation: CTP_CleavageSite=41; ConfidenceScore=5.12e-01
MSNLDSLDLSDNSLALTFIQNWVPSFQLSKIGLRSCMLGVVGNKLSGPIPAWIGSNMQELEILSLGSNHFNGSLPLQICYLRSIQLLDLSMNNFFWATLQISKDLSTITLAELLTALQAPKQRTHETRRPDMKCHKCGQLGHVEKIFKSSKKQENVQAAVEEVDEEEIFVVSCFVTTRSTESWLIDSGCTNHMTYDQELFKDLDATYNTNVRIGNGAKIAVKDKGTIMIEGCTGLKLVPDVLYVPKINQNLLSVGQLLEKGYKVLFEDKSCMIKDSDNKELFRVQMKGKSFALNLIDEEQLVVHKVEDNTLNDVVQGLPELEEKSLIVNKSSFKPKLMKLKVFGCLCFSYIPQVKRDKLDKKAEAGIFVGYSSTSKAYRIFLPQSNKVIVIRDVLFFEEEKWSKESEKLQIQEESEEDVDDQPVRGTRSLSDIYQRCNVVIMEPVDYNEAATDSKWVSAMKEKLDMIEKHQTWELTEKPKDKNVIGVKWIYRTKLNADGSVNKHKARLVVKGYAQMFGVDFSETFSLVARLDTIRICSSWTGGESLSAEKGLVWLKASPKVLTDVGIVIVSLYVDDLLITRSSKEMSKEFKGGMKEAFEITDLGKMSYFLGMQVQQDRGEVFVSQEKYAKEILRKFKMEECKPIATLMNQKEKFSNKDGAEKVDEKLYRSLIGCLKQDVIAQSTAEAEYIVDVVAANQAIWLRKLMVDLCMEQKESTQVQKQGDVQLLYCKTENQLTDFLTKSLPQARFEYLQQKLGVCCR

SEQ ID NO: 189530 - protein, 82 aa, Glycine max
  Coding DNA Sequence Number=SeqID_72752
MTNCLPVGGLIIPVCQTFGGAYQNRKHNILAWSRVGGKEDDDGGINPVMARSRSVAVTAVTVGCSDGEFRPRTKGRGWFLPS

SEQ ID NO: 189531 - protein, 486 aa, Glycine max
  Coding DNA Sequence Number=SeqID_72753
  Homolog annotation: Hit_ID=Q1T1W2; Match level="QueryCoverage=99%, HitCoverage=99%, E-value=1e-58, Identity=37%"; Hit description=VQ
  Pfam annotation: Domain name=VQ; Domain location=181-211; Score=50.1; E_value=7.3e-12; Accession=PF05678.4; Description=VQ motif
MDSANTSGSLQSSSGADEEYDSRAESSPLSAFLTNQPQPPPPSQVVRFILPSQQQQHHHQNTHMFDPLSNYLDPITQSSTSLLNLDVMWSKTGRSESNQTDLVGLIPCSSSSVPSPHNEAFVSSQTRGNNSGAFPTLPPESGSRGLMLSVSAANNDQIQTHNNNNNCNVVRNPKKRSRASRRAPTTVLTTDTTNFRAMVQEFTGIPAPPFTSSSFPRTRLDLFASTATPTLRSNVNVNPFDPPTQPPYLLRPFAQKLQLRSLHPFPPSFSNTLPPPSTNSPTNSTSINYHQQQQQLSEHFGLAKQPFNFNNTTPDTSTLEAYHHPKYTLGNSSSVLVSRTQQQHSLEIPPNLKMGLYEELELRHDHVNTDLGCLHQNMVSSTSVGVGALSSDNNNNLSNATNSSTEWAQRTGTITNNDCDHGRGGGALSGTVNYNDIGEGAVVTNGKVHYSASSSDFHGEKGPDFTVTTAARTQGMVESWINCSSD

SEQ ID NO: 189532 - protein, 126 aa, Glycine max
  Coding DNA Sequence Number=SeqID_72754
METTGREQIKTETEGEIRGTKNGADFFDEPKKLVRVKRETEKDVVVEHCLAPKRMLPEPYSCSDWIVHVIEETLLAVALFENCSAKENLSPLPLTHWPLPYFCIVTLKTGAVGRALLPMLPSCFMK

SEQ ID NO: 189533 - protein, 372 aa, Glycine max
  Coding DNA Sequence Number=SeqID_72755
  Gene Ontology: Mol. function=sequence-specific DNA binding; Cellular component=nucleus; Biological process=regulation of transcription
  Homolog annotation: Hit_ID=Q1S1V6; Match level="QueryCoverage=82%, HitCoverage=91%, E-value=6e-52, Identity=43%"; Hit description=DNA -binding WRKY
  Pfam annotation: Domain name=WRKY; Domain location=203-263; Score =126.2; E_value=9.3e-35; Accession=PF03106.6; Description=WRKY DNA -binding domain
  Subcellular localization annotation: CTP_CleavageSite=86; ConfidenceScore=5.56e-01
MTHEDWDLFAIVRSCKAATFTATTNTETPPTTTTTTTSNTTSCSGLSQENGSFSFPNLVQPTTNGFQELQHQQLLINFNPTNTITSTSTSTSGLGINPNSTFSEVAGFIGQQQIQQSLHHHLVPAPTNHTFIGTPSTTGFDRFQQQQLQTPEQQQPQQNQPPLQAPQTSHILSPTTQPQTPRSRKRKSQQKKMVCHVTAQNLSSDLWAWRKYGQKPIKGSPYPRNYYRCSSCKGCAARKQVERSTSEPNTFIVTYTGDHKHAKPVHRNSLAGNTRTKLSTTRLPETHETVSCVIIENACSSNSELSPMSVRSDTLENEATLVPGEPDCPDTDIDPEVPSEEDEDVLIPNTGAMSDSIFLGLTNFDRDGVSTL

SEQ ID NO: 189534 - protein, 113 aa, Glycine max
  Coding DNA Sequence Number=SeqID_72756
  Homolog annotation: Hit_ID=O23624; Match level="QueryCoverage=98%, HitCoverage=98%, E-value=8e-39, Identity=70%"; Hit description=FPF1 protein
MSGVWVFKNGVFRLVENPQAEVSDRHGKGSSSKRKMLVHLPTGEVVSSYAFLEQILTGLGWERYYDGDPDLYQFHKHSSIDLISLPKDFSKFNSINMYDIVIKNPNVFHVRDK

SEQ ID NO: 189535 - protein, 95 aa, Glycine max
  Coding DNA Sequence Number=SeqID_72757
MESMMLEDKLKSCQRLKRSLTEQLSKMEENMLIIIDQYKEKVNLAASHGQMLEDEQAKVSALQVEREVREAVTELLHKVAMRWMDRFDLTLNKSQ

SEQ ID NO: 189536 - protein, 100 aa, Glycine max
  Coding DNA Sequence Number=SeqID_72758
MGSGGESKCCFNHNMYLCICERAKSETTFPRICSKESAPLTNTTPQREENFKKARAQNSKAHHSAYFGKRALEAARGAAFAEIPRFCKLIIVRVSSVMAG

SEQ ID NO: 189537 - protein, 174 aa, Glycine max
  Coding DNA Sequence Number=SeqID_72759
MDDGVPKGHGEASGCHCSGVFGCGLVRLLEAGAGARAGCCHYWSRGSCCHLWSGFCFWGFCSIRKSIEDSVVVNSKLSEEDKATLQLLVLNNNSNNIQKLLILVFLAYLGCLDLLGFLLSLDFLAPTPTQLHTSLLIELLVVIEFFIGLLLYFWTVMLIITIWGYSYFYGRFMS

SEQ ID NO: 189538 - protein, 82 aa, Glycine max
  Coding DNA Sequence Number=SeqID_72760
  Subcellular localization annotation: CTP_CleavageSite=63; ConfidenceScore=5.72e-01
MARKPRQDFSVSKPPHFFRQLSLSLTLPFSSSSFSIEAPSKASTFGHHFCPKSRKEGIFGVVKCKATSGTSKFQVWVDFFLS

SEQ ID NO: 189539 - protein, 87 aa, Glycine max
  Coding DNA Sequence Number=SeqID_72761
MAKEFVNGFVHQNDIVVITRNPLKGDSGSMYRNTFTSVFSVMAEEFVNGFVHQNGIAVITHNPPQRRFRLHARKLLSDAILSRKGIG

SEQ ID NO: 189540 - protein, 291 aa, Glycine max
  Coding DNA Sequence Number=SeqID_72762
  Gene Ontology: Mol. function=oxidoreductase activity; Biological process=gibberellin biosynthetic process
  Homolog annotation: Hit_ID=Q2HRI0; Match level="QueryCoverage=98%, HitCoverage=94%, E-value=2e-82, Identity=49%"; Hit description =Immunoglobulin/major histocompatibility complex; 2OG-Fe(II) oxygenase
  Pfam annotation: Domain name=2OG-FeII_Oxy; Domain location=166-266; Score=33.4; E_value=8e-07; Accession=PF03171.10; Description=2OG -Fe(II) oxygenase superfamily
MATQTLCESPLPVVDFINENMKPGTDTWLGACQLVRRGFEDYGCFLARFSKVGPELLNSVYYAMEELFSLPLETKRRKTSDKPNHGYTGQVPTSPLFESFAIDNPSSIEDCQKFARIMWPTGNDHLCESVNEYTKMLKELDQTVKRMVFDSYGLDKLKCESFLESTNYAFRSYKYKIPATDESSVGVNSHTDSTFITILHQRVDGLEVKLKDGEWFGVDASPLFCVMAGDAFMVWSRERIRACEHRVILKSKVPSERAQTLEDLVDEEHPIRYKPLDLYVYVGFFVSQRKP

SEQ ID NO: 189541 - protein, 35 aa, Glycine max
  Coding DNA Sequence Number=SeqID_72763
MSSIGMESFQERLGFMRGGLNGTPPKNSNVTRDYA

SEQ ID NO: 189542 - protein, 207 aa, Glycine max
  Coding DNA Sequence Number=SeqID_72764
  Gene Ontology: Mol. function=nucleoside-triphosphatase activity; Cellular component=membrane; Biological process=transport
  Homolog annotation: Hit_ID=Q6ZIW1; Match level="QueryCoverage=60%, HitCoverage=18%, E-value=3e-20, Identity=38%"; Hit description =Putative ABC transporter
MSALNTCGYVSTLFWVPLITETETETICGEPVDLEVLPFVFRDGQPLMNFQLPKQDDDFDYYGNSSQDESFPVKSFKEKDEVDAWLFSNPIRLQQRGKYEDPTALFQLPLQLAAEREIARYLIGEFGIGVSEGIRAPFHESFLYCGFKFSDPLTQAMNMMGLYDFAYWFSWLIWEAVVTILSSLLIISFDCIIMGTFSGSCYLPSKG

SEQ ID NO: 189543 - protein, 80 aa, Glycine max
  Coding DNA Sequence Number=SeqID_72765
  Subcellular localization annotation: CTP_CleavageSite=40; ConfidenceScore=5.26e-01
MATTLHLLESRIGSNGDSAAVAVAVAVRLSCARFRGARVRGGAAAVVAPLCVGLESPFAGDIQVGLDWVGSAQPVLRKFF

SEQ ID NO: 189544 - protein, 46 aa, Glycine max
  Coding DNA Sequence Number=SeqID_72766
MSLRFRSSLRALKPCAVYGPESTGRGQMPGRSWKPKLIKVLRDGRK

SEQ ID NO: 189545 - protein, 131 aa, Glycine max
  Coding DNA Sequence Number=SeqID_72767
  Gene Ontology: Mol. function=RNA-directed DNA polymerase activity; Cellular component=chromatin; Biological process=RNA-dependent DNA replication
MALEDMEKITFITMWGTFCFKVMFFGLKNIGATYQWAMVALFHDMMHKEIEVYVDDIISKSRTEEEHLVNLWKLFERLHKYGLRLNPTKCTFRVKSGKLLSFVVSQKGIEVDPDKVKAILEILKPRTEKQV

SEQ ID NO: 189546 - protein, 58 aa, Glycine max
  Coding DNA Sequence Number=SeqID_72768
  Homolog annotation: Hit_ID=Q9FMX9; Match level="QueryCoverage=59%, HitCoverage=7%, E-value=1e-10, Identity=80%"; Hit description=Serine carboxypeptidase II-like protein
MVVISLSMKLKEEHCSIGFSRQLTNQNKNPFSYGSMECICVYVLGRNRSSGGKIRGLG

SEQ ID NO: 189547 - protein, 454 aa, Glycine max
  Coding DNA Sequence Number=SeqID_72769
MDELHEQAKSYIQMEKMLRFKNKVQQARQNCDKKEGNTKTISHKSDKRHKPNKCKPLPKGPRYECYTPLTANYTTILEEAFNLEVPIRLPPMKLPGRGVINTIASRFSYGGQSNQSRNVTPYPPTREPAKPNPTTAKALTVYQASLDDKFDVDPCDNTSDRGLKPIEELVKLQLRPKLGQCTQLSRDLTSHEHKHIADVLHSNVLSFLDAYSRYNQIRMHAPDEEKMTFITEDANFCYRVYVNDMVFKSQSITQHVVDLEEVLRELRKYDMRLYPKKCTFGVGKVQKLNGGLASLSRFLPKLAEKAKLFYKLLKKTQPITPTPISLSSRRSPLPNDREGGTITHYLSLMTQTLLSESSSGPGNVTLKQALKFNFKASNNQAEYEALIAGTRLDDPDVALSGACRPWIFFINGVLSFLKINGNEMEKEKDDWRCHFKEKMSQEEAHHHRKPWIRA

SEQ ID NO: 189548 - protein, 85 aa, Glycine max
  Coding DNA Sequence Number=SeqID_72770
MDDIVRMEDLFKRWTEYLDIIQSRVCLRNSWHTMLALNPIKTQCKISLEIQVGKLVEEVAKFVATSEENFVEVEAHEESLVEEHD

SEQ ID NO: 189549 - protein, 133 aa, Glycine max
  Coding DNA Sequence Number=SeqID_72771
MEIVRKGVQNVCKLLASPTFLCEVKGVSPERWPVVASMHYLCCKGSFLYMETANSFMEFSHDIIFLLLTFHFRSQTSFSYDGNTPELGNSLGGLMQSYPARALDRRLQEDWARDAREGHRVLMSLRVDFKPMG

SEQ ID NO: 189550 - protein, 585 aa, Glycine max
  Coding DNA Sequence Number=SeqID_72772
  Subcellular localization annotation: CTP_CleavageSite=46; ConfidenceScore=5.08e-01
MGGSHSRGSIQQPLMDHEVISIGGSSSKGTRCGASNNEFSSSERLRASHCTGGGTSCLRERAWPSTASPSRDHVLVMVILSLSIFGEARRSSKDVRVSPLVQRSHSTRSPSSPLVIVGYEWVRDDVLKYKLYIASIASVTTLQRQVKLENPMDSCKMVVQACRSDDFPFLTTASGIPPFFFMYRCLFEVLGFLLPLTAFLCALLEHLNIVSKKLFEFDSNIFRRLKDYFFNVLATDVVANDLLTLMERVNKAILEHLMALLDVRPILSLSSVSDPLAALDGKHFILSCLPSLCLNCIAGSAGGTMPPSVAAPATRERGQHAVEVGLVASVVEVSCRVNTLFGSPYEFARCASSRRGSRFHRYCCCYSVPPTPHVVPIQEVTSTARVDASATSTGFIAASLSTVATPLLSVSVVTTSALVMSPPPFSPPPVPPIAVLVLKKKTPNGFVSAFDRNLIQLVRVENAIDSAKCPKVTNVIVAFAEAVRSNHQLSSKEERKDLVGKVEGIAVKRDELAKLEGELIMYKKKDVKQHEKGFNKVVRQAGFFAKHLDLGLFDSFKDMKDGVLLDEEEIVAKEEATDEEQGAKE

SEQ ID NO: 189551 - protein, 101 aa, Glycine max
  Coding DNA Sequence Number=SeqID_72773
MMTILFALPDTCKKHLVLVHNLVSNHHQAKVVAKYIQDYMVHLPPMAESIYSASLWCPMWNSLTPTTPHVASTRPMPHYTSHMQDALRESSVHTQTASKPF

SEQ ID NO: 189552 - protein, 145 aa, Glycine max
  Coding DNA Sequence Number=SeqID_72774
MVSHGGNVMPYPTQSIVKECVDRLGIKGLEMNNTLDDVSCLLHLHITICILDHIEVSYTKKEIRGQWKLELGIMADQKAYVVMFAGNRGIGMAYLTREALNQLQMADVVWVLRQFGYVPRIPLERLAYEKCSEAWGEWKQHVVLL

SEQ ID NO: 189553 - protein, 71 aa, Glycine max
  Coding DNA Sequence Number=SeqID_72775
  Homolog annotation: Hit_ID=Q60DJ5; Match level="QueryCoverage=91%, HitCoverage=22%, E-value=2e-08, Identity=42%"; Hit description =Expressed protein
MALPGGVERDAMLGEESKVGIRRVIDEPDGKEAVNGKDKGCGKRAREVVEGVYVDVNVEEVGRGGREEFVP

SEQ ID NO: 189554 - protein, 209 aa, Glycine max
  Coding DNA Sequence Number=SeqID_72776
MEDIVRMEDRFKRWTEYLDSIQSRVSHSPPINCDFCGGEHCNDNCHLYSMNNSWWGQELLLYNQYEEERTPNLEGVFAQFMAYHASSKANQNSMQNQEIHVGKSYSIENCQWEQELQPYNQYEEERGSNLDNLLKQFTETTESTQRAFKSLEIKVGKLAEEVAKFVATSEENFVEVEAHEESLVEEHYLMKKMKKKMRRKHNNGRSAHK

SEQ ID NO: 189555 - protein, 73 aa, Glycine max
  Coding DNA Sequence Number=SeqID_72777
MSELREIPSHCSIFLSRRNPELSREKNKSHDDSTSGGFNPFSVSLTFENSIGTVRGKKLEESQGTTRGATIAG

SEQ ID NO: 189556 - protein, 139 aa, Glycine max
  Coding DNA Sequence Number=SeqID_72778
  Gene Ontology: Mol. function=oxidoreductase activity, acting on the CH-OH group of donors, NAD or NADP as acceptor; Cellular component =chloroplast; Biological process=malate metabolic process
  Homolog annotation: Hit_ID=Q9M4Q9; Match level="QueryCoverage=69%, HitCoverage=15%, E-value=4e-44, Identity=90%"; Hit description=NADP -dependent malic protein
  Pfam annotation: Domain name=Malic_M; Domain location=1-96; Score= -72.4; E_value=3.5e-07; Accession=PF03949.5; Description=Malic enzyme, NAD binding domain
GSAIFASGSPFPPVEYEGKVFVPGQANNAYIFPGFGLGLIMSGTTRVHDDLLWAASEALAAQVSQENFDKGLIYPPFTNIRKISAHIAANVASKAYELGLATRALLSLTLLVASLESLSCATAETRRGTPSQCHPRCFN

SEQ ID NO: 189557 - protein, 72 aa, Glycine max
  Coding DNA Sequence Number=SeqID_72779
MRQANSSNGTTQRVKMGWHFLLCNFIPDVDNLQAFKVVSHMAPLAKDKRPPKSAILDGVSSCLHRKETLASK

SEQ ID NO: 189558 - protein, 129 aa, Glycine max
  Coding DNA Sequence Number=SeqID_72780
  Gene Ontology: Mol. function=ligase activity; Biological process =response to auxin stimulus
  Homolog annotation: Hit_ID=Q3LFT5; Match level="QueryCoverage=70%, HitCoverage=15%, E-value=5e-28, Identity=61%"; Hit description =Putative auxin-regulated protein
MREQNVNFKGGGKGFDDAEAVELLGDSFNGGGDRQKVEEFNMDKVIQEFELLTRDAERVKRETLKRILEDNASAEYLQSLGLNGRTDPESFKACVPMVTHKELEPYIYRIIDGDSSPTLTGKPITTMSL

SEQ ID NO: 189559 - protein, 377 aa, Glycine max
  Coding DNA Sequence Number=SeqID_72781
  Gene Ontology: Mol. function=oxidoreductase activity; Cellular component=integral to membrane; Biological process=electron transport
  Homolog annotation: Hit_ID=Q9I167; Match level="QueryCoverage=57%, HitCoverage=49%, E-value=3e-95, Identity=77%"; Hit description=L -sorbosone dehydrogenase
PDGKKLYVGVGSNSNITENGLAVEYRRAAVLEVDTASGASRIFASGLRNPTGLQWEPHSGKLWAIVNERDEIGADLVPDYLTSVQDGGFYGWPYSYFGQHVDRRVQPARPDLVAKAIKPDYALSSHVAPLGLLFYTANALPAEYRGGAFVSEHGSWDRSPLNGYRVSYVAFEQGKPVGKLKAVVTGFVSDDEKELYGAPVGLTVDKAGALLIADDVGNTAGVKQRLAFEAADRHAVGWAAGEHQCGVRPSMPSEQRKHATLIVARQMKEAVPGQQAVELRRQIQLAHIHLSPFLLRETLPAARDHRLSTIDAGDPIPLFDKIGGDRRAIAAAEIQQPRIGRGELQKAIEARPFKQRGGSEAFPGGGMFVIKWDNGAR

SEQ ID NO: 189560 - protein, 253 aa, Glycine max
  Coding DNA Sequence Number=SeqID_72782
  Gene Ontology: Mol. function=sugar porter activity; Cellular component=periplasmic space; Biological process=transport
  Homolog annotation: Hit_ID=UPI00005F7E5C; Match level="QueryCoverage =50%, HitCoverage=42%, E-value=1e-35, Identity=58%"; Hit description =COG1879: ABC-type sugar transport system, periplasmic component
MATPMMCAARQQIWPIAQLGRRRQHAFTRAVRDRGAGRKGARYRPFRDAGLFGDVAGGGFVVFHHGCVDPCFGEVKLYPARSDPLSARRHFCCNYVPFLHPIANLDIHGGIQRRIAVLSPALHPAKTYQVGVALANFDLNFVSILRSQMARELAAQQLQGQFVDAKGDVALQVQQVDDLINQGVNAIILNPVDTQGVQPMIAAAKRAAIPLIFVNRKPEVPLSGATAYVGSDSALSGRLQMEALAKKMNYRGN

SEQ ID NO: 189561 - protein, 232 aa, Glycine max
  Coding DNA Sequence Number=SeqID_72783
  Gene Ontology: Mol. function=aminoacyl-tRNA ligase activity
  Homolog annotation: Hit_ID=Q0K3L8; Match level="QueryCoverage=43%, HitCoverage=81%, E-value=6e-40, Identity=75%"; Hit description =Glyoxalase/Bleomycin resistance protein/Dioxygenase superfamily
  Pfam annotation: Domain name=YbaK; Domain location=1-126; Score =146.6; E_value=6.7e-41; Accession=PF04073.5; Description=YbaK prolyl-tRNA synthetases associated domain
NTATVALAAEAFGVESGQIAKTLSFRVNDGVVLLVMAGTARIDNKKYKQFFGVKARMLPAEEVESLTGYPPGGVCPFAAPAAVRIYCDRSLCRYGEVLPAGGSDNSGVRIAPQRLASITGAEWIDVTGSSGYGTPLRYCGHPGRSQMPHSSGHGNWAANRVRHCLCRRHLAQRGRTHRPVHGCLRQMPGADAPVFHRFETGTMTRYPDRDKVRRHSRVRLRQRSLRPAARVH

SEQ ID NO: 189562 - protein, 497 aa, Glycine max
  Coding DNA Sequence Number=SeqID_72784
  Gene Ontology: Mol. function=transcription factor activity; Cellular component=intracellular; Biological process=regulation of transcription, DNA-dependent
  Homolog annotation: Hit_ID=Q4J0Y4; Match level="QueryCoverage=53%, HitCoverage=76%, E-value=2e-85, Identity=61%"; Hit description =Periplasmic binding protein/LacI transcriptional regulator
  Pfam annotation: Domain name=Peripla_BP_1; Domain location=1-255; Score=-18.0; E_value=1.6e-05; Accession=PF00532.11; Description =Periplasmic binding proteins and sugar b
MKNPHSMMMLDMVTKQLQTRGYMALLLNITAGENYRAVMAMADQLQVDGILFLATVLTKEWAAIAQDLHQIPLVQVCRNTESEHIDVVNIDGYRAGEEIAALLIEQGHRRFGYMKGPDTQSSHLLRMEGYRDKLMAAGFQLDRVLTAGHYDRQRGFQLMSEYLQATPESERVEALFCENDVLALGALEALRQTAPSSAMAVVGFDDIDEAGSANWALTSYSQRIDRLVEEALNRLIDNRATADGAWRQGELRTAEVCQISRSAIKKEGILTHFAEWLSHIQALEVELHQPTTRCDPKRVAALLHEDFEEIGRSGLRYDKRQTVAALEMETDYPQIFAEGPRRALHRAFVDLASDSQGGLADAAEDRSQRDKAAGLIMGFLLRPIMPAPAAHAAELIRFSTGHKPGGLLLSATPAGNAVLATRRRSHVMHLVIHTIQRRQPFNLQQDINHFSKMRHFNGHYLYAKCALASVFIVFGAHHGVGYTEWGHIPGASPCLTM

SEQ ID NO: 189563 - protein, 247 aa, Glycine max
  Coding DNA Sequence Number=SeqID_72785
  Gene Ontology: Mol. function=isomerase activity
  Homolog annotation: Hit_ID=P54724; Match level="QueryCoverage=99%, HitCoverage=78%, E-value=1e-105, Identity=73%"; Hit description =Hypothetical protein yfiH
  Pfam annotation: Domain name=AP_endonuc_2; Domain location=1-170; Score=63.9; E_value=5.2e-16; Accession=PF01261.14; Description=AP endonuclease family 2
MEIAALNVSGNPLDPGELGQRHQRQTDNTLELAGLLGVKKIVMMSGLPPASPHDTIPNWITYTVSWPPTVKNCLDYQWNEVAIPYWQALVARAKACGVERFALENFSAMLVWNPETLFRLREAVGPMVGLNLDPSHLIWMGADPIAVARALGPAIHHVHGKDVRLERGVVEVNGLLETKPIDDVARRAWNYVAVGCGRDLQWWKAFFSVVRMMGYNDWVSLEMEDLTMSVDAGIVSSVQALQQSISQ

SEQ ID NO: 189564 - protein, 268 aa, Glycine max
  Coding DNA Sequence Number=SeqID_72786
  Gene Ontology: Mol. function=sequence-specific DNA binding; Cellular component=intracellular; Biological process=regulation of transcription, DNA-dependent
  Homolog annotation: Hit_ID=Q39LN2; Match level="QueryCoverage=95%, HitCoverage=82%, E-value=2e-96, Identity=69%"; Hit description =Transcriptional regulator, AraC family
  Pfam annotation: Domain name=HTH_10; Domain location=148-197; Score =6.3; E_value=0.0012; Accession=PF04967.3; Description=HTH DNA binding domain
  Pfam annotation: Domain name=HTH_AraC; Domain location=155-201; Score= 24.3; E_value=0.00044; Accession=PF00165.13; Description=Bacterial regulatory helix-turn-helix proteins, araC family
  Pfam annotation: Domain name=HTH_AraC; Domain location=207-251; Score= 47.3; E_value=5.2e-11; Accession=PF00165.13; Description=Bacterial regulatory helix-turn-helix proteins, araC family
  Pfam module annotation: Pfam domain module=HTH_10::HTH_AraC::HTH _AraC; Domain location=148-197::155-201::207-251
MTDDLTQPIHFREGDCFLLNSRRRFRVASDPALPPQGGEQIMAEATRDGIAVHNGGGEVFLISGRFGFSGQHAALLFDALPPIINIPKASSQAGVLRWTLEQWTNELRHPQLGGALMSTHLAHLMLVQVFRQFLETAHGLPKGWFLALTDRQISLAIAAMHAEPARNWTLEELARIAGISRTVFAQRFKGLVGSTAMEYLSRWRMLQAADRLRAGKENVASIAYSLGYGSESAFSTAFKRVMAQSPSQYRRQTPAGASEPEGKGAQRP

SEQ ID NO: 189565 - protein, 56 aa, Glycine max
  Coding DNA Sequence Number=SeqID_72787
MDKWMDTIDMGYVIASRYNIYLKDHCPLPPVALLWSSNCHPQDTIRLDYVTGHCKT

SEQ ID NO: 189566 - protein, 288 aa, Glycine max
  Coding DNA Sequence Number=SeqID_72788
  Gene Ontology: Mol. function=estradiol 17-beta-dehydrogenase activity; Cellular component=membrane; Biological process=metabolic process
  Homolog annotation: Hit_ID=Q397S0; Match level="QueryCoverage=99%, HitCoverage=100%, E-value=1e-125, Identity=78%"; Hit description =Short-chain dehydrogenase/reductase SDR
  Pfam annotation: Domain name=Epimerase; Domain location=8-248; Score=- 33.2; E_value=0.00053; Accession=PF01370.11; Description=NAD dependent epimerasedehydratase family
  Pfam annotation: Domain name=KR; Domain location=7-182; Score=-55.0; E_value=0.00036; Accession=PF08659.1; Description=KR domain
  Pfam annotation: Domain name=adh_short; Domain location=6-170; Score =93.6; E_value=6e-25; Accession=PF00106.15; Description=short chain dehydrogenase
  Pfam module annotation: Pfam domain module=Epimerase::KR::adh_short; Domain location=8-248::7-182::6-170
MNNDHKVWLITGASSGLGKALAEAAIANGDRVVVTARRLDRLRALAKGQEDRVLPLAVDVTDAAARDKAVADTLARFGRIDVLANLAGRGVAGACEEFSLEQLREQMELNFFAAAEMTRAVLPQMRRQGSGNVITVSSIAGLVAMNAAGPYCAAKFALEGWTESLAIEARPLGIHVTLVEPGAFRTEFAGDVNMRPTQRIEAYRPSIAPFETYLAQSAGRQMGDPAKAAQRMLELVTLTAPPVRLMLGRDAYAMWDTTLAKRQQELNAWRERGEDTAFDGAELTEIQL

SEQ ID NO: 189567 - protein, 60 aa, Glycine max
  Coding DNA Sequence Number=SeqID_72789
  Gene Ontology: Mol. function=hydrolase activity
  Homolog annotation: Hit_ID=UPI00006D83F0; Match level="QueryCoverage =96%, HitCoverage=19%, E-value=3e-24, Identity=79%"; Hit description =COG2220: Predicted Zn-dependent hydrolases of the beta-lactamase fold
MAQYLVERVLPGVHRQIEGAVMDRQQPAAEQIPVRLHGLLRVHMHIGPAFVVGAGFHQRQ

SEQ ID NO: 189568 - protein, 113 aa, Glycine max
  Coding DNA Sequence Number=SeqID_72790
  Gene Ontology: Mol. function=RNA-directed DNA polymerase activity; Biological process=RNA-dependent DNA replication
MAPDRIQLQNMYKKEHESFKEYAQKWRDLAAQVAPPMTEREMITMIVDMLPVFCYEKMVGYTPLSFVDLVFAGERIKMGLKRGKFDHPALTYEKTRANKEDEKGEGTHGCRSK

SEQ ID NO: 189569 - protein, 452 aa, Glycine max
  Coding DNA Sequence Number=SeqID_72791
MSTFMSDSTISLNGSDSAGLIEQSIMDWEVISIGGSSSEDTRQGASDSESFSSEKGVAFCCCRGACPDYYDTPHSASKGMRKAVSGYEWVRDDILKCKSCLTLAASVVVLQCQVKLANLEDSYKLTVQAYGNDDLSFLMAAPGRLPFFFMYKCLFEVLGVILPLTAFQCALLEHLNVAPSQLHPNRLLFKVLAIDVVADGISLMLNRVGELPLPILLGRQSHFGVDVDLIGRVGHFVSFFGERSSRCLGWPLVKQVGLAGGTVPPFVFAPFVGEGGQPAREVSPIVVAAERDDVVGPSGHKKSKAPMSLPALTQAAGLMPTADRLLTAQDVPPAPPTINHAYCSTVAPLSAIATPLLSAGVAATGALMVLPLSTSAPMASPSAILVAMASPSSFSHARISLDNLYTSSDAHSLWGEFDNSREEWIVTPRDCAKGGILGGGGRQVDGYYLYSL

SEQ ID NO: 189570 - protein, 78 aa, Glycine max
  Coding DNA Sequence Number=SeqID_72792
MKTWMQSSKRDVYLGAYLNAALKGLDDTPQPNSKAGARWIVVKYFNDVRPLEAKRLKALRIQWAQFYLKVRMLGNLGC

SEQ ID NO: 189571 - protein, 234 aa, Glycine max
  Coding DNA Sequence Number=SeqID_72793
  Gene Ontology: Mol. function=nucleic acid binding; Biological process= DNA integration
  Homolog annotation: Hit_ID=Q0KIN0; Match level="QueryCoverage=79%, HitCoverage=11%, E-value=3e-32, Identity=36%"; Hit description =Integrase core domain containing protein
MTSAGPTFSFSGTPTITTAKLNWKNYLSWSDSVELWFLGQGYYDHLKKGIDTVPSDRKSEWEKLDYQLCAVLWQSVEADVLEILRSFKTCCSFWKKAREIFANDIQSLFNATMKVTALKQTSHDMIAHISKARAAVEELKRFLVADSLEEVNKKPDKFYMVLILRSFHSDFDHVRDQVLAGDQVPSTDSLITRLLRVPHALKEENSADTVETSAMIATRGRRGGRNSKGGRSER

SEQ ID NO: 189572 - protein, 55 aa, Glycine max
  Coding DNA Sequence Number=SeqID_72794
MLMQSSKGGEPSPESRLGDSKKIGPGMQEKVGYPTRLGYPGNVGFFSPCILGHID

SEQ ID NO: 189573 - protein, 69 aa, Glycine max
  Coding DNA Sequence Number=SeqID_72795
MGAKYLEEVKRGSHPNNGWSPDEIRQKRALGGLQLAQASCCLIQKKLARLSELVPSPLSNLRAQVSQGP

SEQ ID NO: 189574 - protein, 143 aa, Glycine max
  Coding DNA Sequence Number=SeqID_72796
MEEVETNVQAYAPNIREAFFLNWFSSIRIRYLGDNSTLISSSKEDNLMEVIKNNKEWLGQWFESFSTWQSHLSSENRLIRVRIFGAPLMLWNDQGFSKFTALVGKLIKMTDEMNNMDNLEFVKVLIRTAIISPIMLFRKFSDE

SEQ ID NO: 189575 - protein, 304 aa, Glycine max
  Coding DNA Sequence Number=SeqID_72797
  Gene Ontology: Mol. function=GTP cyclohydrolase II activity; Cellular component=extracellular region; Biological process=riboflavin biosynthetic process
  Homolog annotation: Hit_ID=P0A7I7; Match level="QueryCoverage=64%, HitCoverage=100%, E-value=1e-104, Identity=94%"; Hit description=GTP cyclohydrolase-2
  Pfam annotation: Domain name=GTP_cyclohydro2; Domain location=110 -278; Score=416.4; E_value=4.1e-122; Accession=PF00925.11; Description=GTP cyclohydrolase II
KNRAVHDNQQQNGRPEAKAQAPQYPAAQNQAGQRAPRTGDGFGDPEQHAQQMPALPRLPLPAGKPYAQRHQHGPGSGYGTISAVSSGQSGPCVIMMIAHPLKVLESHMQLKRVAEAKLPTPWGDFLMVGFEELATGHDHVALVYGDISDHNPVLARVHSECLTGDALFSLRCDCGFQLEAALTAIAEEGRGVLLYHRQEGRNIGLLNKIRAYALQDKGYDTVEANHQLGFAADERDFTLCADMFKLLGINEVRLLTNNPRKVEILSEAGINIVERVPLIVGRNPKNAHYLDTKAEKMGHLLPKS

SEQ ID NO: 189576 - protein, 91 aa, Glycine max
  Coding DNA Sequence Number=SeqID_72798
  Gene Ontology: Mol. function=nucleic acid binding; Cellular component= intracellular; Biological process=transport
  Homolog annotation: Hit_ID=Q1S206; Match level="QueryCoverage=51%, HitCoverage=10%, E-value=2e-12, Identity=65%"; Hit description=RNA -binding region RNP-1 (RNA recognition motif); Nuclear transport factor 2
MVTPFPIPVTAAQVGTYFIGQYYQVLQSQPEFMHQFYSDASTMLRIDGNARETAAAMLVFVSVVCYVVVLVVRVGGKLVSKYARDLFGGVV

SEQ ID NO: 189577 - protein, 122 aa, Glycine max
  Coding DNA Sequence Number=SeqID_72799
MEDIVRMEDLFKRWTEYLDSRQSRVSHSPPINCDFCGGEHCNDNCHLYSMNNSWWGQELLPYNQYEEERTPNLEGVFAEFMAYHASSKANQNSMQNQEIHVGKSYSIENYQWEQELQFLQSL

SEQ ID NO: 189578 - protein, 95 aa, Glycine max
  Coding DNA Sequence Number=SeqID_72800
  Homolog annotation: Hit_ID=Q2HV31; Match level="QueryCoverage=66%, HitCoverage=10%, E-value=8e-18, Identity=71%"; Hit description =Prefoldin
MAKGTKMVKKKKRKRRRVVLIWSAAMQLYRGIQNNKAKVRLQELRKKLNSVRESKQLAIEVAEVVNNKAKQLEQALSQKAIRYEAWKQELEHERK

SEQ ID NO: 189579 - protein, 104 aa, Glycine max
  Coding DNA Sequence Number=SeqID_72801
  Homolog annotation: Hit_ID=Q2HTU1; Match level="QueryCoverage=35%, HitCoverage=5%, E-value=3e-10, Identity=81%"; Hit description =Tetratricopeptide-like helical
MTNANCPQESLHSVSNGNLRDFKETIISMKAEAEIKQQDYKEEVVADHASIMPMIDLLPTAYRDAGSGIALKTLKRVQKAWGQGSISSLLPQQNDFLDYYDCSG

SEQ ID NO: 189580 - protein, 76 aa, Glycine max
  Coding DNA Sequence Number=SeqID_72802
  Homolog annotation: Hit_ID=Q60DJ5; Match level="QueryCoverage=92%, HitCoverage=22%, E-value=9e-09, Identity=43%"; Hit description =Expressed protein
MALPYGVERDAVLGEESKVGIGRVIDERDGKEAVNGRDKGWGGTKGGKRAHEVVEGVCVDVNVEEVGRGGREEFVP

SEQ ID NO: 189581 - protein, 99 aa, Glycine max
  Coding DNA Sequence Number=SeqID_72803
  Gene Ontology: Mol. function=transferase activity; Cellular component= integral to membrane; Biological process=transport
  Homolog annotation: Hit_ID=Q2HVW5; Match level="QueryCoverage=75%, HitCoverage=12%, E-value=1e-17, Identity=51%"; Hit description =Nucleoporin interacting component; Protein prenyltransferase
MEIVPLTGRPIAEKKASVYAEAALGVGVGNLQRIRAFLWIRLRDYGVLDFDAGNARRLPLVDTTWQQLAEWINKGGMVPEEIAAAATEECERMLIVITH

SEQ ID NO: 189582 - protein, 213 aa, Glycine max
  Coding DNA Sequence Number=SeqID_72804
  Gene Ontology: Mol. function=aminoacyl-tRNA ligase activity; Cellular component=mitochondrion; Biological process=tRNA aminoacylation for protein translation
  Homolog annotation: Hit_ID=Q2KXE5; Match level="QueryCoverage=99%, HitCoverage=23%, E-value=1e-112, Identity=91%"; Hit description =Leucyl-tRNA synthetase
  Pfam annotation: Domain name=tRNA-synt_1g; Domain location=2-213; Score=-206.2; E_value=6.2e-07; Accession=PF09334.1; Description=tRNA synthetases class I (M)
MLPYPSGKLHMGHVRNYTINDMMARQLRMRGYNVLMPMGWDAFGMPAENAAIKSKVPPAKWTYDNIAYMKKQMKAMGLAIDWSREMCACDPEYYKWNQWLFLKMLEKGVAYRKTQVVNWDPVDQTVLANEQVIDGRGWRSGAPVEKREIPGYYLRITDYSDELLGAVQNDLPGWPERVRLMQENWIGKSKGLRFRLPAPYHRPGRPVDPGRQA

SEQ ID NO: 189583 - protein, 181 aa, Glycine max
  Coding DNA Sequence Number=SeqID_72805
  Homolog annotation: Hit_ID=Q9FKL4; Match level="QueryCoverage=58%, HitCoverage=42%, E-value=4e-15, Identity=43%"; Hit description =Arabidopsis thaliana genomic DNA, chromosome 5, P1 clone:MUA2
  Subcellular localization annotation: CTP_CleavageSite=61; ConfidenceScore=5.01e-01
MCLFHASTHVLQQWSLSLAKTLSDFLSFPDPANALPTLPHPQSPHSTLRLPPHHQRVPIVMASNLLADEEGVGPPLELLCKTLYAWEEAVSPLLATEREGLVPKDSTVLETLGECLNDVAEWGASKERLLVKLPVQDLLARFDVTCTAFVGDGRLGGISGTISAYESPLMLWMLFLRITIF

SEQ ID NO: 189584 - protein, 92 aa, Glycine max
  Coding DNA Sequence Number=SeqID_72806
  Homolog annotation: Hit_ID=Q9FR59; Match level="QueryCoverage=39%, HitCoverage=4%, E-value=5e-12, Identity=89%"; Hit description =Homeobox 1
MTLEDSLALFSVLPLLFGFLFLLNESLTSSVTKTLGMSAFQDGEDGDEDENAQEEDEEDISHDDYNQVASAMTTFVWMKMRLETTLQAHFCY

SEQ ID NO: 189585 - protein, 143 aa, Glycine max
  Coding DNA Sequence Number=SeqID_72807
  Gene Ontology: Mol. function=N-acetyltransferase activity; Biological process=metabolic process
  Homolog annotation: Hit_ID=Q2KXD6; Match level="QueryCoverage=99%, HitCoverage=81%, E-value=3e-32, Identity=49%"; Hit description =Putative acetyltransferase
  Pfam annotation: Domain name=Acetyltransf_1; Domain location=59-140; Score=73.4; E_value=7e-19; Accession=PF00583.14; Description =Acetyltransferase (GNAT) family
MLTLRPFAPADYALLSSWFNCLSEVVQWGGSHLSYPLAQADLDAMLREGQVQPPTRRCWMACRGDTPVGHVQLAYDWRDVNARLGRVAIAPAERGQGLAGPMVTLMIDEAFCTPGIERLELNVYMFNQPAIRTYHKLGFTFEG

SEQ ID NO: 189586 - protein, 103 aa, Glycine max
  Coding DNA Sequence Number=SeqID_72808
  Gene Ontology: Mol. function=lyase activity; Biological process =aromatic compound metabolic process
  Homolog annotation: Hit_ID=Q2L0L9; Match level="QueryCoverage=89%, HitCoverage=35%, E-value=1e-18, Identity=51%"; Hit description =Putative hydratase
MAGVDSIDDKAQFQDAKVAIGQFQVAVCGHVQIARVRAGDDVLARGQRQALFAQEIGEPVHSGLGVAVGMDAEMLLDFGAINGHRDGHTGSRGVRRGDTRAQN

SEQ ID NO: 189587 - protein, 132 aa, Glycine max
  Coding DNA Sequence Number=SeqID_72809
MASRKRTRTNDIPSSSILAPQSATIGPDLEAQLPLVRPNEAAPPKLAPARVEPMPAEPRSLVVNPPPSPELEVVPPSPPLIIISDASSDETIAPPDSPAGETADPPNSSVGGIAYLSDSSSGEVVALTDSPV

SEQ ID NO: 189588 - protein, 459 aa, Glycine max
  Coding DNA Sequence Number=SeqID_72810
  Gene Ontology: Mol. function=transferase activity; Cellular component= nucleus; Biological process=flavonoid biosynthetic process
  Homolog annotation: Hit_ID=O64470; Match level="QueryCoverage=98%, HitCoverage=99%, E-value=1e-72, Identity=37%"; Hit description =Putative anthranilate N-hydroxycinnamoyl/benzoyltransferase
  Pfam annotation: Domain name=Transferase; Domain location=1-453; Score=308.7; E_value=1.1e-89; Accession=PF02458.6; Description =Transferase family
MVTIVASYNVTPNQPTPKDPLWLSDSDLIGNLGHISVIYIYKAKHNTDTIERLRNSLSKILVYFYPVAGRLNLTKSGRIEVDCNAKGVRLLEAETTKTFGDYGDFSPSESTEELVPKVDNTQPREEIPLLLLQLTRFLGGDEGLAIGVTFAHPLIDATGLIHFINSWAKLARGEALEPNEMPFLNRTILKFQHQPSSSQVLGSSETEFDPHKHDLEKPIAQTPLGVERKKVSASILKLTSSHLERLKKKANDQPSKEGSRPYTRFEVVAAHIWRCASKARESGENHPTLVTFSVNFRNRLNPPLPQNYFGNALAKVVTPECYEGDIISNPLGFAAQKIREAAQMVTDESIRSQLHASLGQGQLNHIRAFFTGHAHSINIPFDVNHSIFLTSWMNMPVYESDFGWEKPLHFGIVSRAQVDRATILPSPDGDGVVITIFFQTALMELFLKFFFEDMDNMEI

SEQ ID NO: 189589 - protein, 155 aa, Glycine max
  Coding DNA Sequence Number=SeqID_72811
  Subcellular localization annotation: CTP_CleavageSite=64; ConfidenceScore=5.18e-01
MRGAVTKMFMTLRLCISTILGKKTRFREQKSSRSAFVTLPRHSREQICEDFPPFFVRSSFFNPLSSLVTDAWGANTFPVRKNNSRTFRKLKFVDYTFPVFPTFFSNKRWWRLCAFSFLGRRTREPRVALPPKGRLRQLAMVFGELGQSLSVHSLP

SEQ ID NO: 189590 - protein, 101 aa, Glycine max
  Coding DNA Sequence Number=SeqID_72812
  Subcellular localization annotation: CTP_CleavageSite=55; ConfidenceScore=5.85e-01
MKDCRNTSSRDVSSTSKTSQSLTNSSQALKTASSSSSANMHNSSFFQILPRAHPRIVALSGWLAKPTGWHSERVKISTIQTHLIHLKLREKMIVKHTKWKY

SEQ ID NO: 189591 - protein, 108 aa, Glycine max
  Coding DNA Sequence Number=SeqID_72813
  Subcellular localization annotation: CTP_CleavageSite=61; ConfidenceScore=5.19e-01
MPIFMDPSSPRLAFGSLGPLNSFMMKKPTCLGELIASVLSFSLPRRAPAHLGELQLPQRFQGSEVEGIERTKKEEEERRGNKVEALPNHDYDQTLYHFLFGVLRVTIG

SEQ ID NO: 189592 - protein, 116 aa, Glycine max
  Coding DNA Sequence Number=SeqID_72814
MNELVNIPTYGEAKWRANGDEREVVVERTNETNSVTVIISSMVEMDIGVKPIGQNLHQGVEAMLSKFILMMPKTQVKNQESNKFQESKSHSIKNQDSSEVSREDSRYARTSRKASR

SEQ ID NO: 189593 - protein, 111 aa, Glycine max
  Coding DNA Sequence Number=SeqID_72815
  Homolog annotation: Hit_ID=Q2HRG4; Match level="QueryCoverage=70%, HitCoverage=5%, E-value=1e-07, Identity=38%"; Hit description =Ribonuclease H
MAQYIAFIRAFEMLQTHPTRITDMHYSYNRIILPSLLSDNHSLTDRMLIEVAQLAVRDPRPSRFRGLFRDSLGAWLSGLYGFFNYTTNVNLELHAILNGLPLAWQKELKNF

SEQ ID NO: 189594 - protein, 100 aa, Glycine max
  Coding DNA Sequence Number=SeqID_72816
  Gene Ontology: Mol. function=nucleotide binding; Cellular component =chloroplast; Biological process=response to heat
  Homolog annotation: Hit_ID=Q43532; Match level="QueryCoverage=91%, HitCoverage=17%, E-value=4e-22, Identity=51%"; Hit description=HSP70
MEKFLATYMETVDRCFNDAKMDKSSVHDVVLVGGSSRIPKVQQLLQDFFHGCIVVWRHYECSRLVLLDVAPLSLGVLVQGYLMTVVIPRNTTIPVKRTWV

SEQ ID NO: 189595 - protein, 111 aa, Glycine max
  Coding DNA Sequence Number=SeqID_72817
  Gene Ontology: Mol. function=structural constituent of ribosome; Cellular component=small ribosomal subunit; Biological process =translation
  Homolog annotation: Hit_ID=Q01D50; Match level="QueryCoverage=49%, HitCoverage=14%, E-value=1e-12, Identity=63%"; Hit description=[J] KOG0900 40S ribosomal protein S20
  Pfam annotation: Domain name=Ribosomal_S10; Domain location=2-73; Score=4.2; E_value=3.4e-05; Accession=PF00338.12; Description =Ribosomal protein S10pS20e
MTVCADLVRGAKDKRLTVKGPVRMPTKVLNITTRKSPCGEAFDKFNTTHQQLPNILISGLLNISKLTLLREPRRRERGRGYDNSQFTMIGLDSGATETAEAFGAATGFNSR

SEQ ID NO: 189596 - protein, 87 aa, Glycine max
  Coding DNA Sequence Number=SeqID_72818
MAIEDQQISFDLFHEEKALTDQNVCLKGLGKTLEPHKGNAYKRGEDPSIMLEIAMNAQSAPVALSQFIAIVNFLNFQMIGPRPTMSR

SEQ ID NO: 189597 - protein, 105 aa, Glycine max
  Coding DNA Sequence Number=SeqID_72819
MMKEWVTCNIRRSKSQDIHENHPSNPTMACSELQNKERETRLKRAIVATYPSAGGRHVTRVPRKQYARSRHQRLFEENVGKTGKDAIYKLLSKRFGSCIYARGRY

SEQ ID NO: 189598 - protein, 211 aa, Glycine max
  Coding DNA Sequence Number=SeqID_72820
MEKLRQRHRAEKKQQHSAADALRPGAWQYNALMDDLERGPLPISALAPLYSDEEEDEDDDDAIDDQYDNDGDEGFINIKSKSINCILSERPVRMRSNDRGFLREHVVVVEEEEEEEEEEEVEEEEENENEDDDVLGLSMEMRVFAERFIGMESLKMEMMKETERCRLEMEKKRIQMILESQRRIVDSIGMVLNCGCDCGFIAILDIVGKCG

SEQ ID NO: 189599 - protein, 53 aa, Glycine max
  Coding DNA Sequence Number=SeqID_72821
MDDQWVNCTRLTKLHRGTPDLVFAKKYGGGRCPEMAVGSKQQAEWDQPALMPS

SEQ ID NO: 189600 - protein, 120 aa, Glycine max
  Coding DNA Sequence Number=SeqID_72822
MWMPDNRTLTLRISLPIPLIHSIPIPSPLQLQPLSVLIPNMKRGEPNHFVKLVQNIPKRDTLPPTFNPSKNAAIRCSTPRDNRTEVMCDAKSRSQRRCHRCCKREQHCLCEFGTQGFYTC

SEQ ID NO: 189601 - protein, 102 aa, Glycine max
  Coding DNA Sequence Number=SeqID_72823
MPGLSRDLVEHRLPICEGKKSVKHVPRRFAPNVMKAIKAEIERLLNAKFTTRKNLLCGHPPSRCHHPSLPAPPALLRSKPPSPPWMLAGPLTPTLSRSPGTK

SEQ ID NO: 189602 - protein, 321 aa, Glycine max
  Coding DNA Sequence Number=SeqID_72824
MASRKRKSIGSRPTSQYDTRRFSSLNDWTRYTDNVLGRNILPERKVDIYHSELDEFKAKLERRNFHKRLTNLVGGRIDLALVKEFYANLYSYEDHPPKQSRVRGHLVKIDADSLNTFLETPVVLAEGETLPAYSRYRRLPTDYIEIEVTLCIPGRGFILNSEGHFGKNWAALMASRKCKSIGSRPTAQYDTRRFSSLDAWTRYTDNVQGRNILPERKVEIYHSELDEFKAELERRNFHKRLTNLVDGSIDLALVKEFYANLYSYEDHPPKQSRVRGHLVKIDADSLNTFWETPVVLAEEETLPAYSKYRRLPTDYKEIEAA

SEQ ID NO: 189603 - protein, 87 aa, Glycine max
  Coding DNA Sequence Number=SeqID_72825
  Subcellular localization annotation: CTP_CleavageSite=71; ConfidenceScore=5.33e-01
MCAKLIRVALSGTMKFRKFTKYRGLASQARFAQWLPQSNALSLGRMSVHPHKMNSLSTLGLAHRSGAWRILQVKKPATLTKPGSRSA

SEQ ID NO: 189604 - protein, 87 aa, Glycine max
  Coding DNA Sequence Number=SeqID_72826
MDWVVLEGHRKYRGGGDRQWWWRMMSPCTSLMILPFGEVSENFNWCGAALERERGDMSVLNLEREKLYLKIGMAGNQLHTIIIDYKC

SEQ ID NO: 189605 - protein, 140 aa, Glycine max
  Coding DNA Sequence Number=SeqID_72827
  Gene Ontology: Mol. function=transposase activity; Biological process= transposition, DNA-mediated
  Homolog annotation: Hit_ID=Q8LE10; Match level="QueryCoverage=65%, HitCoverage=34%, E-value=1e-09, Identity=37%"; Hit description=HVA22- like protein i
MNWRGAVAVLVYATVLWYLFEPVGYNFLSFVIKVFANKLPLYSEAKLAFFVYLWYPKTEKKIDDNCLELKVKAIDFVGFTWHGALICGQKGLGGILNRVTSQATLQPPTDQVHMDKQGSCREVTLMKQIVQCILLGHVHL

SEQ ID NO: 189606 - protein, 647 aa, Glycine max
  Coding DNA Sequence Number=SeqID_72828
  Homolog annotation: Hit_ID=Q9ZTZ4; Match level="QueryCoverage=9%, HitCoverage=21%, E-value=4e-10, Identity=50%"; Hit description=IFA -binding protein
  Pfam annotation: Domain name=DUF593; Domain location=278-371; Score =150.1; E_value=5.7e-42; Accession=PF04576.6; Description=Protein of unknown function, DUF593
MASSSQETHSWTLGGLIGAFIDLVLAYFLLCGSAFAFFVSKWFRFFGLCLPCPCKGSFGFRSSRFCVHRLLFEWPSRKICSIQVMAVKRFPFDLVWVKGHSCSANDKVVTERTHDNRVVELEDEASCSSCSGPCLLPFVDWENVYDAKGKRVMSMKRRSGVRCHRRASYDCAKVSSAVPSENLQSDVVLIPCSPCDGSIIRDKTNAGMSPTSGKGVSVDDAKDDQTGHDLDEKTCHSYDFNGSMVDSPGHDKCLLSLEHYINNVCDNVQIVGNEEDRVKMLENALEEEKAAYAALYLELEKERAAAATAADETMAMISRLQEEKASMELEMRQYLRIIEERVAYDEEEMDILQEILIRRERENHFLEKELDTYRQMDSKGSDQSYGKAKVQHDQWGQRPPILVGTYENRSTRSFVKKDEIKDISSNYMVSQTYSNTKDGLDLEKNTEHKDQVHVNLHSSFYDTDPNVFDVHVINDNIKLREEQNEKLSISSLSTVTNELTNRYLEFGGQTVQSSDVLSNRRRTDKPENGNGVDGPTSHLSMFSNSRCRTLSLDSGSDSSSAVENEKLKIGNEIEILGERLRMVKHEKEKLSFFSENGESEKGQLPCPLPHLSLKWFTMLLPYETNDKDLLKFDTTLQIQVQNMDRTR

SEQ ID NO: 189607 - protein, 61 aa, Glycine max
  Coding DNA Sequence Number=SeqID_72829
MVVQVRMVGILGIEINGGGTIADDKGTVGQSQSFGFGGKTERRKEMKDEDEEGDKRRRQGR

SEQ ID NO: 189608 - protein, 46 aa, Glycine max
  Coding DNA Sequence Number=SeqID_72830
MMNQTRVFEGVKGKAKILSTLDIVVENPNKLKVVALAAGCYSSCRP

SEQ ID NO: 189609 - protein, 84 aa, Glycine max
  Coding DNA Sequence Number=SeqID_72831
MTTKLLSEGRTRPRGRDAASHAPEHPQRAGLLAQVARPGDQPSSSGRGGASTTQEPDIEEPPVPAPPAAEKETTPDQKMYIISR

SEQ ID NO: 189610 - protein, 34 aa, Glycine max
  Coding DNA Sequence Number=SeqID_72832
VAGCIICGGTHEYGCCIPVEEQTTHKVNYMGNQP

SEQ ID NO: 189611 - protein, 228 aa, Glycine max
  Coding DNA Sequence Number=SeqID_72833
MGEMHEIPHHNLADFEPCLGYATEGQAVWRALNFSPNHNPCIPQRLFQVPNVVTPLKFKVPDFDKYKGTTCPKNHLKMYYRKMGAYTKDEKLLIHFSQESLTEAAATWYTNLEPSRVHSWKDLMVVFVRQYQYNSNMASDRMQLQNMGKKGYESFKEYAQMWKDMAAQVVPPMTEREMITMIVDTLPVIEVSLKRGKFDHPALTNEKTGANEEDENEGETLAMTVIPT

SEQ ID NO: 189612 - protein, 71 aa, Glycine max
  Coding DNA Sequence Number=SeqID_72834
MKHKVHRVRSLVLEARCLHRGEQPLPHPEVMKTSSLDDDWPCEIAIFPQGLLDWKNDGQRKEYNGSKNVKN

SEQ ID NO: 189613 - protein, 104 aa, Glycine max
  Coding DNA Sequence Number=SeqID_72835
  Gene Ontology: Mol. function=transferase activity, transferring nitrogenous groups; Biological process=amino acid and derivative metabolic process
  Homolog annotation: Hit_ID=Q4ZJF7; Match level="QueryCoverage=80%, HitCoverage=20%, E-value=6e-27, Identity=69%"; Hit description =Tyrosine aminotransferase
MAFLDWQAALPQIIAHTEEVFFKKTIDNLRHAAYICCKELKDNPYIICPYKPEGSMAMMVRLNLSLLEDISDDIDFCFKLAKEESVIILPGPIGRKGNSKNKEC

SEQ ID NO: 189614 - protein, 204 aa, Glycine max
  Coding DNA Sequence Number=SeqID_72836
  Gene Ontology: Mol. function=transferase activity, transferring nitrogenous groups; Biological process=amino acid and derivative metabolic process
  Homolog annotation: Hit_ID=Q4ZJF7; Match level="QueryCoverage=48%, HitCoverage=23%, E-value=2e-48, Identity=91%"; Hit description =Tyrosine aminotransferase
MFLFTRVFHLAALRIPFLECSSLEKLLCAYLRYIAHVAATISTLTLIYLQRQIHGKTTGQYHFEPRAVPRAALEDVQFSWIREVPQPHEDFTAEQEQEEERDEGASTGDVYITCGCTQAIDVSVAMLARPGANILLPRPGFPLYELSASFRGVEVRHYDLLPEKGWEVDLDVVEALADQNTVALVIINPGNPCGNVYSYHHLEK

SEQ ID NO: 189615 - protein, 337 aa, Glycine max
  Coding DNA Sequence Number=SeqID_72837
  Subcellular localization annotation: CTP_CleavageSite=36; ConfidenceScore=5.02e-01
MTTPPSSLPPPESAPLLSTPKKTRKATWLRLLATIPVGMEKPMVHMDPTTGKVDGPQRKKLWTYLGIIARDNVDVTFVNWKKVPTTEFDIPEAFDQRTKKIILKTVGKGWRQFKSDLTFKWALAQGKEEEDDTVYEKYGITKEKLIQFCQSRKDPSWENVRKKAQAIQKLNIPPHVLSRGVSIGQFCRPWMSECADNCHWVTKALWSCPCCWSRCDDQTILWTSFKNLSHIYVDHSLRVASINRKYYGVADTEISDKLEQSINEKDPNTGELDKFGLYVDDNPSCLIALGKVYEGSTTVHKVPLGNDQVKVGLEEVRDADAHVPVPHSRGSISIAIP

SEQ ID NO: 189616 - protein, 70 aa, Glycine max
  Coding DNA Sequence Number=SeqID_72838
GPGILALITGVCRFYGVPVAPNKPRDSQQLAADSPPPPPESTSAHLQRLEHCLRYMADQQAPNHQDRYEQ

SEQ ID NO: 189617 - protein, 164 aa, Glycine max
  Coding DNA Sequence Number=SeqID_72839
  Gene Ontology: Mol. function=inositol or phosphatidylinositol phosphatase activity; Cellular component=integral to membrane; Biological process=metabolic process
  Homolog annotation: Hit_ID=Q8FVV6; Match level="QueryCoverage=84%, HitCoverage=52%, E-value=2e-30, Identity=43%"; Hit description =Inositol monophosphatase family protein
RFNRLAVRAAKAQQPLVEPLRAVCLNALVIHPGTFAAAGVEGFLMIRIADYANHRLIVADNRQRDAPVVQAVKKAAGAVNRIDDPDKARAADVTAALFTQHRIVRKTLMNQVFYQQLNVAIRLTDHILQILLVLHHQLMALLIPRQRAAGGGFRHLTGIVITGI

SEQ ID NO: 189618 - protein, 367 aa, Glycine max
  Coding DNA Sequence Number=SeqID_72840
  Gene Ontology: Mol. function=calcium ion binding
  Homolog annotation: Hit_ID=O82062; Match level="QueryCoverage=91%, HitCoverage=95%, E-value=1e-140, Identity=72%"; Hit description=39 kDa EF-Hand containing protein
  Pfam annotation: Domain name=efhand; Domain location=253-281; Score =10.2; E_value=1; Accession=PF00036.22; Description=EF hand
  Pfam annotation: Domain name=efhand; Domain location=299-327; Score =5.4; E_value=3.7; Accession=PF00036.22; Description=EF hand
  Pfam annotation: Domain name=efhand; Domain location=32-60; Score =20.9; E_value=0.0045; Accession=PF00036.22; Description=EF hand
  Pfam module annotation: Pfam domain module=efhand::efhand::efhand; Domain location=253-281::299-327::32-60
MGSKKKNGGKGEIVDGSKIMELVGNEKVFSNFVDHKFDELDKDRDGKLSMKELEPAVADIGAGLGLPAQGTSPDSDHIYFEVLNEFTHGKQEKVSKTEFKEVLSDILLGMAAGLKRDPIVILRMDGEDLLEFVNGPSYEAEMASIFSQIESPSGSFREHVIEAFGRLTVDQGIPPTSDSWVFNNIVDPALSQGGPALDKPASQETFLEEFKKVALSVVDFLKEKPVIVAHSENTFDGRGVKRLLSNKFELDRTLNLALENLPKDRNGKISKDYLRVALDLVSPSAGLPPVGAIEEIDKVIVEAFKMVNAEDTKTVKEDEFKKILTEILGSIMLQLEGNPISVSSNSVVHEPLGSSSTLLQPSSSETA

SEQ ID NO: 189619 - protein, 192 aa, Glycine max
  Coding DNA Sequence Number=SeqID_72841
  Gene Ontology: Mol. function=hydrolase activity, acting on glycosyl bonds; Cellular component=membrane; Biological process=metabolic process
  Homolog annotation: Hit_ID=Q1WLP5; Match level="QueryCoverage=98%, HitCoverage=34%, E-value=2e-93, Identity=79%"; Hit description =Neutral/alkaline invertase
  Pfam annotation: Domain name=Invertase_neut; Domain location=1-185; Score=28.1; E_value=5.2e-17; Accession=PF04853.3; Description=Plant neutral invertase
MPHHGGYFVGNVSPARMDFRWFCLGNCIAILSCMATPEQSIAIMDLIESRWDELIGEMPVKVCYPAIESHEWRLVTGCDPKNTRWSYHNGGSWPVLLWLLAAASIKTGRPQIARRALNIAESKLLKDNWPEYYDGTTGRYVGKQARKFQTWSIAGYLSARMMLDDPSHLGLVALEEDKHLQPLLKRSTSSTF

SEQ ID NO: 189620 - protein, 188 aa, Glycine max
  Coding DNA Sequence Number=SeqID_72842
  Gene Ontology: Mol. function=methylthioadenosine nucleosidase activity; Biological process=nucleoside metabolic process
  Homolog annotation: Hit_ID=Q8W162; Match level="QueryCoverage=62%, HitCoverage=45%, E-value=3e-49, Identity=77%"; Hit description =Methylthioadenosine/S-adenosyl homocysteine nucleosidase
  Pfam annotation: Domain name=PNP_UDP_1; Domain location=2-148; Score=- 84.8; E_value=0.0086; Accession=PF01048.10; Description=Phosphorylase family
MIMYVAKNIMVQSQINGFAKGASIGDVFIVSDCAFHDRRIPIPVFDLYGVGVRKTFEAPNLVKELNLKVGKLSTGDSLDMTQQDESSIIANDATVKDMEGAAIAYVSDLLKVPAMFVKAVTDIIDGDKPTAEEFLQNLAAVTAALDLAVEQALLHGFCYLFEIQTLIKDNVLVLSSSTNLLDFDLMAG

SEQ ID NO: 189621 - protein, 719 aa, Glycine max
  Coding DNA Sequence Number=SeqID_72843
  Gene Ontology: Mol. function=GPI anchor binding; Cellular component =membrane; Biological process=root hair cell differentiation
  Homolog annotation: Hit_ID=Q8L8Q7; Match level="QueryCoverage=54%, HitCoverage=90%, E-value=1e-103, Identity=46%"; Hit description =COBRA-like protein 2 precursor
  Pfam annotation: Domain name=PNP_UDP_1; Domain location=431-672; Score=-60.4; E_value=0.00014; Accession=PF01048.10; Description =Phosphorylase family
  Pfam annotation: Domain name=Phytochel_synth; Domain location=36-200; Score=162.1; E_value=1.4e-45; Accession=PF04833.5; Description =Phytochelatin synthetase-like conserv
  Pfam module annotation: Pfam domain module=PNP_UDP_1::Phytochel _synth; Domain location=431-672::36-200
MAKVIGIATDCYDPLDPNGNISVTFDILERTTDNGYLARVTLENYYQYRHVEKPGWKLGWTWANNEVIWSMSGAIATDRGNCSSYSGSQMPHSCKKDPTIVDLSLDVSQNRSEHCCRGGLLSAWSIDPFNAFSSFELEVRNVGDNNPLGQAPNNLTLMAPGPGYTCSPLLDTDLSVSSDFGGLRQVPVLRTWKSTCAYSSFIANTIPVCCVSLSSFYNPAITSCRNCSCGCREADKSTASCIRPSSLPRSNGDNTIDEIIECTDHMCPVRVHWHFKNNYMNQWRVKLTVSNYNYNRNYSNWNVLVQHPGFTQKARTYSFNSTRLPTLGLQDYYNNELVHSDKGVVGLVTTEILLDKDPNSFTVSNGWAFPRRIYFNGENCEMPLPDTFPMLPNGSSSLRATYCGVEGKWTFAFHVFTLIEVSIYAQWCRFPQGAPWVHYHGTFKDLNINLIWTGNDPTLGVDSIGTIPSALATYAAILALQPDLIINAGTAGGFKAKGASIGDIFVVSECAFHDRRIPIPVSVIPLDCNEWNNLLVVVVFSYYVCDRGEVGKRVEVLPSTSICDVLQIFDLYGVGLRKAFETPKLVKELNLKVAKLSTGDSLDMTQQDGSLIIANDATVIDMEGAAIAYVADLLKVPAIFIKAVTNNVDDDKAIVEEFLQNLAALTVELGLAVEQELEASSETPLVTGAQDFQGIVYPWTDSDWDERGAIKKSSNNYTS

SEQ ID NO: 189622 - protein, 151 aa, Glycine max
  Coding DNA Sequence Number=SeqID_72844
  Subcellular localization annotation: CTP_CleavageSite=33; ConfidenceScore=5.49e-01
MQNSPTVIAAPPPLPLPLPPPPGSGGTLPTRRRARRRRVPGGDEGPANGGGDGKGRTVIWKMELGALTKGGSSGKGMTFIWPAGLHGGGKGSGGGATKTLGEFCIVTDKENGGMVGSTVGNLVEDTTKEIRIKWVGGREGGRERWGQRDKM

SEQ ID NO: 189623 - protein, 105 aa, Glycine max
  Coding DNA Sequence Number=SeqID_72845
MGYGRSRASSVLDGFTLNPVPYPVMLILSLILLFLGISGWMLLATPVVLILVVRWLSSVYTSEWFFFNSLPLERRRRTHHFPSEGSSPRGVAACSRASSFSVHFS

SEQ ID NO: 189624 - protein, 295 aa, Glycine max
  Coding DNA Sequence Number=SeqID_72846
  Gene Ontology: Mol. function=hydrolase activity, acting on glycosyl bonds; Cellular component=membrane; Biological process=metabolic process
  Homolog annotation: Hit_ID=Q9SW48; Match level="QueryCoverage=95%, HitCoverage=48%, E-value=1e-110, Identity=72%"; Hit description =Invertase-like protein
  Pfam annotation: Domain name=Invertase_neut; Domain location=97-294; Score=37.8; E_value=1.9e-17; Accession=PF04853.3; Description=Plant neutral invertase
MSLFPTDRSHNGSFKSPEALVSVSETEEFDFSKALDRPRALNIERQRSCDERSMSELSIGFSPRQLATKVDSSSRLGDLLDHLHSPLPKSGINTPRSVTLDPQIPPPLTLEAWEELRRSLVYFRGQPVGTIAALDNSDEKLNYDQVFIRDFVPSALAFLMHGETDIVKNFLLKTLRLQSWEKKIDRFQLAEGVMPASFKVFHDPVRNHETLIADFGESAIGRVAPVDSGFWWIILLRAYTKATGDPSLAERPECQKGMRLILSLCLSEGFDTFPTLLCADGCCMIDRRMVSFLKF

SEQ ID NO: 189625 - protein, 319 aa, Glycine max
  Coding DNA Sequence Number=SeqID_72847
  Gene Ontology: Mol. function=receptor activity; Cellular component =integral to membrane
  Homolog annotation: Hit_ID=Q5Z9P4; Match level="QueryCoverage=91%, HitCoverage=98%, E-value=2e-73, Identity=44%"; Hit description =Permease-like
  Pfam annotation: Domain name=DUF6; Domain location=40-167; Score =16.9; E_value=0.0072; Accession=PF00892.11; Description=Integral membrane protein DUF6
  Pfam annotation: Domain name=DUF803; Domain location=27-286; Score =386.9; E_value=3.2e-113; Accession=PF05653.4; Description=Protein of unknown function (DUF803)
  Pfam annotation: Domain name=DUF914; Domain location=51-304; Score= -213.0; E_value=0.055; Accession=PF06027.3; Description=Eukaryotic protein of unknown function (DUF914)
  Pfam annotation: Domain name=TPT; Domain location=31-167; Score= -38.6; E_value=0.1; Accession=PF03151.7; Description=Triose-phosphate Transporter family
  Pfam module annotation: Pfam domain module=DUF6::DUF803::DUF914::TPT; Domain location=40-167::27-286::51-304::31-167
FRGGNENDEKVVKCVESVRVIVMGIAENSKGLVLAVASGVFIGASFVLKKKGLKQAATHGTRAGVGGYSYLLQPLWWAGMLTSNQLNSFSSQFLPSLNELNILAVLIGEVANFVAYIYAPALLVTPLGALSIIVSAVLAHFLLKEKLQKMGILGCVFCIVGSVLIVIHAPQEHALNSVQEIWDLATQPLFLVYVAAAVSVVLALVLHFEPRYGQTNMLALDTFNTAIVSPVYYVMFTTLTIIASVIMFKDWSDQSAGSIASEICGFVIVLSGTILLHATREQEQSNKQGSLTWYIGEDLVKSIEDGHLNLLHGSDYVEK

SEQ ID NO: 189626 - protein, 48 aa, Glycine max
  Coding DNA Sequence Number=SeqID_72848
MKTDEFGQTAIYKWTNERDDRPPIMTNEDDGSPHCKRQLSNRGFWYCY

SEQ ID NO: 189627 - protein, 33 aa, Glycine max
  Coding DNA Sequence Number=SeqID_72849
MKSQLKAMPMCVGQADTDDVEGLEKMMTRTNNI

SEQ ID NO: 189628 - protein, 316 aa, Glycine max
  Coding DNA Sequence Number=SeqID_72850
  Gene Ontology: Mol. function=ATP binding; Cellular component =contractile ring; Biological process=electron transport
  Homolog annotation: Hit_ID=Q1S771; Match level="QueryCoverage=96%, HitCoverage=86%, E-value=1e-40, Identity=34%"; Hit description=WD40 -like
  Pfam annotation: Domain name=WD40; Domain location=10-45; Score=8.6; E_value=3.6; Accession=PF00400.22; Description=WD domain, G-beta repeat
  Pfam annotation: Domain name=WD40; Domain location=134-171; Score =36.7; E_value=8.2e-08; Accession=PF00400.22; Description=WD domain, G-beta repeat
  Pfam annotation: Domain name=WD40; Domain location=179-217; Score =10.7; E_value=2.1; Accession=PF00400.22; Description=WD domain, G -beta repeat
  Pfam annotation: Domain name=WD40; Domain location=223-259; Score =26.8; E_value=7.4e-05; Accession=PF00400.22; Description=WD domain, G-beta repeat
  Pfam annotation: Domain name=WD40; Domain location=268-315; Score =26.4; E_value=0.0001; Accession=PF00400.22; Description=WD domain, G- beta repeat
  Pfam annotation: Domain name=WD40; Domain location=94-130; Score=9.7; E_value=2.7; Accession=PF00400.22; Description=WD domain, G-beta repeat
  Pfam module annotation: Pfam domain module=WD40::WD40::WD40::WD40::WD4 0::WD40; Domain location=10-45::134-171::179-217::223-259::268 -315::94-130
MNDSIILKKRHCITNLKTLTPHITCLAVHRNLLYAASLNLINVFELTHYSHIDSFNQSPSSGFVKSITFTKSKVFTGHQDRKIRYPETTLPYDATRRGSGSNILTTVSGLAVNERFMYSVSWDRSFKVWDLLSYRCLESVKAHEDAINAVAVNGDGTVYTASADGSIKVWRRDGEAKRHKLVSNIGRQKSTVNALALEGGGAGLFSGGCDGEICRWECGKNGIVEMETLRGHGGAILCLIHVAGLLASASADLTVRIWQRERGSTNGYFCRAVLEGHEKPVKSLVAFSDAEGERDSNAIVTLFSGSLDGEIRVWEL

SEQ ID NO: 189629 - protein, 229 aa, Glycine max
  Coding DNA Sequence Number=SeqID_72851
  Gene Ontology: Mol. function=chitin binding; Cellular component =extracellular region; Biological process=chitin metabolic process
  Homolog annotation: Hit_ID=UPI000044A8F0; Match level="QueryCoverage =82%, HitCoverage=99%, E-value=3e-32, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MGPKSTLRLIRTLGPSLESLAQFTWSLLSNALTRVLLVLAFRGLHALPFKGLHVLPFRGLHVLTFRGLHVLTFRELHVLAFIGLHTLPFKGLHVLAIRGLHVLTFSGLHILTFKELHVLPFRGLHALAFRGLHVPTFRGLHVLAFRGLHILTFRGLHALAFRGLHALPFRGLHVLTFRGLHVLAFRGLHVLAFRGLHALSFRGLHALTFRGLHVLAFRGLHILAFRGLH

SEQ ID NO: 189630 - protein, 101 aa, Glycine max
  Coding DNA Sequence Number=SeqID_72852
MEQCMSQPMKDMDCTEWVWWITTLSTYIYCREREIEAVIKFATCDSMNQLCELLSGKQVDTPHEALTIIHTILRDLATQCTQPYKADFDPLSRTYWLNLKF

SEQ ID NO: 189631 - protein, 102 aa, Glycine max
  Coding DNA Sequence Number=SeqID_72853
  Gene Ontology: Mol. function=heat shock protein binding; Cellular component=chloroplast; Biological process=protein folding
  Homolog annotation: Hit_ID=P93499; Match level="QueryCoverage=91%, HitCoverage=65%, E-value=8e-31, Identity=68%"; Hit description=DnaJ -like protein
  Pfam annotation: Domain name=DnaJ; Domain location=40-101; Score =41.3; E_value=3.4e-09; Accession=PF00226.21; Description=DnaJ domain
MASSSCRVKSRPIVAFATAEARSSWTEQLRPSYLNSSYFSLYDILGIPSDASNQEIKAAYQRLARVYHPDMAAIDRKNSSADEFMKCRSKASKIILMMPKDF

SEQ ID NO: 189632 - protein, 82 aa, Glycine max
  Coding DNA Sequence Number=SeqID_72854
  Gene Ontology: Mol. function=DNA binding; Cellular component=nucleus
  Homolog annotation: Hit_ID=Q0PJF1; Match level="QueryCoverage=79%, HitCoverage=30%, E-value=1e-26, Identity=92%"; Hit description=MYB transcription factor MYB96
MVLQLSLPVDSSEGLLGDANDMDNVIAYVKDLEITPERIRQFLPKVNWNLIASMYVGGCNGDECESSLEMLSNCHVYFACAT

SEQ ID NO: 189633 - protein, 328 aa, Glycine max
  Coding DNA Sequence Number=SeqID_72855
  Homolog annotation: Hit_ID=Q5JK75; Match level="QueryCoverage=43%, HitCoverage=16%, E-value=1e-29, Identity=46%"; Hit description =Putative 200 kDa antigen p200
MVFVVPGKLESIGEDGTRIPLSEGDSCGEELLTWYLEHSSVSTAQVADFGLARLAYAANTHSEEKLEESQGTAKDSAIVVGRHVSPLREEHKRKELEEKFNNVEKDAEETRESARPKAQEHSSDLRKHKTAFIDLVSNQRKLEAELSHAVKQVEATRQDLASMNEKKEESDLMAQKLSLEMKKFHKDLEQKDKILSAMLRKSKLETTEKQMLLKEVKLSKARRKQAEQETQRWKVVLEGKHERRSLKSMLLNLSSRMDVFPGSRGVQHSSTGSSNIANEPDQLLAFPDHYLQQTNGDLCKINFFKLPFLPMLSIRKIVLELRQKGMQP

SEQ ID NO: 189634 - protein, 51 aa, Glycine max
  Coding DNA Sequence Number=SeqID_72856
MSVTLRRKESVDRARGADSLEARVYFHLSQENYTSITNESSAVSADDKSKN

SEQ ID NO: 189635 - protein, 80 aa, Glycine max
  Coding DNA Sequence Number=SeqID_72857
MAVPKSEKMQGVSTKNNGGLWWLMVVVGDGERAWNIGNGFGRKKKNKMAFFLSYLDYKAQNAPVSNALGTDTSRILQISP

SEQ ID NO: 189636 - protein, 101 aa, Glycine max
  Coding DNA Sequence Number=SeqID_72858
  Subcellular localization annotation: CTP_CleavageSite=23; ConfidenceScore=5.36e-01
MTTDSPPPLMFPRTQSPVESPTVATYPSVGGRRGAHMCVFQERKMCGVATNVYLRKTLEKPEKEVSLVIKMVLVVKVLASQRSLLRKLLKEAMRKLLEEAS

SEQ ID NO: 189637 - protein, 88 aa, Glycine max
  Coding DNA Sequence Number=SeqID_72859
MKHGSIDIVLLVTQAGVEDVDVAGEGRLWWRWWELPARTRREMRAQRRSRSQSLCSKQIPILVIYLPCFPAWHKMRSVAIMKYACSII

SEQ ID NO: 189638 - protein, 211 aa, Glycine max
  Coding DNA Sequence Number=SeqID_72860
  Homolog annotation: Hit_ID=Q8L431; Match level="QueryCoverage=89%, HitCoverage=42%, E-value=4e-52, Identity=52%"; Hit description =Proline transport protein-like
MDVEGRASKGKPLTLNLEQGQEKGTQNDDYGLASAHSIDRDSWQQVGLMLVTSFNCGWILSFSNLCLWPLGWTWGIICLIVVGFYTAYANWLLAAFHFIDDRRFIRYRDLMGYVYGKSMYHLTWVFQFLTLLLGNMGFILLGGKALKAINSEFSDSSLRLQYYIVITGAAYFFYSFFFPTISAMRNWLGASALLTFTYIIFLLIVLVKDGN

SEQ ID NO: 189639 - protein, 305 aa, Glycine max
  Coding DNA Sequence Number=SeqID_72861
  Gene Ontology: Mol. function=nucleic acid binding; Cellular component= chloroplast; Biological process=mRNA processing
  Homolog annotation: Hit_ID=Q40270; Match level="QueryCoverage=99%, HitCoverage=99%, E-value=4e-72, Identity=51%"; Hit description=RNA -binding protein precursor
  Pfam annotation: Domain name=RRM_1; Domain location=109-181; Score =69.9; E_value=8e-18; Accession=PF00076.12; Description=RNA recognition motif. (a.k.a. RRM, R
  Pfam annotation: Domain name=RRM_1; Domain location=222-293; Score =115.4; E_value=1.6e-31; Accession=PF00076.12; Description=RNA recognition motif. (a.k.a. RRM, R
  Pfam module annotation: Pfam domain module=RRM_1::RRM_1; Domain location=109-181::222-293
  Subcellular localization annotation: CTP_CleavageSite=58; ConfidenceScore=5.57e-01
MAESCLLSLPSLFYAKNKTLSLSIPTNPLNLQFPCSNSSLFPLTTKTTRHSSLLTFVAQTSGWAKEGEEEEAAWENQGDTAWGTEEGGDDIEDGGEGGFAEEEAEEVKIFVGNLPFDFDSEKLASLFEQAGTVEVAEVIYNRATDRSRGFGFVTMSTIEELEKAVKMFSGYIFVLLKYVGKQEYDSQVNVYELNGRVLTVNKAAPKGAQPERPPRPPQSFRVYVGNLPWDVDNSRLEQIFSEHGKVEDARVVYDRETGRSRGFGFVTMSSETDMNDAIAALDGQSLDGRAIRVNVAAQRPKPSSF

SEQ ID NO: 189640 - protein, 482 aa, Glycine max
  Coding DNA Sequence Number=SeqID_72862
  Gene Ontology: Mol. function=protein serine/threonine kinase activity; Cellular component=nucleus; Biological process=protein amino acid phosphorylation
  Homolog annotation: Hit_ID=P51567; Match level="QueryCoverage=98%, HitCoverage=99%, E-value=0.0, Identity=75%"; Hit description =Serine/threonine-protein kinase AFC2
  Pfam annotation: Domain name=Pkinase; Domain location=98-475; Score =220.9; E_value=2.9e-63; Accession=PF00069.15; Description=Protein kinase domain
  Pfam annotation: Domain name=Pkinase_Tyr; Domain location=98-475; Score=-57.7; E_value=6.2e-09; Accession=PF07714.7; Description =Protein tyrosine kinase
  Pfam module annotation: Pfam domain module=Pkinase::Pkinase_Tyr; Domain location=98-475::98-475
MEMERVFEFPHTHMDRRPRKRARLGWDIPEVPKAQVGLFCGQDVGTISSFAPSRGPSENTTSSLFVKPVARNGSPPWRDDDKDGHYMFALGENLTSRYKIHSKMGEGTFGQVLECWDRERKEMVAVKIVRGIKKYREAAMIEIEVLQQLGKHDKGGNRCVQIRNWFDYRNHICIVFEKLGPSLYDFLRKNNYRSFPIDLVREIGRQLLECIAFMHDLRMIHTDLKPENILLVSPEYVKVPDYKSSSRSPSSYFKRVPKSSAIKVIDFGSTTYEREDQNYIVSTRHYRAPEVILGIYTYCKCCGKNACLTVFCMLTHDNHEKGYMQAKVDFGNDVLGLGWSYPCDIWSVGCILVELCTGGALFQTHENLEHLAMMERVLGPLPQPMLKRVDRHAEKYVRRGRLDWPEGATSRESIKAVMKLPRLQLTLFPPKYMQNLVMQHVDHSAGDLIHLLQGLLRYDPSERLTAKEALRHSFFMRDQFRR

SEQ ID NO: 189641 - protein, 95 aa, Glycine max
  Coding DNA Sequence Number=SeqID_72863
  Gene Ontology: Mol. function=oxidoreductase activity; Cellular component=integral to membrane; Biological process=electron transport
  Homolog annotation: Hit_ID=O81970; Match level="QueryCoverage=70%, HitCoverage=13%, E-value=7e-28, Identity=92%"; Hit description =Cytochrome P450 71A9
MAREIFKNRDSVFSGRPSLHAANRLGYNGSTVSFAPYGEYWREMRKIMILELLSPKRVQSFQAVRLEEREKNIVKRCYKNVCKLREGFQGMPDTC

SEQ ID NO: 189642 - protein, 61 aa, Glycine max
  Coding DNA Sequence Number=SeqID_72864
MVRVEIPILGQGRTLSARSARYARRLSLARLSARLAPSLNPLTRAKCEGGAKHDVVISEPI

SEQ ID NO: 189643 - protein, 323 aa, Glycine max
  Coding DNA Sequence Number=SeqID_72865
  Gene Ontology: Mol. function=oxidoreductase activity; Cellular component=integral to membrane; Biological process=electron transport
  Homolog annotation: Hit_ID=P24465; Match level="QueryCoverage=89%, HitCoverage=62%, E-value=1e-50, Identity=39%"; Hit description =Cytochrome P450 71A1
  Pfam annotation: Domain name=p450; Domain location=48-323; Score= -144.6; E_value=0.00022; Accession=PF00067.12; Description=Cytochrome P450
MALKQWLYEQMKEMAFSTFYLSLFFFISVLYLFNLTRKTKSKTNLNLPPSPPKLPLIGNLHQLGSLPHRSLRDLSLKHGDIMLLQLGQMQNPTVVVSSADVAMEIMKTHDMAFSNRPQNTAAKVLLYGGIDIVFGLYGERWSQKRKICARELLSTKRVQSFHQIRKEEVAILVNKLREVSSSEECYVNLSDMLMATANDVVCRCVLGRKYPGVKELARDVMVQLTAFTVRDYFPLMGWIDVLTGKIQEHKATFRALDAVFDQAIAEHMKEKMEGEKSKKKDFVDILLQLQENNMLSYELTKNDLKSLLLISQVFEPPLYTTGY

SEQ ID NO: 189644 - protein, 33 aa, Glycine max
  Coding DNA Sequence Number=SeqID_72866
MGFYCSCLKSKVLGLIGGTWRGEADGEGDGAGE

SEQ ID NO: 189645 - protein, 338 aa, Glycine max
  Coding DNA Sequence Number=SeqID_72867
  Gene Ontology: Mol. function=binding
  Homolog annotation: Hit_ID=Q9FKW5; Match level="QueryCoverage=100%, HitCoverage=53%, E-value=1e-133, Identity=71%"; Hit description =Arabidopsis thaliana genomic DNA, chromosome 5, TAC clone:K2A18
  Pfam annotation: Domain name=Arm; Domain location=178-218; Score =30.9; E_value=4.5e-06; Accession=PF00514.13; Description =Armadillobeta-catenin-like repeat
  Pfam annotation: Domain name=Arm; Domain location=219-259; Score =34.7; E_value=3.3e-07; Accession=PF00514.13; Description =Armadillobeta-catenin-like repeat
  Pfam module annotation: Pfam domain module=Arm::Arm; Domain location =178-218::219-259
MSSIVKEILASPIQMADQVSKLAEEAQNFRQECLELKSKTEKLAGLLRQAARNSNDLYERPTRRIIDDTEQVLDKALVLVTKCRANSLIKKLFTIIPATAFRKTSMQLENSVGDVQWLLRVSASADERDDEYLGLPPIAANEPILCLIWEQVAILLSGASLDERSDAAASLVSLARDNDRYGKLIIEEGGVPPLLKLLKEGRMDGQENAARAIGLLGKDPESVEHIVNAGVCSVFAKVLKEGHMKVQTVVAWAISELAANHPKCQDHFSQNNAIRLLVSHLAFETIQEHSKYAIANKHKSIHSVLMASNTTSAQEEEDDKQMVAHPGANQSANLMHNV

SEQ ID NO: 189646 - protein, 481 aa, Glycine max
  Coding DNA Sequence Number=SeqID_72868
  Gene Ontology: Mol. function=quinolinate synthetase A activity; Cellular component=chloroplast; Biological process=NAD biosynthetic process
  Homolog annotation: Hit_ID=Q2QTL0; Match level="QueryCoverage=90%, HitCoverage=95%, E-value=1e-174, Identity=68%"; Hit description =Expressed protein
  Pfam annotation: Domain name=NadA; Domain location=30-382; Score= -58.6; E_value=3.9e-10; Accession=PF02445.7; Description=Quinolinate synthetase A protein
MCMTYQSKSKDGEEIAFVQAKYLFPNELKVDELVNVLKEKKIGVVAHFYMDPEVQGILTAAQKQWPHIHLSDSLVMADSAVKMAKAGCQFITVLGVDFMSENVGVYRMSNKQIGCSLADAAATPTYMEYLAAASRSTSLHVIYINTKLETKAYAHELVPTITCTSSNVVQTILQAFAQVPDFSIFYGPDSYMGANIKDLFQQMTKMTDEEIAAIHPKHSQDSIRSLLPRLHYFQDGTCIVHHLFGHEVVEKIKEMYCDAFLTAHLEVPGEMFSLAMEAKRRGMGVVGSTQNILDFIKDRIQEALDRNIDDHLQFILGTESGMVTSIVATVRSLLEPAKSSSQRAKVTVEIVFPVSSDSISTTTSSLSSGLNSVKVGDIILPVVPGIASGEGCSIHGGCASCPYMKMNSLSSLLKVSHHLPDEENILSAYKAERFKLQTPNGKSVADVGCEPILHMRNFQRSSLIRFFVPNTVEVQCDKLEK

SEQ ID NO: 189647 - protein, 291 aa, Glycine max
  Coding DNA Sequence Number=SeqID_72869
  Gene Ontology: Mol. function=oxidoreductase activity; Cellular component=integral to membrane; Biological process=electron transport
  Homolog annotation: Hit_ID=P24465; Match level="QueryCoverage=80%, HitCoverage=60%, E-value=5e-38, Identity=35%"; Hit description =Cytochrome P450 71A1
  Pfam annotation: Domain name=p450; Domain location=1-290; Score= -68.7; E_value=7.6e-08; Accession=PF00067.12; Description=Cytochrome P450
MGLESIQQEPCSASHLSCLNSQEEATPIHQHRQSSSATHVAPYSEEAEKKGLFVSTKSVRSFQFIIVEEVAEMIGVIHEACATSYKKLASVNLSELLIALTNKTRLMVVEALENLEGSCCVIAQHKEKMNKREDHEQSDTKDFVDILLQLEEAGMLGFELSHDNLKAMLVDMFIGASDTTSTTLEWTMAELMRHQNTMEKVQEEVRRVVGYKAEVDENDVKQMNYLKCVVKETLRLHPPAPLLLPRENTSVVKLRGYEIQAKTRLMLNAWAIQRDPEFCDGPDEFLKKKGY

SEQ ID NO: 189648 - protein, 141 aa, Glycine max
  Coding DNA Sequence Number=SeqID_72870
  Pfam annotation: Domain name=zf-CCHC; Domain location=111-128; Score =30.0; E_value=8.2e-06; Accession=PF00098.13; Description=Zinc knuckle
MGPKTTLRLMRTLGPSPTSLPQSSWSLLSNAFGGKNLKFLSDTFEQYEILQKQPQDVVTLHQKIYFLRQTLSKFVGSTKKLNKMLRYNKCPTNKFGNGYKGKKNIHDEEIIVCYLCGKVGHMSSNCRHLPTIGSSNAFRTN

SEQ ID NO: 189649 - protein, 114 aa, Glycine max
  Coding DNA Sequence Number=SeqID_72871
  Gene Ontology: Mol. function=DNA binding; Biological process=DNA integration
  Homolog annotation: Hit_ID=Q1RZ71; Match level="QueryCoverage=73%, HitCoverage=7%, E-value=1e-17, Identity=53%"; Hit description =Peptidase aspartic, catalytic; Polynucleotidyl transferase, Ribonuclease H fold
MARSMLNGNSTPKHLWAETCFILNIKDNLGKLDSNFDNGTLLGYSKTSKAYRVYNSRTSIVEEAIHVGFKDTKPDTKMLELDESFVDIRWDKGIGPLIEQSTRTNASNQIIGQP

SEQ ID NO: 189650 - protein, 91 aa, Glycine max
  Coding DNA Sequence Number=SeqID_72872
  Homolog annotation: Hit_ID=UPI00006A2901; Match level="QueryCoverage =34%, HitCoverage=20%, E-value=2e-10, Identity=96%"; Hit description =UPI00006A2901 related cluster
IGSEGWARGSPSRPVGCRWTARAAFRGRERVVACPVGGRIGNGALRGLFPPGVEQSTQNCALNVKVKKFNQARVNGGSNYDSLKVAKCLVI

SEQ ID NO: 189651 - protein, 73 aa, Glycine max
  Coding DNA Sequence Number=SeqID_72873
EDEGPTAQVPQHMEDESSKTTTPNPLVRRKKEDEAQEAAATSEKSLEATSEPSEPVANTASPQQAADPSTPED

SEQ ID NO: 189652 - protein, 74 aa, Glycine max
  Coding DNA Sequence Number=SeqID_72874
  Gene Ontology: Mol. function=carbonate dehydratase activity; Cellular component=chloroplast; Biological process=carbon utilization
  Homolog annotation: Hit_ID=Q5NE21; Match level="QueryCoverage=90%, HitCoverage=24%, E-value=2e-13, Identity=60%"; Hit description =Carbonic anhydrase
MAGGSYEEAIAALTKLISEKADLSGVAAAKIKQLTSELETATANGSTPFNPDERIRTGFAHFKNEKFQISNLPA

SEQ ID NO: 189653 - protein, 247 aa, Glycine max
  Coding DNA Sequence Number=SeqID_72875
DKAFYPKPIRVFLRNVVLRNNKVIVSMVVGVQVTLSNDSISKATRYLHEGNTYHEGWEKAYDSHITRALYKDNTEKTGASYPACRTREKIAPQRLKDLNETDDDEEDNVIKVVVDKLVKALDAFDAKILWIQIVWVDTLKASSSGYDGSDNFQHHDFIQVLNLVRTYHFDDAYACFTKDADSHSFYNVDGERKVNLMKTVQNEGFNLFSFSLTLGNPIRANQRKSLRNLRKLLEILLSLSEYTHEPT

SEQ ID NO: 189654 - protein, 298 aa, Glycine max
  Coding DNA Sequence Number=SeqID_72876
  Gene Ontology: Mol. function=binding; Cellular component=cytoskeleton
  Homolog annotation: Hit_ID=Q1SPQ2; Match level="QueryCoverage=89%, HitCoverage=39%, E-value=1e-100, Identity=70%"; Hit description=IMP dehydrogenase/GMP reductase
  Pfam annotation: Domain name=Arm; Domain location=126-161; Score=6.3; E_value=2; Accession=PF00514.13; Description=Armadillobeta-catenin -like repeat
  Pfam annotation: Domain name=Arm; Domain location=204-244; Score =24.0; E_value=0.00052; Accession=PF00514.13; Description =Armadillobeta-catenin-like repeat
  Pfam module annotation: Pfam domain module=Arm::Arm; Domain location =126-161::204-244
MAIKGAMVEEEKANNKKQQQQQQQQQQSGNNSQMSIAGTSIKGREYEDAGTKAQMKAMAARALWQLSRGNLTVCRSITESRALLCFAVLLEKGPDDVQSYSAMALMEITAVSEQHSELRRSAFKPTSPAAKAVVDQLLKVIEKEQPDLLIACVRSVGNLARTFRATETRLIGPLVRLLDEREAQVSMEAAIALNKFACTDNYLHENHCNAIIEAGGAKHLIQLVYFGEQMVQIPSVTLLCYIALHVPKSETLAQEEVLIVLEWCTKQAHLIEEPSIQPLLPEAKSRLELYQSRGRGFR

SEQ ID NO: 189655 - protein, 46 aa, Glycine max
  Coding DNA Sequence Number=SeqID_72877
MQPKVLNLDPSFFSRVKHVEAALSVGCTLSPNGELSATSTSRLSLF

SEQ ID NO: 189656 - protein, 548 aa, Glycine max
  Coding DNA Sequence Number=SeqID_72878
  Gene Ontology: Mol. function=hydrolase activity, hydrolyzing O -glycosyl compounds; Cellular component=extracellular region; Biological process=carbohydrate metabolic process
  Homolog annotation: Hit_ID=Q10P81; Match level="QueryCoverage=95%, HitCoverage=93%, E-value=0.0, Identity=58%"; Hit description =Glycosyl hydrolase family 10 protein, expressed
  Pfam annotation: Domain name=Glyco_hydro_10; Domain location=197-491; Score=151.0; E_value=3.2e-42; Accession=PF00331.11; Description =Glycosyl hydrolase family 10
MRRGSASPKQKTRYWYVVGTFKDGPLYDSTAYTECKEKPEEPLYGGGLFKTEQHSRRGSIANNSYVPSLVLYNLTQGTIYSFSAWVRVKDSSSAMIRTTLETEKETHDCIGTVSAKHRCWSFLKGGFVLNWPSNLSIIFFQNADGKDINIDVASPSLQPFTKQQWRINQQYIINTQRKRAVTIHVSDSNGRRLEGASICVEQISKDFPFGSAIAKTILGNVPYQNWFVKRFNAAVFENELKWYATEPDQGKVNYTISDQMLQFVRTNNIIARGHNIFWEDPKYTPPWVLNLTGTQLQSAVNSRIHSLMSQYKDEFVHWDVSNEMLHFDFYEERLGPNATLHFFQTAHKSDPLATLFMNDFNVVETCSDVKSTVDAYISRVRELQRNGIFMDGIGLEGHFTIPNPPLIRAILDKLATLGLPIWLTEVDISKTLDRDAQANYSEEVLREGFSHPSVNGIMLWTALHPNGCYQMCLTDNNFKNLPAGDAVDKLLQEWQTGRVEGVSDVHGSYSFYGFLGEYRISVKYGNNTTKSTFSLSRGDETRHFTITI

SEQ ID NO: 189657 - protein, 463 aa, Glycine max
  Coding DNA Sequence Number=SeqID_72879
  Gene Ontology: Mol. function=amino acid transporter activity; Cellular component=integral to membrane; Biological process=auxin mediated signaling pathway
  Homolog annotation: Hit_ID=Q8L883; Match level="QueryCoverage=99%, HitCoverage=99%, E-value=0.0, Identity=80%"; Hit description=Auxin transporter-like protein 5
  Pfam annotation: Domain name=Aa_trans; Domain location=37-413; Score =258.6; E_value=1.3e-74; Accession=PF01490.8; Description =Transmembrane amino acid transporter protein
MASEKEVETVIVGNYEEMESEGKPRDAKSRLLSLLWHGGSVYDAWFNCASNQVAQVLLTLPYSFSQLGMLSGTLFQLFYGLLGGWTAYLISALYVEYRTRKEREKFNFRNHVIQWFEVLDGLLGKHWRNVGLAFNCTFLLFGSVIQLIACASNIYYINDNLDKRSWTYIFGACCATTVFIPSFHNYRIWSFLGLLMTTYTAWYLTVASLLHGQGVKHSGPTKLVLYFTGATNILYTFGGHAVTVEIMHAMWKPQKFKAIYLLATLYVMTLTLPSAAAVYWAFGDMLLNHSNAFSLLPRSPFRDMAVILMLIHQKAIGIHECRSLCKRALARLPVVIPIWFLAIVFPFFGPINSTVGSLLVSFTVYIIPALAHMFTFKSPSARQNAVEQPPRLVGRWVGAYTINLFVVVWVLVVGFGFGGWASMVNFIHQIDTFGFFTKCYQCPTPTSVEPPHLNATALSPRAH

SEQ ID NO: 189658 - protein, 120 aa, Glycine max
  Coding DNA Sequence Number=SeqID_72880
  Gene Ontology: Mol. function=peptidyl-prolyl cis-trans isomerase activity; Cellular component=membrane; Biological process=protein folding
  Homolog annotation: Hit_ID=O49605; Match level="QueryCoverage=98%, HitCoverage=66%, E-value=1e-50, Identity=79%"; Hit description =Peptidyl-prolyl cis-trans isomerase
  Pfam annotation: Domain name=Pro_isomerase; Domain location=1-111; Score=98.2; E_value=2.5e-26; Accession=PF00160.11; Description =Cyclophilin type peptidyl-prolyl cis-
MKILELCAQGGDIVHHDGRGYESIYGGTFPDENFKIKHSHAGVVSMVNSGPDYNGSQFFITTVKTGWLDGEHGVFGKVVQGMDSVFAIEGGAGTYNGKPRKKVVIADSGEIPKSQWDKER

SEQ ID NO: 189659 - protein, 97 aa, Glycine max
  Coding DNA Sequence Number=SeqID_72881
  Homolog annotation: Hit_ID=Q69JG4; Match level="QueryCoverage=100%, HitCoverage=17%, E-value=2e-33, Identity=68%"; Hit description =Putative nodulin-like protein
MAMPGSLYIWSIVVGICYAVPLAITLPTASELFGLKYYGLIYNILIFNLPFGSFLFSGLLAGILYDLEATTTAGGGDTCVGAHCYRLVFIIMAAACV

SEQ ID NO: 189660 - protein, 279 aa, Glycine max
  Coding DNA Sequence Number=SeqID_72882
  Gene Ontology: Cellular component=cellulose and pectin-containing cell wall
  Homolog annotation: Hit_ID=Q6Z681; Match level="QueryCoverage=87%, HitCoverage=87%, E-value=6e-35, Identity=36%"; Hit description =Putative phi-1
  Pfam annotation: Domain name=Phi_1; Domain location=32-279; Score =201.2; E_value=2.4e-57; Accession=PF04674.3; Description=Phosphate -induced protein 1 conserved region
MACVYPGQLLLLCLILSVVPIAVSAGNDAAPLTNHGGRLLTGKLNVGILWSLNMNTPAPDAAKQPQVSSWWNIVESYGAASGNNNNIPVKVVNQVFDPNYSYGKVLIKDFIKPLLPKATGGNKNTLALIIASKGVTVQDMCAGSCAQHGLIENQPYVAVGNPEEECPACAWPFLPSKGKTGAIMKPPNGNVGADAMVKLLAGGLAGAVTNPFGDGFFANAHGGDILEATSKCPDDLFATTKVSVDLKTGGAFNAVGDKGTKFLLPAIWNPKTSSCWTPL

SEQ ID NO: 189661 - protein, 118 aa, Glycine max
  Coding DNA Sequence Number=SeqID_72883
  Gene Ontology: Mol. function=actin binding; Cellular component =intracellular; Biological process=cell division
  Homolog annotation: Hit_ID=Q9ZNT3; Match level="QueryCoverage=99%, HitCoverage=100%, E-value=1e-44, Identity=67%"; Hit description =Actin-depolymerizing factor 5
  Pfam annotation: Domain name=Cofilin_ADF; Domain location=16-118; Score=77.8; E_value=3.3e-20; Accession=PF00241.10; Description =Cofilintropomyosin-type actin-binding pr
MAMAFKMATTGMWVTDECKNSFMDMKWKKEHRYIVFKIDEGSRLVTVDKLGGPTEGYDDLTASLPTDDCRYAASRIRAKILYATSKDGLRRALDGISYELQATDPTEMGFDVIRDIAK

SEQ ID NO: 189662 - protein, 217 aa, Glycine max
  Coding DNA Sequence Number=SeqID_72884
  Gene Ontology: Mol. function=DNA binding; Cellular component=nucleus; Biological process=regulation of transcription
  Homolog annotation: Hit_ID=Q0PJM0; Match level="QueryCoverage=93%, HitCoverage=100%, E-value=1e-107, Identity=94%"; Hit description=MYB transcription factor MYB48
MRGSGEGILLESIGWEGPLAVRKHTQTKVHGPKKKIIASFLTLELTVKAAGALSPKPPAFSVAARAVVSAGSTISALTSSAAISPSKKTNSSSNSTASLATSIDPATHRPLNDSSHQEPAAVSAPPKHQESFHHERCPDLNLELTISPPHHPQPDHPHLKTLVTNSNLCFPCSLGLHNSKDCSCALHTSTANATATGYDFLALKTTVVLDYRTLHMK

SEQ ID NO: 189663 - protein, 536 aa, Glycine max
  Coding DNA Sequence Number=SeqID_72885
  Gene Ontology: Mol. function=calcium-dependent phospholipid binding; Cellular component=integral to membrane
  Homolog annotation: Hit_ID=Q1T680; Match level="QueryCoverage=94%, HitCoverage=95%, E-value=0.0, Identity=77%"; Hit description=C2
  Pfam annotation: Domain name=C2; Domain location=262-346; Score =101.1; E_value=3.2e-27; Accession=PF00168.20; Description=C2 domain
  Pfam annotation: Domain name=C2; Domain location=419-501; Score=51.8; E_value=2.2e-12; Accession=PF00168.20; Description=C2 domain
  Pfam module annotation: Pfam domain module=C2::C2; Domain location =262-346::419-501
MGFFGTIFGFFGFGIGISIGFVIGYFLFIYVQPTDVKDPEIQPLAEEDSETLQRMIPEIPLWIKNPDFDRVDWLNKLIEYMWPYLDKAICKTAKNIAKPIIDEQIPKYKIDSVEFEEFTLGSLPPTFQGMKVYETDEKELIMEPSIKWAGNPNVIVAVKKFGLKAIIQVMDLQAFLAPRITLKPLVPSFPCFANIYVSLMEKPHVDFGLKLVGVDLMSIPGFYKFVQEFIKDQVANMYLWPKTLEVQVIDPTKALKRPVGILNAKILKAMKLKKKDLLGASDPYVKLNLTEDKLTSKKTTVKHKNLNPEWNEEFSLVVKDPESQALELYVYDWEQVGKHDKMGMNMVPLKELLPEEPKVFTLDLLKNMDPNDAQNEKSRGQIVLELTYKPFREEDLAGFDETQPIQKAPEGTPPGGGLLVVIIHEAQDIEGKYHTNPHVRLIFRGEEKRTKVMKKNRDPRWEEEFQFLVEEPPTNDKLHVEVVSTSSRNLLRQKESLGYADISLADVVANNRINERHHLIDSKNGRIQIELQWRAS

SEQ ID NO: 189664 - protein, 620 aa, Glycine max
  Coding DNA Sequence Number=SeqID_72886
MERRLGRETKGSLSLQKKMAETRLREKPAPDLTDFMNDMFFGAADMDHKTYDLTGSTGVAVDDDDDYDEEGFDDSTRSNSARLTQEWLQEARRIVASSPSRCDSPARSLGSPRFGATQPPSPLPSSSDRRDALSRTRSARRYRAVEGISDEILSKTAKHTRNKSDTFTQPSSDGDGSPATALHNWFANILKPTYSNNNNTQQPPPSPPDSPKPSLPPRQHHPRKSRFKTEPSAAPHPQGIHPPNSRRTFKTSTPPPENPPSDSAPLSPPRNLVESAQRRTISSSTCSQERIAPRHVLAKGEEASLNGFLKEQRILLKKISSGELHANAQIVLSGPSNSTASMVAAICHAWLLGYRQKEKEGGSERAVVVPVMNVMRGSMWKLKQAAWLFHHAALDANALLFTDEVDMESLLMTGQLSVLVVGQDVLNTTGEVGSQCTVVTDNYCEDAYDLLQNSALKKLLLAGILLDTQNLKASAAISMTRDAEAVQLLLVGSAPNYRYALFDQLMQDQKTASFVEALNHNYGRPPVESEQNSEGNTKHKVRERKSSSKSDREPIISNSKTNSFDTKSSKASKVSPNPVKLVTPPLLSPSPAPAPQHAEKEVPRGKNKFFLTRWLGFGSK

SEQ ID NO: 189665 - protein, 1183 aa, Glycine max
  Coding DNA Sequence Number=SeqID_72887
  Gene Ontology: Mol. function=ubiquitin-protein ligase activity; Cellular component=intracellular; Biological process=protein modification process
  Homolog annotation: Hit_ID=Q1T683; Match level="QueryCoverage=99%, HitCoverage=62%, E-value=0.0, Identity=70%"; Hit description=HECT
  Pfam annotation: Domain name=Arm; Domain location=132-170; Score =21.9; E_value=0.0022; Accession=PF00514.13; Description =Armadillobeta-catenin-like repeat
  Pfam annotation: Domain name=Arm; Domain location=7-47; Score=11.7; E_ value=0.42; Accession=PF00514.13; Description=Armadillobeta-catenin -like repeat
  Pfam annotation: Domain name=Arm; Domain location=89-129; Score=12.1; E_value=0.38; Accession=PF00514.13; Description=Armadillobeta-catenin- like repeat
  Pfam annotation: Domain name=HEAT; Domain location=12-49; Score=21.8; E_value=0.0024; Accession=PF02985.12; Description=HEAT repeat
  Pfam annotation: Domain name=HEAT; Domain location=137-172; Score =17.1; E_value=0.063; Accession=PF02985.12; Description=HEAT repeat
  Pfam module annotation: Pfam domain module=Arm::Arm::Arm::HEAT::HEAT; Domain location=132-170::7-47::89-129::12-49::137-172
MLSIGTEDSLSTFSVDSFVPVLVGLLNHESNPDVMLLAARALTHLCDVLPSSCAAVVHYGAVSIFCARLLTIEYMDLAEQSLQALKKISQEHPTACLRAGALMAVLSYLDFFSTGVQRVALSTAANMCKKLPPDAADFVMEAVPLLTNLLQYHDSKVLEHASVCLTRIAKAFASSPDKLDELCNHGLVTQAASLISTSGSGGGQASLSTPTYTGLIRLLSTCASGSPLGAKTLLLHGASGILKDILSGSGVSSNTSVSPALSRPADQIFEIVNLANELLPPLPQGTISLPVSSNLFVKESVVKKSPPSGNPGIQEDTNGNVHEISARAKLLNDKPELLKQFGMDLLPVLMQIYGASVNGPVRHKCLSVIGKLMYFSTAEMIQSLLSVTNISSFLAGVLAWKDPHVLVPALQISEILMEKLPGIFSKMFVREGVVHAVDQLILAGNATNISTQTSSAEKDTDSVSGTSSRSRRYRLRSGNSNPDANRSDDLKSPVPVNVGLPPSSVETPTTNSSIRASISSVANAFKDKYFPSDPGSVEVGVSDDLLHLKNLCSKLNTGVDDQRSKAKGKVEASGFDLDDDSTNTEEYLIGVISDMLKELGKGDSVSTFEFIGSGVVEALLNYFSCGYFSKDRISETNLPKLRQQALTRFKSFVAVALPLSIDNGAVAPMTVLVQKLQNVLSSLERFPVMLSNSSRSSSGSGRLSSGLSALSQPIKLRFCRAQGEKSLKDYSSSVVLIDPLASLAAIEEFLWARVQRGESGLKSTVGTENSESGTTPAGAGVSSPSSYIPSTAFRYSTGSRSRSSVNIGDTPRKEIFQDNGTSSSKSKGKAVLKPAQEEARGPQTRNAVRRRAALDKDAQMKPANGDSTSEDEELDISPVEIDEALVIEDDDISDDEDEDREDVRRDYYLPVYLPDEVHDVKLGDSAEESTVAPATSDSQTNAASGSSSKAGTARGCDSADFRSGYSSSSRGAMSFAAAAMAGLGYANSRGFRGGRDRHGRLLFGSSNDPPKLIFTAGGKHLNRNLTIYQAIQRQLMLDEDDDERLAGSDRVSSDGSSLWGDIYTITYQRAENQPDKASNGGSSSNTSKSAKSGSALNSSSEAKLHQTSVLDSILQGDLPCDLEKSNPTYNILALLRVLEGLNQLAPHLRTQMVSDSFAKGKILDLDELGVTTGARVLPEEFVS

SEQ ID NO: 189666 - protein, 208 aa, Glycine max
  Coding DNA Sequence Number=SeqID_72888
  Gene Ontology: Mol. function=nucleic acid binding; Cellular component= intracellular
  Homolog annotation: Hit_ID=Q5JME8; Match level="QueryCoverage=73%, HitCoverage=79%, E-value=3e-15, Identity=30%"; Hit description =Putative drought-induced protein DI
  Pfam annotation: Domain name=Di19; Domain location=5-187; Score=12.4; E_value=3.7e-10; Accession=PF05605.3; Description=Drought induced 19 protein (Di19)
MKEFNCMASESDNNSVIHYTDVDNDGRCDFRCPFCDFEIEVPVLCSNFEEEHCSALKNVVCPVCEENIGKDAIMQFTHSSSRRWAWKPEKSSIWPGNSAMLGKKLATRGNKQESITDPLLSPFICNVPFPKSNNFHPDENSRSNNKDIDIPNAKRTSTDAPDKGDEKDQQERRLKAAFVQQLVKTEKANKNRDTFVNVTEKTENIEVY

SEQ ID NO: 189667 - protein, 455 aa, Glycine max
  Coding DNA Sequence Number=SeqID_72889
  Gene Ontology: Mol. function=helicase activity; Cellular component =intracellular; Biological process=protein amino acid phosphorylation
  Homolog annotation: Hit_ID=Q94DI0; Match level="QueryCoverage=97%, HitCoverage=79%, E-value=1e-104, Identity=42%"; Hit description =Pentatricopeptide (PPR) repeat-containing protein-like
  Pfam annotation: Domain name=PPR; Domain location=124-158; Score=3.0; E_value=3.3; Accession=PF01535.11; Description=PPR repeat
  Pfam annotation: Domain name=PPR; Domain location=196-230; Score =15.0; E_value=0.12; Accession=PF01535.11; Description=PPR repeat
  Pfam annotation: Domain name=PPR; Domain location=231-265; Score =36.2; E_value=1.2e-07; Accession=PF01535.11; Description=PPR repeat
  Pfam annotation: Domain name=PPR; Domain location=266-300; Score =35.9; E_value=1.4e-07; Accession=PF01535.11; Description=PPR repeat
  Pfam annotation: Domain name=PPR; Domain location=301-335; Score=0.3; E_value=6.9; Accession=PF01535.11; Description=PPR repeat
  Pfam annotation: Domain name=PPR; Domain location=337-371; Score =15.6; E_value=0.11; Accession=PF01535.11; Description=PPR repeat
  Pfam annotation: Domain name=PPR; Domain location=89-123; Score=23.3; E_value=0.00085; Accession=PF01535.11; Description=PPR repeat
  Pfam module annotation: Pfam domain module=PPR::PPR::PPR::PPR::PPR::PP R::PPR; Domain location=124-158::196-230::231-265::266-300::301 -335::337-371::89-123
MNKDRVSLTRFYSQGIQENAMQIVVTKVVDIISGSEWGDEVMSNLAKLEIRMSDNFVTRVLKELRNCPLKAYEFFNWVGKQSGYEHDTVTYNAIARVLASTDSIEKFWSVIEEMKSVGHELDIDTYIKISKKLQKNKMMEDAVKLYELTMDGSYKPSVKDCSLLLKSISASDDPNLDLVFRVSKKYESTWHTLSKAIYDGIHRSLSGAGKLDEAESIVNHMRNAGYEPDNITYNQTIFGFCKMRKLDEACKVLEEMESCGFIPEIKTWTILIQGHCVANEVDRALLCLNRMIEKGCNADAAVLGVLIGSFLGQKRIDDAYKLLVEIVSKHGTSPRHGTYAKLIDNLLGIGKLEEALDLHCLMRNHEFTPIIEPFVQYISKFGSIEDAIKFLKSKGTPRSHSVYFRVFKSLLGNGRLSDAKDLLSKIPYISKRKKILELFSSMENCTVHGLSHISQ

SEQ ID NO: 189668 - protein, 433 aa, Glycine max
  Coding DNA Sequence Number=SeqID_72890
  Subcellular localization annotation: CTP_CleavageSite=62; ConfidenceScore=5.56e-01
QHSPPMDVKALAKSKRSHTQHHSKNSHHSHKPNKAASSSSSSSSVGPNDAAKKNPLGKQQVSEEKKKKSHHSALPSNWDRYEDEEEELDSGSGIASKTVDVVLPKSKGADFRHLVAEAQSLAETSLEGFPAFNDLLPGEFGVGLSSMLVVRGEGIVSWAGDDNFVVEDKTNGNLEASFLSLNLHALAESFAKVDLAKRLFIEADLLPTELCVEESAMSSSEEHEELKTKDESELANRMSEELDVDDLAADQFISSSSSSSSHAASTFPLSNDFRIPVNYVDAEAQQTSSSGKNKAFVLSSDASLHSTEDTRGKPYSTFEAADAEKELDMLLDSFGETNILDSSGFKSNTSIPVSSGVASVYPPHISNKDPVPSKTAPITASLDDVLDDLLEGTSTLTNPNVLLRPQEEKPVHHSMQSSSNSGSKSKVADDFDS

SEQ ID NO: 189669 - protein, 97 aa, Glycine max
  Coding DNA Sequence Number=SeqID_72891
MEYEQGMKCQNILGLMTLPYIITLLTQYPRPTYSTTRWSAVCCLPLGNLHSKYTFSGKKQAKTFRPHGEENDIFRVRHSLELLQKAPSNKDSNQFLK

SEQ ID NO: 189670 - protein, 43 aa, Glycine max
  Coding DNA Sequence Number=SeqID_72892
KEKKKLLVKRGKVSAGCRGLSTDSCFVFFHNQIQEEIDEPLPP

SEQ ID NO: 189671 - protein, 509 aa, Glycine max
  Coding DNA Sequence Number=SeqID_72893
  Gene Ontology: Mol. function=nucleic acid binding; Cellular component= intracellular; Biological process=regulation of transcription
  Homolog annotation: Hit_ID=Q9FFH3; Match level="QueryCoverage=93%, HitCoverage=93%, E-value=1e-103, Identity=47%"; Hit description =Similarity to zinc finger protein ID1
  Pfam annotation: Domain name=RS4NT; Domain location=158-195; Score =14.0; E_value=0.044; Accession=PF08071.2; Description=RS4NT (NUC023) domain
  Pfam annotation: Domain name=zf-C2H2; Domain location=173-195; Score =21.6; E_value=0.0028; Accession=PF00096.16; Description=Zinc finger, C2H2 type
  Pfam annotation: Domain name=zf-C2H2; Domain location=200-221; Score =17.5; E_value=0.05; Accession=PF00096.16; Description=Zinc finger, C2H2 type
  Pfam annotation: Domain name=zf-C2H2; Domain location=97-119; Score =22.6; E_value=0.0014; Accession=PF00096.16; Description=Zinc finger, C2H2 type
  Pfam module annotation: Pfam domain module=RS4NT::zf-C2H2::zf -C2H2::zf-C2H2; Domain location=158-195::173-195::200-221::97-119
  Subcellular localization annotation: CTP_CleavageSite=56; ConfidenceScore=5.02e-01
MDEGEIITHTAFPQNLTASAASNDHNKPPSALRRKRNLPGNPGMLVSFILKCFLIKRKEKKSYTKDLICESFFPICTDPEAEVIALSPKTLMATNRFLCETCGKGFQRDQNLQLHRRGHNLPWKLKQRTGKEARKRVYVCPEKSCVHHDPSRALGDLTGIKKHFCRKHGEKKWKCEKCSKRYAVQSDWKAHSKTCGTREYKCDCGTIFSRRDSFITHRAFCDALAEETARVNAASDINTSLGGNNIGYNIMGTSLGPNMASHFPSIFKPVSSTDETSNQTSRGLPLWMSQITSSQAQERIMVNTNLREIHQLGSATSSSSGTIYDGNSILQCPNLPPSNNYQLSWVFGTKISNNSNNQELTTSTTTSLPLGNTSAIPSWYSSQHQPQHQQACPSANMSATALLQKAAQIGATSSDPSWLGSLGLKCGNNSQGQDGNNNKYSGMYGSSLVLTTTLGSEADNSGCELSQMHPHKRRHVLNEESGGGQTRDFLGVGVQNHFPHFINQGVDLI

SEQ ID NO: 189672 - protein, 108 aa, Glycine max
  Coding DNA Sequence Number=SeqID_72894
MGVMAVGFPMEEGMICLGRGDVVGTGRMSLDFEVHGLGSIIPYPIRQHLESTKMMGIRRMSLDFEVHGLGSIKMLKRFLELVATDLKIDVVDIWKWKLEDSDVPSMMS

SEQ ID NO: 189673 - protein, 446 aa, Glycine max
  Coding DNA Sequence Number=SeqID_72895
  Gene Ontology: Mol. function=nucleic acid binding; Cellular component= membrane; Biological process=DNA integration
  Homolog annotation: Hit_ID=Q1RSI0; Match level="QueryCoverage=82%, HitCoverage=46%, E-value=1e-51, Identity=31%"; Hit description=IMP dehydrogenase/GMP reductase
MVFLKTMLLEEEDEIKLALAECMCDALTSAMERKKQDWVMQFLRGLYDQFNIVRSNVLMMDPLPSIAKHGYPPRQKLNKYWSSNINNISNVKEEGDSSAQERNQETQNEDVKLTTQQYKALMALLQQQNTFHNISHVNQIGAVNNKGSLLSITYSVSKTNQDEWILDSGATDHIIVFPHFFSICKKINLVIVRPPNGHRVTATHAGIIQFSQFLYLEDDMQNLQRIGTVDMVEGLYKLKMVPLKPHGKYNSNSIIVPACPIVKPQSYSEASKDHNWIEVINADIKALEHNDTWILTNLPKHKTAICCKWVYKIKHKYDGSIQRYKDSPVAKGYTQVEGQDYLESFSPMAKLITVRLLLALAAINQWHLKQLDVNNDFLHGDLNEEVYMTVPQGMKVARPGQVARSSTDINLCHRKYALDILSDAGVLGSKPVSTPCDYTTNLQQHL

SEQ ID NO: 189674 - protein, 392 aa, Glycine max
  Coding DNA Sequence Number=SeqID_72896
  Gene Ontology: Mol. function=calcium ion binding; Cellular component =nucleus; Biological process=regulation of transcription, DNA -dependent
  Homolog annotation: Hit_ID=Q1T0C7; Match level="QueryCoverage=74%, HitCoverage=54%, E-value=2e-55, Identity=51%"; Hit description=IQ calmodulin-binding region; CG-1
MKKIFYSLEDTYNGSAPLWIEAKSHVQVGGYECGYYVMHWMWCIVSASLENNWNELSGIRIMAESLKDCVIDNNEYKSTSADMYFILSADALVSTGLADLGYGYVNIANNVSAEIASFGNVTQPIAGRNKVPYKISESVTLQTMDNQANPHEQKNNTVSLSGVDSLDTLESPVSSIHEPYSSLVVDSQQSSLPEQVFTITDVSPTCVSSTEKSKVVVTGFFLKDYMHLSNSNLLCVCGDVSVPAEIVQVGVYRCWVSPHSPGFVNLYFSIDGHKPISQVVNFVYRTPALHDHAACHWISVIGVDGQLFIGQHIVEAKFGPQNPDECTTTDLAYMRGHDGLEAYLSEKSLDQQNLKDTLIAYRTAAEAASRIHAAFREHSLKLRTKAVSYSIE

SEQ ID NO: 189675 - protein, 203 aa, Glycine max
  Coding DNA Sequence Number=SeqID_72897
MAVCYVSHAVYVENNPPCTKIPSVRDMPLMRMIHHSVVVIAIRTFRVPCASSIRENCYKLKDWHRTLVKTSAWDYVVVWKYGDDPTSGSCIDVVKPEEEKAEVCNMAPICRDDHFHFQHPVRTKACEALAQLPFALSLYSGSLSLILTYVCIPMDMNIIELITAHGCVSSEQETISAQSYTSLNINEHLPLREQYSQWCSPHM

SEQ ID NO: 189676 - protein, 537 aa, Glycine max
  Coding DNA Sequence Number=SeqID_72898
  Gene Ontology: Mol. function=protein serine/threonine kinase activity; Cellular component=membrane; Biological process=protein amino acid phosphorylation
  Homolog annotation: Hit_ID=Q9FFW5; Match level="QueryCoverage=74%, HitCoverage=58%, E-value=1e-134, Identity=60%"; Hit description =Similarity to protein kinase
  Pfam annotation: Domain name=APH; Domain location=183-358; Score= -16.0; E_value=0.079; Accession=PF01636.13; Description =Phosphotransferase enzyme family
  Pfam annotation: Domain name=Pkinase; Domain location=181-421; Score =129.4; E_value=1e-35; Accession=PF00069.15; Description=Protein kinase domain
  Pfam annotation: Domain name=Pkinase_Tyr; Domain location=181-454; Score=161.7; E_value=1.9e-45; Accession=PF07714.7; Description =Protein tyrosine kinase
  Pfam module annotation: Pfam domain module=APH::Pkinase::Pkinase_Tyr; Domain location=183-358::181-421::181-454
  Subcellular localization annotation: CTP_CleavageSite=51; ConfidenceScore=5.60e-01
WPPPLQPLSSPPQFRAPPPPDRPSSRRNAPSNDSTQGTSEKSRSGHHKHGVASHTNSTGSSPNQTSSGDNSGKYVGYTLAGIFAVALVAVAVALVFVFKKKKSRRDAYTTPYMPPFKIHVKSGANGHYYVQQPIPSPPLANNYGNGNMSMQHLGASFDSAQFKSVQIVFTYEMVMEMTNAFSTQNVIGEGGFGCVYKGWLPDGKTVAVKQLKAGSGQGEREFKAEVEIISRVHHRHLVALVGYCICEQQRILIYEYVPNGTLHHHLHESGMPVLDWAKRLKIAIGAAKGLAYLHEDCSQKIIHRDIKSANILLDNAYEAQVADFGLARLADAANTHVSTRVMGTFGYMAPEYATSGKLTDRSDVFSFGVVLLELVTGRKPVDQTQPLGDESLVEWARPLLLRAIETRDFSDLTDPRLKKHFVESEMFRMIEAAAACVRHSALRRPRMVQVVRALDCGDESSDISNGMKYGHSTVYDSGQYDKAIMLFRRMANGNFDDSDFDMGLRESTHSSATETNEYRRMALEAAAFNPIRFPKFF

SEQ ID NO: 189677 - protein, 131 aa, Glycine max
  Coding DNA Sequence Number=SeqID_72899
  Subcellular localization annotation: CTP_CleavageSite=48; ConfidenceScore=5.05e-01
MLHKITKAWGLSGSVGPKPTPSYYRFATPVLEVVIPFESLLSSTDIAMSFADFDSSSKDTDTASPTLMYPHSMLPEAWVLPEVDLVSENEGEDSEEDTSYEEDPFMDKEDPATEPEIMEEDSLQDSFEESY

SEQ ID NO: 189678 - protein, 33 aa, Glycine max
  Coding DNA Sequence Number=SeqID_72900
AGGILRLLFYVLASPIVVLLYYFISESAGIQGQ

SEQ ID NO: 189679 - protein, 111 aa, Glycine max
  Coding DNA Sequence Number=SeqID_72901
MGGSQSKKNKARKALLEIESRFWLPAVRVNAFNLVQGYPEREGDNVARNHEEVIGLGGKVVESEGLREGDVAAQHRRDLRDGSVGEHCHRNPRIAGGIGCDVREGRGQGSV

SEQ ID NO: 189680 - protein, 270 aa, Glycine max
  Coding DNA Sequence Number=SeqID_72902
  Homolog annotation: Hit_ID=Q9LK89; Match level="QueryCoverage=57%, HitCoverage=69%, E-value=4e-14, Identity=34%"; Hit description =Arabidopsis thaliana genomic DNA, chromosome 3, TAC clone: K16N12
  Pfam annotation: Domain name=DUF1645; Domain location=79-248; Score =13.1; E_value=8.8e-06; Accession=PF07816.2; Description=Protein of unknown function (DUF1645)
MNNMQNETSSVMQLKMQALSILRMPPSFHKSKDVAPISLKLNQNFIGENEIQIDNEENFEEQQEFIFACFSTQGILTFADEILDNGKIRLASTTSDHSVGFTIEEDNDTLALQPPLKKLFVGEQLNNFFSQSKGTLEESCNGNSQKMATVEVETSNNKCKKSKSMGFSNTCRLPKSTKLRSNSDGKHTFVLLNPLGSMPMKSIEAKEESNVSKRGKDGKCKTTLSPHEKFYVMNKKRKETNKRKSFLPYRKNLIGFFTNINGFSRILSPF

SEQ ID NO: 189681 - protein, 95 aa, Glycine max
  Coding DNA Sequence Number=SeqID_72903
MCVRITLGYFRQPPDAWVRISRCCVCRDNHLGYFCLQPDTWVRISRCCLCADNRKVSPHATGLTEKKVCADNHRVSPHATGLTSQNNKTWGGQQK

SEQ ID NO: 189682 - protein, 118 aa, Glycine max
  Coding DNA Sequence Number=SeqID_72904
  Gene Ontology: Mol. function=ubiquitin-protein ligase activity; Cellular component=intracellular; Biological process=protein modification process
  Homolog annotation: Hit_ID=Q1T683; Match level="QueryCoverage=90%, HitCoverage=5%, E-value=5e-53, Identity=91%"; Hit description=HECT
  Pfam annotation: Domain name=HECT; Domain location=1-116; Score= -136.6; E_value=0.012; Accession=PF00632.15; Description=HECT-domain (ubiquitin-transferase)
SETLADHIKFDHGYNAKSPAIINLLEIMGGFTPEQQRAFCQFVTGAPRLPPGGLAVLNPKLTIVRKLSSTAVNTSSNGNGPSESADDDLPSVMTCANYLKLPPYSTKKGNGAMKMVSK

SEQ ID NO: 189683 - protein, 1217 aa, Glycine max
  Coding DNA Sequence Number=SeqID_72905
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q1RSD6; Match level="QueryCoverage=96%, HitCoverage=97%, E-value=0.0, Identity=79%"; Hit description=ATPase, E1-E2 type
  Pfam annotation: Domain name=E1-E2_ATPase; Domain location=109-391; Score=-111.4; E_value=0.0045; Accession=PF00122.10; Description=E1 -E2 ATPase
  Pfam annotation: Domain name=Hydrolase; Domain location=420-879; Score=38.0; E_value=3.2e-08; Accession=PF00702.16; Description =haloacid dehalogenase-like hydrolase
  Pfam module annotation: Pfam domain module=E1-E2_ATPase::Hydrolase; Domain location=109-391::420-879
MAGGRRRRHHFGRIHAFTCGRASMKEEHSLIGGPGFSRKVYCNDPERATASLLNYGDNYVRTTKYTLATFLPKSLFEQFRRVANFYFLVCAVLSFFPVSPYSGISNVVPLLVVVAATMVKEFIEDFRRKKQDIEMNNRKVKLHRGGGVFDYSKWRDLKVGDVVRVEKDEFFPADLILLASNYDDAICYVETMNLDGETNLKLKQAPEATSKLQEDSNVQNFRAVIKCEDPNANLYTFVGSMELGDQQYPLAPQQLLLRDSKLRNTDFVYGVVIFTGHDTKVMQNATDPPSKRSKIEKRMDKIIYCLFFVLILISFIGSIFFGIATNDDLENGRMKRWYLRPDDTEIYYDPNEPVAAAILHFFTALMLYSYLIPISLYVSIEIVKVLQSVFINQDVHMYYEETDKPAHARTSNLNEELGQVDTILSDKTGTLTCNSMEFIKCSIAGVAYGRGVTEVERALSRRHESHPGQELKKISESKSSIKGFNFMDERVMNGNWIKEPNANVIQNFLRLLAVCHTAIPEVDEETGKVSYEAESPDEAAFVIAARELGFEFYERTHTTISLRELDTISGQKINRSYKLLNILEFTSARKRMSVIVKDEEGKLLLLSKGADSVMFEQIAKNGRDFEEKTKQHIAEYADSGLRTLILAYRELNDEEYNKFNKEFTEAKNLVSEDQEQIVEGIIQNIEKDLILLGATAVEDKLQDGVPECIDKLAQAGIKLWVLTGDKMETAINIGFACSLLRQGMKQIIISSDTPETKSLEKMEDKSAAEAAIKSSVLRQLRESKALLSTADENYEALALIIDGKSLTYALEDDVKDLFLELAIGCASVICCRSSPKQKALVTRLVKMRTGSTTLAIGDGANDVGMLQEADIGIGISGVEGMQAVMSSDIAIAQFRFLERLLLVHGHWCYRRISSMICYFFYKNIAFGFTLFFFEMYASFSGQAAYNDWFMSLYNVFFTSLPVIALGVFDQDVSSKLCLKFPLLYQEGTQNILFSWKRIIGWALNGVVTSAIVFFFCIRSMEYQAFRKGGEVMGLEVLGATMYTCVVWVVNCQMALSISYFTYIQHIFIWGSILFWYIFLLAYGAIDPSFSTTAYKVFIEALAPAPSFWIVTFLILIASLLPYFVYASIQLRFFPMYHQMIQWMRNDRQTSDPEYCNVVRQRSIRHTTVGFTARLEASKRFEASRRVEASNPFEASNHFDASKRLEASKRSEGKFEDR

SEQ ID NO: 189684 - protein, 105 aa, Glycine max
  Coding DNA Sequence Number=SeqID_72906
  Homolog annotation: Hit_ID=Q1RSE0; Match level="QueryCoverage=33%, HitCoverage=24%, E-value=5e-07, Identity=77%"; Hit description=EF -Hand type
  Pfam annotation: Domain name=efhand; Domain location=5-33; Score =33.4; E_value=8.1e-07; Accession=PF00036.22; Description=EF hand
MAKWSLTEMIKEADTDGDGVISFTEFATIMPRSDSDFLGLSLCLPYNIFIHFIQVLIMSRYMLCKEISTKLFHSIWSAYLTVCLEWLTYYQVSSEKDVEVKENAF

SEQ ID NO: 189685 - protein, 346 aa, Glycine max
  Coding DNA Sequence Number=SeqID_72907
  Homolog annotation: Hit_ID=Q9FN46; Match level="QueryCoverage=38%, HitCoverage=14%, E-value=6e-12, Identity=38%"; Hit description =Genomic DNA, chromosome 5, P1 clone:MYJ24
DGPVTSKKDISSLQQPTNKDITKSITENETEEDVEVENIERPVDLYKAIFSDDSDDEGEDPSNRRVENQEKKAEVANTALSRLIAGDFLESLGKELGIEVPPDMPYPTQKSRNVAHQKDIVNEDARTDILKSENNSVMSLNHDLPYDQQHIAHDCEPSKGDTIDGNMLESGNNKTKGTTSQDNDSSSEEERSQKRSNREKYDESRKDKTPRKGAENGPDINGIRGMMQEVIHPVMMTEEIDTVQGQKGEGKVLPEKKAGVKNTQNVTSTESMNLQIDPLVIAMRKTVHIPEKRKGGGNERETCFLCFQEHFGIMLGDRCCILVLKDVTKFWVCDTEVLPMDFICSD

SEQ ID NO: 189686 - protein, 723 aa, Glycine max
  Coding DNA Sequence Number=SeqID_72908
  Gene Ontology: Mol. function=RNA binding; Cellular component =intracellular; Biological process=RNA processing
  Homolog annotation: Hit_ID=Q9FN46; Match level="QueryCoverage=99%, HitCoverage=72%, E-value=0.0, Identity=52%"; Hit description=Genomic DNA, chromosome 5, P1 clone:MYJ24
  Pfam annotation: Domain name=DUF1604; Domain location=36-124; Score =186.1; E_value=8.4e-53; Accession=PF07713.3; Description=Protein of unknown function (DUF1604)
  Pfam annotation: Domain name=G-patch; Domain location=159-200; Score =2.2; E_value=0.096; Accession=PF01585.13; Description=G-patch domain
  Pfam annotation: Domain name=Surp; Domain location=410-453; Score =52.9; E_value=1.1e-12; Accession=PF01805.10; Description=Surp module
  Pfam module annotation: Pfam domain module=DUF1604::G-patch::Surp; Domain location=36-124::159-200::410-453
MESDEDDFVFYGTPIEREDDSISRKKKAIAESSGQLRALPAWKQEVRDEEGRRRFHGAFTGGYSAGYYNTVGSKEGWAPQSFKSSRKSRAEFKEQNILNFLDEDEKTELEGCFLGTTSQFDTFGFTAAEIARKQAEKEQKQRPSIIPGPAPDEIVVPATESVGVKLLMKMGWSRGRSIKDSHSEALYDARRQARRAFLAFSSDDPKLKITGSEPIEGDVEIFPEEPVNGDAQFSKSTPVYVLNPKQDLHGLGFDPYKHAPEFREKKRSRLASKGGGPGYSKNFSTRDSLFGKAAPGFGIGALEELDVEDEDVYATGYEFEDAYVQEVEEPSTLRLENQRTKEQKDQGDLRGFRVASNSDFKMERFEAPLIPKDFVPHHEFSGPLNINRKSCEVTPPDVPPPGDGNLKLLIEGVANLVAKCGKLYEDLSREKNQSNPLFNFLSGGTGHEYYARKLWEAQQKHKTSRQLDGKMPPSVQRLTAESRGQILGEKPLEKSSQDLSSSVSSTDIHLQFNLTDTFTESASLIVPSTQIIPLTRFLDSVPWNLNDKGIAEPLIARLWAQCQSELVNVEKPFKDDPTKQERFEQFLKEKYKGGLRSASSSLASDMSEAARAQERLSFEAAAEAIEKGRQGRGSKPLIPSSMDFIPGGVMQFTSGEVKPKKDLLAEDILKKKMYPKREEFQWRPSPLLCKRFDLIDPYMGKPPPAPRIRSKMDTLIFTSDSVK

SEQ ID NO: 189687 - protein, 171 aa, Glycine max
  Coding DNA Sequence Number=SeqID_72909
  Gene Ontology: Mol. function=metal ion binding; Cellular component =mitochondrial inner membrane; Biological process=electron transport
  Homolog annotation: Hit_ID=Q6YYC5; Match level="QueryCoverage=85%, HitCoverage=36%, E-value=4e-66, Identity=80%"; Hit description =Copine I-like protein
  Pfam annotation: Domain name=Copine; Domain location=62-171; Score =152.5; E_value=1.1e-42; Accession=PF07002.6; Description=Copine
MIFKEGPENCCLNVFGNKNNPCWNYVTTALRKEGLESSNLILGIDFTKSNEWTGRISFNKRSLHAIGSTPNPYEKAISIIGKTLAPFDDDNLIPCFGFGDATTHDQEVFSFHSDHSPYHGFEEVLACYQKIVPNLKLSGPTSYAPVIEAAIDIVEKNRGQFHVLVIVADGQ

SEQ ID NO: 189688 - protein, 173 aa, Glycine max
  Coding DNA Sequence Number=SeqID_72910
  Homolog annotation: Hit_ID=Q8S2G4; Match level="QueryCoverage=36%, HitCoverage=18%, E-value=7e-15, Identity=60%"; Hit description=Mucin- like protein
MHEIEDELHKLEVENRKREVFKCLYLNEFEKVKMFFNSHDSEFRVASLPYMLEFKVMPEGCDGINEDVDDGHYDIHKMEDEMLYREFVEKLQQKEKSVFSHQQFNAQCKIFSYFITVESTSVVESIHHRVTTTVVPNVPFDEVGQELLLCIFLGAHCSQRVLNFSRVRELLRK

SEQ ID NO: 189689 - protein, 146 aa, Glycine max
  Coding DNA Sequence Number=SeqID_72911
  Gene Ontology: Mol. function=DNA binding; Cellular component=nucleus; Biological process=regulation of transcription
  Homolog annotation: Hit_ID=Q9FFI5; Match level="QueryCoverage=93%, HitCoverage=28%, E-value=3e-63, Identity=80%"; Hit description=NAM (No apical meristem)-like protein
  Pfam annotation: Domain name=NAM; Domain location=6-134; Score=320.7; E_value=2.7e-93; Accession=PF02365.6; Description=No apical meristem (NAM) protein
MAPMSLPPGFRFHPTDEELVAYYLERKITGRSIELEIIAEVDLYKCEPWDLPDKSFLPSKDMEWYFYSPRDRKYPNGSRTNRATQAGYWKATGKDRPVHSQKKQVGMKKTLVYYRGRAPHGIRTNWVMHEYRLIESVPGTALSSLK

SEQ ID NO: 189690 - protein, 134 aa, Glycine max
  Coding DNA Sequence Number=SeqID_72912
MTSHNLLQPSHHHWEDQDGSGPCQNQWPEHGSVSVEFGPVKPNLPKTEGRYTWTESSKTNMEFVGLRFGGLTEVWLSKAMREASCIEVGVESRSIERWKLSLEKSIVDAIFNEELAALALAESPIVDVEQNDIS

SEQ ID NO: 189691 - protein, 440 aa, Glycine max
  Coding DNA Sequence Number=SeqID_72913
  Gene Ontology: Mol. function=receptor activity; Cellular component =anchored to membrane; Biological process=protein amino acid phosphorylation
  Homolog annotation: Hit_ID=Q1SBD8; Match level="QueryCoverage=97%, HitCoverage=92%, E-value=1e-113, Identity=48%"; Hit description =Unnamed protein product; contains similarity to elicitor-inducible receptor EIR gene_id:T5M7.12
  Pfam annotation: Domain name=LRR_1; Domain location=112-135; Score =13.1; E_value=1; Accession=PF00560.23; Description=Leucine Rich Repeat
  Pfam annotation: Domain name=LRR_1; Domain location=137-159; Score =10.0; E_value=3.9; Accession=PF00560.23; Description=Leucine Rich Repeat
  Pfam annotation: Domain name=LRR_1; Domain location=161-180; Score =8.9; E_value=6; Accession=PF00560.23; Description=Leucine Rich Repeat
  Pfam annotation: Domain name=LRR_1; Domain location=185-207; Score =7.4; E_value=12; Accession=PF00560.23; Description=Leucine Rich Repeat
  Pfam annotation: Domain name=LRR_1; Domain location=209-231; Score =16.6; E_value=0.091; Accession=PF00560.23; Description=Leucine Rich Repeat
  Pfam annotation: Domain name=LRR_1; Domain location=233-255; Score =5.7; E_value=25; Accession=PF00560.23; Description=Leucine Rich Repeat
  Pfam annotation: Domain name=LRR_1; Domain location=257-280; Score =9.6; E_value=4.6; Accession=PF00560.23; Description=Leucine Rich Repeat
  Pfam annotation: Domain name=LRR_1; Domain location=282-304; Score =7.2; E_value=13; Accession=PF00560.23; Description=Leucine Rich Repeat
  Pfam annotation: Domain name=LRR_1; Domain location=306-328; Score =16.8; E_value=0.076; Accession=PF00560.23; Description=Leucine Rich Repeat
  Pfam annotation: Domain name=LRR_1; Domain location=330-351; Score =5.3; E_value=30; Accession=PF00560.23; Description=Leucine Rich Repeat
  Pfam annotation: Domain name=LRR_1; Domain location=81-109; Score =6.3; E_value=19; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =112-135::137-159::161-180::185-207::209-231::233-255::257-280::282 -304::306-328::330-351::81-109
MKNKEKEVIYSVIQGLVGKWWNGSYLYPDPCGRTPIQGVSCEQYDDGFWYVTTVNFGPVFDNSLNCNHEAQFPQQLFNLKHLKVLSLSTCFLSPTKNPVKLPLSNWEKFSHSLESLTLRSNPGLVGTIPSAIGSLKKLQSLVLLENGLTGELPLSIGNLVKLRQLVLQGNNLEGQVPANYGWLSELLIFDASRNNLSGVLPSTLGLLDSLLKLDLSNNMLEGELPRELGRLKNLTLLDISHSKLRGGLVRTIKELVSLKHLVLSNNPIGGDLLGVKWENFQNIEALDLSNIGLEGSVPESMAKMKRLRFLDLSNNNLCGTLSRSLEKLPCLTALHVNGNNLTGRLEFSDRFYMKLGMRFAAWNNANLCCNIAKPQNEMPYGVKPCAQNITISEGVSNVKMSEGNYEDSFASLGGSGFYYGLWWVFTVNGVLNVLLWNMLF

SEQ ID NO: 189692 - protein, 602 aa, Glycine max
  Coding DNA Sequence Number=SeqID_72914
  Gene Ontology: Mol. function=ATP-dependent helicase activity; Cellular component=nucleolus; Biological process=rRNA processing
  Homolog annotation: Hit_ID=Q84T03; Match level="QueryCoverage=85%, HitCoverage=84%, E-value=0.0, Identity=65%"; Hit description =Putative RNA helicase
  Pfam annotation: Domain name=DEAD; Domain location=114-285; Score =236.6; E_value=5.5e-68; Accession=PF00270.19; Description=DEADDEAH box helicase
  Pfam annotation: Domain name=Helicase_C; Domain location=355-431; Score=99.1; E_value=1.3e-26; Accession=PF00271.21; Description =Helicase conserved C-terminal domain
  Pfam annotation: Domain name=ResIII; Domain location=110-280; Score= -24.3; E_value=0.005; Accession=PF04851.6; Description=Type III restriction enzyme, res subunit
  Pfam module annotation: Pfam domain module=DEAD::Helicase_C::ResIII; Domain location=114-285::355-431::110-280
MAETEDKTLQASPMNETKKMKKNKNKKKSDKKRPREIATEERPEEEENENNTDSDGESSKKKKKKKVEGESEVKEKKVKNNGGSGIMSTESFESLGLSEPTYKAIMDMGFHHMTQIQARAIPPLLIGKDVLGAARTGSGKTLAFLIPAVELLYNVKFTPRNGAGVIVICPTRELAIQTHAVAKELLKYHSQTLGLVIGGSARKIEAERIAKGINLLVGTPGRLLDHLQNTKGFIYKNLKCLMIDEADRILEANFEEEMKQIIKILPKNRQTALFSATQTKKVEDLARLSFQTTPIYIDVDDGRTKVTNEGLLQGYVVVPCAKRFIVLYSFLKRHQSKKVMVFFSSCNSVKFHADILNLIQLNCSSIHGKQKQQSRTTTFFDFCKAEKGILLCTDVAARGLDIPAVDWIVQYDPPDEPKEYIHRVGRTARGEGGKGNALLFLIPEELQFLRYLKAAKVPVKEYAYDEKKVANVQSHLENLVVNNFYLNKMAKEAYRSYILAYNSHSMKDIFNIHHLDLQTFADKSINWYLVDSRGWKRVSDPKNNNAVASSFCFSNPPNVSLNINSSKQRNKMRKVDGSRHGFSGDNPYGKRNADDKRQFVRY

SEQ ID NO: 189693 - protein, 330 aa, Glycine max
  Coding DNA Sequence Number=SeqID_72915
  Gene Ontology: Mol. function=peptidyl-prolyl cis-trans isomerase activity; Cellular component=chloroplast; Biological process=protein folding
  Homolog annotation: Hit_ID=Q016V9; Match level="QueryCoverage=71%, HitCoverage=80%, E-value=6e-33, Identity=35%"; Hit description=[O] KOG0865 Cyclophilin type peptidyl-prolyl cis-trans isomerase
  Pfam annotation: Domain name=Pro_isomerase; Domain location=108-301; Score=9.0; E_value=1e-07; Accession=PF00160.11; Description =Cyclophilin type peptidyl-prolyl cis-
  Subcellular localization annotation: CTP_CleavageSite=45; ConfidenceScore=5.40e-01
MATPSLSPFQLIPTSPSFPILKQQCRFSRRELTIFSNSCLLLLLGAQARAEENLTLAEEDVGNTSNSDQPEENLTLAEEDVANTSNSDKPEENVAVTPSCTERKPTKQVFLDISIDGEPVGRVTIGLYGDDVPAGVDRFSKIASGAAGISYRRKEFVKIMPNYVQHGGLRSYGVDAELASKTGSNLGTSRLGEEWEREYERCPGTKNVAGSVGIIVRNPSKPPPKLKLIAKQGKLEIDEEEVGNDPNGTEFVIATKDSPELDASTLVIGRVIGGMEVVQRIGLVKTVQENTGSPYFRVAKLIGDKRAVVAERGFNRPYSKVIVTNCGLME

SEQ ID NO: 189694 - protein, 74 aa, Glycine max
  Coding DNA Sequence Number=SeqID_72916
MATYSNFVQEYCPITESRIQEPEKGISLTEPQKANLEARRQKDLKAKNYLFLAIDWPILETILCKELSRTFGIL

SEQ ID NO: 189695 - protein, 690 aa, Glycine max
  Coding DNA Sequence Number=SeqID_72917
  Gene Ontology: Mol. function=prephenate dehydrogenase (NADP+) activity; Cellular component=cytoplasm; Biological process=tyrosine biosynthetic process
  Homolog annotation: Hit_ID=Q1RX89; Match level="QueryCoverage=95%, HitCoverage=94%, E-value=0.0, Identity=76%"; Hit description =Prephenate dehydrogenase; NADP oxidoreductase, coenzyme F420- dependent
  Pfam annotation: Domain name=2-Hacid_dh_C; Domain location=370-511; Score=-100.9; E_value=0.077; Accession=PF02826.9; Description=D -isomer specific 2-hydroxyacid dehyd
  Pfam annotation: Domain name=F420_oxidored; Domain location=407-555; Score=-49.3; E_value=0.04; Accession=PF03807.7; Description=NADP oxidoreductase coenzyme F420-dependent
  Pfam annotation: Domain name=GFO_IDH_MocA; Domain location=406-495; Score=-20.7; E_value=0.075; Accession=PF01408.12; Description =Oxidoreductase family, NAD-binding Rossmann fold
  Pfam annotation: Domain name=NAD_binding_2; Domain location=76-206; Score=-82.6; E_value=0.053; Accession=PF03446.5; Description=NAD binding domain of 6-phosphogluconate dehydrogenase
  Pfam annotation: Domain name=PDH; Domain location=410-670; Score= -13.9; E_value=7.6e-08; Accession=PF02153.8; Description=Prephenate dehydrogenase
  Pfam module annotation: Pfam domain module=2-Hacid_dh_C::F420 _oxidored::GFO_IDH_MocA::NAD_binding_2::PDH; Domain location=370 -511::407-555::406-495::76-206::410-670
  Subcellular localization annotation: CTP_CleavageSite=53; ConfidenceScore=5.60e-01
MAVSTFQAPPLKPSLPSTLLRRLKRVPLSHSFSLFSAPNTNSFHSSYRALRIRAIDAAQPFDYESRMAQQFHDAQKLKIAIVGFGNFGQFLAQTLVRQGHTILAHSRSDHSLSAQQLGVTFFQNPHDLCEEHPEVILLCSSIISTQRVLLTLPLQRLKRSTLFVDVLSVKEFPKNLLLHALPPDFDVLCTHPMFGPQSAPRAWTGLPFVYEKVRIGAHDDRRIARCEKFLGIFAREGCRMVEMSCADHDKLAAGSQFITHTVGRVLEMLTVKSTPINTKGYESLLNLVENTCGDSFDLFYGLFMYNKNSLEMLERLDFAFEDLRKQLMARLHDVVREHLSDNAGIGKVQSLPDEYVHQLLLKNGQNGSAAAPLLSLPSEDLRSGDVVKLNNYKSNDANQSDDNSKLKIAIVGFGNFGQFLAKTFVRHGHRVLAYSRSDYSLVAQELGVSYFNNIDDLCEQHPEVILLCTSILSTEKVLKSLPVQRLKRSTLFVDVLSVKEFPRNLFLQHLPRNFDILCTHPMFGPESGKNGWNGLAFVFDKVRIGIDESRSSRCDQFLDIFASEGCRMVEMSCAEHDWHAAGSQFITHTTGRFLEKLELEGTPIDTKGYETLLSLVENTAGDSFDLYYGLFLYNRNAMEQLERFDLAFESVKKQLFDRLHGFYRQQVFKHEEKLHDSPERRMLPKISEDK

SEQ ID NO: 189696 - protein, 435 aa, Glycine max
  Coding DNA Sequence Number=SeqID_72918
  Gene Ontology: Mol. function=protein dimerization activity; Cellular component=nucleus; Biological process=transposition, DNA-mediated
  Homolog annotation: Hit_ID=P03010; Match level="QueryCoverage=76%, HitCoverage=41%, E-value=1e-22, Identity=25%"; Hit description =Putative AC9 transposase
  Pfam annotation: Domain name=zf-BED; Domain location=104-146; Score =24.1; E_value=0.00049; Accession=PF02892.5; Description=BED zinc finger
MRVREWEKESGGLYCYSIHWAREEEEKGPNLKKQVTVGDANYMDWGGAGAGLNNHYRTTYKDDQKSMMEVALISNMDPVNIGLGCSDKPAPVTSLKPRKKTMTSVYLKFFETAADGKTRRCKFCGQSYSIATATGNLGRHLANRHPGYDKSGEAVSNAAARPVTVVKKSQPHGKANQVDYDHLNWLLIRWLVLASLPPSTLEEKWLVNSYKFLNPSIQLWPSDKYRTVLDEVFRSMREDVRALLEQVSSKVSITLDFWTSFEQIYYMSVTCQWIDENWCFQKLLLDICRIPYPCGGAEIYRSLIKVLKFYNIENRILSCTHDNSTSAMHACHTLKEDLDGQKIGPFCYIPCAARTLNAIIDDGLRSAKQVISKIREFAIELNASPVISEDFIQLSTAYQEGIWKFPLDVSARWSGNYQMLDLVRKVGLYISNGFS

SEQ ID NO: 189697 - protein, 1169 aa, Glycine max
  Coding DNA Sequence Number=SeqID_72919
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q9SX33; Match level="QueryCoverage=99%, HitCoverage=96%, E-value=0.0, Identity=73%"; Hit description =Putative phospholipid-transporting ATPase 9
  Pfam annotation: Domain name=Hydrolase; Domain location=422-887; Score=26.4; E_value=9.9e-05; Accession=PF00702.16; Description =haloacid dehalogenase-like hydrolase
MSGGRRRKLRLSKIYSFACCKASFEGDHHSQIGGKGYSRVVFCNEPDSFVEDGVKNFADNSVRSTKYTLATFFPKSLFEQFRRAANFYFLVTGTLAFTKLAPYTAVSAILPLIIVIGATMVKEGIEDLCRKKQDIEVNNRRVKVHKADGIFEYTAWKNVRVGNIVKVEKDEFFPADLLLLSSSYDDAVCYVETMNLDGETNLKLKQGLEVTSSLQEDLHFLNFKATVKCEDPNANLYSFVGSMDFEEKNNALSPQQLLLRDSKLRNTDYIFGAVIFTGHDTKVIQNSTDPPSKRSRIEKKMDRVIYFLFCILFLMAFVGSIFFGIATKDDFQNGLMKRWYLTPDDSTVFFDPKRPAAAALFHCLTALMLYGFFIPISLYVSIEIVKVLQSIFINQDIHMYYREADKPARARTSNLNEELGQVDTILSDKTGTLTCNSMEFIKCSIAGVAYGRGATEVEKAMDRRKGSPSIHEHDIESEADNIRGSLDKRALIKGFNFADERITNGNWVNEPHADVIQKFFRLLVVCHTAIPEVDEETGNVSYEAESPDEAAFVIAARELGFEFYKRGQTSLLTYELDPVSCKKVERKYKLLNCLEFNSSRKRMSVIVEDEEGKILLLCKGADSIMFERLAKNGREFEEKTMEHVHEYADAGLRTLILAYRELDAEEYKEFDNKFSMAKNLVSADQDILIEEVSEKIEKNLILLGATAVEDKLQDGVPECIDKLARAGIKIWVLTGDKMETAINIGLLRQGMKQIIIHLDSPEIQALEKDGDKMAIAKASRQSVLLQISDGAAQLTAYRGSSHQAFALIIDGKSLAYALEDNMKNMFLELAIRCASVICCRSSPKQKAMVTRLVKSGARKTTLAIGDGANDVGMLQEADIGVGISGVEGMQAVMSSDIAIAQFRYLERLLLVHGHWCYRRISSMICYFFYKNITFGFTLFLYEVYASFSGQAAYNDWFLSLYNVFFSSLPVIALGVFDQDVSARYCLKFPLLYQEGVQNVLFSWRRILSWMLNGFISALIIFFFCTKAMELQAFDVEGRTAGKDILGAAMYTCVVWVVNLQMALAVSYFTMIQHFFIWGSILLWYLFLVVYGAMPPHFSTNAYKVFIEALAPSPSYWIVTLFVVISTLIPYFSYAAIRMRFFPMYHETVQWIRYEGKIKDPEFLSVQQHA

SEQ ID NO: 189698 - protein, 286 aa, Glycine max
  Coding DNA Sequence Number=SeqID_72920
  Gene Ontology: Mol. function=protein dimerization activity; Cellular component=intracellular; Biological process=regulation of ARF protein signal transduction
  Homolog annotation: Hit_ID=Q1SYN6; Match level="QueryCoverage=84%, HitCoverage=35%, E-value=2e-15, Identity=28%"; Hit description=Zinc finger, BED-type predicted
  Pfam annotation: Domain name=hATC; Domain location=166-246; Score =111.1; E_value=3.2e-30; Accession=PF05699.5; Description=hAT family dimerisation domain
MLLGSSDKSAVSIMHQYLEPFYKTTNNICTSKVPMVGLVLFFVDHISETITSFRESRLSPEWLKNAAEEMAKKARNYINQVCNIFTYMTAILDPRIKGDLIPDSLNSENFLDEARTHFIRNYSASHFSSMSSGYNAQEIEDGGSVSFAEEIARKKRRTSMSSATDELTQYLSEAPAPIPTDVLEWWKVNSTRYPRLSVMARDFLAVQATSVVPEELFCGKGDEIDKQRICMSHDSTQAILCIKSWIQVGIKFKFKSTEIDYERLMELAAAAAATDNSPSSSDKKQR

SEQ ID NO: 189699 - protein, 533 aa, Glycine max
  Coding DNA Sequence Number=SeqID_72921
  Gene Ontology: Mol. function=translation initiation factor activity; Cellular component=eukaryotic translation initiation factor 2B complex; Biological process=cellular metabolic process
  Homolog annotation: Hit_ID=Q10G37; Match level="QueryCoverage=72%, HitCoverage=63%, E-value=1e-159, Identity=71%"; Hit description =Translation initiation factor eIF-2B delta subunit, putative, expressed
  Pfam annotation: Domain name=IF-2B; Domain location=243-533; Score =295.5; E_value=1e-85; Accession=PF01008.8; Description=Initiation factor 2 subunit family
MDAPRVSRAIGDPKIRRVGFFASDSSATDSLMIPSPRHRSIPVPPTHPSGDRHVASGSYDPTEYPKLATGIEKRGEEEEEKEVLQSSLKPLKAKTTKAERRALQEAQRAAKAASKDEGSKAVAESGRGTPGKSTKQSSQKKGGPSCVSPVATDKNAGNRPLDKDRKMDAPSPRMQFDDKSRLEKARRCAVVNPTESRNKVELFQHLPQYEYGTQLPNLESKFFQIGSVHPAVFEVGLRYSAGDISGGNARCIAMLRAFQDAIRDYCTPHEKVLVRDLASKISSYVSFFTECRPLSMSMGNAIRFVKSRIVNLTLNHSEFEAKTTLCSDIDRFINEKIILADKVIVRHAFTKVKDGDVLLTYGLSCVVEMILLYAYEQGKKFRVVVVDSRPRLEGQALLRRLVAKGLSCTYTHINAVSYIMHEVTRVLLGASAVLSNGTVYSRVGTSCVAMVAHAFHVPVLICCEAYKFHERVQLDSICSNELGDPDAIARVPGRMDVSYLSNWASEDNLRLLNLMYDATPSDYVSVIVTDYGM

SEQ ID NO: 189700 - protein, 89 aa, Glycine max
  Coding DNA Sequence Number=SeqID_72922
MEILPLYKMIVGLQGCVYKIDSFYGGSLKLEDRDLPSYLSSLSKRLFLTLRSGFTLLSWIDSLYGGSLKLEDRDFPSYLSSLSERLTHA

SEQ ID NO: 189701 - protein, 184 aa, Glycine max
  Coding DNA Sequence Number=SeqID_72923
  Gene Ontology: Mol. function=transition metal ion binding; Cellular component=chromatin; Biological process=proteolysis
  Pfam annotation: Domain name=Transposase_21; Domain location=16-184; Score=139.6; E_value=8.4e-39; Accession=PF02992.5; Description =Transposase family tnp2
MAKAVMMQPQIIVIQQRFVADYPQWKTIDQLYPEFGKDPRNLRLGLVSDGMNPFAGPRQQGNDIDVYLTLLIEDLRKLWVDGVDVYDGSLKKTFRLRTMIFCTINDFPAYENLSRYSVKGHHACPICEKNTSYIQLEHGKKTVYTRHRRFFKPYHPYRRLKKAFNGENEIESAPKPLGGHEVYD

SEQ ID NO: 189702 - protein, 88 aa, Glycine max
  Coding DNA Sequence Number=SeqID_72924
MSDLTSKWALAADKDNFNDIDLRKKEQAIHKQNTSSYVLPRGGYEYLEKKLMDEKTKKKLEKAAQSRSTNTVIDPPSPIKKHVKWKMA

SEQ ID NO: 189703 - protein, 173 aa, Glycine max
  Coding DNA Sequence Number=SeqID_72925
VFAFSERFSETIAVSFAIKRQASLLARRDKLWSSASFFKTSMSFGPDYYNLLCHPETIESVGTQRQIMVICPLFEDFHAFRDKLWSSAPFLKTSMSFDRDYYSLLCHPEISESVGTQRQIMVICPLFEDFHVFRSRLLQSPLPSRDKRVRWYAVTIIVIRFIVFKTIAVSFAI

SEQ ID NO: 189704 - protein, 111 aa, Glycine max
  Coding DNA Sequence Number=SeqID_72926
ALHTFVAWPTDLVKLVFDEDEEIIPHKVDAHGDKPANVDTDDPMRGLIKYNFDIYDKPVECKFDGSKFGIADAPPLIFLTYSDETCGECKGYLERWLKESDREVYVGPYFH

SEQ ID NO: 189705 - protein, 251 aa, Glycine max
  Coding DNA Sequence Number=SeqID_72927
  Gene Ontology: Mol. function=adenosine deaminase activity; Biological process=purine ribonucleoside monophosphate biosynthetic process
  Homolog annotation: Hit_ID=Q4X1Q4; Match level="QueryCoverage=35%, HitCoverage=31%, E-value=1e-22, Identity=50%"; Hit description =Adenosine deaminase
YDGVFEVLQWLLFLSAVPPVQLLTGWCVTAKAPPDISAGKCSGRVPFAIQAAQLLGRAIGAGLFAITPAGERGMCCKAIKLGNARVFPEFDGDCGPIHIHAALHGEMPDAETRDDGLVSYASRGMCLRIEEDFRVVDVVKMGALEVCPAEGFEVVGRDEYGHADEVVMQEVVQGGSSLSIPSTSRGGPVPAFVPFSEVGKPVVPAALMNRPTRGERRFAYWALAECILAYYVGTDEGVSEVLHVAGEKRLH

SEQ ID NO: 189706 - protein, 253 aa, Glycine max
  Coding DNA Sequence Number=SeqID_72928
  Gene Ontology: Mol. function=DNA binding
  Homolog annotation: Hit_ID=Q1SFS3; Match level="QueryCoverage=68%, HitCoverage=39%, E-value=5e-14, Identity=30%"; Hit description =Lambda repressor-like, DNA-binding
VKSLDVTSLKELGRLMGPLQRQAFHKVYGKILDLTAAEVFTEAVVSLAQYYDQPLMCFTFGDFQMIVAVVGDSAKELDRMKQTRNGVVGLPRKYLKGKARDMASQEKWGPFADILALLIFGVVLFPNVDGLVNLAAIDAFLAYNHSKESPVVAILADLFDTFDRRKSRLGPTFGWDRGQRDQLVSSLEGRQGRSSFVVWGLGKARLAKEKFKAAATHIRKECTELQEKNAATARALEQETKRVRKEEYGREKF

SEQ ID NO: 189707 - protein, 63 aa, Glycine max
  Coding DNA Sequence Number=SeqID_72929
MGAYSKDEKLLMHFIQDSLAGAVVAWKPHYKRNLKESWASSSKRNNTRKSSLPWIQTENANET

SEQ ID NO: 189708 - protein, 368 aa, Glycine max
  Coding DNA Sequence Number=SeqID_72930
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=8e-49, Identity=33%"; Hit description= UPI00006A17C9 related cluster
VLHALAFRGLHVLTFRGLDANAFRGLHVLTFRGLHALAFKRLHALAFKGLDILAFRGLHVLAFRGLHVLAFRGLHALPIRGLHVLTFRGLHVLAFKGLPALAFRGLHVLAFRGLHVLPIRELHVLAIRGLHILAFRGLHVVTFKGLHTFAFEGLHALTFKGLHVLAFRGLHVLAFRGLQDLTFRGLHVLTLRGLHALAFRGLDVLTFRGLLALTFKGLHVFAFRGRATCPHHQRATRPHVQRTTRPHLQRAARPCLYWTTRPRLQRTTRPRLQRTTRPPYQGTARPRHQRTTRPRLQRTTRPCLHRAARPHPQRTTRPRLLRTTPPHLQRTTHPHLPTATRPCLQRTTRPHIQRTTRPCLQRTRRPHL

SEQ ID NO: 189709 - protein, 53 aa, Glycine max
  Coding DNA Sequence Number=SeqID_72931
  Gene Ontology: Cellular component=coated vesicle membrane; Biological process=intracellular protein transport
  Homolog annotation: Hit_ID=Q1SEA1; Match level="QueryCoverage=87%, HitCoverage=32%, E-value=8e-13, Identity=70%"; Hit description =Longin-like
MGMRLMLMVNKQGQTRLAQYYEHLIIQESQALEGKILHKCLARNDNQILNVCT

SEQ ID NO: 189710 - protein, 82 aa, Glycine max
  Coding DNA Sequence Number=SeqID_72932
MIKGIRFKYPSAKSGGLGYKGYEMTRLGHDSNRQDMFVGLLKIRGNLYTQEAKIVTFGGGAEGLLLVVLINLSHEISKAEHW

SEQ ID NO: 189711 - protein, 272 aa, Glycine max
  Coding DNA Sequence Number=SeqID_72933
MDGHIDVALVKEFYSNLYNPKDKSPKQVQVRRKLIKFDAASLNAFLETPPLIQPGEQSTLEALEEGSDYTSPDLECGEVSLWASFEDGHGCGLPHITPDFSDGLVQLLAARLPSPHHRLMHRPRSYLGFSNFRARARGSEGPSSSAPALASTSAHASSDPTTSTSHPPSSVPAPSGTSAQSLDLTVPMLQSLHHGLRLVMQSIHDLAQHQPIMSMEEFTTQVAWPGVQPSPLRGGEASAAQEPHSQPEVSEEEENGAADLDYVADMTAAQST

SEQ ID NO: 189712 - protein, 99 aa, Glycine max
  Coding DNA Sequence Number=SeqID_72934
MSKKPKDGSESDGVRVVRVVSDDGDQGGQSRVTLVRVVSCSGERGVGERAILVSPPLNGDNFHSWSHAMRRALLTKNKHKFKDETITTPINKGDPLFDT

SEQ ID NO: 189713 - protein, 72 aa, Glycine max
  Coding DNA Sequence Number=SeqID_72935
MPATELLLLFLLRLRLRLNLRRWQWRQRVRGRGRNERVKIKGRFHFDQSKVRSEIRLHEGRARPIDLNGSDD

SEQ ID NO: 189714 - protein, 82 aa, Glycine max
  Coding DNA Sequence Number=SeqID_72936
MVDYEGDEEDWCLLHLGTLHDVELGDTNMNVPKSLVIHFTRNATTYMPQGFYPIVLKAPSSFPYESNKIVLWRYDAQVSEGG

SEQ ID NO: 189715 - protein, 105 aa, Glycine max
  Coding DNA Sequence Number=SeqID_72937
  Homolog annotation: Hit_ID=Q9M112; Match level="QueryCoverage=32%, HitCoverage=4%, E-value=6e-11, Identity=94%"; Hit description =Putative GTP pyrophosphokinase
MEIVKDYIATPKPNGYQSLQTTVIPFLYERMFRLEVQHFYIGSDMTDVEMLTILRRSRVKDRLRMLSILHRLFNDRRRKLSILHQSCNCDRHRMLNFLHRSQLKD

SEQ ID NO: 189716 - protein, 210 aa, Glycine max
  Coding DNA Sequence Number=SeqID_72938
  Homolog annotation: Hit_ID=Q9FN45; Match level="QueryCoverage=64%, HitCoverage=67%, E-value=1e-23, Identity=41%"; Hit description =Genomic DNA, chromosome 5, P1 clone:MYJ24
GVNSASGTESGPEQEQTEFLAGALVGVDEMKRFGVGVTHHVLEIGAHIHELLGGGGGGGGEAGGDDAGTDGDALHGAEDVADAVSGAAAGGEAGLLAVAKGSPEGDGAEGAGVGGCGALKGDADDAVPHFSDENHTWPRRLPKMVPITIDFEGRGGAVEAAVEDDVEEAGEEGDGGLRLGREETWKKEPTEGVDGHFGGGCDLVDHVSAC

SEQ ID NO: 189717 - protein, 198 aa, Glycine max
  Coding DNA Sequence Number=SeqID_72939
  Gene Ontology: Mol. function=nucleic acid binding
MNNLFGDVGDDNQDAEEEDGESDDDDFVVVDDESDPDFGIDVLCENDGDLFDTSNYNYEFESMRSLPSSDDEGGSIRKMVYPQFDTSSRFRHGGQMGKNIRGKTCCKVKGCPWEIYCAWNKATKSFQLKTFVKEHNCGSIFKNNQANRKWVAKNLSEKLKIHPTLTHHETHEYMKIEFGVTIDERKMCRALQKAKKHG

SEQ ID NO: 189718 - protein, 53 aa, Glycine max
  Coding DNA Sequence Number=SeqID_72940
MEVIKLIKLVWVGDKEENQQSQRRAASPCMPQLIRLLSFMETKHFIPPGIDTT

SEQ ID NO: 189719 - protein, 379 aa, Glycine max
  Coding DNA Sequence Number=SeqID_72941
  Gene Ontology: Mol. function=transporter activity; Cellular component= mitochondrial inner membrane; Biological process=mitochondrial transport
  Homolog annotation: Hit_ID=Q10NJ7; Match level="QueryCoverage=99%, HitCoverage=97%, E-value=1e-110, Identity=50%"; Hit description =Mitochondrial carrier protein, expressed
  Pfam annotation: Domain name=Mito_carr; Domain location=147-237; Score=107.4; E_value=4.3e-29; Accession=PF00153.17; Description =Mitochondrial carrier protein
  Pfam annotation: Domain name=Mito_carr; Domain location=297-377; Score=55.2; E_value=2.2e-13; Accession=PF00153.17; Description =Mitochondrial carrier protein
  Pfam annotation: Domain name=Mito_carr; Domain location=35-136; Score= 66.9; E_value=6.6e-17; Accession=PF00153.17; Description =Mitochondrial carrier protein
  Pfam module annotation: Pfam domain module=Mito_carr::Mito_carr::Mito_ carr; Domain location=147-237::297-377::35-136
MEAARVGVAVEGGHGNKSNNVKMLQQPKNQQAQMGTVSQLLAGGLAGAFAKTCTAPLARLTILFQSWMQNCLHGMHFDVAALSKPSIWGEASRIVNEEGFRAFWKGNLVTIAHRLPYSSVSFYAYERYKNLLHMLLREKHRGNTSADHFVHFVGGGLSGITAATATYPLDLVRTRLAAQRSSMYYRGISHAFTTICRDEGFLGLYKGLGATLLGVGPNIAISFSVYESLRSCWQSRRPDDSTVMISLACGSLSGVASSTDSGGGGYGGNDNSNDGDAGGDGCIDHCLWWRWVRQLNSDGSATFPLDLVRRRKQLEGAGGRARVYNTSLFGTFKHIIQNEGVRGLYRGILPEYYKVVPSLGIVFMTYETLKMLLSSIPRD

SEQ ID NO: 189720 - protein, 213 aa, Glycine max
  Coding DNA Sequence Number=SeqID_72942
  Gene Ontology: Mol. function=nucleic acid binding
MAELATSQGTDVSQLIRPPNIGDNQINFPSWVHNNLNHNQFMGASTKDPMLISQDFYNYAATDWLNLHLHHSLTTWEEVMDKFFNHFFPESRVKAIKEHIVNFKQAPTELLFDTWERYKALLRRITNGCRRMINASVGGNYPNKTTTKVKTIIEDMAASERIVETNRSNLPKGMYELNAQDNLLALQQKMQQVKDIEERMNLHENRSCNHRCS

SEQ ID NO: 189721 - protein, 116 aa, Glycine max
  Coding DNA Sequence Number=SeqID_72943
MALLHLCNAGLELLESISICHGRWGRIESFEWGLASEARPSSLSIPSTSRGGPVPAFVPFSEVGKPVVPAALMNRPTRGERRFAYWALAECILAYYVGTDEGVSEVLHVAGEKRLH

SEQ ID NO: 189722 - protein, 126 aa, Glycine max
  Coding DNA Sequence Number=SeqID_72944
  Homolog annotation: Hit_ID=Q47522; Match level="QueryCoverage=33%, HitCoverage=53%, E-value=2e-19, Identity=100%"; Hit description=LacZ protein
VLQWLLFLSAVPPVQLLTGWCVTAKAPPDISAGKCSGRVPFAIQAAQLLGRAIGAGLFAITPAGERGMCCKAIKLGNARVFPEFDKGCQRVALPSGRCMWERLGSSWVLTFVRGVISLDYAQTLYE

SEQ ID NO: 189723 - protein, 65 aa, Glycine max
  Coding DNA Sequence Number=SeqID_72945
PAEPGFYFLSMPYSGSVHGKGHMARRLAEARAGEAPAEAPDEADETREDEEMTDLLDFLGWSRAT

SEQ ID NO: 189724 - protein, 52 aa, Glycine max
  Coding DNA Sequence Number=SeqID_72946
MDSSSVAKHYQDATTLACTWHLAMSSSINKGVTMGWPDEPPGLYGLQKIRLI

SEQ ID NO: 189725 - protein, 109 aa, Glycine max
  Coding DNA Sequence Number=SeqID_72947
MTVMGNSSKKECAPTVEASQGRKNGQSGKRYQSHQGEQLHWKHSSEFGENWKKGRRGRRRRRRGLDYVVVAVDGGGGGFRWRRGREEGEGVGQSGGGVARLTAMVAWRG

SEQ ID NO: 189726 - protein, 305 aa, Glycine max
  Coding DNA Sequence Number=SeqID_72948
  Homolog annotation: Hit_ID=Q5XM22; Match level="QueryCoverage=20%, HitCoverage=35%, E-value=7e-16, Identity=68%"; Hit description =Resistance-like protein HAAS-2
  Pfam annotation: Domain name=DUF1723; Domain location=24-73; Score =41.0; E_value=4.1e-09; Accession=PF08330.1; Description=Protein of unknown function (DUF1723)
SVPAIDGLAAGTGLSPLIACSVEIGDRGLLSSFVERWHRETSSFHLPTGEVTIMLDDVSSLLHFPGRLPGLRQGSVVDRTYAYNGYVIFMSADAMQVIGQLRLVRIFFIFWVGLCLLTRVQPMFMLCFWRPFVTSVRPGVAKSTADPDYDEGIHRMPVGSAWTDSGFRMSVGSYMGSTDRVMQLFGYTQTIPALPVNSWVSYDDIHDRWMHYSDHMVAAGEVCAVPDPLPDGHALQPRVIPQVPETNIPHVPKPGAPSISARPAVDEPGHAVEVCYGIAERLERHLSLGVVMPGSSKFHSQLTQM

SEQ ID NO: 189727 - protein, 677 aa, Glycine max
  Coding DNA Sequence Number=SeqID_72949
  Gene Ontology: Mol. function=DNA-directed RNA polymerase activity; Cellular component=membrane; Biological process=regulation of transcription, DNA-dependent
  Homolog annotation: Hit_ID=P06223; Match level="QueryCoverage=64%, HitCoverage=97%, E-value=0.0, Identity=74%"; Hit description=RNA polymerase sigma-54 factor
  Pfam annotation: Domain name=ABC_tran; Domain location=29-213; Score =195.6; E_value=1.1e-55; Accession=PF00005.17; Description=ABC transporter
  Pfam annotation: Domain name=Sigma54_AID; Domain location=230-278; Score=72.2; E_value=1.6e-18; Accession=PF00309.10; Description=Sigma- 54 factor, Activator interacting
  Pfam annotation: Domain name=Sigma54_CBD; Domain location=333-531; Score=372.2; E_value=8.3e-109; Accession=PF04963.3; Description =Sigma-54 factor, core binding domain
  Pfam annotation: Domain name=Sigma54_DBD; Domain location=543-676; Score=271.8; E_value=1.4e-78; Accession=PF04552.3; Description=Sigma- 54, DNA binding domain
  Pfam module annotation: Pfam domain module=ABC_tran::Sigma54 _AID::Sigma54_CBD::Sigma54_DBD; Domain location=29-213::230-278::333 -531::543-676
MATLVAENLAKAYKGRRVVEDVSLQVKSGEIVGLLGPNGAGKTTTFYMVVGIVPRDAGRIIIDEEDISILPLHARARRGIGYLPQEASIFRRLSVYDNLMAVLQVRDDLTEEQRQDRANELMDEFHIGHLRDSMGQALSGGERRRVEIARALAANPKFILLDEPFAGVDPISVIDIKKIIEHLRDSGLGVLITDHNVRETLAVCERAYIVSQGHLIAHGTPDEILADEQQGLQLRLSQQLAMTPQLQQAIRLLQLSTLELQQELQLALESNPLLEQTDLHDEVDAREFQENEALDTREALEQKEMPEELPLDATWDEIYTAGTPSGTGTDYQDDELPVYQGETTQSLQDYLMWQVELTPFTDTDRAIATSIVDAIDDTGYLTVSLQDICDSIGDEELTLEEVEAVLKRVQRFDPVGVGARDLRDCLLVQLSQYAADMPMLNEARLIVSEHLDLLANHDFRSLMRVTRLKEEVLKEAMLLIQSLDPRPGQSINTSEPEYVIPDVLVRKTGTRWTVELNADSLPRLKINQHYAAMGGSARNDSDSQFIRSNLQEARWLIKSLESRNDTLLKVTRCIVEQQQAFFEQGEEYMRPMVLADIAQAVDMHESTISRVTTQKYLHSPRGIFELKYFFSSHVSTEGGGEASSTAIRALGIMVARRTVAKYRESLSIPPSNQRKQL

SEQ ID NO: 189728 - protein, 264 aa, Glycine max
  Coding DNA Sequence Number=SeqID_72950
  Homolog annotation: Hit_ID=Q8PIW4; Match level="QueryCoverage=49%, HitCoverage=14%, E-value=3e-62, Identity=87%"; Hit description =Leucyl-tRNA synthetase
DAAAGRVGVRRDGVAAAGCGRPARAGQPAACQRLDDLGAGFCRRDLVAGHVAGAPGAWARAGRRGARLWRAGRAGGVCPAGRAAGAAGTTACVRLLGGLAGPGPAVVAATLRLAAGAGGACLEPAGLETFAALRRLNPPPSSTGTPPVHFEVDETSDKPKYYCLSMLPYPSGALHMGHVRNYTIGDVISRYKRMTGHNVLQPMGWDAFGLPAENAAIKNKTAPAAWTYKNIDHMRSQLKSLGYAIDWSREFATCRPDYYVHEQR

SEQ ID NO: 189729 - protein, 282 aa, Glycine max
  Coding DNA Sequence Number=SeqID_72951
  Gene Ontology: Mol. function=ATPase activity, coupled to transmembrane movement of substances; Cellular component=integral to membrane; Biological process=transport
  Homolog annotation: Hit_ID=Q1MJ31; Match level="QueryCoverage=90%, HitCoverage=40%, E-value=1e-121, Identity=89%"; Hit description =Putative ATP-binding component of ABC transporter
  Subcellular localization annotation: CTP_CleavageSite=65; ConfidenceScore=5.16e-01
MPWPLRRPLCQGSKQQNGKSAALFRWSGGGGKARDNAHFVAFAHLLQMFFGRSCLALAVPHRGVEAVLGKQFAMRAALGDLAALQHDDLVGADDGRQAVGDDQRGAVLRHGIERGLDFAFGRGVERRCRLVQDQDRRRLQDGAGDRHALLLAAGEFEAALADLGLEAFRQQLDEMGDLGDFGGRLHVCLAGRRAAVADVVGDRVVEKHGILRNHADRRSQALLRQSADILAVDGDRPALDIVEAVEQARQRRLAGPGRADDGDGLAGGHVEGDAIQDRARRI

SEQ ID NO: 189730 - protein, 402 aa, Glycine max
  Coding DNA Sequence Number=SeqID_72952
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=79%, HitCoverage=93%, E-value=1e-124, Identity=80%"; Hit description =Photosystem I P700 chlorophyll a apoprotein A1
  Pfam annotation: Domain name=PsaA_PsaB; Domain location=1-235; Score=- 138.2; E_value=0.0003; Accession=PF00223.9; Description=Photosystem I psaApsaB protein
AVGGKVALLPIPLGTADFLVHHIQAFTIHVTVLILLKGVLFARSSRLIPDKANLGFRFPCDGPGRGGTCQVSAWDHVFLGLFWMYNSISVVIFHFSWKMQSDVWGSISDQGIVNHITGGNFAQSSITINGWLRDFLWAQASQVIQSYGSSLSAYGLFFLGAHFVWAFSLMFLFSGRGYWQELIESIVWAHNKLKVAPATQPRALSIVQGRAVGVTHYLLGLAQDPTTRRIWFGIATAHDFESHDDITEERLYQNIFASHFGQLAIIFLWTSGNLFHVAWQGNFEAWVQDPLHVRPIAHAIWDPHFGQPAVEAFTRGGALGPVNIAYSGHLVHVAIPGSRGEYVRWNNLLSILPHPEGLGPFFTGQWNLYAQNPDSNSHIFGTPQGAGTAILTLLGGFHPQTQ

SEQ ID NO: 189731 - protein, 884 aa, Glycine max
  Coding DNA Sequence Number=SeqID_72953
  Gene Ontology: Mol. function=transferase activity, transferring glycosyl groups; Cellular component=periplasmic space; Biological process=carbohydrate biosynthetic process
  Homolog annotation: Hit_ID=P33136; Match level="QueryCoverage=52%, HitCoverage=91%, E-value=0.0, Identity=76%"; Hit description=Glucans biosynthesis protein G precursor
  Pfam annotation: Domain name=MdoG; Domain location=158-634; Score =1012.0; E_value=2e-301; Accession=PF04349.3; Description=Periplasmic glucan biosynthesis protein, MdoG
RGSKVENQPAEGAPHQRIGQQGQRQLAPANLLIIDAALLIAQPAEAQHAKRGENHQYHIKNCGRVMSGTAVNSGMPTRSSRTFSQRTVSHSEASWLLTDQRWVDLLAGFTLKPDYAGRNSTGCKQRILSVKNNGGLVKMRWVGAAVLLALYANNSWAFNIDDVAKQAKALAGKGFEAPKSNLPSQFREMKFADYQQIQFNHDKAYWGKLRTPFKLEFYHQGMYFDTPVKINEVTASSVREIKYNPDYFNFGNVKHDADAVKNLGFAGFKVLYPLNKKGKDDEITSFLGASYFRVIGEGQVYGLSARGLAIDTALPSGEEFPRFKEFWIERPKPQDKQLVIYALLDSPRAAGAYRFVIQPGKESTVDVQSKVYLRDNVGKLGVAPLTSMFLFGANQPSPVSNFRQELHDSNGLSIHAGNGEWIWRPLNNPKHLAVSTFTIENPKGFGLLQRGRDFSHYQDLDDRYDLRPSGWVEPQGDWGKGRVELVEIPTADETNDNIVAFWTPESLPEPGKEMNFKYRLHFTRDENQLHQDDVAWVKDTLRSAGDVKQSNLVRQPDGSIAFTVDFVGKAMSKLPENTHVAPQVSVGNNADVVEQKSTLQPGHTKAGVWCCVCAYLPMNKSTYLPQSYVEALPLDAAARATLSASLQNAQAFHAIHSALGQDIAASERPDDAPLKSVSSRVSMAWPDSLADGQQLSKDYLDRTTLKAMPPVKRSLMFPEAWRTNPIARAWDSLRGQKGNPRYATVEEQKAEDKWRHVGSMRRYVLLILTILQTVVATWYMKTILPYQGWTLLDPVELFNQNWLQSVELILPYILQTGILFLFAILFCWVSAGFWTALMGFLQLLIGRDKYSISYSTTGDEPLNPEHRTALIMPICNEDVERVFA

SEQ ID NO: 189732 - protein, 163 aa, Glycine max
  Coding DNA Sequence Number=SeqID_72954
  Gene Ontology: Mol. function=chitin binding; Cellular component =extracellular region; Biological process=chitin metabolic process
  Homolog annotation: Hit_ID=Q86AI8; Match level="QueryCoverage=78%, HitCoverage=25%, E-value=3e-11, Identity=38%"; Hit description =Similar to Homo sapiens (Human). Mucin 2
MKGTVHEPQVNIGADQKFPTSNIQSCGFGMTGPLDESISCFLIRMDPWVLVPITFRGLHVLTIRGLHALTFRGLHDYTCVALRGLHVLTIRGLHALTSRGLHVLALRGLHALTLGTSYPHRQRTTRPRLERTTRPHHQRAARPHLQRTTCPRLERATRPHLGY

SEQ ID NO: 189733 - protein, 95 aa, Glycine max
  Coding DNA Sequence Number=SeqID_72955
  Subcellular localization annotation: CTP_CleavageSite=48; ConfidenceScore=5.28e-01
MRVHCNQASRRPSMTTDSPPLLMFPQTRWSRQLSQPTLRREGDARLTGASSKEGKHTKSPPTFIRGKRWKNWKRCGLRTLSMKGSGVVLTHGEGL

SEQ ID NO: 189734 - protein, 109 aa, Glycine max
  Coding DNA Sequence Number=SeqID_72956
EDEGPTAQVPQHVEDESFEATILETFVIREEVDETQVRQVAAATPERSLEATSVPPAPMVDLPSPHHTIDPSTPILEIPEDPTTPVLTIDTSPPATPILHLTNEEDVQT

SEQ ID NO: 189735 - protein, 80 aa, Glycine max
  Coding DNA Sequence Number=SeqID_72957
MNENAILGAPNKGREWRIALSNHYAWLQTRGWRMHERKRNSWGSEKGVENGELHYAITTLSSKLEGGGHMNENAIHGAPK

SEQ ID NO: 189736 - protein, 111 aa, Glycine max
  Coding DNA Sequence Number=SeqID_72958
  Subcellular localization annotation: CTP_CleavageSite=8; ConfidenceScore=5.11e-01
TNIVFCTLCQSRSEPVDTQRLTSSSALFVNRDPEHDSTQRLTSSSALFVNRGPSPLTQANIVFCTLCQLRSEPVDTQGLTSSSAPFVNRGGNTQVVIRINILSLPIRPRAR

SEQ ID NO: 189737 - protein, 132 aa, Glycine max
  Coding DNA Sequence Number=SeqID_72959
MGCNSLSELVSLSETFMLSKSSLMARIALSELVMQSKLFPLNGIALSELVLLSELFPLGGITLSELVSLSELFNKSPRCSNIYHYFLAKVISHAQDVILQFPMVKMWRHGFRAHNPSLKAIQRLMSPRSWFY

SEQ ID NO: 189738 - protein, 58 aa, Glycine max
  Coding DNA Sequence Number=SeqID_72960
MVEDVCFLYKRRWKNTLKLRFLSQKLHEYRLTTVLNVLKNKDAVSNLQNCSYGIRMCG

SEQ ID NO: 189739 - protein, 114 aa, Glycine max
  Coding DNA Sequence Number=SeqID_72961
MEESIGKITKITFPSQEGPLLTVKHTLENGGINRENNKDHISQSRGTHWRMEESIGKIKKITFPSQEGPLLTVKNTLENGGINRENNKDHISQSRGSALDGVAHIGEWRNQSGK

SEQ ID NO: 189740 - protein, 214 aa, Glycine max
  Coding DNA Sequence Number=SeqID_72962
MSIDRDYFSFPSSSRDGKSDDMQRPIWSSTPFVEDSSIDRDYFSLPSSSREGKSDDTQKPIWSYAPFVEDSMSIDRDYFSLPSSSRDGKSDDPYKPIWSSATFVENSMSIDRDYFSLPSSSRDSKSDDMQRPIWSSAPFVKDLMSIDRDYFSLPSSSRDSKSNDTQRPIWSSAPFVEDSMSIGRDYFSLPSSSRDGKSNDTQRQIMVILTLFII

SEQ ID NO: 189741 - protein, 91 aa, Glycine max
  Coding DNA Sequence Number=SeqID_72963
  Gene Ontology: Mol. function=catalytic activity; Biological process =metabolic process
  Homolog annotation: Hit_ID=Q9ZW77; Match level="QueryCoverage=98%, HitCoverage=18%, E-value=2e-30, Identity=67%"; Hit description =Putative carboxyphosphonoenolpyruvate mutase
MARSDARQVVSLEEVLVRSRAFANAGADVLFIDALASREVMKAFCNVSPFVPKMANMLEGGGKTPILNPMELEDVGFKIVVYPLSLTGVSI

SEQ ID NO: 189742 - protein, 98 aa, Glycine max
  Coding DNA Sequence Number=SeqID_72964
MEVHEEKLATKNEMKRTLEDDENYENTSVEMDGVIVTKREKTMVVHLTQILRVITTLVSYPNFVRELLLDDMQPLIGRFEIPGTLCCTICEVPRRVGN

SEQ ID NO: 189743 - protein, 93 aa, Glycine max
  Coding DNA Sequence Number=SeqID_72965
MVDILFLLKQQTSLEITSEKSVVKVDVHLVPFDIFPDQKLSCMVIKSKVEDNLISGHQFFFHEGTGIMSQQLMAHHRGWRLAIRCVFLGPAEA

SEQ ID NO: 189744 - protein, 128 aa, Glycine max
  Coding DNA Sequence Number=SeqID_72966
FESVLCDGNIRNDDSRYTSDGCDNSGDSCNNADGNGYVVVVVAVLMVVTVTTNYDDNNDDSSDDGISGGDDGGGVGGYGCGGSGDGVIVKFIRVPLCSHPIDILGVQTVFLEEDGKKRISISHLLEGN

SEQ ID NO: 189745 - protein, 228 aa, Glycine max
  Coding DNA Sequence Number=SeqID_72967
  Gene Ontology: Mol. function=cation transporter activity; Cellular component=membrane; Biological process=cation transport
  Homolog annotation: Hit_ID=Q3BVR8; Match level="QueryCoverage=76%, HitCoverage=49%, E-value=2e-59, Identity=65%"; Hit description =Cation diffusion facilitator family protein
MFASCTRGVQKRDDGRERARASGGCTGGSTGQACTETSSVRCRRRGQCGSPGGIDLRRLRLDEQCHQFRKLLLHCSFDAGDAGFDLRRAPVILEFRAEHGHDLFRAHLHGGHAIGAAQVRIGFGHGHDPLSHRRMGRLAHQQSLGFACEKKGGGGKHAGDAQRRHTIKHRHVQDLGGHEPDQCETQAQQGRAILQQHGKGGRILAAAERFEVAELALGAPELAQRHPP

SEQ ID NO: 189746 - protein, 487 aa, Glycine max
  Coding DNA Sequence Number=SeqID_72968
  Gene Ontology: Mol. function=nucleic acid binding; Cellular component= chromatin; Biological process=DNA integration
  Homolog annotation: Hit_ID=Q1SRN1; Match level="QueryCoverage=80%, HitCoverage=44%, E-value=2e-43, Identity=36%"; Hit description =Integrase, catalytic region
NHNIHQLGHFDGPDQIYIGNGEGLKILGSGSGSSRSPTNPNFPLYLHNLLHATNEVLLQGIAGSDGLYSFPNLKLQEFSASQPSLRVPVSFTATVSKDVVFNENRFPYSELFPQASYSMTSAPQHFSLTPSFPPFTQTPPTASIPNTVSDSIPLHSSSDPASNTVSAPNSVTSPVTSSAFSDPSTHQSVASTNLSQQQLQDVSDPPTQSSVSVPESEHQLLLRPPNVHPMQTRSKSGFHNPRIHPSLFLTHCEPRGVKQEMADPDWLSAMKQEYNALINNHTWDLVSLPTNRKAVGFKWVFRVKENADGTLNMYKARLVAKGLITIRIIITLALTNGWDLLQLDVNNAFLNGILEETVLFVRAMCDDWASDVDDDRRSTFGFALFLGLNLISWWSGSSKSLQGVGCPFCYSNSAMITKVLLPHNPVFHSRTKHVKIDVFFVQEQVLSKQLAIYHIPSLDQWADILTKPLSPNRFDFLKSKLNVKDFI

SEQ ID NO: 189747 - protein, 166 aa, Glycine max
  Coding DNA Sequence Number=SeqID_72969
MSVAEVEPFGGVDSGIEGEKEGLLGLAVIREVDGNNVGMVVGTVSVGDGVGLSYRGSRGVRGRGGIGVWVRNVCAEEEDGGGIDTGDGGGSGARRKKGSGGWFSEAVLGERHPVSIRGGVEQQDWPRQSSLAGENSRWVSVGMAAMEAPFGEWQPWKATIEAPFGE

SEQ ID NO: 189748 - protein, 142 aa, Glycine max
  Coding DNA Sequence Number=SeqID_72970
  Pfam annotation: Domain name=COX17; Domain location=17-68; Score=3.4; E_value=0.00014; Accession=PF05051.3; Description=Cytochrome C oxidase copper chaperone (COX17)
MSGAQLQSASPALIIQGSQKNEGSVAVATAAESKPKKKICCACPDTKRLTVEILNKSREIDCYKQFIIFEPAVRIIYRIQRSKDVEIKMTQGCMNDTGGLQEVNTTRSKRKNAPPTCLRNVQHGWHHASCIHAPHIGKAQTI

SEQ ID NO: 189749 - protein, 63 aa, Glycine max
  Coding DNA Sequence Number=SeqID_72971
  Subcellular localization annotation: CTP_CleavageSite=41; ConfidenceScore=5.22e-01
MCNFRRASTIKCSFNVLSATEESGRASSSRSHTKREISVLSAAVVFSQAQRTTGAKLKCTYSR

SEQ ID NO: 189750 - protein, 459 aa, Glycine max
  Coding DNA Sequence Number=SeqID_72972
  Gene Ontology: Mol. function=DNA-directed DNA polymerase activity; Cellular component=mitochondrion; Biological process=nucleobase, nucleoside, nucleotide and nucleic acid metabolic process
  Homolog annotation: Hit_ID=Q6QZN8; Match level="QueryCoverage=98%, HitCoverage=60%, E-value=1e-141, Identity=53%"; Hit description=DNA -directed DNA polymerase
  Pfam annotation: Domain name=DNA_pol_B_2; Domain location=4-396; Score=204.2; E_value=3.1e-58; Accession=PF03175.4; Description=DNA polymerase type B, organellar and viral
MAFSYLSTLALYHPNYTVTPLMRDNRLYEVAVYSKKRLLFTFRDSLHLLPGKLDDLAKNLCPELGSKGSISYEDVRLESLSIMKESLLEYMEQDILLLGGIMQSFQDIYYKAYQADIVNKLTIASLALSLFREKYYDYNKHRIHIPNQNEDTFIRRGYYGGHTDAYLPYGTNLYYYDVNSLYPFVIKEFSMPGGTPVWHSDLEYMTLDNMFGFIEAYVECPKSINKPFLPYGDNKDGTLIFPTGTFVGVYYSEELKYARDIGYTIIPICGYLFEEMESPFKDYINSLFESRSNAKKKGNNALSSFGINPQSTKTEMCNKSKRDRIFRRPEFIDDVFIREDLYMVSYLTNPGKGPSYWDPPKNSAVQLAAAITAGSRIYMYKYISREDCLYTDTDSIVLGNPLPEEDVSSSVLGKFKLEDKILEGFFLAPKCYSYTTEESDGNKKVYKYKGPGRNVITPE

SEQ ID NO: 189751 - protein, 287 aa, Glycine max
  Coding DNA Sequence Number=SeqID_72973
  Homolog annotation: Hit_ID=Q1STP5; Match level="QueryCoverage=63%, HitCoverage=30%, E-value=3e-15, Identity=30%"; Hit description=IMP dehydrogenase/GMP reductase
MAIEGFTMRRGGFRDLGQSRGYAWGVVVLVHMYDQLNEASQTPTRQMGGYLTLLQCWIYEYFPSVHQCVTDDGYAEKTPRASRWLTMKAHMKGIKGAPYRARLDALTITDGQLRWGHVVVYVRPERVVQQFGYMHTIPPLPVTSLLSYEDISDRWMHFGDHLAPAGEICVVPSQVSADYMEWFFQISHPFVMSTQEGDEPRHPPAPDVDAYVEPHIPEVPVPANLPRPSVVAYEGCEAIAKRLERVLNLRMVTARTELHEIMEDCLRIARGDTSDGSLRARRRQRID

SEQ ID NO: 189752 - protein, 133 aa, Glycine max
  Coding DNA Sequence Number=SeqID_72974
MCPVVGFGPWLGLGKPLVEILPPGQLRGFCPLLAWLGSAVLGYGPVLSFGLVGPLLPPVISFVARICQLWLAPRWLKSGASVVDHHVITWQDTRLPGPVGQGYRLVEYISVARVRPRTSKGITDLLLPQTSVA

SEQ ID NO: 189753 - protein, 58 aa, Glycine max
  Coding DNA Sequence Number=SeqID_72975
  Subcellular localization annotation: CTP_CleavageSite=35; ConfidenceScore=5.02e-01
MASKAINKPQTPITYLYLPEMRGGGCTAARPGKLLASSRSNLARPGKLVTSALSFLVA

SEQ ID NO: 189754 - protein, 59 aa, Glycine max
  Coding DNA Sequence Number=SeqID_72976
MLEYQERKREDTFWGIYDDHANLSRGLSDKDIGSEANARSDIFIHSTSANEIQDKVDWI

SEQ ID NO: 189755 - protein, 45 aa, Glycine max
  Coding DNA Sequence Number=SeqID_72977
  Homolog annotation: Hit_ID=Q2MJ01; Match level="QueryCoverage=95%, HitCoverage=8%, E-value=2e-09, Identity=68%"; Hit description =Cytochrome P450 monooxygenase CYP704G7
MEDLLMKSTLDSIFQVAFGTELDSMCGSSQEEGKIFADAFDTSSV

SEQ ID NO: 189756 - protein, 143 aa, Glycine max
  Coding DNA Sequence Number=SeqID_72978
MARRDKLWSFCAFGHPEVASPMTYGDKLWLDRVRRHAETNYGQSAPFCHPEAIVPNGAQRQIMVILRLSIQAQSCSMTRRGKLWLDHVRWHAETNYGHSAPFCHPEAIVPDGSGDKLCKSSDKHAETNYGHSAPFVIQEQQVE

SEQ ID NO: 189757 - protein, 142 aa, Glycine max
  Coding DNA Sequence Number=SeqID_72979
  Subcellular localization annotation: CTP_CleavageSite=13; ConfidenceScore=5.19e-01
MLFYVKPAKRLTLCQAGMSSRKRKSVGSRPTPQYDTRRFQSFEAWTRYTDNVLGRYILVERKVEIYHTELGEFKGEMERRNFHKRLTNLADSSIDLALVKEFYANLYSPEGPSPKQVRIQSHLITIDADNLNAFLETPCGAC

SEQ ID NO: 189758 - protein, 141 aa, Glycine max
  Coding DNA Sequence Number=SeqID_72980
  Subcellular localization annotation: CTP_CleavageSite=61; ConfidenceScore=5.40e-01
EGFFRSFLSVAPPPIPAPPLVPLPPPTPVPHVARAPLLGPVLPRAPNPLPPPAPLPLQAPAASAVPRRGATVRGFWSAARTTAFHGSRLLICFWRKSFLIIEFEKLKLKPKMFQVFAADIFTSKLCNDVSNQQAGMQFKNK

SEQ ID NO: 189759 - protein, 171 aa, Glycine max
  Coding DNA Sequence Number=SeqID_72981
  Subcellular localization annotation: CTP_CleavageSite=29; ConfidenceScore=5.37e-01
MTITIGGARRARARPAKAPSTSAAPPPARTSATPSTSPSAYFHRLEAMLWSIHQGQIILLQSLQLVAPPDSIPSVEQFNEWVAWPGTQPPLHREDEGPIAQVPQEMEDGSSETSTPEPLIKRKRVVETQEVATTSKKSLEATSEPSEPVADTASIQQLADPSTPEDQTTAV

SEQ ID NO: 189760 - protein, 35 aa, Glycine max
  Coding DNA Sequence Number=SeqID_72982
MGFYGYLQKYLQTKRVMIRIWELGMETSIYLRIYA

SEQ ID NO: 189761 - protein, 241 aa, Glycine max
  Coding DNA Sequence Number=SeqID_72983
MASGNRLQRSNKSLVIDYQLCVIDYTVHIAGFHVLKLCNLSLASGNRLPMLCNRLPEMKSLEAPLLIACSGYGTHCVATVVRSLVKESTPFLLFLVIAMAVQLIHDQVEMECLEGVWETLEGNARCRFRGTIRFTATSLVHPEEPARTLQRTVEWILPTPTPYRLVEPVQVIEVTSSEEDPEEDPEELPPEPAIDALDFPEGEEDPLREVDSPEDVMSASEADSMEKSGPEGIATSGVFSS

SEQ ID NO: 189762 - protein, 98 aa, Glycine max
  Coding DNA Sequence Number=SeqID_72984
MAYTHIPVKVENPGESLETSNNSFQNCPIQHQLDLAPYTSEPYNAQWNAPGLLRDKHTLRSSRILGEMEVDEPWLGLWLPLNYQVVFVIGSAVDRLCG

SEQ ID NO: 189763 - protein, 77 aa, Glycine max
  Coding DNA Sequence Number=SeqID_72985
MRKLIKERMENKVVNFVGLNKVVLGIKWMNGMVKQVDFLELWFERTRVKMKGRKESLFPARATHKGCESPLIQPGCS

SEQ ID NO: 189764 - protein, 76 aa, Glycine max
  Coding DNA Sequence Number=SeqID_72986
  Homolog annotation: Hit_ID=Q10PS3; Match level="QueryCoverage=66%, HitCoverage=7%, E-value=5e-10, Identity=64%"; Hit description=HEAT repeat family protein, expressed
MRERRGGVSVKIDLTLFIASLRKMGCYRDQLVPFCLVVRETNEELRALKADPAEAFDVGAILSIARRQLSSELEAT

SEQ ID NO: 189765 - protein, 277 aa, Glycine max
  Coding DNA Sequence Number=SeqID_72987
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=4e-27, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MLHVITLRGLHTLIFRGLHVLAFRGIHVLDCRGLHALTFIGQHILAFRGLHVLTFRGLHVFPFRGLHALAFRGLHVLVFRGLHRAMRPRLRRATRSHLERTTRPRLQRATHPRLQRTTCPRLHRATRHHLLRTTRPLLERATLPRLQRTTPLPLQRSKGYTSSPSGTTRPHLQRTTCPCLQRTTRPRLQRTTRPRHQRATLHVLAFRGLHVLIFRETHVLAFKGLRILLFRGLHVVAFRGLHVLIFRGLHVLTFRKLHALTFIGPQSLAFRGLHVLT

SEQ ID NO: 189766 - protein, 199 aa, Glycine max
  Coding DNA Sequence Number=SeqID_72988
  Gene Ontology: Mol. function=catalytic activity; Cellular component =cellular_component; Biological process=biosynthetic process
  Homolog annotation: Hit_ID=Q2SMG9; Match level="QueryCoverage=99%, HitCoverage=93%, E-value=2e-56, Identity=49%"; Hit description =Predicted epimerase, PhzC/PhzF-like protein
  Pfam annotation: Domain name=PhzC-PhzF; Domain location=1-198; Score =0.7; E_value=4.3e-10; Accession=PF02567.7; Description=Phenazine biosynthesis-like protein
IDAFTDELFRGNPACVVPLKEWLPDETLLKIAMENAVAETAFFIDLGSRIHLRWDGLYYLDFPSRMPSPSSLPDLISKSLNIQPKEVFKSRDYVLVYDNEDDIRNIKIDRQIFDQINLDPGGVIVTAKGDHSDFVSRYFTSQASILEDPVTGSAHCSLIPFWSDRLGKKDLFAMQLSERLGKLYCEDQGDRVIIAGKAK

SEQ ID NO: 189767 - protein, 277 aa, Glycine max
  Coding DNA Sequence Number=SeqID_72989
  Gene Ontology: Mol. function=S-adenosylmethionine-dependent methyltransferase activity; Cellular component=nucleus; Biological process=rRNA processing
  Homolog annotation: Hit_ID=Q57NF9; Match level="QueryCoverage=62%, HitCoverage=34%, E-value=2e-72, Identity=77%"; Hit description=Paral putative rRNA methyltransferase
  Pfam annotation: Domain name=Nol1_Nop2_Fmu; Domain location=107-277; Score=-64.8; E_value=0.00082; Accession=PF01189.8; Description =NOL1NOP2sun family
KKYQHLVRNNSVFWLASGYNLDFGLIGGVVKTGTFQQFIRGGIHAKRVAQLGHGDSVAKLRQRAACGLPDLFASGILRTAVPEPGSALHFALTLLVRLADEAEFERFLAISQQPLRRSLRVNTLKISVEDFLTRVAGYGWQLTPIPWCREGFWIARDDESLPLGSVAEHLSGLFYIQEASSMLPVSALFDAAPDARQVMDVAAAPGSKTTQMAALMRNQGAILANEYSASRVKVLHANISRCGVSNVALTHFDGRVFGAALPEQFDAILLDAPCSGE

SEQ ID NO: 189768 - protein, 73 aa, Glycine max
  Coding DNA Sequence Number=SeqID_72990
MDCLALFMCPPPLSAEPPVTGGPFGRANKSYLETHELIVIHASSTNESGAPQIDCLALFAYPPFSTFIRSPMN

SEQ ID NO: 189769 - protein, 213 aa, Glycine max
  Coding DNA Sequence Number=SeqID_72991
SGTWRYVAGVRRPWGRQASSWQSTYKRTKTTKQGGLCGGWPAVNFECYMGYGLWLKNEIRKLRGLLVIDYQGIVMAAQLIHDRVEMECLEGAWETLEGNARCRFRGTIRFTATSLVHPDEPARTLQRTVEWILPTPTPYRLVEPVQVIEVTSSEEDPEELPPKPAVDALDFLEGDEDPLPEVDSPEDVMSASEADSTEDSGPGEMAISGGSSS

SEQ ID NO: 189770 - protein, 262 aa, Glycine max
  Coding DNA Sequence Number=SeqID_72992
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q7NA43; Match level="QueryCoverage=90%, HitCoverage=53%, E-value=2e-59, Identity=49%"; Hit description =Sensor protein
  Pfam annotation: Domain name=HATPase_c; Domain location=149-258; Score=92.6; E_value=1.2e-24; Accession=PF02518.16; Description =Histidine kinase-, DNA gyrase B-, and HSP90-like ATPase
  Pfam annotation: Domain name=HisKA; Domain location=39-103; Score =32.5; E_value=1.4e-06; Accession=PF00512.15; Description=His Kinase A (phosphoacceptor) domain
  Pfam module annotation: Pfam domain module=HATPase_c::HisKA; Domain location=149-258::39-103
MASTAVVADTFTGTYRTNKRRRDIADLRTRYGELTRLNTMGELAAGIVHELNQPLTAIMSYNQAAVRLIKKNDPVKIPELLEASVLQIKRIDALLSQFRLKLTSKRAEYQPVDLPSLWLRVCELLDNEIRAGKVRISSHFPSDLPALPAPPLWVEQILHNIVSNAIQAQSINVPGSAWIHLQAVRVNNGIALTLTDGGPGLSSEALEQVFIPFYTTRTDGVGLGMALADTLVQRLNGKIEASNITGQGACFRLWFPLRNEEK

SEQ ID NO: 189771 - protein, 371 aa, Glycine max
  Coding DNA Sequence Number=SeqID_72993
  Gene Ontology: Mol. function=3-hydroxybutyryl-CoA dehydrogenase activity; Cellular component=glycerol-3-phosphate dehydrogenase complex; Biological process=fatty acid metabolic process
  Homolog annotation: Hit_ID=P76083; Match level="QueryCoverage=97%, HitCoverage=69%, E-value=2e-72, Identity=45%"; Hit description =Probable 3-hydroxybutyryl-CoA dehydrogenase
  Pfam annotation: Domain name=3HCDH; Domain location=281-370; Score =13.3; E_value=5.2e-05; Accession=PF00725.12; Description=3 -hydroxyacyl-CoA dehydrogenase, C-terminal domain
  Pfam annotation: Domain name=3HCDH; Domain location=51-136; Score =82.7; E_value=1.1e-21; Accession=PF00725.12; Description=3 -hydroxyacyl-CoA dehydrogenase, C-terminal domain
  Pfam annotation: Domain name=3HCDH_N; Domain location=1-49; Score= -92.6; E_value=0.0014; Accession=PF02737.8; Description=3-hydroxyacyl- CoA dehydrogenase, NAD binding domain
  Pfam module annotation: Pfam domain module=3HCDH::3HCDH::3HCDH_N; Domain location=281-370::51-136::1-49
MAGLHFFNPAPLMKLVEIVSGLETGTDTLAALQALAQRWGKQSVVCRSTPGFIVNRVARPFYAETLRALEERVADAATLDAVLRDAGGFAMGPLQLTDLIGQDVNYAVTESVYQAFLSGSALHALTGATGAGGGRAPRPQVRPRFSTATTHRDPPPRSPFAPPAQAALPQRVTLHGDWSSLADLAELLIENAGPIKQPGQTSPHVTIDDVTLMLTNGKTAGQLADERGTPVVLFDLCADYAHASAIAISCAAQNDAQHNAKAIRLLQSLGKQVIQLPDYPGLLTMRTLAMLANEALDVVNKGVASAEDTDLAMLRGVNYPRGPLAWGAALGWCHILATLENLQRYYGEARYRPMPLLRRYASPASFPGAER

SEQ ID NO: 189772 - protein, 310 aa, Glycine max
  Coding DNA Sequence Number=SeqID_72994
  Gene Ontology: Mol. function=amino acid transporter activity; Cellular component=membrane; Biological process=amino acid transport
  Homolog annotation: Hit_ID=Q4KIN3; Match level="QueryCoverage=85%, HitCoverage=57%, E-value=2e-86, Identity=57%"; Hit description=Amino acid permease
  Pfam annotation: Domain name=AA_permease; Domain location=64-308; Score=-44.4; E_value=0.00015; Accession=PF00324.11; Description =Amino acid permease
MIFARPYVLVGAKPRQYRLRDRRHSRRHPYRLTSLGNPAMPQMNDFEHIARRQGGLNKHLTAGQMSMLAIGGAIGTGLFLGSAYAIQMAGPASGGMTSEHPTPGSFGDYAEFYLGPLFGFLVRYSYWSCVVLAVGTEVIAIGMYMQFWFPATPTWPWVLLFSAAVIVVNVIGVKSFGQVEYALSTVKVTAIVAFILIGLGMLAFSGNPAYGLRNLTAGGFMPFGVKGMWFATIVSIFSYLSIEMIAVAAGEAKNPVIAVKAAFKGTLVRLFIFYMLSIALMLAIVPWRQSGTGESPFLMAMNVIHLPAAA

SEQ ID NO: 189773 - protein, 213 aa, Glycine max
  Coding DNA Sequence Number=SeqID_72995
  Gene Ontology: Mol. function=nucleic acid binding; Cellular component= signal recognition particle, endoplasmic reticulum targeting; Biological process=RNA-dependent DNA replication
ALRKRHITSYYERELMDKLQRLRQGSMSVEEYRQQMELLFLSVGLREEERTSIARFLSVLNMEVRDKVELLPYRDLDDLVQLCIRVEQQLKRKPTSKSYDSYSYLKKDQGQGISGAALSKPKDDKGKIIEKESPKASIQEKTSSIKSKGEESTEEIYPQEEGQLLMVKEPCKEALVSTATPLGLEVIPQVKELLDEGLVRKSLNPCALLVPKI

SEQ ID NO: 189774 - protein, 56 aa, Glycine max
  Coding DNA Sequence Number=SeqID_72996
MTHQIPPHLAFCTPGKNQKAEQGTNPETLKGDKQTQKHLHILNESQGMKGMGNIQH

SEQ ID NO: 189775 - protein, 299 aa, Glycine max
  Coding DNA Sequence Number=SeqID_72997
  Homolog annotation: Hit_ID=Q1SDS1; Match level="QueryCoverage=60%, HitCoverage=40%, E-value=1e-20, Identity=35%"; Hit description=IMP dehydrogenase/GMP reductase
EWAPFIDILALLIFGGVLFPNVNGLVDLAAIDVFLAYHNHKESPVVAMLADLYDTFDRRCEESNARIVRHACPLESHRSCTEKGGANWDRLLASKEGASVNWFPRWKEGGTGVLISWGGFPNVPLMGMRGCISYNPVLAIRQLGYPMRGAPLEDELAPVRKAWGVVQKKDKELRDNGPIGGYSEWLKAHVQGLDWLPSLRTAKREEHEAPEEDEEVQALRTELKQAQTVKERFKSAALKIRKENAELRDINIATTKALEQETKRAHREEHGRNKFRGALWGSNNELKLRREERDQSRVD

SEQ ID NO: 189776 - protein, 328 aa, Glycine max
  Coding DNA Sequence Number=SeqID_72998
LGGRQRYPNGYPYKTIFVNPDPRSQDEETNVVICTLCQPGASEPVDTQRLISSSAPLSSRDGMSDDMQRYPSDYPYKTIYVNPDPRSRDTQVVIHINTLLRSIRLRVRYHAETNIVICTLCQPGASEPVDTQRLTSSFAALSSRDGESGDMRRYPSGASKPVDMQTLTSSSAPLSSRDGESGDMRTYPSGYPYKMISVNPDPRSGRRRYPSGYPYKHSFAIRQTHSSIACRDKHHHLHPLSTRETASPMTCGDTQVVFRTNQLLLISTREVRWQAKIPQVVIRTNALLLILTREVRWQAEIPQVVIRTHTVLLPRPVRSQVACGDALY

SEQ ID NO: 189777 - protein, 73 aa, Glycine max
  Coding DNA Sequence Number=SeqID_72999
APHSLETLEVVLVVVGVSGSGNGRVSGVEERVKTQRIIASKSPFAKSRITLDNNYKHRGLPWTRMQCFGGENG

SEQ ID NO: 189778 - protein, 560 aa, Glycine max
  Coding DNA Sequence Number=SeqID_73000
  Gene Ontology: Mol. function=transition metal ion binding; Cellular component=proton-transporting two-sector ATPase complex; Biological process=metabolic process
  Homolog annotation: Hit_ID=Q4KD15; Match level="QueryCoverage=100%, HitCoverage=13%, E-value=1e-179, Identity=57%"; Hit description =Haemagluttinin repeat protein
  Pfam annotation: Domain name=Haemagg_act; Domain location=26-138; Score=100.1; E_value=6.7e-27; Accession=PF05860.3; Description =haemagglutination activity domain
ARREAGFVVADGLGKDGLKVDENPLTRGWINARDAIQSQAADGRVLVNIEQTADQAILNWETFNIGGNTTLNFLQNPDWAVLNRVNDPAARPSQILGQLKANGTVFVANRNGVVFGNNSQVNVRNLVAAAARISDAQFREQGLYSADANTSALTDAVGKVMVERGARITTHEPTTATRGGGYVLLAGHSVENAGQIETRKGQTQLAAGDSFVIRRGVGTAQNTASTTRGNEIAPRFVADSTAGSVRNSGLIQAREGDVTLAGRTVEQAGVAVATTTLNQRGTVHLLNSASDAAGSVTLAAGSTTAVLLEDDGKSTALDSQRNALIKESAEQDKLRGSSNSGTFDNLSRLQDRREQSRIEVVSGGDVNFQAGSLAVATGGQVIADASRRSYLDDGARVDVSGAVGVQVAMESNNVKVKVQGNELRDSPDNRDSGKLISSEVWIDRRQLTEVAAGTGGYEGTRWYAGGGLLEVGGYLDNQGHSISEWAAQGGTVQLAGKEVVSHAGSRINLAGGSLDVQSGVVQQSRLRGRDGQLYRLDDAPAEMLYDGLYQGYEVKQERWG

SEQ ID NO: 189779 - protein, 267 aa, Glycine max
  Coding DNA Sequence Number=SeqID_73001
  Gene Ontology: Mol. function=beta-lactamase activity; Biological process=beta-lactam antibiotic catabolic process
  Homolog annotation: Hit_ID=Q8UCH4; Match level="QueryCoverage=99%, HitCoverage=51%, E-value=2e-69, Identity=50%"; Hit description =Penicillin binding protein
MALTKWAQALVNSEGPFKGLLDRLSADRRLSDGRVTGYGLGLRWNEVDGKRFVGHGGSHPGYKSYFLLDPTAKTGLIVVSNREDANTYKMARDCMAALNGLSLLETNCTVPDGLYVADSGPFWLEMRNGIANWLDSEDTLYDIGDGWFSSLSPSSPVRLRWTGTELEGEIGYVPRRLKPVKVGPLGHELDGHWQAPSYGASFDIKDGHLIMGIGPTRRAMPLEDLGQGRALFTLHDGPWTKRVCLHRLQDDRIELVLSRARMIEYVR

SEQ ID NO: 189780 - protein, 107 aa, Glycine max
  Coding DNA Sequence Number=SeqID_73002
MGISFIIFLQRIVGMRKELPLEGRGLAQIVWSGTGSEVWRQTIRAGLRTIPPIETRRAFVPAQHGFRDGSHLIFLKPTCRPSSVLALPLRYPSYFWIGCYRGAFALF

SEQ ID NO: 189781 - protein, 289 aa, Glycine max
  Coding DNA Sequence Number=SeqID_73003
  Gene Ontology: Mol. function=structural molecule activity; Cellular component=intermediate filament; Biological process=nucleosome assembly
  Homolog annotation: Hit_ID=UPI0000DBF0F4; Match level="QueryCoverage =83%, HitCoverage=93%, E-value=3e-31, Identity=43%"; Hit description =Choline-phosphate cytidylyltransferase B (EC 2.7.7.15) (Phosphorylcholine ...
  Homolog annotation: Hit description=transferase B) (CTP:phosphocholine cytidylyltransferase B) (CT B) (CCT B) (CCT-beta).
  Subcellular localization annotation: CTP_CleavageSite=20; ConfidenceScore=5.26e-01
MIGTSKPYTGAMSGTVHDPQANLGAVQNSTLTFKGLHVLAIRGLHALAFKRLLVLAFRGLPVLIFRGLRALTFRGLHVLAFRGLPALAFRGLHVLAFRGLHALAFKELHVLSFRGLHSLTFRGLHALTFRRLDVLALKGLQALAFRGLHVLSFTGLNALTFRGLDALTFRGLDVLAFRGLQVLAFRGLPVLTFRGLWALAFRGLHVLSFIGLPILTFRGLRALAFRELHVPTFRGLHALAFRGLRVLTFRGLHALAFRGLHVLSFRGLHALGLQRTTCPLLQRATFPHL

SEQ ID NO: 189782 - protein, 729 aa, Glycine max
  Coding DNA Sequence Number=SeqID_73004
  Gene Ontology: Mol. function=phosphotransferase activity, for other substituted phosphate groups; Cellular component=integral to membrane; Biological process=phospholipid biosynthetic process
  Homolog annotation: Hit_ID=Q8ZEI2; Match level="QueryCoverage=57%, HitCoverage=89%, E-value=0.0, Identity=83%"; Hit description =Cardiolipin synthetase
  Pfam annotation: Domain name=DUF440; Domain location=622-729; Score =137.2; E_value=4.6e-38; Accession=PF04269.3; Description=Protein of unknown function, DUF440
  Pfam annotation: Domain name=PLDc; Domain location=367-394; Score =34.1; E_value=5e-07; Accession=PF00614.12; Description=Phospholipase D. Active site motif
  Pfam annotation: Domain name=PLDc; Domain location=547-574; Score =34.8; E_value=2.9e-07; Accession=PF00614.12; Description =Phospholipase D. Active site motif
  Pfam annotation: Domain name=YCII; Domain location=9-93; Score=43.3; E_value=8.2e-10; Accession=PF03795.4; Description=YCII-related domain
  Pfam module annotation: Pfam domain module=DUF440::PLDc::PLDc::YCII; Domain location=622-729::367-394::547-574::9-93
SRLGIGTGSAFGGSGATSGSGSGSGGGGGDEGRLIVAGPLPAVDSNEPGPAGFTGSVIVAEFSSLETAQSWANDDPYIAAGVAGAAADWSCAVAVAPSGLASGTPAHRHAGGTGGGPADSECFTGITRPLTTAFIAQSDAAAAPPDDESHGCAYNDVTALPASGHDGDAPGLVAAVWLLAADCRGYAAHPDEAACGDLSDGLAADHLHSAAGKRRAERARTMWPSTAKWLNDLKQCRHIFATEHSDVARSLFELCRHRQGIAGVKGNQLQLLTSADDVMQALIRDIQLARHNIEMVFYIWQPGGLADDVAESLMAASRRGVHCRLMLDSAGSVAFFRSPWVGMMRNAGIDVVEALQVSLWRVFLRRMDLRQHRKVVLIDNYIAYTGSMNLVDPRFFKQDAGVGQWIDLMARMEGPVATTMGIVYACDWEIETGKRILPPAPDGNVMPFEQESGHTIQVIASGPGFPEDLIHQALLTAVYSAREQLIMTTPYFVPSDDLLHAICTAALRGVEVSIVVPRHNDSLLVGWASRAFFTELLEAGVKIYQFEDGLLHTKSVLVDGQLSLVGTVNLDMRSLWLNFEITLVVDDDGFGSDLATVQDDYIAPLYCKTSENITASGQAGMTMDLNNRLTEDETLEQAYDIFLELAGDNLDPADIILFNLQFEERGGAELFDPSEDWQEHVDFDLNPDFFSEVVIGLGEADGEPITDVFARILLCREKDHKLCHILWRE

SEQ ID NO: 189783 - protein, 126 aa, Glycine max
  Coding DNA Sequence Number=SeqID_73005
MRGYPIVTCTFRQPGANEPVDAQRLTSSLAPFVVLTREVRITLWLPAPFVNQGANEPVDAKRRTSSFAPFVIQGQRVRWFLLSLSGNIQAQRRARFFSAKQGRSSAMAKGNVVVVQLCRFQDTEVC

SEQ ID NO: 189784 - protein, 161 aa, Glycine max
  Coding DNA Sequence Number=SeqID_73006
MEEKKKKQLEEIAQSRSTDTVVDPPSPTRQHMKWNMARTKKSSQMTSEASKEIANRIIKHPSRVPVVGVDVTIKHYFGPDSRGSRISSSMALDDLEKLTQKIRDRVYEGSTTIHNVPLGNDQVKGVEGPVKAVDVSDPDVDPLYLMTLIIPQLFLKPLQVS

SEQ ID NO: 189785 - protein, 175 aa, Glycine max
  Coding DNA Sequence Number=SeqID_73007
MEKIGVNIEDDDSTVDTCLSPFSRQMPTNVNGEEEVYEVLANPHGYTTQLPSFSALVSNTFIVYVKEDKKRNMTQIDNWKQVPIGHKDLIWEDIQVEFDIPESFNDKQREVEPFFVEAKLHDESKNNSSESRTIQEFKIESRRRKLRVKNQDSRFKISRIKIKIQDSRFKNQEKA

SEQ ID NO: 189786 - protein, 1118 aa, Glycine max
  Coding DNA Sequence Number=SeqID_73008
  Gene Ontology: Mol. function=protein serine/threonine kinase activity; Cellular component=integral to membrane; Biological process=protein amino acid phosphorylation
  Homolog annotation: Hit_ID=O49318; Match level="QueryCoverage=95%, HitCoverage=95%, E-value=0.0, Identity=59%"; Hit description =Putative receptor-like protein kinase
  Pfam annotation: Domain name=LRRNT_2; Domain location=32-72; Score =48.4; E_value=2.4e-11; Accession=PF08263.3; Description=Leucine rich repeat N-terminal domain
  Pfam annotation: Domain name=LRR_1; Domain location=113-135; Score =16.6; E_value=0.092; Accession=PF00560.23; Description=Leucine Rich Repeat
  Pfam annotation: Domain name=LRR_1; Domain location=137-159; Score =21.1; E_value=0.0041; Accession=PF00560.23; Description=Leucine Rich Repeat
  Pfam annotation: Domain name=LRR_1; Domain location=161-183; Score =14.3; E_value=0.43; Accession=PF00560.23; Description=Leucine Rich Repeat
  Pfam annotation: Domain name=LRR_1; Domain location=185-207; Score =8.4; E_value=7.5; Accession=PF00560.23; Description=Leucine Rich Repeat
  Pfam annotation: Domain name=LRR_1; Domain location=209-231; Score =8.5; E_value=7.3; Accession=PF00560.23; Description=Leucine Rich Repeat
  Pfam annotation: Domain name=LRR_1; Domain location=233-255; Score =6.4; E_value=18; Accession=PF00560.23; Description=Leucine Rich Repeat
  Pfam annotation: Domain name=LRR_1; Domain location=257-279; Score =13.2; E_value=0.93; Accession=PF00560.23; Description=Leucine Rich Repeat
  Pfam annotation: Domain name=LRR_1; Domain location=281-303; Score =13.5; E_value=0.79; Accession=PF00560.23; Description=Leucine Rich Repeat
  Pfam annotation: Domain name=LRR_1; Domain location=305-327; Score =14.5; E_value=0.39; Accession=PF00560.23; Description=Leucine Rich Repeat
  Pfam annotation: Domain name=LRR_1; Domain location=329-351; Score =2.6; E_value=95; Accession=PF00560.23; Description=Leucine Rich Repeat
  Pfam annotation: Domain name=LRR_1; Domain location=353-375; Score =11.3; E_value=2.2; Accession=PF00560.23; Description=Leucine Rich Repeat
  Pfam annotation: Domain name=LRR_1; Domain location=377-399; Score =18.7; E_value=0.022; Accession=PF00560.23; Description=Leucine Rich Repeat
  Pfam annotation: Domain name=LRR_1; Domain location=401-423; Score =3.7; E_value=58; Accession=PF00560.23; Description=Leucine Rich Repeat
  Pfam annotation: Domain name=LRR_1; Domain location=425-448; Score =7.5; E_value=11; Accession=PF00560.23; Description=Leucine Rich Repeat
  Pfam annotation: Domain name=LRR_1; Domain location=449-471; Score =6.7; E_value=16; Accession=PF00560.23; Description=Leucine Rich Repeat
  Pfam annotation: Domain name=LRR_1; Domain location=473-495; Score =6.1; E_value=20; Accession=PF00560.23; Description=Leucine Rich Repeat
  Pfam annotation: Domain name=LRR_1; Domain location=497-519; Score =14.7; E_value=0.33; Accession=PF00560.23; Description=Leucine Rich Repeat
  Pfam annotation: Domain name=LRR_1; Domain location=521-543; Score =10.9; E_value=2.6; Accession=PF00560.23; Description=Leucine Rich Repeat
  Pfam annotation: Domain name=LRR_1; Domain location=545-568; Score =9.2; E_value=5.5; Accession=PF00560.23; Description=Leucine Rich Repeat
  Pfam annotation: Domain name=LRR_1; Domain location=569-591; Score =17.9; E_value=0.037; Accession=PF00560.23; Description=Leucine Rich Repeat
  Pfam annotation: Domain name=LRR_1; Domain location=593-615; Score =17.7; E_value=0.041; Accession=PF00560.23; Description=Leucine Rich Repeat
  Pfam annotation: Domain name=LRR_1; Domain location=617-639; Score =9.2; E_value=5.3; Accession=PF00560.23; Description=Leucine Rich Repeat
  Pfam annotation: Domain name=LRR_1; Domain location=666-688; Score =12.7; E_value=1.2; Accession=PF00560.23; Description=Leucine Rich Repeat
  Pfam annotation: Domain name=LRR_1; Domain location=88-111; Score =5.1; E_value=32; Accession=PF00560.23; Description=Leucine Rich Repeat
  Pfam annotation: Domain name=Pkinase; Domain location=820-1093; Score= 163.2; E_value=6.5e-46; Accession=PF00069.15; Description=Protein kinase domain
  Pfam annotation: Domain name=Pkinase_Tyr; Domain location=820-1093; Score=120.3; E_value=5.6e-33; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=Pkinase::Pkinase_Tyr; Domain location=32-72::113-135::137-159::161-183::185-207::209 -231::233-255::257-279::281-303::305-327::329-351::353-375::377 -399::401-423::425-448::...
  Pfam module annotation: Domain location=449-471::473-495::497 -519::521-543::545-568::569-591::593-615::617-639::666-688::88 -111::820-1093::820-1093
MAGDIKEERALAKGYSVILLLLTLLVCSTEGLNTEGKILLELKKGLHDKSKVLENWRSTDETPCGWVGVNCTHDNINSNNNNNNNNSVVVSLNLSSMNLSGTLNAAGIEGLTNLTYLNLAYNKLSGNIPKEIGECLNLEYLNLNNNQFEGTIPAELGKLSALKSLNIFNNKLSGVLPDELGNLSSLVELVAFSNFLVGPLPKSIGNLKNLENFRAGANNITGNLPKEIGGCTSLIRLGLAQNQIGGEIPREIGMLAKLNELVLWGNQFSGPIPKEIGNCTNLENIALYGNNLVGPIPKEIGNLRSLRCLYLYRNKLNGTIPKEIGNLSKCLCIDFSENSLVGHIPSEFGKIRGLSLLFLFENHLTGGIPNEFSNLKNLSKLDLSINNLTGSIPFGFQYLPKMYQLQLFDNSLSGVIPQGLGLHSPLWVVDFSDNKLTGRIPPHLCRNSGLILLNLAANKLYGNIPAGILNCKSLAQLLLLENRLTGSFPSELCKLENLTAIDLNENRFSGTLPSDIGNCNKLQRLHIANNYFTLELPKEIGNLSQLVTFNVSSNLFTGRIPPEIFSCQRLQRLDLSQNNFSGSLPDEIGTLEHLEILKLSDNKLSGYIPAALGNLSHLNWLLMDGNYFFGEIPPQLGSLETLQIAMDLSYNNLSGRIPVQLGNLNMLEYLYLNNNHLDGEIPSTFEELSSLLGCNFSYNNLSGPIPSTKIFRSMAVSSFIGGNNGLCGAPLGDCSDPASRSDTRGKSFDSPHAKVVMIIAASVGGVSLIFILVILHFMRRPRESIDSFEGTEPPSPDSDIYFPPKEGFAFHDLVEATKGFHESYVIGKGACGTVYKAMMKSGKTIAVKKLASNREGNNIENSFRAEITTLGRIRHRNIVKLYGFCYQQGSNLLLYEYMERGSLGELLHGNASNLEWPIRFMIALGAAEGLAYLHHDCKPKIIHRDIKSNNILLDENFEAHVGDFGLAKVIDMPQSKSMSAVAGSYGYIAPEYAYTMKVTEKCDIYSYGVVLLELLTGRTPVQPLEQGGDLVTWVRNCIREHNNTLTPEMLDSHVDLEDQTTVNHMLTVLKLALLCTSVSPTKRPSMREVVLMLIESNEREGNLTLTQTYNDLPSKDGM

SEQ ID NO: 189787 - protein, 214 aa, Glycine max
  Coding DNA Sequence Number=SeqID_73009
  Gene Ontology: Mol. function=nucleic acid binding; Biological process= DNA integration
  Homolog annotation: Hit_ID=Q2HSF6; Match level="QueryCoverage=98%, HitCoverage=15%, E-value=2e-17, Identity=29%"; Hit description =Glycoside hydrolase, family 1; Zinc finger, CCHC-type; Polynucleotidyl transferase, Ribonuclease H fold
  Pfam annotation: Domain name=zf-CCHC; Domain location=94-111; Score =28.0; E_value=2.3e-05; Accession=PF00098.13; Description=Zinc knuckle
MSLATLFGMLQEHEMKLMRLNQHEENDKKKKGISLKASSSIQEESDKDDSNEIDDDDDLSLFVKRFNEFLRNKGNQRRSNFKSKKRAEDSSSIPKCYECNQPGHLRVDCPIFKKMIERSEKKTSNDKKAKKAYIPWDDNDMDSSEDLENEVVKLSLMPKDYESNEKVSLKKSWYIDSGCSKHMTGDASIFTHISPKKSEHMTYGDNNKGRILRV

SEQ ID NO: 189788 - protein, 123 aa, Glycine max
  Coding DNA Sequence Number=SeqID_73010
  Gene Ontology: Mol. function=identical protein binding; Cellular component=cell wall; Biological process=negative regulation of enzyme activity
  Homolog annotation: Hit_ID=Q948Q4; Match level="QueryCoverage=65%, HitCoverage=9%, E-value=1e-15, Identity=51%"; Hit description =Subtilisin-like serine protease
MSTPHVAGIAALIKQYNPLLTPAMIASAISTTSSKYDNLGEHMMAEGFEASSLLPSTPFEYGVGFVSPNCAIDPGLVLSSGVKLDGTGQLKNILVTAASGGVGHYTDQLAKLILCFRDPEYKA

SEQ ID NO: 189789 - protein, 65 aa, Glycine max
  Coding DNA Sequence Number=SeqID_73011
  Subcellular localization annotation: CTP_CleavageSite=32; ConfidenceScore=5.52e-01
MGFSGAFRGLPVNTSGKNFPKNLGKIKSKYFRNASVSDSVEILHRSLSFFTVLHPFFVRSSFFNG

SEQ ID NO: 189790 - protein, 107 aa, Glycine max
  Coding DNA Sequence Number=SeqID_73012
  Homolog annotation: Hit_ID=Q1STK5; Match level="QueryCoverage=53%, HitCoverage=14%, E-value=3e-08, Identity=51%"; Hit description=Zinc finger, CCHC-type
MKEEIQEKEAKEESQQKEEKMLPNPTWKTQSSKKRSKLQQVIIGSKKFKKQTQETCSKSYVKPDSSFKNLISNMIKGCSQSTHDEDKSLVLNLENHNHHLLDQVVSK

SEQ ID NO: 189791 - protein, 93 aa, Glycine max
  Coding DNA Sequence Number=SeqID_73013
QGEPFESTIVDDWKFDYSSHDARRMVCNDQAEMTVKRSFAIGAGAVTSFGYRKDWNGQWLKKDVLPPQDERTPSPPPQRDDSALMIEVLSELR

SEQ ID NO: 189792 - protein, 119 aa, Glycine max
  Coding DNA Sequence Number=SeqID_73014
MSPFEWSKKGPLSLFDCDPYSVTKFLAFLCVRRGQFSKASNIYIKTLRIKPRAWFREDLEEDPEELPPEPAIDAPDLPEDGEDPLPDVDSPEDIMSASEADSTEESGPGGTTNSDDSLD

SEQ ID NO: 189793 - protein, 118 aa, Glycine max
  Coding DNA Sequence Number=SeqID_73015
MGYSSINEDVTRLDVNQESQHAKLYRQATEEAAFLKSLCVKQDSDVIVPSLPSSMRDVIVPSQPLSIHHQEYALYRQKYLVMYSPFKGKQKDKEFMKKQIKKLFTVNLKKNTKATETN

SEQ ID NO: 189794 - protein, 296 aa, Glycine max
  Coding DNA Sequence Number=SeqID_73016
MAFGIGGMVHVDHVTDEVHEQSEEVGVDDFVVDAFSGEPHDTSVLMDYVYHVAVTKRLELKLSSHGRKVEKFGKPALEIEGLVAAIGLSSLITCPLDTGEVTITLDDVALLLHLPITGTFHSFETLHVDEIVFLLVKLLEVNSEECWIYEHFPSISSSISVEDYHERKPHVCHWKSGKTLPVLTYSKRLDRLTSDVICVVPGQCATDYIEWFYIIFHPFMSLAQPENPRRHLTVVDDETFVEPNIPQLPVAVAAMDEAPADAPTDVEQPRHGLEAFQAIAKRLERLINLRVVTEGT

SEQ ID NO: 189795 - protein, 85 aa, Glycine max
  Coding DNA Sequence Number=SeqID_73017
MGLDPLEQGVSQHHNVDQSRFPLTPARDSGGGGADDDHDGGGGETGQRELKLVVGEDGVVIIVGFGTKPDILKEYQEEEEPKNEA

SEQ ID NO: 189796 - protein, 311 aa, Glycine max
  Coding DNA Sequence Number=SeqID_73018
  Gene Ontology: Mol. function=RNA polymerase II transcription factor activity; Cellular component=transcription factor TFIIE complex; Biological process=transcription initiation from RNA polymerase II promoter
  Homolog annotation: Hit_ID=Q6S7C3; Match level="QueryCoverage=69%, HitCoverage=78%, E-value=7e-38, Identity=45%"; Hit description=TFIIE- alpha 2
MGRLPTSTNYKEERTIRQHPCFPIFYTSFQSCPNWDLGDDQNNEFAASSSLSAAFWCQTLVDTLVLVVQSNVQLKPLMDQLSRVKDLPVPEFGSLQAWEARASAAVRAANGDINAGDSKISQLGYNGVPYSGDTKVVVDFNTEGKGEGVKSETDSTSLKVLPPWMITSGMNLTKEQRGEVKQETKMDETSTSTAVQYTDDKKLTIGHDNNQNIQDEYIKAYYAALLKQHELEEAAKKQLPNTLAADDPSSSTSNRQVGMKSKREEDDDCTEWEEAPIAGNGNGGYKVDLNVEAEEVAADDDDDDDVDWEEG

SEQ ID NO: 189797 - protein, 57 aa, Glycine max
  Coding DNA Sequence Number=SeqID_73019
MVEMDEDHWMHESATSKEVDMNEGNKEELGVHQHVNCFDALNTSQVFATRDDVLHWA

SEQ ID NO: 189798 - protein, 37 aa, Glycine max
  Coding DNA Sequence Number=SeqID_73020
VAALQMLEKQMGPESFRRVRAIDIYIICPSDHFTYAG

SEQ ID NO: 189799 - protein, 363 aa, Glycine max
  Coding DNA Sequence Number=SeqID_73021
  Gene Ontology: Mol. function=membrane alanyl aminopeptidase activity; Cellular component=nucleus; Biological process=regulation of transcription, DNA-dependent
  Homolog annotation: Hit_ID=Q6SJQ9; Match level="QueryCoverage=94%, HitCoverage=27%, E-value=1e-119, Identity=58%"; Hit description =TFIID component TAF2
MVELAVLRGCTALQTSNTSILDINPDTETRDGDTGWPGMMSIRVYELDGMYDHPILPMAGDAWQLLEIQCHSKLAARRFQKPKKGLKLDGSDDNGDVPSMDMRSNTESPLLWIRADPDMEYLAEVHFNQPVQMWAQAIAALEASPQLSFSIVNALNNFLSDSKAFWRVRIEAAFALANSASEETDFSGLLHLMKFYKSRRFDTDIGLPKPNDFHDFAEYFVLEAIPHAVAMVRAADKKSPREAIEFVLQLLKYNDNNGNPYSDVFWLAALVQSVGELEFGQQSHAKLQWNLDYQLYPDIDPDCIKAFRDRVYGLVKPFRDIKALWQVRIEASRALLDLEFHCKGMDSALLLFIKYIEEEHSLR

SEQ ID NO: 189800 - protein, 84 aa, Glycine max
  Coding DNA Sequence Number=SeqID_73022
MTARGGHWWSVEVEKKLGGVGGWFRGREGGRKWLFYAAGRICSLQHLPKRVRADPAQIFLLRNLQTKLEDNATVNKSGMMILLK

SEQ ID NO: 189801 - protein, 323 aa, Glycine max
  Coding DNA Sequence Number=SeqID_73023
  Homolog annotation: Hit_ID=Q1WK55; Match level="QueryCoverage=71%, HitCoverage=62%, E-value=2e-49, Identity=53%"; Hit description=CYC5
  Pfam annotation: Domain name=TCP; Domain location=71-312; Score =177.4; E_value=3.6e-50; Accession=PF03634.4; Description=TCP family transcription factor
NSNYALPPPPPPPPLSFFQSPFDENIFLEHHHHDLLLLHQYSLTDSGVSKNLEVVAEISPIPCPEQGGIAMEHTPRKRSSKRDRHSKINTARGLRDRRMRLSLEVAKRFFGLQDMLGFDKASKTVEWLLNQAKGEIKQLAREKTSVVGGGGKSASSTSECEGVSSLDEVAVSTGGVNNEEQERETVPNMMKRRKSKVCRKSAFNAIDKESREKARERARERTREKMRTRRVLVSDASNLNRLSSWNPFETVEDSAGTTHHPSLDVHLHEADQEPISSHNVKEHNLGEDMAHEDNSLALMNKWSPTMLFNSLHNSGILQEVSSN

SEQ ID NO: 189802 - protein, 78 aa, Glycine max
  Coding DNA Sequence Number=SeqID_73024
MGSETCFKEKKTIQQEKVRTKRNHEDMKLTSTPTVTMAARVAVWNCETGSDNGSEMRRHGVAMKTMTRATLELRQRLE

SEQ ID NO: 189803 - protein, 40 aa, Glycine max
  Coding DNA Sequence Number=SeqID_73025
MAGDWPFISDESEVTASLTVKISFSMIAARGFTNTRCHNS

SEQ ID NO: 189804 - protein, 84 aa, Glycine max
  Coding DNA Sequence Number=SeqID_73026
MFKQNQFPDHLNTVQQVICAKKEFEKERGKYEKREKGGLAPPEIASCSGERQRAIFFGCGIGAPYAYVENMNANVDKNGPTKIT

SEQ ID NO: 189805 - protein, 925 aa, Glycine max
  Coding DNA Sequence Number=SeqID_73027
  Homolog annotation: Hit_ID=Q2QNC7; Match level="QueryCoverage=22%, HitCoverage=21%, E-value=3e-16, Identity=29%"; Hit description =Expressed protein
MGKRICEKECALSNGNSHHTHPGRVWGMLHVIRYHHWRQVKRRLTHRRHGGERLDASTRAGIPGTSDDSGVHSMGEHDKPHTELSNVEEELVHSSQPAKNSIKSRLRSLLNEDIYRKKGRHKRSSTCPAKSQLTQAVSVHNIEVDPLSELLLNVQSPEPVLETFQNRLAAGTLDVLSPVFSEKPIANNDKCVDCGTMFSKDILDHSKIHKHFCSPSQGGPEKKSMNAQILTTDASPHLFKDFLDALDVINTNKDFLLEHIQDPGSPLPFHTHNQQSFNGKQRRSKSLSFPVSASSSGSQDSVHGQLINQMVDDWLDSEEEKLQNQSNMQNTSMDESSEDSYQQTIPSGSSNNFDQWGERDSNSSSVSSQVPNNVKTRHFRNLRKKMRHIIDDGRNEKHRITMDAILDKIPSGKRLTKNVKKFIHDKSKNPTIKGEGEDSATRGFGSRLSSNSFNKHQPPPMRNSSLKDSAGRYSQLYHQTCFNSEAKYPKTENLRLRTEERNSILKTPKSFKRFLSMPNLKSYFHQNEELPLPLSPQSSIKKSGDRTTKFKSYFHQNEEMPLLLSPQNSIKKSGDRTTSTNVIDQQKSWFDHNDDSKSQILPPTFADNTNQECSLNADQKQLLVRSASKSGIDFSTEEKADKSIRIEGFGDLRDSEHDIGAETESVSVPAEANSVFSSDTSFLDFTFDLENLNIQEEESDTEIKPVQDDGLDDMAEQQEAKEDHPEEVENFQNIGTLSKRFNYEIPCIEVDPSNEAAFNYVRKVLELSGFTGHDSLGIWYSDNQPLDPSMYEELEGCLLLDPDCSGNSGEGGECNHHLLLFDIINEGLLEIFGRSYNYYPRPLSYLSHVHPLPAGENVLYKVWTLISWYLMNSTTYELYPSLDYYVSKDLAKYDGWMNLQFDSECVGLELDDLIFDDLLEEIIST

SEQ ID NO: 189806 - protein, 120 aa, Glycine max
  Coding DNA Sequence Number=SeqID_73028
RTDIQTGPFTCGCGKDNDQPVLRYRVEIMVTQNNESSKFLLWDRECVELIGETADDVNRVKIEDGDLDLNASPQALDKFLGHVLAFKVRIQSKFKNAVVLRYSNDLDLINVVLEMMSDSE

SEQ ID NO: 189807 - protein, 138 aa, Glycine max
  Coding DNA Sequence Number=SeqID_73029
  Gene Ontology: Mol. function=transition metal ion binding; Cellular component=cytoplasm; Biological process=proteolysis
  Pfam annotation: Domain name=Transposase_21; Domain location=79-138; Score=-125.8; E_value=0.00071; Accession=PF02992.5; Description =Transposase family tnp2
MGMEYRKIHACPNDCILYRHQFQEISKCPRCGVSRYKLKDGEECSSDENSNKGPPAKVLWYLPIIPRFKHLFANGDGAKDLTWHANGRNYDEMLRHLADSSQWKKIDRLYQDFGKNLRLGLATDGMNLYGSLSTQHSS

SEQ ID NO: 189808 - protein, 48 aa, Glycine max
  Coding DNA Sequence Number=SeqID_73030
DAKYLKAANQRLHIIKVSSSSPSATAATGSSGAGYWAVEAPPPPEGES

SEQ ID NO: 189809 - protein, 91 aa, Glycine max
  Coding DNA Sequence Number=SeqID_73031
STKRNTHGLSARKTLEEDELYRRHPTGYTICGGAHEIGQCIPTKENTQEIHYMGNQQRQGYTQGGFLGFQQGPYNQQGQWRTHPGNQFNKD

SEQ ID NO: 189810 - protein, 120 aa, Glycine max
  Coding DNA Sequence Number=SeqID_73032
  Homolog annotation: Hit_ID=UPI00005F90C7; Match level="QueryCoverage =80%, HitCoverage=46%, E-value=3e-22, Identity=50%"; Hit description =COG1434: Uncharacterized conserved protein
MDWRDATAFAIAVNAYGGRTFTALVQPLAKKRQNPYLIELADAVTAESATGGRSAAGPAGKPVCHVEWQRAVGTELQPAEQQPAARDRRRSPVATLSSGQNDLHRCRCGLQSAQQRQRCC

SEQ ID NO: 189811 - protein, 700 aa, Glycine max
  Coding DNA Sequence Number=SeqID_73033
  Homolog annotation: Hit_ID=P04951; Match level="QueryCoverage=34%, HitCoverage=99%, E-value=1e-103, Identity=75%"; Hit description=3 -deoxy-manno-octulosonate cytidylyltransferase
  Pfam annotation: Domain name=APH; Domain location=267-513; Score =13.5; E_value=0.00058; Accession=PF01636.13; Description =Phosphotransferase enzyme family
  Pfam annotation: Domain name=CTP_transf_3; Domain location=4-221; Score=313.8; E_value=3.2e-91; Accession=PF02348.9; Description =Cytidylyltransferase
  Pfam annotation: Domain name=NTP_transferase; Domain location=4-213; Score=-94.7; E_value=0.011; Accession=PF00483.13; Description =Nucleotidyl transferase
  Pfam module annotation: Pfam domain module=APH::CTP_transf_3::NTP _transferase; Domain location=267-513::4-221::4-213
MSFVAIIPARYASTRLPGKPLLDIHGKPMVVHVMERARESGAERVIVATDHPDVAAAVTAAGGEVCMTRADHQSGTERLAEVIEKYQFADDTIIVNVQGDEPMIPAEIVRQVADNLAQADAGMATLAVPIHEAEEAFNPNAVKVVTDASGYALYFSRATIPWDRERYAQSREQIGDTLLRHIGIYAYRAGFIRRYVAWQPCALEQIELLEQLRVLWYGEKIHVAVAATVPSVGVDTPDDLLRLTPEDSSMEQLRAELALVLGEGVSRLETISEQAQSRLYALYDDHGKPMPLVAKYFRHQGRAALEAKKLTMLAHEGLITLPTVYGLVLSQQPPAHEMLLLARLNGVSAEAPARTAARWEQLCEQIVEGLLAWHRIDSHGLVGSVDSVQENRWPAWYRQRVEVLWSTLGYLSPPGFTHADRQILFRSREQLAQLFAGFDDPCVLMHGNLRLASMLKDPHSDQLVAMTQPGTILWAQREYELMRLAENGAEASLLQHYLQRAPVDEGFVWRRWLYQLWDCVDTLVSSGQFATAAQPMPDQPQRFVHRALAMAEPQRRGQRAIPDADRRHQQKRMLPDGLLHRQRFFAGVMWLIQHDNGIVGHAKAARHVSSNAGVAARIVARSGTGEDHFGLRIASPLANAFGHARQAVVQQVGARCPLPVIGVTPAQHHDIVYRLAAIPRGILVFQRGQQPIGHRLQTQQ

SEQ ID NO: 189812 - protein, 53 aa, Glycine max
  Coding DNA Sequence Number=SeqID_73034
MEVNESSGEKAKKTWVGLVSVMGELRNGEKEKRESEARDKSKTKDHNKNGMKY

SEQ ID NO: 189813 - protein, 170 aa, Glycine max
  Coding DNA Sequence Number=SeqID_73035
  Subcellular localization annotation: CTP_CleavageSite=71; ConfidenceScore=5.18e-01
MENKMKNKKLNSIRACRPWIFFINRVLRFLKIRAVQRRRKKVQTSKFRPLLRHKISCSFSLSPSTHLLLPSSSYPWLPMVWCLLSTLLLLHFATIKIQEAKDSIDEEDPRPTCSNGATSKAEIESLLKTNFIQTARDLNAVIPKDEYPMPIADMLVDSIASNEILSLLDG

SEQ ID NO: 189814 - protein, 123 aa, Glycine max
  Coding DNA Sequence Number=SeqID_73036
  Gene Ontology: Mol. function=DNA binding; Cellular component =chromatin; Biological process=DNA integration
MDIFMEMRHVKDIVEIKRGEFSGFQSLTNPSPWSDSKKCMITSLKFQVFPPLVLITLLPTLSSLHPLLDQLDLFGGFLYHLTDAILPPRELDRRLQEDWGRDAGEGPRVLMSLRVDFGPMGYV

SEQ ID NO: 189815 - protein, 313 aa, Glycine max
  Coding DNA Sequence Number=SeqID_73037
MWAIIDQYKEKLSLASTNEQRLEDKYAKVLVLQVEREARERVIDSLHREAMMRMDRFAFTLNGSQELPKLLAKAKAMTDVYLALKEVQEQMKANMEALKDQMTSLMEAMLSMKRMIESNTTTTAATSATAEADLIHSSAINQANQPIQDVLGQGGEVLGSTGGPHVGHNRNAYPYGLPPNYTPPTMHMPNENANHAVPVTLEGDFDPYPTFTIERPTFNAMPQPNTVGAPQPRPLQPLYFSIGVPPPAVEGREKLDLIEERLRVVKGFGDYPFADMAELCLVPDVVIPQKFKVLDFDRYKGTTFPKNHLKMYC

SEQ ID NO: 189816 - protein, 112 aa, Glycine max
  Coding DNA Sequence Number=SeqID_73038
MQRKDKELRGSNNGIVGGYHKWLKAWTQELVWLPKLKASSEEEAKTLEESEKVQALKAELPRVQAVREKFKATTIKVRKECDKLRDVNVATAEALERETKRAQKEEWGRNKF

SEQ ID NO: 189817 - protein, 88 aa, Glycine max
  Coding DNA Sequence Number=SeqID_73039
MPLEKDPVRPHKWIWSLTNIGFEVRNTNAILKQSRVGLSSRRDRDHAFQTPSGPREVQQSTDVFSLDHGPLPVLWGASYSLKAYPAPH

SEQ ID NO: 189818 - protein, 76 aa, Glycine max
  Coding DNA Sequence Number=SeqID_73040
MELIATKCKALRGTEHTLLARERLNDLHMDVDVWYLMRILKLAKYRLKAQVEKDEGPSGEGQSPRVEKDEGSSGEG

SEQ ID NO: 189819 - protein, 67 aa, Glycine max
  Coding DNA Sequence Number=SeqID_73041
MVLKVTRLCPWKSWDRLLKNKEKVEKHINFAIFISRTSWVQRRWKNTLRLQFLSQKLHGFRFVGTKA

SEQ ID NO: 189820 - protein, 57 aa, Glycine max
  Coding DNA Sequence Number=SeqID_73042
MGGLAFHCHEKLTNTKRKQEVWKKMEARVPNTIMFFNINHALSRHVLAKHTCKVQLT

SEQ ID NO: 189821 - protein, 246 aa, Glycine max
  Coding DNA Sequence Number=SeqID_73043
  Gene Ontology: Mol. function=glutamate N-acetyltransferase activity; Biological process=arginine biosynthetic process
  Homolog annotation: Hit_ID=Q7WP92; Match level="QueryCoverage=92%, HitCoverage=30%, E-value=4e-38, Identity=36%"; Hit description =Hypothetical protein vrgS
GIEIKLTVICASPKTSVQLPVEGLLFWKLSGREAMSESFALTLTLLGTDARIDRSKLLGQPVTVTIPTQNLLSSRYINGKVTRVAVSAVELTGTRYAVYQLTGQTVPQIVKTLLAEHQVNVEDKLTGSYRVWDYCVQYQESSLDFISRLMELEGIAYHFSHEADKHTLVLTDAATQHQPFSGYEVIPYHQTPSGGSTDEEGISQWALEDSVTPGIYSLDDYDFRKPNAWLFQAQQNPASPKPGSID

SEQ ID NO: 189822 - protein, 144 aa, Glycine max
  Coding DNA Sequence Number=SeqID_73044
MTDRANPSLDDEKNPNQVQMNLMLDGIIAEQDGVIAIRDFAAMVVAVKTVGTKGGGIDVGAAIGGGCAEEDGADVGAAVGGGCAEEDGADVGVVVVGVIGSMEGGTVCRVVVLNKLNIRCWVLAKSIAGGGSGGCTEEGNHGIR

SEQ ID NO: 189823 - protein, 153 aa, Glycine max
  Coding DNA Sequence Number=SeqID_73045
MSCLVIITPISLCRSVSWCMPPTRHPLDPDKSNRALWVPVTPSKVIQLPITQAFIEKYCTPRQVQGDAPQDPNAPPPPHQADPTGRPTTGGRYKYMSVSIASALVSRGKVSLLLRALRQSSLGMRSHGRRLARGPGRGGTCKIPGRCRGGPHG

SEQ ID NO: 189824 - protein, 139 aa, Glycine max
  Coding DNA Sequence Number=SeqID_73046
  Gene Ontology: Mol. function=oxidoreductase activity; Cellular component=cytoplasm; Biological process=retinoid metabolic process
  Homolog annotation: Hit_ID=Q8LBR3; Match level="QueryCoverage=77%, HitCoverage=33%, E-value=5e-29, Identity=50%"; Hit description =Alcohol dehydrogenase, putative
  Pfam annotation: Domain name=ADH_N; Domain location=1-90; Score=19.2; E_value=9.3e-06; Accession=PF08240.2; Description=Alcohol dehydrogenase GroES-like domain
MGILKNEAQRAYPRIFGREASGIVESVREGVNDMKEGNLVVPIFNEECGDCKYCKCEKTNMCERFGVDPMRKVMVPQEYTVVDSACVVKIRVDGDGDLNPYIKRLTLLSCGVSTARAGHSTRQLRPWSRLSNSRVYVDS

SEQ ID NO: 189825 - protein, 176 aa, Glycine max
  Coding DNA Sequence Number=SeqID_73047
MEMQRKTKEKRYRLEVMVNYKEESTNFLLWDCECTELIGQSANEVNKLKIEEGDVDLNVSPQALDKLMGYVLAFKVKVQPKFNNVVVLRYSNDIELINVVVDMLPNAECFPDFMYVGIILFKNSTASNSKFSLLISVSVMQQSVSVTANHDPLLGLSLTPTKRITSVDCDDEPKSS

SEQ ID NO: 189826 - protein, 165 aa, Glycine max
  Coding DNA Sequence Number=SeqID_73048
MKVFPATAEGEEGRIVVTRVQQPLKKEDSLLEVPWRASSNEESLIGATFRSTRVSPLTLLVKGTRSPMQEIVKPMLATSTLASVSSRFRVLERCKKQLYFHGIIQWWSVRGHAYRGWAAYLAHNKNYEGFFCAPIKLLQFAGCAKEKTQTTTDFASHAIRHSLLR

SEQ ID NO: 189827 - protein, 68 aa, Glycine max
  Coding DNA Sequence Number=SeqID_73049
MALRISEGREKQKHIGRRKTYWKCFRNVLEKLGHVLQRLGMGNVLVHCSRGDIFGRKIELTTTRHVGI

SEQ ID NO: 189828 - protein, 359 aa, Glycine max
  Coding DNA Sequence Number=SeqID_73050
MDGDEVFECYKDLLEERNNFASKVEHAAEEKEEPVATVAKFAKVIIDLQARLQESKSKLKKSKLESEKERDTNKEFEEQLLAFKKKDVNDSELLDEEEMVVVEEDTNEEQDDGANVEGSANQPDDFPFCFAEFLTPGRRDLLEVLYQGALEIHQGSPRIDLGFDECLEIHQGSRMADLGFDALEIRRGSPRVNLKFDEPLEICFGDSLRLTKDEPWVLPKADLVFDEPLEIYRGSPTVDLGFELSVVVSGNDVRKTISTDEVLIGSLYVHPPQEIKKIFRAMACLDDQKVTLGTYMLTKDTKYWWESTHQCLVAEARLVTWDVFKEIFLEKYFPEYSPYYNGVGGESSKRVSLSMDYYL

SEQ ID NO: 189829 - protein, 75 aa, Glycine max
  Coding DNA Sequence Number=SeqID_73051
MEDKVSKPIDQKPLKESLLLVVLKPQCLMTQSKKLNLHVSSLKFDLVVDMPTSGPVTTFDVCLNCHVMIFDMFAS

SEQ ID NO: 189830 - protein, 68 aa, Glycine max
  Coding DNA Sequence Number=SeqID_73052
MKLGHRMETHPDCSWVREKDQWLNTTNNNNNLHPNMLGVLQNIFGIILKDNESGMKRSGSLGRGVKRS

SEQ ID NO: 189831 - protein, 101 aa, Glycine max
  Coding DNA Sequence Number=SeqID_73053
MSGFTRDSPQISASPHQLDLAPYASGPYNAQLNAPGLLRDKHTLHSSRILGEMEVDEPWLGLWLPLNYQVDMGASFLAAKFISWLVFWFMLKVVFVIGSAV

SEQ ID NO: 189832 - protein, 108 aa, Glycine max
  Coding DNA Sequence Number=SeqID_73054
MQMCGNAMIYANAMHEYDKGQMQERYVHCDAMKRCMMQSRNMPKNLMEMIQRSTSSDNSKGWFQVTSLASRDIILLDEVSLSSSESETQHDHRLTSTPYGSHRPGYRA

SEQ ID NO: 189833 - protein, 66 aa, Glycine max
  Coding DNA Sequence Number=SeqID_73055
MENSSITVNQMFVIYLRSNSNDWGGKTARKPHYKRNLKESWASSSKGNNTRKSSLPWIQIENANET

SEQ ID NO: 189834 - protein, 75 aa, Glycine max
  Coding DNA Sequence Number=SeqID_73056
NVSPILLALSSSPFKLLLLRDRICLYLQPYRDCDSSPPYQGASTVKHSKDLQDIVKLVGLYTMQHNGDCKLCHAN

SEQ ID NO: 189835 - protein, 98 aa, Glycine max
  Coding DNA Sequence Number=SeqID_73057
MMLNFLVLLNVGLHSPHTCTPTIPPSSLSLFHMPLPPTYSNILHRHALHRSMATGHIADPPCMDLPVRKTLDIRDPMFMDSSSPSFSSESVITSNHRF

SEQ ID NO: 189836 - protein, 196 aa, Glycine max
  Coding DNA Sequence Number=SeqID_73058
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=59%, HitCoverage=10%, E-value=5e-16, Identity=34%"; Hit description=Chromo
MICFKGITVGELCLNTLEGTSFVVQVEGTSTWVIVTENKRGYISCGSILVEGTSTRLIKENKGGYIPCGYLLRDRLLVELKSNLRKAQLRMKLNVDRKRTEVLEWIGNEAYKLELPLDAKIHPVFHVSLLKLCQGDLVSQYISLPLMLSSAGSQLQPIAVLDTRKVLLDNTWIPQLLIQWEGSKAYTWEALSYIQE

SEQ ID NO: 189837 - protein, 680 aa, Glycine max
  Coding DNA Sequence Number=SeqID_73059
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=95%, HitCoverage=52%, E-value=1e-162, Identity=47%"; Hit description =Chromo
MGRNYHPQRIPWLLQVLYKRVILLLYFTIFHYRLIKVLLVVPPSALRVSLQLPMEPAGDVKVMVGNEHYLHAEGVVRDLPLTISGQTIHFPSYVLPVSSAEVVLRASWLATLGAHIADYSSASIKFYLDYAFVTLQGDTSYCPSVVQFHHLKRYYANHAIAELYTLSCSPHDSSVAHSMDLSADLHLDLVAIIRQFFMVFYVPKGLPPPHTQDHSIPLQDGVSAIRVKRYRYPFSQKTQIERMDGSWRFCIDYRALNAVTMKDSFPIPTVDELLDELKGSKFFSKLDICSEYHQILVRPEDLHKTAFRTHNAPATFQALMNDKFVLVFFDDILIYSPAWTTHMEHLAIVLDCLRQHQLFTKLSKCSFGQHKLEYLGHIVSDQGVEMDPSKVQVVQDWPCPTTVTQLKAFLGLTRYYRRFINHYASIAGPLIDLLHKDNFRWTSEADVAFRALQQALTTTSVLSLSDFTQPFIVETDASGQGIAYVRELYAITKAVAKFRHYLFGHYFIIRTNQRSLKHITDQIIQTPEQESLLPKLLGFNFSIEYKPGPTNQVVDALSRSFYMALSSPQANLLDDIKDVVASSPTMQQLIQQFQSDPASMPQHKLRNGLLFLRHRVWEDVAMDFITGLPLSNGYSVILVVVDRLSKFAHFASLRSYFTTQQVAEVFLQNVVKLHGIPVTP

SEQ ID NO: 189838 - protein, 125 aa, Glycine max
  Coding DNA Sequence Number=SeqID_73060
MQQGQVDIFIARFPDPDYGVKTGSSQCRVATENNGGLWWLMVDVGDGESAWDVRKGFGRKKEEEMVFFLSYTKAKAENAQVRNGLGHGNAAHTPDIFSKIPMAAHVASLRSFIKRLPQEASSWLL

SEQ ID NO: 189839 - protein, 278 aa, Glycine max
  Coding DNA Sequence Number=SeqID_73061
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=82%, HitCoverage=14%, E-value=2e-44, Identity=43%"; Hit description=Chromo
MAEATRMKDLVADLKQVTDIVSKHDAQHRTTQQQLIRIEDTQASFQHTLDTITRSVDCLTTNTLTGALSSGTQSRPVKLDFPKFDGSNPLQWLFRAVQFFSYYVTFDAQKLIITVVHFEGSVVPWFQMLQKSNLIPTWAALAQAIEEQFGPSQFDSPRAQLFKLSQTNSVADYYTQFMTLANRVEGLTEPALLDCFISGLWDPIRRDVIAQSPPTLLRAVSLACLFDEKLLKETSQESFSKKPRGSFLRNPLSEASQGSYMNCLGKNAAQPSLTIGSS

SEQ ID NO: 189840 - protein, 120 aa, Glycine max
  Coding DNA Sequence Number=SeqID_73062
  Gene Ontology: Mol. function=helicase activity
  Homolog annotation: Hit_ID=Q2HTA7; Match level="QueryCoverage=91%, HitCoverage=5%, E-value=1e-52, Identity=90%"; Hit description =Helicase, C-terminal; Argonaute and Dicer protein, PAZ; Type III restriction enzyme, res ...
  Homolog annotation: Hit description=subunit; Ribonuclease III, bacterial
MHSCATAVAKKAEVIRERTGYQVGHYCGEIGQDFWDARRWLREFDTKHVLVMTAQILLNILRNSIIKMEAINLLILECLHAMKKHPYSLVMSEFYHTTPKENKPSVFGMTASPVNLKGSY

SEQ ID NO: 189841 - protein, 93 aa, Glycine max
  Coding DNA Sequence Number=SeqID_73063
MKGPLMEWQPKEHEMELQRLNQNEENDKKKRSIVLKASSSMQEENEEDDSDDEKDFSFFVKKFQKFIKKRRIGRRQNFNNGRKSQEDSQILRC

SEQ ID NO: 189842 - protein, 98 aa, Glycine max
  Coding DNA Sequence Number=SeqID_73064
MVVSFFLTHLFLEVASSIIFLPYPFRCHDLQEAKDSTDEEDPRPTSSPWSYIMSNMYKDKIRGLLKESTSCFLIRSSPLVLVLIGLFHRTQRPMLYLS

SEQ ID NO: 189843 - protein, 99 aa, Glycine max
  Coding DNA Sequence Number=SeqID_73065
ITIAKGGVVDKSEAFAPTYPQYVMRNLDLRSSCKSGVFACYRTLGSLDSKGCLWVIVGCLRMPSDSWVTVTKGRVVDKSRAFAPTYPQFVMRNSDLRSS

SEQ ID NO: 189844 - protein, 61 aa, Glycine max
  Coding DNA Sequence Number=SeqID_73066
MGLRIRFEGGGWTNSARQSIRGAPDSMVEDAINSWGSRLDGGGCMNDHQFMGLRIRFEGGG

SEQ ID NO: 189845 - protein, 76 aa, Glycine max
  Coding DNA Sequence Number=SeqID_73067
MSLHYISSNKHSNRACKDITVKTSIPTTLAPPPNLDRKRTIYKQDLVHYSQWGTSTHPSWPKVTPPQLRWVRSHHN

SEQ ID NO: 189846 - protein, 65 aa, Glycine max
  Coding DNA Sequence Number=SeqID_73068
MLSFRSSFSNYTEVPNQGEQKSKGYFTKPHIVKNLLSQDKSGYENEVASAVKGVFKTSSELSQKS

SEQ ID NO: 189847 - protein, 93 aa, Glycine max
  Coding DNA Sequence Number=SeqID_73069
MSLEQQLSKNSQLRVLAFHGKEAPFTLKKRNQEKLLAYKGVGMSPLPLGISQSLKNSLISLKDENLVPCSALCSLKFTLFRPLTAIQHTLAPP

SEQ ID NO: 189848 - protein, 137 aa, Glycine max
  Coding DNA Sequence Number=SeqID_73070
MTLLHMALKKKHRRVMIAKGIHSVSGESKPKISCLFSKFQIQTINQPDDRAFLHNFSHLHAMCRNVPFAGERGRGSRVRFPKEERCAELPPTFICGKRQENRRKPVKMKILSSGVVFTLEEGISTSHVCLKGQQPIF

SEQ ID NO: 189849 - protein, 51 aa, Glycine max
  Coding DNA Sequence Number=SeqID_73071
MVPTPTKERWASKRSPRKSAILLKKRSSPDIYGEPMLLRVGDHLMIEDKHR

SEQ ID NO: 189850 - protein, 474 aa, Glycine max
  Coding DNA Sequence Number=SeqID_73072
  Gene Ontology: Mol. function=sugar porter activity; Cellular component=integral to membrane; Biological process=phosphoenolpyruvat e-dependent sugar phosphotransferase system
  Homolog annotation: Hit_ID=Q2NTC5; Match level="QueryCoverage=50%, HitCoverage=83%, E-value=1e-100, Identity=76%"; Hit description=PTS system mannose-specific IID component ManZ
  Pfam annotation: Domain name=EIID-AGA; Domain location=1-236; Score =465.6; E_value=6.2e-137; Accession=PF03613.5; Description=PTS system mannosefructosesorbose family IID component
MVPVIRRLDPENNDERKQAIKRHLEFFNTHPYVAAPVLGVTMAMEEQRANGAAIDDGAINGIKVGLMGPLAGVGDPIFWGTVRPVFAALGAGIAMSGSLLGPLLFFFLFNIARMLTRYYGVAYGYRKGVDIVSDMGGGFLQKLTEGASILGLFVMGALVNKWTHVNVPLVVSRITDQTGKTTVTTVQSILDQLMPGLIPLLLTFGCMWLLRRKVNALWIIVGFFAIGIFGYWIGLLGLANAEVTSVEEEACMSLTDALIALLIAALALFAIYDDRHLYRAATDSAVEQRQPSWPAAHHHFADGARVDRLPAYSEYEPVRGWHSGDAAGAASPADCGETARRPGENLPYAGGGALNALPQRQGEIRVTAKGGAGGQLLPHRFTRTPGKGGHLQQAHRFRPVQRHRVVKVLLIDLLKSRIVFLFRRMQLHFTIDQRLKLLQMVRPRRHRQQIAAGPDNAAQLLLVTGRVNAHDGVQ

SEQ ID NO: 189851 - protein, 119 aa, Glycine max
  Coding DNA Sequence Number=SeqID_73073
MDGRAALHFRPGLLQILCHTINLAYIKKNCWNLDDPSVTFPRTRKSRPRRSEAPSPSVVPAPPTSALSTSALPSAPAAPILPGPSAHSSEPFMSMLQSLHQGQLLIMRACRMWSSSDQL

SEQ ID NO: 189852 - protein, 55 aa, Glycine max
  Coding DNA Sequence Number=SeqID_73074
MLLVAVGSKPTMDYGRNMNAGVDCLESCTLRKRDKNFGLLGMDVALENNESSIGM

SEQ ID NO: 189853 - protein, 102 aa, Glycine max
  Coding DNA Sequence Number=SeqID_73075
MEALKIFKWSLFFTPMSDSGTSHIEMLEIEQLKLSRYSNGLDFSHGGSIQAHSTSRCSKLNYGSSQEIQMVESFHSNVQFRRIAYRDARNRTTEALEIFKWS

SEQ ID NO: 189854 - protein, 377 aa, Glycine max
  Coding DNA Sequence Number=SeqID_73076
  Gene Ontology: Mol. function=FMN binding; Biological process=electron transport
  Homolog annotation: Hit_ID=Q07X11; Match level="QueryCoverage=53%, HitCoverage=96%, E-value=1e-76, Identity=66%"; Hit description =Conserved hypothetical flavoprotein oxygenase
MAADLLAIAMAEIGSIAERRLDRLVNPLVSGLPPFLVAQPGVNSGMMIAQYVAASLCAENRQLAQPAVLDNYITSGLQEDHLSLGTGAALKLLRLLNNLWQVLAIEYLLAAQALDFHGEAQLASGTGRALRALRAEVATWQEDRWLAPEIARARRNVSRRQCPDLTAARVRAHQIKTLIFADRVIGGRTAGAQNRLRFGGLIDAVLQQRFIDMNRHRFAQYQPALQLASLCILQANQLRQATLKVDRAFCHHADVNVGSGQRRQAGEGKLVVIGRHRGGALIHGFCQRTRRQVPDELAGFTDILHAVFPAAAGKTNDWRMVVKTVKETIGRQIALAAGALRADPANRARADDGVERIVRQTVSTAWLISVTLTHLRS

SEQ ID NO: 189855 - protein, 313 aa, Glycine max
  Coding DNA Sequence Number=SeqID_73077
  Gene Ontology: Mol. function=methyltransferase activity; Cellular component=cytosol
  Homolog annotation: Hit_ID=P75782; Match level="QueryCoverage=94%, HitCoverage=96%, E-value=6e-87, Identity=54%"; Hit description =UPF0049 protein ybiN
  Pfam annotation: Domain name=Methyltransf_10; Domain location=9-303; Score=531.6; E_value=8.2e-157; Accession=PF05971.2; Description =Protein of unknown function (DUF890)
  Pfam annotation: Domain name=Methyltransf_12; Domain location=115 -221; Score=14.8; E_value=0.022; Accession=PF08242.2; Description =Methyltransferase domain
  Pfam module annotation: Pfam domain module=Methyltransf _10::Methyltransf_12; Domain location=9-303::115-221
MSGESMNKPAATALFHPRNRHQGRYDFAALTAAHPPLADKVRPNGYGELSVDFADPHAVLLLNQALLKLFYNLNWQLPEGYLTPPVPGRADYIHALADLLASDNGGVLPRDLDVMDIGCGANCIYPLIGHAEYGWRFTGTDISADAVNAASQIVASNPGLQRAIRLRRQKQESAIFAGVVHKNERYHAVLCNPPFHASAADAAAGSQRKVRNLGLSRQAPLNFGGQHNELWCDGGERAFIGRMIDESVALGDRIVWFTSLVSRKEHLPELRDRLKAHDAYQVRIVDMAQGQKQSRFIAWTFLPPATRAQWLAR

SEQ ID NO: 189856 - protein, 45 aa, Glycine max
  Coding DNA Sequence Number=SeqID_73078
MYRGPRGSFGVEGRSKVGPSGQAEGIYTNAPDPIRTSQLSVLGRE

SEQ ID NO: 189857 - protein, 127 aa, Glycine max
  Coding DNA Sequence Number=SeqID_73079
  Gene Ontology: Mol. function=nucleic acid binding
MTLQLADRSITRPYGVIEDVLIRVKHFIFSADFVVMDISEDIDIPVILGRPFMLTASWIVDMGKRKLELGFEDQKIDFDLFVEDKPAPEHNVCLQVMGEGQEVLKSPFAKHKPRAKRISVHALSHES

SEQ ID NO: 189858 - protein, 100 aa, Glycine max
  Coding DNA Sequence Number=SeqID_73080
MECYQTLELQGSIRTKQGQTLGVPTDFFEPHFQEQCRGFCGFERGQCGFFGSVGGSVVSSEDNVGVEGAVSGGRRKRRAISDRRMKKRRGRARFSSARGL

SEQ ID NO: 189859 - protein, 165 aa, Glycine max
  Coding DNA Sequence Number=SeqID_73081
MERSLIDAASGGALGDMTPAEARNLIEKMASNSQQFSARSDAIVNRGVHEVATSSSSSAKTKKLEGKLDALVNLATQLAMNKKSAPVAILCGLCSSADHHTNLCPSVQQSEAIEQPEAYAANIYNRPPQPQQQNQPQQNNYDLSSNKPYVPPPIQQQQQQQQQQQ

SEQ ID NO: 189860 - protein, 140 aa, Glycine max
  Coding DNA Sequence Number=SeqID_73082
MSSDSPSLDDKGANDHNLSLRVSGLACLLLTNGAGPYGSPRCHQTHRLWMTKARFPLVDKRCRTIWFPRMSLDSPSLDDKGADDHNLSQRAIRRLSLIDSRKNVYTDNHLGMSPEFRVSMTEIVGRPTKARLLLLRILNL

SEQ ID NO: 189861 - protein, 82 aa, Glycine max
  Coding DNA Sequence Number=SeqID_73083
  Subcellular localization annotation: CTP_CleavageSite=39; ConfidenceScore=5.12e-01
MMKALTSSCSKAMVETLGPFSPRVPLCVSDRPKFCFTLRSKNEKKGWNLLLLKLVRNNDLYPVHAVPPKDQLGTILSSIFRV

SEQ ID NO: 189862 - protein, 80 aa, Glycine max
  Coding DNA Sequence Number=SeqID_73084
PALAKVTKKEEGLTSLQKIVIGDVCSILTMHGGIDWLNDDINAGKLDYYYFLIAGLASINLMSKKKLWRNLSLEGYWKND

SEQ ID NO: 189863 - protein, 110 aa, Glycine max
  Coding DNA Sequence Number=SeqID_73085
MEALEAAMLQSIVEAPLNETKDDMIETDHDTAKIYPRHITTVDEEVVDALIKLLPLRPSSSTQQETIKEPDTNATLNYGFRGFRVMEWPTCNKSWREKIGFGSPILDPNM

SEQ ID NO: 189864 - protein, 118 aa, Glycine max
  Coding DNA Sequence Number=SeqID_73086
RIPHHTEFDEFKVELERRNLHKRLANLQDGSIDVAVVKEFCANLYSPEDQASKQARVRGHLIKIDADRLNEFLQTPVVLEEGESLPTYSRFCRLRTNHQEIKVRLCIPRKGFVLNAKG

SEQ ID NO: 189865 - protein, 169 aa, Glycine max
  Coding DNA Sequence Number=SeqID_73087
MTHYNPYPRKQKGKKENFQSRESKKKRKEIPIKKWEKAKRKERKFPIKEWEKAKRKERKFPIKEWEKDKTLTCARLIHFEWISSIFVKPSVSSKWSFRNKMLTSKISYKVMGGFHQQTLLPRGENTETFSSLTSYPELRRSEFLIGGYVGAKASLLSTAPLSVTMTQEL

SEQ ID NO: 189866 - protein, 153 aa, Glycine max
  Coding DNA Sequence Number=SeqID_73088
  Homolog annotation: Hit_ID=Q47522; Match level="QueryCoverage=27%, HitCoverage=53%, E-value=2e-19, Identity=100%"; Hit description=LacZ protein
DLPSQVLQWLLFLSAVPPVQLLTGWCVTAKAPPDISAGKCSGRVPFAIQAAQLLGRAIGAGLFAITPAGERGMCCKAIKLGNARVFPEFDLRAPFHEHAEIGHAMDHFHLQRHLSTLSKPRPAHVLSNNTFAQSLSSVPNDVKEEGLDFEERG

SEQ ID NO: 189867 - protein, 76 aa, Glycine max
  Coding DNA Sequence Number=SeqID_73089
MDYTTVPSLASRMSRNFADCVLTLPFDSRHVAKLHGLPNDGCQEPRSGQAKVTSHQTDGPRTKLGYDSGPLLPLSA

SEQ ID NO: 189868 - protein, 83 aa, Glycine max
  Coding DNA Sequence Number=SeqID_73090
MALPSPNQKSIYSKQRFDSLVTTYTKKNSPPWSDIHTQVVKDIKLKVQSINSLYLPIPQAFKIIETDASDIGYGGILKQRVHT

SEQ ID NO: 189869 - protein, 118 aa, Glycine max
  Coding DNA Sequence Number=SeqID_73091
  Pfam annotation: Domain name=zf-MIZ; Domain location=31-70; Score= -11.8; E_value=0.044; Accession=PF02891.10; Description=MIZ zinc finger
MTSTYNYFIDFFRITCLRSSSPSNDANAPPCKLSLSLILCVHSNPIDCNYVQVKKKKINNRWNSAVCNQKQSVCRVFAQVFMAKELRKFVQNINMSRKSFNNGEYPLAGTLNLPLAAT

SEQ ID NO: 189870 - protein, 44 aa, Glycine max
  Coding DNA Sequence Number=SeqID_73092
MSWEPSCLLNQIVPHFVRTRCHCSSSRKAKDCENCYQQAMFSEY

SEQ ID NO: 189871 - protein, 59 aa, Glycine max
  Coding DNA Sequence Number=SeqID_73093
MAGLLGYMSLPPKAKNLVAIDKFEADKNKNAGDANMPSKAILDSTGSLAEFACEVEITE

SEQ ID NO: 189872 - protein, 46 aa, Glycine max
  Coding DNA Sequence Number=SeqID_73094
GSTGSNKDRRKSLKVYQSHTGQGLTFSPWVKVYDNLGFWLKACRTA

SEQ ID NO: 189873 - protein, 46 aa, Glycine max
  Coding DNA Sequence Number=SeqID_73095
RATDTPPSPLEFISAHPQKAIKRPAQDIKEALLGGTLVPFISLRVI

SEQ ID NO: 189874 - protein, 87 aa, Glycine max
  Coding DNA Sequence Number=SeqID_73096
MDADLLYEPEHKSMSAHLDSFQGIFLRKRPVQRRMGHQVLKTYHHRDVHLKKEVHLMQTSYASSSKEIYQFRNNGYLKMKANIYQEL

SEQ ID NO: 189875 - protein, 674 aa, Glycine max
  Coding DNA Sequence Number=SeqID_73097
  Gene Ontology: Mol. function=protein serine/threonine kinase activity; Cellular component=cell surface; Biological process =protein amino acid phosphorylation
  Homolog annotation: Hit_ID=Q6UY57; Match level="QueryCoverage=96%, HitCoverage=94%, E-value=0.0, Identity=65%"; Hit description=Lectin -like receptor kinase 1;1
  Pfam annotation: Domain name=APH; Domain location=359-534; Score= -16.1; E_value=0.08; Accession=PF01636.13; Description=Phosphotransfer ase enzyme family
  Pfam annotation: Domain name=Lectin_legB; Domain location=22-260; Score=212.3; E_value=1.1e-60; Accession=PF00139.10; Description =Legume lectin domain
  Pfam annotation: Domain name=Pkinase; Domain location=357-624; Score =176.7; E_value=5.8e-50; Accession=PF00069.15; Description=Protein kinase domain
  Pfam annotation: Domain name=Pkinase_Tyr; Domain location=357-624; Score=89.9; E_value=7.6e-24; Accession=PF07714.7; Description =Protein tyrosine kinase
  Pfam module annotation: Pfam domain module=APH::Lectin_legB::Pkinase:: Pkinase_Tyr; Domain location=359-534::22-260::357-624::357-624
MLGTPHTLILLLFLFLITTFSHSLVFNITNFDDPAAATAISYEGDGRTTNGSIDLNKVSYLFRVGRAIYSKPLHLWDRSSDLAIDFVTRFTFSIEKLNLTEVAYGDGFAFYLAPLGYRIPPNSGGGTFGLFNATTNSNLPENHVVAVEFDTFIGSTDPPTKHVGVDDNSLTSAAFGNFDIDDNLGKKCYTLITYAASTQTLFVSWSFKAKPASTNHNDNSSSFSYQIDLKKILPEWVNIGFSASTGLSTERNTIYSWEFSSSLNGSPADFENVKLKHQSSKLALILAVLCPLVLLFVLASLVAVFLIRKKRRSHDDCMLYEVGDDELGPTSVKFDLDKGTIPRRFEYKELVDATNGFSDDRRLGQGASGQVYKGVLSYLGRVVAVKRIFADFENSERVFTNEVRIISRLIHKNLVQFIGWCHEEGEFLLVFEYMPNGSLDSHLFGNKRVLEWHLRYKIVLGVVNALHYLHEDAEQCVLHRDIKSANVLLDTEFNTKVGDFGMAKLVDPRLRTQRTGVVGTYGYLAPEYVNVGRASRESDIYSFGVVSLEMASGRRTYQDGEFHVSLMNWVWQLYVEGEIMRAADEKLNNEFEVDQMRSLLVVGLWCTNPNDKERPKAAQVIKVLNLEAPLPVLPLDMYERAPPMEIIRMPHHPSGKNHSGMSTPITSSLVSVGR

SEQ ID NO: 189876 - protein, 505 aa, Glycine max
  Coding DNA Sequence Number=SeqID_73098
  Gene Ontology: Mol. function=5-formyltetrahydrofolate transporter activity; Cellular component=membrane
  Homolog annotation: Hit_ID=Q1RSU2; Match level="QueryCoverage=95%, HitCoverage=97%, E-value=0.0, Identity=69%"; Hit description =Biopterin transport-related protein BT1
  Pfam annotation: Domain name=BT1; Domain location=64-483; Score =400.8; E_value=2e-117; Accession=PF03092.7; Description=BT1 family
  Pfam annotation: Domain name=MFS_1; Domain location=52-429; Score =10.9; E_value=0.0001; Accession=PF07690.6; Description=Major Facilitator Superfamily
  Pfam module annotation: Pfam domain module=BT1::MFS_1; Domain location=64-483::52-429
CFKGVIMQEEENQEDPCGESMEENEPKNGVWDCFCIPINWFRMLSREMHWSFVFGVVVVYGISQGLGGALAEVGTKYYMKDVQKVQPSEAQVYKGITSIPWIVKPLWGLLTDVLPFFGYRRRPYFIFAGILGVIAMLLLSLHENLHLMLALLALTAGSAAVAIADVTIDACVAQNSISQPSLAADMQSLCAFSSSVGSLFGYFISGIFVHLLGPMGVFGLMTIPAGLIISVGFLLYEPRMHNTSYTQVKQNFIDAGKAMWTTLRSEDVWGPCLYMYFSLALSLDIREGMFYWYTDSKGGPSFSQESVGFIFSISSGGALLGAILYQYALKDYAFRNLLFWTQLIYGLSGMLDLILVFRLNLKFGIPDYFFVVIVESIAQMTNRLKWMPMLVLSSKLCPSGIEGTFFALLMSIDNVGLLSASWGGGFVLHILRITRTKFDNIWLAILIRNILRIAPLWLLFLVPRADPSSSILPSKNMNSKVAIDTSDIKNVELVSLVHSLEVDES

SEQ ID NO: 189877 - protein, 74 aa, Glycine max
  Coding DNA Sequence Number=SeqID_73099
QSGPLGSSKMFQQKAVPSGGSNPARLGEFGGNHKIQAEALPQRFRDVSVGDFVKIFHRYSSFFVLSSSFFGLQP

SEQ ID NO: 189878 - protein, 68 aa, Glycine max
  Coding DNA Sequence Number=SeqID_73100
MAPLQLKVAPPWLDDYGNLHALENGAVWAGNTPHPGASGGALRAGTLTYGLPRGTLVRAPAPSTSRRP

SEQ ID NO: 189879 - protein, 146 aa, Glycine max
  Coding DNA Sequence Number=SeqID_73101
  Pfam annotation: Domain name=zf-CCHC; Domain location=61-78; Score =12.2; E_value=0.0096; Accession=PF00098.13; Description=Zinc knuckle
RNKSITLEEVQNSIQTKKLQKLQELKADDNEEGLNILKGRSYERGPKRKKSRSKSRSKSKLKCFNYHKNGHFKKDYLEKWGKEFHEGSWMQVGLQEKGRYSKCGEGKITFLQGDPEETIHMQQPKGFIEDQTYWTSGLNNLRGEVN

SEQ ID NO: 189880 - protein, 46 aa, Glycine max
  Coding DNA Sequence Number=SeqID_73102
MPRAQNSTAHHSAYFGKRALEVARGAAFAEIPRFSKHPCWGFLLNS

SEQ ID NO: 189881 - protein, 81 aa, Glycine max
  Coding DNA Sequence Number=SeqID_73103
MNTRLRVIGDPMNGVQRYTKMKFGRVVPFLIPMTRGEGHNSLFEDSPSECGDGAATVRYGLIFKGHSRNKIQAQGRVTRYH

SEQ ID NO: 189882 - protein, 281 aa, Glycine max
  Coding DNA Sequence Number=SeqID_73104
GTVLKQQSCLAIVDSMEFFELNPIFQNPKSMSYSVLPLQLGVGLAFGGLICKDKSESGNSMVFSLVGVLVSGRHREGVGVDEDGGEGEGTLEGFLGGGGREWMLFSSGVGEGWLGYEHLYGCVYLYKLFKASIHLLIILWVSVNCGQGLQTDFKVDFKDNRQHNIPISPKIARQHDFGKILVESGSKKAIGPGNANPVAVAALENKDLAFLVTQLGSDSHQSNNNNNSDATRIRDNSEISFRKVAENMPQPSCACIASRLGKGTDCTKAKGFNLTSDADRG

SEQ ID NO: 189883 - protein, 124 aa, Glycine max
  Coding DNA Sequence Number=SeqID_73105
MSRQNNFVGYAFTGINPKKFDIPKGCSIDQLKDLIKQVAPKGNPPHGIHESQVVRRLFYRQPSHLEYFEKVLEFKIVELKCDDDVLKVLVESNYWKQFVSIEILALFHKVVMENEDDVVTSLRD

SEQ ID NO: 189884 - protein, 107 aa, Glycine max
  Coding DNA Sequence Number=SeqID_73106
  Gene Ontology: Mol. function=nucleoside-triphosphatase activity; Biological process=transport
  Homolog annotation: Hit_ID=Q9FF46; Match level="QueryCoverage=84%, HitCoverage=8%, E-value=2e-23, Identity=61%"; Hit description =Putative white-brown complex homolog protein 29
MEGMAAPSGEGSSHGAATATQNNEAPSFAGELWQDVKCNVEMKKDILHLNFLSSNDLSNRITPGVFNQYKYFLGRGGKQRLREARTQAVDFLILLLAGLLLRNTLLK

SEQ ID NO: 189885 - protein, 54 aa, Glycine max
  Coding DNA Sequence Number=SeqID_73107
GIGGPMTRSKTKRMKQALQGLILKIKEKEDQCELRVAPNWVTPLQIDEYVLRPI

SEQ ID NO: 189886 - protein, 43 aa, Glycine max; identical to SEQ ID NO: 167653
  Coding DNA Sequence Number=SeqID_73108

SEQ ID NO: 189887 - protein, 113 aa, Glycine max
  Coding DNA Sequence Number=SeqID_73109
MEHETFLATWLAEIDFSPNGLDGGSSQYCIIIVILQRILLGERSVYAMMLVFPPEFSPLKSILFGNPSQDTVEPLMEALEEDYKDGNEINESRQFIEGVLDLEKRINRLDTLT

SEQ ID NO: 189888 - protein, 97 aa, Glycine max
  Coding DNA Sequence Number=SeqID_73110
  Homolog annotation: Hit_ID=P64542; Match level="QueryCoverage=73%, HitCoverage=72%, E-value=6e-22, Identity=57%"; Hit description =Hypothetical protein ypeC precursor
RTAKENPMRKILLLAAVLLASAPIVTQAEEITLLPAIKLQIGDRDSYGHYWDGGRWRDKDYWHRHYEYRDKHWRKLEKKQRKAYEKGYHDGRKDAKK

SEQ ID NO: 189889 - protein, 134 aa, Glycine max
  Coding DNA Sequence Number=SeqID_73111
MARQDTCRGLVWLKDKRDAPHYFHDTKCKNDDLETLCKTGRACTYADTQVSNFYGILLPKHVHIFVRYFCYIHAYPRWWRCVYCPLPAIPMLLWCFALRLPGDAVLLDESSISRGPDALAGGYRYSVELIETRN

SEQ ID NO: 189890 - protein, 69 aa, Glycine max
  Coding DNA Sequence Number=SeqID_73112
MKQKGKRKKDREGRHVIVKKYKSFVKSKRIFWEQGTDAKSLVFGITEIRMDEFIELMKEHNLETLGLFV

SEQ ID NO: 189891 - protein, 110 aa, Glycine max
  Coding DNA Sequence Number=SeqID_73113
MGFDIVRCDLYGNKNDANLKLQNGHQEQFEEESHGEGPVLMNIVPGISRDIEGLKENLVRLGGNEEGNFFFEGCMKQSYKEIGKELVFVCKGLGGVKGPWWKAKKKMGAK

SEQ ID NO: 189892 - protein, 109 aa, Glycine max
  Coding DNA Sequence Number=SeqID_73114
  Subcellular localization annotation: CTP_CleavageSite=33; ConfidenceScore=5.29e-01
MGIVSPIPYPDSSTYPHTRTRYPTGLSLLSHTRTRRVSDFKWRGGFGFGVETSLVIPYPYPYPTFGYRGKPEPVPIPGQLGYYPSKSGRIRAGTHGYRFSCHVYSKSCW

SEQ ID NO: 189893 - protein, 82 aa, Glycine max
  Coding DNA Sequence Number=SeqID_73115
MYIKYGPKYIMKHSQQNKLSNETKTPHTYSQNNSEAPKFLKDMDASTRIKPRLLSYPNFVREPLLDDLRPFFGPCEVLGTHH

SEQ ID NO: 189894 - protein, 152 aa, Glycine max
  Coding DNA Sequence Number=SeqID_73116
IAQKGTDHPETEHCPPTVCLVGVMNIWSRSSWLRRRRRSWRKLHSQEAAQSRSVDGIIDPPSPVRRHVKWKMARTKKTGEMTTEAAKEITEKIDSFEEQVTQGSFVPHGRQDVLTAAIRRPEHPRRVHVAGAGVTIKQYFGSAPRRLQMQML

SEQ ID NO: 189895 - protein, 149 aa, Glycine max
  Coding DNA Sequence Number=SeqID_73117
MARTKKTGKMTFEVAKEIVEKVVKHLGHVRIAGVGVTIKQYFGPAPRTSRTSSSTAPEELEQLTQQIRDQLEESITEKGLALPPEPEVGPSAACVSTKESCVDPSGNDPDTGDSDKCGLYIEENPPCLVALGKVYEGLTTIHNILLLQD

SEQ ID NO: 189896 - protein, 79 aa, Glycine max
  Coding DNA Sequence Number=SeqID_73118
  Gene Ontology: Mol. function=transition metal ion binding; Cellular component=chloroplast; Biological process=iron ion homeostasis
  Homolog annotation: Hit_ID=Q948P6; Match level="QueryCoverage=98%, HitCoverage=31%, E-value=3e-20, Identity=66%"; Hit description =Ferritin-3, chloroplast precursor
MELALSLERLNNEKLLNLHSLANENNDVQFVDFLESEFLVGQVEDIKKISEYVAQLRRMGKGHGVWHFDQMLLNGGVAA

SEQ ID NO: 189897 - protein, 137 aa, Glycine max
  Coding DNA Sequence Number=SeqID_73119
  Gene Ontology: Mol. function=transition metal ion binding; Cellular component=chloroplast; Biological process=iron ion homeostasis
  Homolog annotation: Hit_ID=Q8H1T3; Match level="QueryCoverage=80%, HitCoverage=42%, E-value=5e-32, Identity=58%"; Hit description =Ferritin-2, chloroplast precursor
  Subcellular localization annotation: CTP_CleavageSite=52; ConfidenceScore=5.59e-01
MLLGSSSSIYVSLSDRAKLVPSLSSSAPFLNSLNGSYGLRFFSKRNVGCGVVAKVSKEAENQPILGIAFEPFEEVKKELLVIPSVPHASLARQMYTDQCEAALNAQINVEYNVSYVYHAMYAYFDRDNVALKGLAKY

SEQ ID NO: 189898 - protein, 65 aa, Glycine max
  Coding DNA Sequence Number=SeqID_73120
MSMMSAMVMQSAECKVQNPQLEDASFEDLEFKIRVCACTDIVKEHFRFAELGRSREVLGFENMDL

SEQ ID NO: 189899 - protein, 180 aa, Glycine max
  Coding DNA Sequence Number=SeqID_73121
  Gene Ontology: Cellular component=mitochondrion
  Homolog annotation: Hit_ID=Q9FH50; Match level="QueryCoverage=62%, HitCoverage=28%, E-value=2e-36, Identity=64%"; Hit description=APO protein 3, mitochondrial precursor
MGEAFHSSKSSVNTIPHETAQFVLNATQFGNTIMQYFLDFFRLCIFSEVQKLIEHILSIFKRDGILGDKIDFISIRGNHNYSHHATILIGNKSPSMHTVPPKLEPSHNISLDCYSEQVHSDTLHARHNWDRQDHLMLPLVMHVNHFETDDLKPCTFSTYVLWDQPGPQDNSRKYSQNTSP

SEQ ID NO: 189900 - protein, 192 aa, Glycine max
  Coding DNA Sequence Number=SeqID_73122
  Gene Ontology: Cellular component=mitochondrion
  Homolog annotation: Hit_ID=Q9FH50; Match level="QueryCoverage=77%, HitCoverage=31%, E-value=3e-33, Identity=61%"; Hit description=APO protein 3, mitochondrial precursor
  Pfam annotation: Domain name=DUF794; Domain location=15-190; Score= -185.1; E_value=0.00011; Accession=PF05634.2; Description=Arabidopsis thaliana protein of unknown function (DUF794)
MRATVTSSKLSLLKQLPHRLIPTLSFASETWPVPAASVDDAFQYSDVPRPRRRNSEWKPYVTPMKALIERVKAEKEVRKAQPRRVLEEPPENGLLVPELVEVARRVYEACGSLLFSLSQLVRVIPVLRCRQIQQLLWLVLVGFTFNVGFIFLSGFVMRSTLVMWVMKFKHVLDQRAFCGMQCIFGQGEVFEM

SEQ ID NO: 189901 - protein, 136 aa, Glycine max
  Coding DNA Sequence Number=SeqID_73123
MAYNLCLTASRYLAPFVAQYVKFRDMPEIKMKHCYTIRETIFRSGIASGGSNPARLGEQGGNLLPLFPINRLNGALLRVPDPPSDVLQLFWVKKKIPEENPSRGASVTVPRGFRKQIRDGFPPFFTVLYPFFFIQW

SEQ ID NO: 189902 - protein, 106 aa, Glycine max
  Coding DNA Sequence Number=SeqID_73124
MLCRDDSRGTPSPGPRESHLTDLSSLAHEAPGFGVCREDEEAGRTGRRGHPLPPDGSVDFSQRRGQRTAHVAAIRTLHRTIQSVGATGGVYKGQGRSQRELMTRAY

SEQ ID NO: 189903 - protein, 53 aa, Glycine max
  Coding DNA Sequence Number=SeqID_73125
MAYPSGWPWLSWQASNHGTGFLLKHFRITLPVLLLSPRAFFSNLDNDYIASAK

SEQ ID NO: 189904 - protein, 116 aa, Glycine max
  Coding DNA Sequence Number=SeqID_73126
MPTTDGKLILFASNFGGGDASFHTIGRIEALTKQPNTIDTTLFSSKSKYDYLYYGDADDEGDAHDIHEVDLEGEGRGEFMQSSQGGDPSPEPWLGDSKKIGPEMQEKALRFSLALG

SEQ ID NO: 189905 - protein, 66 aa, Glycine max
  Coding DNA Sequence Number=SeqID_73127
MGAKYLEVVKRGSHPNNGWSPDKIRYRHIIPILSNSFLLVDTRRKMTIICLCVSSGTIELGWQGAE

SEQ ID NO: 189906 - protein, 136 aa, Glycine max
  Coding DNA Sequence Number=SeqID_73128
MVRGGDDQQQWWWRMIPFSSSMILPFEEVLVNFNRWNRKRSENEEDWALRDIRDEGGTRTRVRLRNVIGFEGIYRGGQGVIDYKVYGQEGFHSQKVVASSIRFVHNNCQQKYIPLLQWIKQHYFVSYYAKKLEQIQ

SEQ ID NO: 189907 - protein, 108 aa, Glycine max
  Coding DNA Sequence Number=SeqID_73129
  Subcellular localization annotation: CTP_CleavageSite=29; ConfidenceScore=5.12e-01
MGSGVTISQYYGRASHGSSSSSTSVLGARVSTKGSNAEIAINPAGEEDGAHVMPSMELYVQGHNCTHLVALGKIYDGGGLPYTTWLMQMMWLGSVLKKFMTMTLKFRS

SEQ ID NO: 189908 - protein, 72 aa, Glycine max
  Coding DNA Sequence Number=SeqID_73130
MKLHCKNCGKHLQQMMRVMSKMTATATNSISLKPLGRDGTVRSHLVEEIPIVVPRYAVKPQATVTLESTDQR

SEQ ID NO: 189909 - protein, 93 aa, Glycine max
  Coding DNA Sequence Number=SeqID_73131
MGAKYLEAVKQRLHAIKQWSPDEIRFLSLHKCCKIVFPLNFKVTPLVRSILVPRGLSNVALKNDVALGVDGYRDKLCRPRPLVLTATEIRLLL

SEQ ID NO: 189910 - protein, 215 aa, Glycine max
  Coding DNA Sequence Number=SeqID_73132
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=1e-27, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
TTHPCIQRATHPHLRGLHVLAFRGLHGLTFRGLHALSVKGLHVVDFRGLHTLAFRGVHALTFRGLHVLTFRGLHVLTFRGQHALTLHALAFTGLDALTFRGLHVLAFRGLRALAFVGLHALPFRGLHFLTFTGLHALTFRRLHALAFGGLHVLPFRGVHFLTFQGLHVLAFRWLHTITFRVLHVLAFRGLHFLAFKGLHVLTFRGLHILTFRGLH

SEQ ID NO: 189911 - protein, 83 aa, Glycine max
  Coding DNA Sequence Number=SeqID_73133
MKLEGHAFHVKGGGSADKGFELGVVAEIVEEGDEFSDGGGVPSEPWGLGDSFVKLRGEGREVGVGGGRGEEAGESAENDGACN

SEQ ID NO: 189912 - protein, 102 aa, Glycine max
  Coding DNA Sequence Number=SeqID_73134
  Homolog annotation: Hit_ID=Q9FGQ4; Match level="QueryCoverage=40%, HitCoverage=28%, E-value=2e-09, Identity=70%"; Hit description =Arabidopsis thaliana genomic DNA, chromosome 3, TAC clone:K5K13
GNAGALTNVEVLDFLRAKGASKDPTRVIAKVYDYLVDTAASTTKKLVFYDAHSKACQNLLLELADYSVYQCGGCGAVLRAKHKGYVSGSLSDEGKVGLGGDS

SEQ ID NO: 189913 - protein, 160 aa, Glycine max
  Coding DNA Sequence Number=SeqID_73135
MGRAVRAVVLLTRGGRAGRRAGLRLRSGAFAPDCPCVNLPVAAGLPGREHPTPPHSVDKESSGSGPPIDRKVTPEARLPQRTKRIAGRAIMQISGCVIGVDVGKFELQVAGHEKSIVSGVLPNNRSSIVGWLKRLPAGSVIGMEATGGYQELLARLAHER

SEQ ID NO: 189914 - protein, 103 aa, Glycine max
  Coding DNA Sequence Number=SeqID_73136
MTLMCYNLPLIVKTFDVIDIYMEHSIDVPMLDDRLPTKRDKTFTKTKEVEVVVIDYRVSEEEHINVGEVPGDGKVPSDGEVPDDAEVHDDGEVVDDRDNEDLD

SEQ ID NO: 189915 - protein, 77 aa, Glycine max
  Coding DNA Sequence Number=SeqID_73137
MASDVDMVVDLTQGRWRAKITSMCIVLGFLVWCITIKPWKFQKLQDKSLLYRGGNRSGRPTETYDLTYIKPDPNWPI

SEQ ID NO: 189916 - protein, 216 aa, Glycine max
  Coding DNA Sequence Number=SeqID_73138
  Gene Ontology: Mol. function=DNA binding; Cellular component =mitochondrion; Biological process=DNA integration
  Homolog annotation: Hit_ID=Q2HRM8; Match level="QueryCoverage=99%, HitCoverage=20%, E-value=9e-56, Identity=47%"; Hit description =Polynucleotidyl transferase, Ribonuclease H fold
MTLPPGLVVHDPNLVCRLQRSLYGLKQASRQWFTWLSSFLISHDFRQSSANHSLFLHFHNNDITVVLVYVDDIILAASTPMDYSTRLTASMGTPLSETSSSSYRRLIGRLIYLTNTHPDITHVVQQLSQYMAHPTSAHSQAAFRILRYLKGSPGSGIFLAAHDTLQLKAFSDSDWAGCRDTRRSITGFSVYLGPSLISWRSKKQPTVSRSSSETEY

SEQ ID NO: 189917 - protein, 272 aa, Glycine max
  Coding DNA Sequence Number=SeqID_73139
  Gene Ontology: Mol. function=DNA binding; Cellular component=oxygen evolving complex; Biological process=DNA integration
  Homolog annotation: Hit_ID=Q1SS72; Match level="QueryCoverage=99%, HitCoverage=18%, E-value=6e-74, Identity=57%"; Hit description =Integrase, catalytic region
MDSNKLAVNGSLDSLHSSSPTTSDSLQLIIPFFLHFHNNDITVLVYVDDIILAGNNLDTIVHITKLLDQAFSIKDLGTLKFFLGLEVARTSHGIHLSQRKYVLDILSDSGMLASRPASTPMDYSTRLTASTGTPLSETSSSSYRRLIGRLIYLTNTRPDITHVVQQLSQYMAHPTSAHSQAAFRILRYLKGSPGSGIFLAAHGTLQLKAFSDSDWAGCRDTQPSIIEFLVYLGPSLISWRSKKQSTVSRSSSEAEYRALASTTCELQWLTYC

SEQ ID NO: 189918 - protein, 892 aa, Glycine max
  Coding DNA Sequence Number=SeqID_73140
  Gene Ontology: Mol. function=DNA binding; Cellular component=beta -galactosidase complex; Biological process=DNA integration
  Pfam annotation: Domain name=zf-CCHC; Domain location=230-247; Score =14.2; E_value=0.0046; Accession=PF00098.13; Description=Zinc knuckle
  Pfam module annotation: Pfam domain module=RVT_2::zf-CCHC; Domain location=590-787::230-247
MNELAPNTESYLYLHPSKNLVVALVSPVLDSSNYHSWSRSMVTALSAKNKVEFINGNAPEPLKTNRTYGAWSRCNNMVVSWIVHSVSVAIRQSILWMNKAEEIWNDLKSRYTQGDLLRISDLQQEASSMKQDTLSVTEYFTKLRIIWDEIENFRPDPTCSCTIKSIQQCTISRVAHGTHAHNTKDFLLYGSTRTSAIRQIGHTESVCYKKHSVPSSYEGRSKSYNTRNGKTCTHCGKIGHTIDVCYKKHGFPPGYKFGNGKVVANNIVAVEGKATSDQMQRHESHDLVRFSPEQYLALLALIQQPSSGSSAPTQSQVASISSCSTNTSPGTLLSFKTTDSISWILDSGATDHVSSSLANFHSYHQVSPIMVKLPNGHQVHATHSGTVHLTPSIILNDDTNTKAKIGTVEGIIHQTTCVETLEQNGIVEPYLINCIPTPFLNNKSPYEQLYARPCDISNLRVFGCLCYMSTLKSHRQKLDPCAHPCIFIGFKPHTKGYLVYDLHSHNITTSRNIVFYEDHFPLFPDNQTLPTLHTSISPLPFSSNPENFDSPIPPSDNPSSPHTTYPPLRRSTRPKQAPTYLQDYHRALTSQADTTASNARLVAKGYTQLEGLDFLDTFSPVAKLTTVRLLLALAALHNWHLRQLDVNNAFLHGDLDKEVYMTLPPGLNLAVNGSLDSLHSSSPTTSDSLQLIIPFFLHFHNNDITVLVYVDDIILAGNNLDTIVHITKLLDQAFSIKDLGTLKFFLGLEVARTSHGIHLSQRKYVLDILSDSGMLASRPASTPMDYSTRLTASTGTPLSETSSSSYRRLIGRLIYLTNTRPDITHVVQQLSQYMAHPTSAHSQAAFRILRYLKGSPGSGIFLAAHGTLQLKAFSDSDWAGCRDTQPSIIEFL

SEQ ID NO: 189919 - protein, 82 aa, Glycine max
  Coding DNA Sequence Number=SeqID_73141
  Homolog annotation: Hit_ID=Q6ZA70; Match level="QueryCoverage=43%, HitCoverage=3%, E-value=5e-09, Identity=86%"; Hit description =Putative RNA-binding region RNP-1 and Splicing factor PWI family member protein
MLERLQIILDEEAEMFVLKMWRMLIFEIKKVESGLALSCLERGSRQLPRFTTWNCKFNTSTSNLEYSIFLKIYKKIAALGRD

SEQ ID NO: 189920 - protein, 669 aa, Glycine max
  Coding DNA Sequence Number=SeqID_73142
  Gene Ontology: Mol. function=nucleic acid binding; Biological process= mRNA processing
  Homolog annotation: Hit_ID=Q6ZA70; Match level="QueryCoverage=97%, HitCoverage=73%, E-value=2e-43, Identity=46%"; Hit description =Putative RNA-binding region RNP-1 and Splicing factor PWI family member protein
  Pfam annotation: Domain name=DUF1509; Domain location=12-341; Score= -220.3; E_value=0.085; Accession=PF07420.2; Description=Protein of unknown function (DUF1509)
  Pfam annotation: Domain name=RRM_1; Domain location=56-127; Score =24.6; E_value=0.00036; Accession=PF00076.12; Description=RNA recognition motif. (a.k.a. RRM, R
  Pfam annotation: Domain name=TolA; Domain location=202-570; Score= -139.4; E_value=0.019; Accession=PF06519.2; Description=TolA protein
  Pfam module annotation: Pfam domain module=DUF1509::RRM_1::TolA; Domain location=12-341::56-127::202-570
  Subcellular localization annotation: CTP_CleavageSite=42; ConfidenceScore=5.14e-01
MVRPVFPARPPGAVNIPTISRPPVAGIPAVRPIIPPVVRPVVAPSVTPAEKPQNTVYIGKIAPTVENEFMLSLLQLCGTIKTWKRPQDLSTGTPTSFGFYEFESAEGVLRALRLLTKLNIDGQELKVNVNQAMKEILELYVKTKTENLKNKETQEVGEKNEGEQPSNANEDAKVDTEPSNKEASESSNKESHDVANFGIVTDEDREADCEALEKITKMIEERLKTRPLPTPPAQPTGDGSVNLTSEQPVKARDGDSVVDTEKNESAENKNEKETNNDNKPTSEHERTESPDRRHDRKSRERDRDRELKREKDRELERYEREAERERVRKEREQRRRVEEAERQYETYLKDWEYREREKEKERQYEKEKEKERERKRRKEILYDEEDEDEDSRKRWRRSVIEEKRKKRLREKEDDLVDRQKEEEEIAEAKKKAEEEQKRQRDALKLLSEHVVNGGDGNSINVIIDESTIASVAPTDAQSGGNAPTKKLGFGLVGSGKRTSVPSVFHEEDDDDAHKDKKMRPLVPIDYSTEELQAVQPTVSGPTPPNLAAAAEFAKRISSTNFKEEKLDGERDRSRRSNEKSNHRDRSDEDGTHNRDENKERIPGRDRDRDHGSEKLKTSDNKRLLDAKQLIDMIPKTKEELFSYEIDWAVYDKKHKNMNSGGQIGVFSSF

SEQ ID NO: 189921 - protein, 606 aa, Glycine max
  Coding DNA Sequence Number=SeqID_73143
  Homolog annotation: Hit_ID=Q2QYH0; Match level="QueryCoverage=95%, HitCoverage=93%, E-value=6e-16, Identity=28%"; Hit description =Expressed protein
  Pfam annotation: Domain name=DUF936; Domain location=1-605; Score =120.6; E_value=4.3e-33; Accession=PF06075.3; Description=Plant protein of unknown function (DUF936)
MATLAPGILLKLLNGLNTGVKPTSEHRSSLLQVTDIVPADLDEKNLIPKQGFYIKVSDSSHSIYASLPSDQDDVVLSNKMQLGQFIYVDRLEPGSPVPVLKGAKPLPGRHPLVGTPEPLMGLRDQNQNQNQNQKLNSAPRRGSWGTSCDGGFNFKPVNLDFEQCTPVKVRNGGFQPVSSSPLIRGKVGREGTTPGSGVRSSVGGGLLAKISDAKVESPALLRKSCVVATSNSKFTRSRSVSEREHRIPASPFKSAVELFVAKNLKDAVFASSREKKSGTPPPRLRNARVITPSSSSSFSSGDAQGHNTDTSVASQPQSQSTTNSAFDNCNNLSLPMNLPGKLSSLGKEAMQQREVAQKIALQALRDASATETVVRSLKMFSNLCKSARTDAPLACFERFLEFHNEIVQAVNEMVSIQAATSASELAQKSDKPELQVLHEVMDNCENSESNMSKRRGALYKSMAAIPEKHEQKANMGRLLRTSTNQKEILQKKGSTPLTKMPLEPIVENDENKKPGGSCSLSNTIKLGKQIETEAGNWFMEFIEKALETGLKKTKDASDGDVRKVPQSLILKVMNWVEVEQCQSNKRPSHPKAAQIARKLRIKMKNP

SEQ ID NO: 189922 - protein, 61 aa, Glycine max
  Coding DNA Sequence Number=SeqID_73144
MRGNNHSEERKESCSIHRRSSKAVREGEGEAIVVVDGESPTMARFIGERVGGGMILCGKFI

SEQ ID NO: 189923 - protein, 223 aa, Glycine max
  Coding DNA Sequence Number=SeqID_73145
  Gene Ontology: Mol. function=acyltransferase activity; Cellular component=integral to membrane
  Homolog annotation: Hit_ID=Q1SWP9; Match level="QueryCoverage=59%, HitCoverage=27%, E-value=1e-58, Identity=80%"; Hit description =Chalcone and stilbene synthases, N-terminal
  Pfam annotation: Domain name=FAE1_CUT1_RppA; Domain location=13-217; Score=154.7; E_value=2.3e-43; Accession=PF08392.2; Description =FAE1Type III polyketide synthase-lik
  Subcellular localization annotation: CTP_CleavageSite=98; ConfidenceScore=5.40e-01
MENAVSVFRYDSSVKFRSVMCDPPCLLCSTLQASAFRPLRPPLSLPSFSLLRASSFSLRPPLLLRHHLSSPSFSLVNPKDIGILVVNCSLFNPTLSLSSMIVNKYKLCGNAKSFNLGGMGCSAVDLAKDMIQVYPNTYVIVVSTKNITQNWYFGNNKVMLIPNCLFRVCGAVILLSNKSFDRARAKYKLVHVVRTHKGADDKAFRCVYQVRATLRHVEELDHG

SEQ ID NO: 189924 - protein, 64 aa, Glycine max
  Coding DNA Sequence Number=SeqID_73146
  Subcellular localization annotation: CTP_CleavageSite=49; ConfidenceScore=5.34e-01
MPFLPSLSTAKLPVLLVGAQVSLTPLHSATASAMFTSLLSLHNTNWGCLSEAFGEVKGESIYKR

SEQ ID NO: 189925 - protein, 38 aa, Glycine max
  Coding DNA Sequence Number=SeqID_73147
MLGYSVYNVGLAGKKPAKPMPRLATGTVPGGRVFILKI

SEQ ID NO: 189926 - protein, 127 aa, Glycine max
  Coding DNA Sequence Number=SeqID_73148
  Homolog annotation: Hit_ID=Q1S015; Match level="QueryCoverage=44%, HitCoverage=4%, E-value=6e-18, Identity=78%"; Hit description =Inositol polyphosphate related phosphatase; PapD-like; WD40-like
MTNGGSGGDNGGGCGSDNDNDSGCINNNDDECDENDGPGNDSGDDNSNDDKVGDNVDYNDNGGGIGCGAHGFVDMKFGRKNCLVHEQPESLPYLGCLHSTNSVVCHLQILLRYEDLRDELKPLHFAQ

SEQ ID NO: 189927 - protein, 263 aa, Glycine max
  Coding DNA Sequence Number=SeqID_73149
  Gene Ontology: Mol. function=thiopurine S-methyltransferase activity; Cellular component=cytoplasm; Biological process=metabolic process
  Subcellular localization annotation: CTP_CleavageSite=13; ConfidenceScore=5.31e-01
MSATVTLTLNLCRSSIVASCPHYNHKPNPNFNALFSFSLSLSLSHHRRIAICKKPFSSRRTWLHGHMKRDRDYELENGLALFGSDEELATQIPTQAQSLVEGSGSIRVAEFKPVPDVDYLQELLAIQQQGPRAIGFFGTRNMGFMHQELIEILSYAMVITKNHIYTSGASGTNAAVIRGALRAEKPELLTVILPQSLRKQPPESQELLSKDRDWELLWHGSLEVLITCKMRRGRMVKNVIEKPHNDHLPLIEASRCFGVMIGA

SEQ ID NO: 189928 - protein, 236 aa, Glycine max
  Coding DNA Sequence Number=SeqID_73150
  Gene Ontology: Mol. function=inositol or phosphatidylinositol phosphatase activity; Cellular component=membrane fraction; Biological process=vascular tissue development (sensu Tracheophyta)
  Homolog annotation: Hit_ID=Q1S015; Match level="QueryCoverage=99%, HitCoverage=20%, E-value=1e-119, Identity=86%"; Hit description =Inositol polyphosphate related phosphatase; PapD-like; WD40-like
MVVFFGDFNYRLFGISYDEARDFVSQRCFDWLREKDQLREEMKAGKVFQGMREALIKFPPTYKFERHKPGLGGYDSGEKKRIPAWCDRIIYRDTRSAPVSECNLDCPVVSSILQYDACMDVTDSDHKPVRCKFNVKISHVDRSIRRKEFGVVMTSNEKIRSILEDLCDVPEATVSPNSLVLQNLDTSLLLITNRSTKDKAIYKITCEGQSIVKNDGQAPDYSPRGGFGFPRWLEVL

SEQ ID NO: 189929 - protein, 665 aa, Glycine max
  Coding DNA Sequence Number=SeqID_73151
  Gene Ontology: Mol. function=inositol or phosphatidylinositol phosphatase activity; Biological process=vascular tissue development (sensu Tracheophyta)
  Homolog annotation: Hit_ID=Q1S015; Match level="QueryCoverage=90%, HitCoverage=51%, E-value=0.0, Identity=80%"; Hit description =Inositol polyphosphate related phosphatase; PapD-like; WD40-like
  Pfam annotation: Domain name=WD40; Domain location=197-234; Score =6.5; E_value=6.4; Accession=PF00400.22; Description=WD domain, G -beta repeat
  Pfam annotation: Domain name=WD40; Domain location=243-280; Score =12.9; E_value=1.1; Accession=PF00400.22; Description=WD domain, G -beta repeat
  Pfam annotation: Domain name=WD40; Domain location=503-539; Score =0.9; E_value=29; Accession=PF00400.22; Description=WD domain, G-beta repeat
  Pfam module annotation: Pfam domain module=WD40::WD40::WD40; Domain location=197-234::243-280::503-539
MDDRIDEDEKDKEEEESLAGLTSLPPHRKAHSYSQQLRGTSTHKRHHQVRKHSLDDSRISSNIVEAASFYDCGEDDDILSRSSSTNNPAADEVYSEGADSTTTQYQPLQEFIGSGGGTGVFKPPFRASVHPGRPPCLELRPHPLRETQVGKFLRNIACTKTQLWAGQEGGVRVWEIKNAYDPGKGLGGTVRRGDEDAAPFCESSDTSPTLCLVVDHGNRLVWSGHKDGKIRSWRMDQRFATPFKEGLSWQAHRGPVLSIVLSSYGDLWSGSEGGIIKIWPWESVEKSLSLSPEERHMAALLVERSFIDLRAQVTVNGVCSISSQEVKCLLCDHVRGRVWCAGPLSFSLWDARTKELLKVFNIDGQVENRVDISSVQQQDQAVEDEMKVKFVSTSKKEKSQGTSFLQRSRNAIMGAADAVRRVATKGAGAFVEDTKRTEALVQTGDGMIWSGCTNGLLVQWDGTGTRVQDFNRHPCAVQCFCTFGTRLYVGYVSGIIQVLDLEGNLIAAWVAHNGPVIKLAVGCDYVFSLATHGGLRGWIIASPGPVDNMIRSELAAKELIYTRLHNVRILIGTWNVGQGRASQDSLSSWLGSIASDVGIVVVGLQEVEMGAAKIAVVDTDQAEIQRWPLMRCLNCERRGLLLWIGCANDIYIVNCGIRISEVIAR

SEQ ID NO: 189930 - protein, 77 aa, Glycine max
  Coding DNA Sequence Number=SeqID_73152
  Homolog annotation: Hit_ID=Q1S015; Match level="QueryCoverage=97%, HitCoverage=6%, E-value=3e-30, Identity=81%"; Hit description =Inositol polyphosphate related phosphatase; PapD-like; WD40-like
MGQWWLDTIGRALEEGKAFERMGSRQLAGLLVSLWVRKNLRTHVGDIDAGAVPCGFGRAIGNKEGKLKWLRTFSAVA

SEQ ID NO: 189931 - protein, 87 aa, Glycine max
  Coding DNA Sequence Number=SeqID_73153
MEILTRTHCDLTLARNPSSHSLARDSLSLLLDAGSACSPCSRLAVVQSNLSRTHGGHNCGVDLDEFGVELGGEHHLFVNMHEREREK

SEQ ID NO: 189932 - protein, 92 aa, Glycine max
  Coding DNA Sequence Number=SeqID_73154
  Gene Ontology: Mol. function=positive transcription elongation factor activity; Cellular component=nucleus; Biological process=regulation of transcription, DNA-dependent
  Homolog annotation: Hit_ID=Q94C60; Match level="QueryCoverage=84%, HitCoverage=68%, E-value=6e-37, Identity=87%"; Hit description =Transcription elongation factor SPT4 homolog 2
  Pfam annotation: Domain name=Spt4; Domain location=14-92; Score =123.0; E_value=8.6e-34; Accession=PF06093.4; Description =Transcription initiation protein Spt4
MATAPAQIPTSFGHELRACLRCRLVKTYDQFRESGCENCSFFKMEEDHELVVDCTTPNFNGIISVMDPNRSWAARWLRIACGQDLEREFENS

SEQ ID NO: 189933 - protein, 225 aa, Glycine max
  Coding DNA Sequence Number=SeqID_73155
  Gene Ontology: Mol. function=nucleotide binding; Cellular component =nucleus; Biological process=mRNA processing
  Homolog annotation: Hit_ID=Q1SL19; Match level="QueryCoverage=61%, HitCoverage=23%, E-value=7e-29, Identity=48%"; Hit description =Nonsense-mediated decay UPF3
  Pfam annotation: Domain name=Smg4_UPF3; Domain location=1-147; Score =50.2; E_value=6.8e-12; Accession=PF03467.6; Description=Smg-4UPF3 family
MVCHKRQMHSRAYIDFKCPDDVFEFTEFFDGHVFVNERGAQYKVIVEYAPSQRVPKPSAKKMDVKGLYSKVDVMTDPDYLEFLKLIAKPQEHLPSAEIQLERKEAEQADKFQYHWSHSYIVSFPGASKETPIVTPLMEYIRQKPAADSGSPPGVLDHGGHLPSYQSSQRFLIQILVREPLALMDNIATVSTMKLICDISRSACDLVQRVPLHTRDLKPNYGDKGN

SEQ ID NO: 189934 - protein, 115 aa, Glycine max
  Coding DNA Sequence Number=SeqID_73156
  Subcellular localization annotation: CTP_CleavageSite=58; ConfidenceScore=5.03e-01
MKKKANKTRNELKVSDSKTYRLKNEERKKNGGKSSRNHPTKVLRQRCGSTSTQFFFMKTEKRGGACHPARPALWKPRKPFFHKMGDELTALLAQASRLHPQEATQLPKCFGRAQI

SEQ ID NO: 189935 - protein, 131 aa, Glycine max
  Coding DNA Sequence Number=SeqID_73157
MFPQADCWNFENNNFGSLTKREWRTKRNSNREGMALSAQRCAKPNSYQEEVALSAQSVKNMIFHSILLQNVTQTLKSHFSSPKTTGGRRELPLLAVEPPHQEEHFNQSGILRILLKDSVEKILQSSVSKLL

SEQ ID NO: 189936 - protein, 234 aa, Glycine max
  Coding DNA Sequence Number=SeqID_73158
LENEIRKLGGLLVIYYQGRNKPLVINYQSCVIDYTVHFAGFHVLKLCNSNLASGNRLPMRCNRLPEMKSLEIPLLLACSGYGTHCVATAIAMAAQLIHDRVEMECLEGAWETLEGNARCRFRGTIRFTATSLVHPDEPARTLQRTVEWILPTPTPYRLVEPVQVIEVTSSEEDPEEDPEELPPEPAVDALDFLEGDEDPLPEVDSSEDVMSASEADSTEDSGLGEMAISGGSSS

SEQ ID NO: 189937 - protein, 125 aa, Glycine max
  Coding DNA Sequence Number=SeqID_73159
  Gene Ontology: Mol. function=transcription factor activity; Cellular component=nucleus; Biological process=regulation of transcription, DNA-dependent
  Homolog annotation: Hit_ID=Q1S1X7; Match level="QueryCoverage=99%, HitCoverage=10%, E-value=1e-36, Identity=56%"; Hit description =Integrase, catalytic region; Zinc finger, CCHC-type; Peptidase aspartic, catalytic
MELEKLNIKTTFLHDRLEEGIVMLQLEGFEMEGKENFVCRLKRSFYELKQSPRQWYKRFNEFIISHGYIRSSYDSCVYHSKVEDGSHIYLLLYVDDMLIASQNFEFEMKKMGAAKKILATDIKRD

SEQ ID NO: 189938 - protein, 80 aa, Glycine max
  Coding DNA Sequence Number=SeqID_73160
VSLDKYLFVFLVEKNVTLEDVMVLEGFATVGDPVFTPFQSKEMMKVEKKLIHRIGQQQSPRSKKSGDNNNLQGVKRVGFI

SEQ ID NO: 189939 - protein, 381 aa, Glycine max
  Coding DNA Sequence Number=SeqID_73161
  Gene Ontology: Mol. function=protein-tyrosine kinase activity; Cellular component=membrane; Biological process=lipopolysaccharide biosynthetic process
  Homolog annotation: Hit_ID=Q6D9W1; Match level="QueryCoverage=94%, HitCoverage=51%, E-value=2e-68, Identity=39%"; Hit description =Putative capsulatr polysaccharide biosynthesis protein
CRIYAFALIQTRRNLSEAAKHYGPQHPKYLQAQAQLQAVNAQLGQVLGELFNGLRQQYQIALDDEQHYQKMLNDQKADFQALGAKRDQYNTMTTALNKTEELYKSLYQRANEQKLSETFSVPDEVIYDAAVPPDRPSKPQRGLLIVMITLMALALYIMYLIVSTALDKTVNSLSELKAKTSLEASGEFPLLAHLENAQQIFHNVLYADMIHSLRLALLNQRDKPATILVTSVQSRSGSSYIAELLACSASKSRKTLLIDLDYLATQGLSAKFPQHKQGFSQLLNGECMPEQSVVKLDDQLDFIPRGKLNDSSLLLLTSERLPALLATLHQTYDTLIIDAPALNHAQDSLLLAAQSDITLLVVKAGEQAPRIRKAEQRLQSA

SEQ ID NO: 189940 - protein, 153 aa, Glycine max
  Coding DNA Sequence Number=SeqID_73162
MWDIPFIPEPNQTLTYVMSSRSTSLEPKSQLTINLALGRKQRKESSQSKNRKKAKRENSQSKSGRKQKHKRKKIPDQGSEENIRNMQKELSPNRQEKKGNHDLKWSSPFDCQPKSCASVTCSPHTKQEKKGKGQEYSKPNFPKKQTIPKKKSY

SEQ ID NO: 189941 - protein, 618 aa, Glycine max
  Coding DNA Sequence Number=SeqID_73163
  Gene Ontology: Mol. function=protein serine/threonine kinase activity; Cellular component=ubiquitin ligase complex; Biological process=protein amino acid phosphorylation
  Homolog annotation: Hit_ID=Q9LYH3; Match level="QueryCoverage=98%, HitCoverage=96%, E-value=1e-152, Identity=57%"; Hit description =Putative receptor-like kinase
  Pfam annotation: Domain name=Pkinase; Domain location=342-602; Score =100.0; E_value=6.9e-27; Accession=PF00069.15; Description=Protein kinase domain
  Pfam annotation: Domain name=Pkinase_Tyr; Domain location=342-605; Score=79.2; E_value=1.3e-20; Accession=PF07714.7; Description =Protein tyrosine kinase
  Pfam annotation: Domain name=Usp; Domain location=1-138; Score=16.4; E_value=0.025; Accession=PF00582.16; Description=Universal stress protein family
  Pfam module annotation: Pfam domain module=Pkinase::Pkinase_Tyr::Usp; Domain location=342-602::342-605::1-138
MVAVDKDKNSGYAFRWTIKHIDNPVIIAVHVKHKNIPHHEGTNVFPPDEDDIAHVFKPLRHMCHGNIVMLKEAVIDDSDVVKGIVEYAQRNRVNTIVVGATHSFSWWLSCLRKCKGHHDVSTGVMKSAPDYSSVYVISKGKIVGARPAIRPMINVVAPPKENVVRTHSHRRGSTNGRSERSTLLEMPRCSSAGQSTNQRSLFSPSSVESDSPSDSLGDLEAAMKMLRLKLKQTMDMYSSAQNKAKEINQWKEERISEEATKLPKEAALEPVEMEKVKAQAALEAAEEAIKMVEKEAQKRFQLEVKARREAQEKDRTLNRLINNDTRYRKYSIKDIEEATQKFSPSLKVGEGGYGPVFRGQLDHTPVAIKILNPEASHGRRQFQQEVEILCSIRHPNMVLLLGACPEYGCLVYEYLENGSLEDRLLMKNNSPPIPWWKRFEIAAEIATALLFLHQTKPEPIVHRDLKPSNILLDKNFVSKISDVGLARLVPPSVADSVTQYHLTAAAGTFCYIDPEYQQTGRLTKKSDIYSLGIMLLQIITAKPPMGLAHHVKRAIEKETFSEMLDIMISDVPLEEALAFAKLSLSCAELSKKDRPDLATVVVPELNRLRDFGLTFQKN

SEQ ID NO: 189942 - protein, 124 aa, Glycine max
  Coding DNA Sequence Number=SeqID_73164
MKEGHQEEERYNMNRKGRCCPEPDEEGLLDFKGGGGAVPNGGVCEGFDGGGSTSDGGGCEGFVGGGSTSEGGGGGGGGFDVKSEEGGEGYDVKSGGGGGTDDVVVCCGGEGMCDSGVRGEEGGG

SEQ ID NO: 189943 - protein, 558 aa, Glycine max
  Coding DNA Sequence Number=SeqID_73165
  Gene Ontology: Mol. function=hydrolase activity, acting on glycosyl bonds; Cellular component=periplasmic space; Biological process =trehalose metabolic process
  Homolog annotation: Hit_ID=P13482; Match level="QueryCoverage=92%, HitCoverage=91%, E-value=0.0, Identity=63%"; Hit description =Periplasmic trehalase precursor
  Pfam annotation: Domain name=Trehalase; Domain location=57-536; Score= 839.5; E_value=1.7e-249; Accession=PF01204.9; Description=Trehalase
MIKNVVITPARLTLLLSAALLSASAVHAEDNSRMLSAQPQPPDVRLGPLFSAVQQARFYPDQKTFADAVPKYDPASILADWQMQKNQRNFDLRRFVDTNFTLPKAQDKYVPPAGQSLRAHINGLWPVLTRSTPTASQYDSLLPLPKPYVVPGGRFREVYYWDSYFTMLGLAESGHWDRVQDMVDNFASELDKYGHIPNGNRSYYLSRSQPPFFSLMVDLLASHKGDDVYRQYLPQLQKEYDYWMADSDKVAAGQASKRVVKLSDGTLLNRYWDDRDVPRTESWLDDVNTAKKAPERNKQQVYRDLRAGAASGWDFSSRWFTDAHNLASIRTTQLAPVDLNSLLFHLEQTLAKAAKLAKQNDKAQQFAADAEKRQAAINRYLWDDKQGWYADYDFQKKQVHNQLTAATLFPLYMQLAGDKQAERTAAAVEKQLLKPGGLVTTTVNNGQQWDAPNGWAPLQWVAVEGLEHYKQNQLAQQIGQRFLQNVQQTYDREHKLVEKYVVDGAQLGGGGGGEYPLQDGFGWTNGVTLKLLDKYCPKDKTCNSTRDIPSMPTLNAAK

SEQ ID NO: 189944 - protein, 753 aa, Glycine max
  Coding DNA Sequence Number=SeqID_73166
  Gene Ontology: Mol. function=siderophore-iron transporter activity; Cellular component=outer membrane; Biological process=siderophore transport
  Homolog annotation: Hit_ID=O52981; Match level="QueryCoverage=86%, HitCoverage=93%, E-value=0.0, Identity=71%"; Hit description =Ferrioxamine receptor
  Pfam annotation: Domain name=Plug; Domain location=84-191; Score =90.8; E_value=4e-24; Accession=PF07715.5; Description=TonB-dependent Receptor Plug Domain
  Pfam annotation: Domain name=TonB_dep_Rec; Domain location=487-707; Score=66.3; E_value=9.8e-17; Accession=PF00593.14; Description=TonB dependent receptor
  Pfam module annotation: Pfam domain module=Plug::TonB_dep_Rec; Domain location=84-191::487-707
MTLFLIINRRAGVVRLLFSAKGIIMTALFPLNRGRLLCALALAFPALGVAEPSLVVTAQPQESATSPTADYLATRSGATKSDRPLLTTPQSISVVTRQQIDDQGAQDLNQALGYTPGVFTNFGGAATRYDTISLRGFHGGDVDNTFLDGLRVMSDGGSFNILQVDNWFLDRIDVIKGPSSALYGQTVPGGLVNMVTKRPQFASQGHLRFATGSNASNSAAFDYTDAINDQWAYRLTGITRNSDTQYDHTREEKYALSPQLLWQPDEDTSLLLRAYLQKDPSGGYHGSVPAEGTLYSHNGRWLSDGFYEGDSALDQFKRHEQIYGYDFSHRFDEVWSVHSTGSYSHSSVALDQVYQIGWNSDNPDLLNRYYSGERSSLSAWATDNQLQAEFASGALQHRVTLGAEYHRYKNDLSDASGAASPLNAWSGEAIGSQPDYLWTAQTRRYYQSGLYLQDEVAWQRWHLDLSGRYDRIVSENGNSRRQDDHVSGRAALLYAFDNGVSPYVSWSQAITPASLTDPDGNQLKPTTSEQYEAGVKYQPNGTRDLYSVALYDLTQNDVANRNVQDGTYTPSGKVHAQGIELEARSQLTERFSTIAGYTLNHLRFKDSVDGNDGHTPYVTPNSMASLWGHYQFDYGLSAGAGVRYIGRQWADNENTTRLPSVTLFDASLRADLGAWQSSLKGAWLQLNALNLTDRKYLAACYGTAADFTVDPQHHNGTDHRDHEAAKVEAVNPAKAEQGTDPAAHHRTDNPEYH

SEQ ID NO: 189945 - protein, 156 aa, Glycine max
  Coding DNA Sequence Number=SeqID_73167
  Gene Ontology: Mol. function=transferase activity; Biological process= amino acid biosynthetic process
  Homolog annotation: Hit_ID=Q6D2U0; Match level="QueryCoverage=94%, HitCoverage=62%, E-value=1e-32, Identity=47%"; Hit description =Putative glutamine amidotransferase
MTQTRTLPLALIQLETPPPQVVAKIGEQPQWFIAALALQPDDYVIVRPHLGEELPAFSGISGAIFSGSWAMVTDHADWSERTAAWIRAAIDAQLPLLGVCYGHQLMAYALGGKVGDNPNGWERGLKTLTRTPHRDPWLAQLPEAFPAWLSHRQSVL

SEQ ID NO: 189946 - protein, 391 aa, Glycine max
  Coding DNA Sequence Number=SeqID_73168
  Gene Ontology: Cellular component=membrane
  Homolog annotation: Hit_ID=Q2W911; Match level="QueryCoverage=54%, HitCoverage=71%, E-value=3e-37, Identity=38%"; Hit description =Permease of the drug/metabolite transporter superfamily
MRCVGVQADPAILARIVTGQRIPLGGWRTVQRRQAVLKPARGQADVDADRGRRPQQIAQRLAGEADAGGGEFANGKSRGEAVGLKKVDRRRVFRTPQSLPQLLPQCGSALRIHAKPPENTQASSIAEWISGGAGAESGHACAGYAAVHAVAQHQHAHQYRQHRRQQRVGHDQDAKPAAPAGVAQRGKLLRFGQPRGRADNRHRKEGDPAGQRQRFNRRRLFHNHIAHRPAGGAAQQNTQHPPRRNCRAAGEHHHPGQRDGDTAQLHQPQFLLQHHHRQQHGNRRTQLDHNGAGAGIGIAHADKQQRKVHEAKGKRQRQQPRQLGARDAAKRHQHDGHHDKAHPGEKQRRKLQQSPFHRHVIEGPDANYHQNQKKMPHRHAAVLGLRKVVTV

SEQ ID NO: 189947 - protein, 336 aa, Glycine max
  Coding DNA Sequence Number=SeqID_73169
  Gene Ontology: Mol. function=catalytic activity; Cellular component =integral to membrane; Biological process=metabolic process
  Homolog annotation: Hit_ID=Q3K7Y4; Match level="QueryCoverage=99%, HitCoverage=74%, E-value=2e-88, Identity=52%"; Hit description=L -carnitine dehydratase/bile acid-inducible protein F
  Pfam annotation: Domain name=CoA_transf_3; Domain location=134-314; Score=-0.9; E_value=6.5e-09; Accession=PF02515.7; Description=CoA -transferase family III
MARVLGEHADRSSLAAVVARWQGHALEQAVVDAGGCAAWMRSAQQWQQHAQGLAVSDEALIAQRATGEAPTPGWALLPARPLLGVRVLDLTRIIAGPVATRFLASLGAQVLRIDPPGWREPTLEEEINCGKRCAQLDIKTRAGRDRLITLLQHADVLVHGYRADALEKLGLDAESRQRLAPGLVDVSLNAWGWHGPWRNRRGFDSLVQMACGIAEQGMRWQAGVKPTPLPVQALDHATGYMMAAAVLEGLRQRRVNGTGWQARLSLARTALLLQQHGAAPQGEQRGITPQPHDALSALEINRWGIGERLRAAAYLPGTPMLCAAPAQLPGSSHPCW

SEQ ID NO: 189948 - protein, 408 aa, Glycine max
  Coding DNA Sequence Number=SeqID_73170
  Gene Ontology: Mol. function=peptidyl-prolyl cis-trans isomerase activity; Cellular component=cytoplasm; Biological process=protein folding
  Homolog annotation: Hit_ID=Q6Q152; Match level="QueryCoverage=77%, HitCoverage=63%, E-value=1e-112, Identity=65%"; Hit description =Multidomain cyclophilin type peptidyl-prolyl cis-trans isomerase
  Pfam annotation: Domain name=Pro_isomerase; Domain location=14-168; Score=178.2; E_value=2.1e-50; Accession=PF00160.11; Description =Cyclophilin type peptidyl-prolyl cis-
MSSVYVLEPPTKGKVVVNTTRGPLDIELWPKEAPKAARNFVQLCLENYYDNTIFHRIIKDFLVQSGDPTGTGTGGESIYGGVFADEFHSRLKFKHRGIVAMANAGTLNSNGSQFFITLDRCDWLDRKHTIFGKVTGDTMYNLLRLGELETDKNDRPLDPPKILSVEVLWNPFEDIVPRTLQKLQIEAKADTKNKESGKKGVKKLNLLSFGEEAEEEEKELASVKQKIKSSHDVLNDPRLLKEDTLNNELSSSRRDMQLSVRDALNSKKDEPQKDSDAGSMACLNFSDDDEADFDARMRMQILKKRKELGDLPPKPKLRNVCYISTSDLGNVSGSTYASFNDLITMTLCYQSHCQAALFIPSSSPTEDKSFRNYCGHLILIPSVNLKTKHKNDVLLKYQHYEIQFSLLW

SEQ ID NO: 189949 - protein, 198 aa, Glycine max
  Coding DNA Sequence Number=SeqID_73171
  Gene Ontology: Mol. function=peptidyl-prolyl cis-trans isomerase activity; Biological process=protein folding
  Homolog annotation: Hit_ID=Q6Q152; Match level="QueryCoverage=79%, HitCoverage=33%, E-value=4e-45, Identity=58%"; Hit description =Multidomain cyclophilin type peptidyl-prolyl cis-trans isomerase
MIRRLQPGSLWVAFGQYLLHVSALAYLGTKLFELVAKDPRSNAVSVDEDQPKVEKLSLKKKGVGSEARAERMSNADADLQLLNQAERGRQLQKQKKRRLQGREDEVLAKLEKFKNSLSAKATPPTDESEDVSNEELSDWKGVSLKFAPQTGKDRMSRNEDPNDYVVHDPLLEKGKEKFNRMIAKQKRREREWAGSSLT

SEQ ID NO: 189950 - protein, 110 aa, Glycine max
  Coding DNA Sequence Number=SeqID_73172
MSWLLLFNDALFLFFPNTSVSGVKVRRSKIEKKKRESERQRERREATTIPYTVDKISTRECAGACDALRCLRSRQLMVGFFSLSLELTKVDEVGNAREGCCVTLGIAIYD

SEQ ID NO: 189951 - protein, 558 aa, Glycine max
  Coding DNA Sequence Number=SeqID_73173
  Gene Ontology: Mol. function=protein serine/threonine phosphatase activity; Cellular component=protein serine/threonine phosphatase complex; Biological process=protein amino acid dephosphorylation
  Homolog annotation: Hit_ID=O81709; Match level="QueryCoverage=99%, HitCoverage=100%, E-value=1e-131, Identity=48%"; Hit description =Protein phosphatase 2C
  Pfam annotation: Domain name=PP2C; Domain location=259-541; Score =260.6; E_value=3.3e-75; Accession=PF00481.12; Description=Protein phosphatase 2C
MEEMSFAVAVPLRVGNCNCNSVCDNPTTVVPHMDVSRFKLMGDTGLLSNSVTKIFTETVAGSDDCHDSGNLEDEVGIAEVIPPIQDREGESPMLDMISQNRSTLVAGDEELTMEIEEDSLSFEGDQFVDSSCSLSVVSENSSVCGEESFCFDATSDVGTPCSTDVEKSICAVNIVAEAVDLGESNVDTDIMTDPLAVAVSLEEESGVRSGPKSSAVDLHQLPQEKGVSGTVGRSVFELDYTPLYGFISLCGRRPEMEDAVATVPRFLKIPIQMLIGDRVIDGINKCFNQQMTHFFGVYDGHGGSQVANYCRDRTHWALAEEIEFVKEGLISGSMKDGCQNQWKKVFTNCFLKVDAEVGGKVNNEPVAPETVGSTAVVAVICASHIIVANCGDSRAVLCRGKEPMALSVDHKPNRDDEYARIEAAGGKVIQWNGHRVFGVLAMSRSIGDRYLKPWIIPEPEVTFVPRTKDDECLILASDGLWDVMTNEEVCDLARKRIILWYKKNGLEQPSSERGEGIDPAAQAAAEYLSNRALQKGSKDNISVIVVDLKPQRKYKSKT

SEQ ID NO: 189952 - protein, 200 aa, Glycine max
  Coding DNA Sequence Number=SeqID_73174
MEDLKDIVHSIGMDARDIDVACQENGILLLIRCLWMLFLGDMNKKKKTRRDVEEESHPRELQQPTRYQFNTPLPSFTKALSMVLGKEFSNFAYHLQNQMLSSVVFDYGKDILQGANVDFQAFMCNAWEKILEKHRVGFDKAIRQGTWSLFKTFLEGLPDSRPPTPGTFHLAMPHTDTLMTNTDSVEDDTRNQNEGEENNR

SEQ ID NO: 189953 - protein, 77 aa, Glycine max
  Coding DNA Sequence Number=SeqID_73175
MVNRLMLCSHNYHASNTILREAKDIAENNLRWCTLANPKEYVSLQLIQQARQKGIYENSISPHTRTVYKPPKPRGTQ

SEQ ID NO: 189954 - protein, 190 aa, Glycine max
  Coding DNA Sequence Number=SeqID_73176
  Gene Ontology: Mol. function=structural molecule activity; Cellular component=protein complex; Biological process=microtubule-based movement
  Homolog annotation: Hit_ID=UPI0000D9CC26; Match level="QueryCoverage =98%, HitCoverage=54%, E-value=7e-63, Identity=66%"; Hit description =PREDICTED: alpha tubulin isoform 1
  Pfam annotation: Domain name=Tubulin; Domain location=15-189; Score= -15.8; E_value=6e-07; Accession=PF00091.15; Description=TubulinFtsZ family, GTPase domain
  Pfam annotation: Domain name=Tubulin_C; Domain location=103-190; Score=27.1; E_value=1.9e-05; Accession=PF03953.7; Description =TubulinFtsZ family, C-terminal domain
  Pfam module annotation: Pfam domain module=Tubulin::Tubulin_C; Domain location=15-189::103-190
MMPFDSTFDVAHDAFNTFSKTGSGKHVPRAVFVDLEPTVIGEVRYGTYRQLFHLEQLISGREDAADNFASDHYTIGKEIVDLCLDCIRKLVDNCTGLQGFLVFNAVDGGKYPRIHFMLSSYAPVISAAMFYHEQLSVPKITNAVFEPTSMMAKCDPRQDKYMACCLMYCGDVVPKDVNTAVATIKTKRTA

SEQ ID NO: 189955 - protein, 106 aa, Glycine max
  Coding DNA Sequence Number=SeqID_73177
  Homolog annotation: Hit_ID=Q8LFQ5; Match level="QueryCoverage=93%, HitCoverage=34%, E-value=2e-07, Identity=43%"; Hit description=RNA binding protein-like
MALQVTFKEVEAAKKACEDSTTLIINGRRANYNLAFLGAHRPRSSSNVSPPPPQPQGGSNGGIVKNVNNASGPPPAINHVQPYHYPVRTTALPFHNHTLPFYGYAM

SEQ ID NO: 189956 - protein, 153 aa, Glycine max
  Coding DNA Sequence Number=SeqID_73178
MENRVEMPDITVTSVDFKGVHPEQDEPMVITIEVVGCLPCDNPLFGFMGERLPTRGSIKLMTSASYNILLDRPSINAIEAIVSTPHLAMKFPSYYKTIITFHANQKEARECYMASLKLTLIQEIPKSQAVNMVTMVKLGVHEDLDLDPRTKDD

SEQ ID NO: 189957 - protein, 472 aa, Glycine max
  Coding DNA Sequence Number=SeqID_73179
  Gene Ontology: Mol. function=RNA-directed DNA polymerase activity; Cellular component=chromatin; Biological process=chromatin assembly or disassembly
  Pfam annotation: Domain name=rve; Domain location=176-307; Score =20.3; E_value=0.00012; Accession=PF00665.16; Description=Integrase core domain
  Pfam annotation: Domain name=zf-H2C2; Domain location=117-158; Score =8.5; E_value=0.027; Accession=PF09337.1; Description=His(2)-Cys(2) zinc finger
  Pfam module annotation: Pfam domain module=rve::zf-H2C2; Domain location=176-307::117-158
MEALPVRPHLHHFDGPPELEKPYVPRSQNIVADALSRILIPNDAKLYSLPMPTFVFLDELQDTLLQDIQYKDLLDDVRQNPSKHPDLKVHRDLIFRNGKIWLPIKTPINSLQLQEFHSSPIGGHIGVAKTFHRLHQNFDWPRILEDVCRYVLQCVVCQQTKYETKKPVGLQQLLPIPSAVWEDMSLDFITGLLSSHEFTTILVFMDCFSKCAHFGALPPHNSAYKTALLFLDMELFRLSGTKLRMRTTYHPQTNDQTEVMNHILEQYLHTFVHDRPSQWYHFLSLAEWSYNTSTHSGTVISPFEAIYGKLSPSIPHYILGDTTVEVVDSLLTTRTAILIRLCCRLIKAQTNMKTIVDAHHHDVEFVVAYRLQLPSSFKIHPTFHASLLKLYHGPPPTRPAVLPPSNTKNHPIIEPFHILDWKWDFSFSTPNKLILVQWNDLAQEDTTWEQLDTLRQSYNLGDKVALVEGGDD

SEQ ID NO: 189958 - protein, 296 aa, Glycine max
  Coding DNA Sequence Number=SeqID_73180
MAMVCPEGCLMDIRTRYAYLVKALSEVVIGLYQSGIEHRGNLLLEFSFLEMWVAVWFYVDEVGVRDEVNMVLDGSGSGDSWRCDEEDEGLGWVGIGEAIQAKGVGRCGAIHSMQNNMRKWVWEMQSRLTVVASNPFVITVITKSPDAPESHFLIGLCLVWVWGKLGLVIIGNEAMVRGKGYDGGRGVLFPEAWPGPRPVSMMRVAEPAPHDASPGSSRRRRRQKDHRNKLGQNATQGPRAFLSRMSGNRSLTSIGTGREGESEIVIEEEEEEVGMVVITANRSRIESNLAFVVAWI

SEQ ID NO: 189959 - protein, 299 aa, Glycine max
  Coding DNA Sequence Number=SeqID_73181
  Gene Ontology: Mol. function=oxidoreductase activity; Cellular component=mitochondrion; Biological process=metabolic process
  Homolog annotation: Hit_ID=Q1LCY9; Match level="QueryCoverage=100%, HitCoverage=59%, E-value=1e-136, Identity=78%"; Hit description =Aldehyde dehydrogenase
  Pfam annotation: Domain name=Aldedh; Domain location=27-298; Score =108.7; E_value=1.7e-29; Accession=PF00171.12; Description=Aldehyde dehydrogenase family
MKYVHPGLPGSLVSFRKRYGNYIGGKFVEPVSGNYFTNTSPVTGQPIAEFPRSDAKDIELALDAAHAAADAWGKTSVQARSNVLLAIADRIESRLEMLALTETWDNGKPIRETLNADLPLAVDHFRYFAGCLRAQEGTAAEIDQNTVAYHIYEPLGVVGQIIPWNFPLLMAAWKLAPALAGGNCVVLKPAEQTPLGISVLMEEIGDLLPPGVLNVVQGFGAEAGEALARSKRIEKIAFTGSTPIGRHILACAAENIIPSTVELGGKSPNIYFADIMQAEPEFIDKAIEGLVLGFFNQGE

SEQ ID NO: 189960 - protein, 83 aa, Glycine max
  Coding DNA Sequence Number=SeqID_73182
  Homolog annotation: Hit_ID=Q8ZR73; Match level="QueryCoverage=74%, HitCoverage=23%, E-value=1e-07, Identity=49%"; Hit description =Putative cytoplasmic protein
RIQVAGLALFFAHTPPAGRADHAGERALPALCRAGRVRHAAAGVGAGAAGAWRRIGGGGGGAEPGALFGSGHAAGRVAGGDDD

SEQ ID NO: 189961 - protein, 71 aa, Glycine max
  Coding DNA Sequence Number=SeqID_73183
MLLNSNVIHVRVVMLVRMIHTRLFAVARGKSCPGMHSRCVIASLSGCARTVGRPPISGGGPGTDKRKLLAP

SEQ ID NO: 189962 - protein, 62 aa, Glycine max
  Coding DNA Sequence Number=SeqID_73184
  Gene Ontology: Mol. function=protein binding
  Homolog annotation: Hit_ID=UPI0000196B24; Match level="QueryCoverage =76%, HitCoverage=4%, E-value=5e-13, Identity=61%"; Hit description =ATP binding / kinase/ protein serine/threonine kinase
  Pfam annotation: Domain name=LRRNT_2; Domain location=1-36; Score =19.6; E_value=0.0078; Accession=PF08263.3; Description=Leucine rich repeat N-terminal domain
DALIEIKNSLIDPKNNLKNWNKGDPCAANWTGVWCFDQKGDDGYFHVREMYGFFFLLLSLCS

SEQ ID NO: 189963 - protein, 244 aa, Glycine max
  Coding DNA Sequence Number=SeqID_73185
  Gene Ontology: Mol. function=protein kinase activity; Biological process=protein amino acid phosphorylation
  Homolog annotation: Hit_ID=Q2QZ78; Match level="QueryCoverage=91%, HitCoverage=40%, E-value=6e-60, Identity=52%"; Hit description=AT hook motif-containing protein, putative
  Pfam annotation: Domain name=DUF889; Domain location=167-244; Score= -90.5; E_value=2.3e-05; Accession=PF05970.5; Description=Eukaryotic protein of unknown function (DUF889)
MTESLLLLFMMLMIYFSISLPINTDEQKTIYHRIIQAINNNEGGMFFLYGFGGTGKTFIWRTLASSLRAENQIVIIVASSGIASLLLPGGRTAHSRFKIPVPIFEDSTCNIHQGTKLAELLNQTSLIIWDEALMAHKFCFEALDQSLRDIITNKSSSNQIFGGKVIVFGGDFRQILPVIPRGTHSDIVNAAINSSYLWDSCDILTLTKNMRLHSNLELVDEQETATFAKWILDIGDGIIDYEND

SEQ ID NO: 189964 - protein, 130 aa, Glycine max
  Coding DNA Sequence Number=SeqID_73186
MDEDVREVLGAGPKYCLIVTPALVACTRPSFLGVGHLLLHVSSDGRWRINHDIRCFRDIKFSLTSEKLHFIVTCRNVPFRGWAKARLTGALSKGGKVRGVATNVYLWKTSGKPKETGQNENSKFGSCIYV

SEQ ID NO: 189965 - protein, 242 aa, Glycine max
  Coding DNA Sequence Number=SeqID_73187
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=97%, HitCoverage=26%, E-value=1e-127, Identity=83%"; Hit description=DNA -directed RNA polymerase beta chain
  Pfam annotation: Domain name=RNA_pol_Rpb2_6; Domain location=1-240; Score=199.6; E_value=7.3e-57; Accession=PF00562.18; Description=RNA polymerase Rpb2, domain 6
MESYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQKREIKVGDKVAGRHGNKGIVSKILSRQDMPYLQDGRPVDMVFNPLGVPSRMNVGQIFECSLGLAGGMLERHYRITPFDERYEQEASRKLVFSELYEASKQTSNPWIFEPEYPGKSKIFDGRTGNSFKQPAIMGNLIF

SEQ ID NO: 189966 - protein, 52 aa, Glycine max
  Coding DNA Sequence Number=SeqID_73188
MEDWGIFSTKSLRRILLRLKCSSWCGASAISLSELVLLSRSPLFILSATIQA

SEQ ID NO: 189967 - protein, 284 aa, Glycine max
  Coding DNA Sequence Number=SeqID_73189
  Gene Ontology: Mol. function=receptor activity; Biological process =protein amino acid phosphorylation
  Homolog annotation: Hit_ID=Q6H663; Match level="QueryCoverage=79%, HitCoverage=77%, E-value=1e-58, Identity=50%"; Hit description =Receptor-like protein kinase-like
  Pfam annotation: Domain name=DUF26; Domain location=192-246; Score =58.3; E_value=2.6e-14; Accession=PF01657.8; Description=Domain of unknown function DUF26
  Pfam annotation: Domain name=DUF26; Domain location=91-146; Score =51.7; E_value=2.4e-12; Accession=PF01657.8; Description=Domain of unknown function DUF26
  Pfam module annotation: Pfam domain module=DUF26::DUF26; Domain location=192-246::91-146
LQLESGYRIILALRLSSLLILFSSVLSAHGYPSRAHIFIYAACSQEKYQPNSPFEGNLNSFLSSVVSSFSDVTYNSFAIGNGSSTPQEGNVYGLYQCRGDLHPVDCSKCVGRLVNQIGLVCPYALGASLQLEGCLVRYEHAGDFLGKLDTSLRYKKCSKAVTSDVEFFRRRDDVLADLQTANGFRVSSSGLVEGFAQCLGDLSVSDCSSCLADAVGKLKSLCGSAATADVFLGQCYARYWASGYYDESDSSNNDQVGKSVAIIVGVFAGLAVLVVLLSICKKAA

SEQ ID NO: 189968 - protein, 53 aa, Glycine max
  Coding DNA Sequence Number=SeqID_73190
MAFGTMTARPGELMLHPEVSLAFLIKTLNDHLFRIVTDVQHHQSISKDQKISK

SEQ ID NO: 189969 - protein, 79 aa, Glycine max
  Coding DNA Sequence Number=SeqID_73191
MASRDIILLGNNIVAMRLHYPQASRRPNMTTDRSPLPMSHTDPGIGPNISTCVQKCKCHVCMEKSKNYPTLLAKQTDNS

SEQ ID NO: 189970 - protein, 267 aa, Glycine max
  Coding DNA Sequence Number=SeqID_73192
  Gene Ontology: Mol. function=RNA-directed DNA polymerase activity; Biological process=RNA-dependent DNA replication
MGEIEEVQKEMKADMEAMKEQMTTMMSMRKMMEVNMVIVVAASAAIEVDPTHPSSINQASCPVPDMVQSKHPLPLYGFPPNYTPPNVAHTPDENDEAPQDHNLADFEPHLKYAAKGQAFCGIPLPNTLGAPQVPLAMVEREKFDHIEERLRAIEGGGDYAFADMAELCLVPNMVIPLKFKVPHFDKYKGTTCPKNHLKMKVLLRAAVTWYTNLEPSRVHSWKDLMVAFIRQYQYNSDMTLDRMQTCVRKSMNLSKNTPKGGGIWQLK

SEQ ID NO: 189971 - protein, 391 aa, Glycine max
  Coding DNA Sequence Number=SeqID_73193
  Homolog annotation: Hit_ID=Q82IZ7; Match level="QueryCoverage=49%, HitCoverage=73%, E-value=6e-29, Identity=40%"; Hit description =Putative methyltransferase
  Pfam annotation: Domain name=MTS; Domain location=9-161; Score=-78.2; E_value=0.0061; Accession=PF05175.4; Description=Methyltransferase small domain
  Pfam annotation: Domain name=Methyltransf_11; Domain location=30-133; Score=48.2; E_value=2.8e-11; Accession=PF08241.2; Description =Methyltransferase domain
  Pfam annotation: Domain name=Methyltransf_12; Domain location=30-131; Score=58.5; E_value=2.2e-14; Accession=PF08242.2; Description =Methyltransferase domain
  Pfam module annotation: Pfam domain module=MTS::Methyltransf _11::Methyltransf_12; Domain location=9-161::30-133::30-131
QAAYIAEREARFNAQLDVLALAAGQDFHVVDLACGPGSLSLRILQRFPQARVTAIDLDPLLLAVARGALAAYGDRIRILQADLADPACFSALSGLAPQAAVSSTALHWLMPEQQLALYRNVAGLLADGGVFLNADHQRYDQRQPRLKALAERHDEQTQQRAWDNGVEDWDRWFAGALQSPALAAYQAEREALFAGRPVPPPTPVDFQLAALRQAGRLAAVAGGGAAAGPAGRHPVGARADRVARRLAHRAWRQRRCGDRRRCVSAHHLVAADAARAVGGAGRRRIGVGGHRAAVADPQPAGRSLGAGHLLRRRRGGGNGAGIGAGRRPVVGVRRRVYRRAGGVCVGDAAGRAFAAGGVHAVYPGRGGGDAVALRADFADHPLAGGRQRHAR

SEQ ID NO: 189972 - protein, 136 aa, Glycine max
  Coding DNA Sequence Number=SeqID_73194
  Gene Ontology: Mol. function=siderophore-iron transporter activity; Cellular component=outer membrane; Biological process=siderophore transport
  Homolog annotation: Hit_ID=Q8PFC1; Match level="QueryCoverage=94%, HitCoverage=18%, E-value=1e-08, Identity=32%"; Hit description=TonB -dependent receptor
MRRIAQLQRAAGHLHAVIQPGDRPETARGKVVGQRRRSDAGQASGVLDGGGQRAIAPLLDRSCADDIDAARRLPSGQPKLRSAAAHGAQRIVAPGGGRRLHGELFFASRGIAGFIAVGGESQRRRQCAADPGGGKA

SEQ ID NO: 189973 - protein, 453 aa, Glycine max
  Coding DNA Sequence Number=SeqID_73195
  Gene Ontology: Mol. function=molybdate ion transporter activity; Biological process=regulation of transcription, DNA-dependent
  Homolog annotation: Hit_ID=P58497; Match level="QueryCoverage=56%, HitCoverage=100%, E-value=4e-85, Identity=68%"; Hit description =Transcriptional regulator modE
HVQPIEGFVEDQQVRLGHQRPAQQGFARFAGGEVFEAARQQGGDAELRGQPLTARGVLHLFLNDFRRGAAGVVLVRAEQIGVVTLPLVADHFLQLFEGDAHRVLKVAAALTAQQNQFVGQRARQGGFAAAVGADEGPAVAGLDFQRVQRQGAGVLQGDVNQQKRNVTLRLTQRGDNHAIGVEQGVYGGADAQLQALQLRRRQGGAQGFATRQRHQHLAVFGARLNAGHHARQRVIRAGMLRGRLDQRQHLFARRQLQPVGALLGDGRRQASGAVIQQNRQVLLHLLMIAFDDGTEELIARAGLQREARDGRQQAVERQIVLLQHVESFLLHLAQQVIQLDQPLAIVRQLCAAAAFTAGGAFHHRVFRQLVHLIDGVPGAFVADARQFGALADGAGVLHLFQQRDAARIGEQLLLEFESQKNFGLHSASCRRQKSYCRRFGGKAPSAVRWRAGQ

SEQ ID NO: 189974 - protein, 94 aa, Glycine max
  Coding DNA Sequence Number=SeqID_73196
  Gene Ontology: Mol. function=nucleoside-triphosphatase activity; Cellular component=membrane; Biological process=cobalt ion transport
  Homolog annotation: Hit_ID=UPI00005F8935; Match level="QueryCoverage =84%, HitCoverage=15%, E-value=6e-37, Identity=91%"; Hit description =COG1119: ABC-type molybdenum transport system, ATPase component/photo repair protein PhrA
MAGAARARRRARRRPVPQPFLGPTAAGADRPRAGETPGAADPRRAAARVGSAQSPAGAPLHRRADRPGRHPAAVRLAPCRRRAAVHHTPPQLRA

SEQ ID NO: 189975 - protein, 564 aa, Glycine max
  Coding DNA Sequence Number=SeqID_73197
  Homolog annotation: Hit_ID=UPI00005F7B18; Match level="QueryCoverage =38%, HitCoverage=90%, E-value=8e-59, Identity=56%"; Hit description =COG1266: Predicted metal-dependent membrane protease
  Pfam annotation: Domain name=GalP_UDP_transf; Domain location=448 -564; Score=-35.0; E_value=0.0005; Accession=PF01087.12; Description =Galactose-1-phosphate uridyl transferase, N-terminal domain
  Pfam annotation: Domain name=Isochorismatase; Domain location=2-208; Score=-62.9; E_value=0.097; Accession=PF00857.11; Description =Isochorismatase family
  Pfam module annotation: Pfam domain module=GalP_UDP_transf::Isochorism atase; Domain location=448-564::2-208
MSAALIIIDLIEDLIGPKGRANHCREQVTASHLLANVNAAAAYARVRKIPVIWVRTGFADDYHDIPLHSPLFNHLKQIGALRLNGPGCRWAPDLHQEETDLQFDKTAHVARHREHRASGARRRLPGDRAARSVRGPHAGAPPAEPGHPAKPGGNRPFAGLDARLTSIPPVVWAGTLHGCVTAPTFSVILGHIMWGVLAASLFFLPFNRLIAWVILAASAGMGLYHGVLTPLSLGCLLAIVALAGLRHHFRERRSLAIAFEGLVVAGCVALFLHLVPGIHNQLMIDGEKAGPLSAPFTIGLDCAAAGRAGAVAAGRGAGRLKNRAACARLDPAFRDGEPVLRLYGRRSAVSRLPAAAPQPVAGRLAGADRRFSGVRRRAFGRRHADGDLRDAGRGDLRPGVDVERPPVASLTADAGREPFSAGRSGENAIIGSAPQCPQSRCHRLFSAHQALFITRRGRAIFLRNDLSLFSNGRIKTVIGSDYTLVDAKKGTGQQEAVPTETLPAHDPDCFLCPGNARITGDRNPDYRGTYVFANDFAALLSDTPPAPDSQDPLMRSQSARGVSR

SEQ ID NO: 189976 - protein, 376 aa, Glycine max
  Coding DNA Sequence Number=SeqID_73198
  Gene Ontology: Cellular component=membrane; Biological process =protein secretion
  Homolog annotation: Hit_ID=Q3W7X7; Match level="QueryCoverage=43%, HitCoverage=56%, E-value=5e-42, Identity=55%"; Hit description =Hypothetical protein precursor
WARWRVAAGYRGGDRCRCGARGRRGVVADRARRALGAGRHLRRGVPDPVPARTTAAAATASSTAVAGCVRPSGRVDSRRAVAPGRGRRPRRIRAGDAPAGVRCLRQRSAGQRQVRDEPRSVEVGAGGSHRRPDPGDAAHGASGRRDRAGRCAARSLRVGPCGCGPARRGRGTTVVDPRCGGPGGHRAVGHPRSARTASGGSLCLRLAGRRARHLRRSGGVRARLPDHAGAVVRMNAVTALAAAVLIGGAFSVGALSILWVLPRWRAASLTVRIGAYVRDVVADDRLPPAALPTVGVLPASARTLWERAEARFARMLGGGEALRLRLAQAGVRLDASVFRGRQLGWALAGIGAGRRRVDRARSHRPDVGADQRAAAA

SEQ ID NO: 189977 - protein, 271 aa, Glycine max
  Coding DNA Sequence Number=SeqID_73199
  Gene Ontology: Mol. function=chitin binding; Cellular component =extracellular region; Biological process=chitin metabolic process
  Homolog annotation: Hit_ID=UPI000044A8F0; Match level="QueryCoverage =92%, HitCoverage=99%, E-value=4e-42, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=35; ConfidenceScore=5.29e-01
GYTPSPSKNCTSSPFKGLNVLAFRRLHVLPFRGLHALAFKGLHVLPFKGLQVLTFRGLHILTFRGLHALPFKGLHVLAFRGLHALAFRGLHALTFKRLHALAFRGLHVLTFIGLHALTFRGLHAHALRGLHFLALRGLHAFVFRGLQVLAFRGLHALAFRGLYILAFRGLHALAFRGLHDLAFRGLHTLAFRELHVLNFRGLHVLAFTGLHVLAFRGQHVLAFRGLHVLVFRGLHALALRGLHALVFRGLHILAFKRLHALAFRGLRVLTF

SEQ ID NO: 189978 - protein, 250 aa, Glycine max
  Coding DNA Sequence Number=SeqID_73200
  Gene Ontology: Mol. function=transporter activity; Biological process= transport
  Homolog annotation: Hit_ID=UPI000052752D; Match level="QueryCoverage =99%, HitCoverage=57%, E-value=8e-76, Identity=53%"; Hit description =extracellular solute-binding protein, family 1
MNTYDAFLEGSRAIVASGVQSAIWPAPTSEFYQPWFDFYPLYLAETDGTMLVEDGKSTFDSDDGRTVAEFWKTFYDEKLSPNEASTDDAMSAGTTAMQLAGPWAIPSYADTVDVGFMPVPTSDGRENPTTFADSKSVSMFTACENQGTAWEFLKFSTSVDSDGQLLELTGQMPMRTGLTDTYADYFEANPNYVAFAEQAENTADVPSIPNSVEAWQAFRDEYSSAVIFGKESIDDFLGNAATKIDELVAE

SEQ ID NO: 189979 - protein, 130 aa, Glycine max
  Coding DNA Sequence Number=SeqID_73201
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=Q9T3G4; Match level="QueryCoverage=76%, HitCoverage=26%, E-value=4e-34, Identity=61%"; Hit description =NAD(P)H-quinone oxidoreductase chain 2, chloroplast (EC 1.6.5.-) (NAD(P)H dehydrogenase, chain 2)
  Pfam annotation: Domain name=Oxidored_q1; Domain location=2-130; Score=-61.4; E_value=0.00027; Accession=PF00361.10; Description=NADH- Ubiquinoneplastoquinone (comple
KEVRNPLFDSDSPTPVVAFLSVTSKVAASASATRIFDIPFYFSSNEWHLLLEILAILSMILGNLIAITQTSMKRMLAYSSIGTFACNVSFGLRTGTDNIRDYAGLYTKDPYLALSLALCLLSLGGLPPLS

SEQ ID NO: 189980 - protein, 179 aa, Glycine max
  Coding DNA Sequence Number=SeqID_73202
MVHMVGMALASLPPMTRMLVVSLHDVCVLLHLFLCGIAMADKDGHPDLTLTRSMCSSGLSLVQSYNKCFFRKSLLSEKFGKKDLPEKGSSGRTQIVLPETFWKNLLPEDFRKNLLPEEEIIFFNARTILPIHLIAGCTSNVAGAPSMSQIAVGLLSKGCNRFHEAYPLVRSLKKLLDLG

SEQ ID NO: 189981 - protein, 78 aa, Glycine max
  Coding DNA Sequence Number=SeqID_73203
MAHRDKLWSFCALPPRLDHVRGHAETNYGHSAPCVNQKERTRQYQDDVARSVLIIFKIFAGSAGREIHRPNGVSLERN

SEQ ID NO: 189982 - protein, 223 aa, Glycine max
  Coding DNA Sequence Number=SeqID_73204
MGIPTQHLLRFEKSCFFGEHSTMKVVSCCSGGELLSIRLASNGRISRGLRGGGLPCGRILIYAMNLSFMDVDKILPSSSTLGWHSLKVKGEVQTKKGLWWIPRHPETRKGVVSDEMLRGVENKRRSGDSRYRSTFRTAAESTGRQETTCLNRENGVVGELYKCRAARRSSRECCTLDGESPVAESITSLRSDPSSMAHVESRVNQQGPPCKAKYSWVTDSEVV

SEQ ID NO: 189983 - protein, 80 aa, Glycine max
  Coding DNA Sequence Number=SeqID_73205
MYIVVVKQGQDHLGLPSGVETKHERQKPIKVGYLRMNASGDGITTDRSLPLLCAKQAGNVVARQPRILCILQLSFTICLF

SEQ ID NO: 189984 - protein, 249 aa, Glycine max
  Coding DNA Sequence Number=SeqID_73206
  Gene Ontology: Mol. function=transferase activity; Biological process= metabolic process
  Homolog annotation: Hit_ID=UPI00003979DD; Match level="QueryCoverage =82%, HitCoverage=59%, E-value=9e-10, Identity=25%"; Hit description =COG0859: ADP-heptose:LPS heptosyltransferase
MPGISPFAACGVPGARKWKKTSSQKPNRQDIKSILLVRNEGKIGDAIVSTCFLRALFEAGYRVDILAVKENESLFRHNPYIHNIYLSESFSDCHQRDKYDTAIGSEVVTLLRDNAYDLLIDTAIWQTALYMPKMIADINPKMTLGFNKPGWLKPYDINIQFDHLNNHVKNIYRAVLDYLQVETVDGLNYEIFYPERIDAEIHQSGMFSADEHNILINIYASHADRDLSEQQLNELIGAIVRHNAATNIV

SEQ ID NO: 189985 - protein, 143 aa, Glycine max
  Coding DNA Sequence Number=SeqID_73207
MTQELVARGDTLRLSAPRHSVTPSVIDEQRPMWSSAPFPEMSASSGGDFFKSHKLSRTTGGGPDDMRRQNLVTPHPFDIQTQSCPMARRDKIWSFCTLCHPEAAGPMTCGDKIWSFRTPLPFRHSHVRWHAETKFGNSAPFVI

SEQ ID NO: 189986 - protein, 137 aa, Glycine max
  Coding DNA Sequence Number=SeqID_73208
IPNWDDIVDLCAKDRATGLGAENALDVDDIMSKETNEEEAIHSASFDLEGSSSATRKNIRPSKSGEKEGMISSMKEVVESLKEFVELDNIPNFNGALRHREIDWLIENLIKFAIIKALPLDEKEDCIFVFYALMPNY

SEQ ID NO: 189987 - protein, 141 aa, Glycine max
  Coding DNA Sequence Number=SeqID_73209
MACLIQRKQAVGLAEKKRSSNKEEKLAEKKRSNSVNGQNDPFNKLLGAPAILLGAPSISHIRVSIGSSSMVKELYLGVARCTSTIVLLFLSLVVVFASVEIGSSSLEEKILPVVVLFRWSLRMKFIGIKLTDELHLYDSYG

SEQ ID NO: 189988 - protein, 85 aa, Glycine max
  Coding DNA Sequence Number=SeqID_73210
MTIEESKHVSFDETNVTSPRKEFLDDIADSLEDMHNQERDLKRKRNEENKDVQDDITQKIIIFPKNGKLQEIILLTTSSKISQKG

SEQ ID NO: 189989 - protein, 110 aa, Glycine max
  Coding DNA Sequence Number=SeqID_73211
  Homolog annotation: Hit_ID=Q09JM0; Match level="QueryCoverage=45%, HitCoverage=91%, E-value=6e-07, Identity=58%"; Hit description=10 kDa putative secreted protein
NWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRVS

SEQ ID NO: 189990 - protein, 326 aa, Glycine max
  Coding DNA Sequence Number=SeqID_73212
  Homolog annotation: Hit_ID=Q6D1I3; Match level="QueryCoverage=34%, HitCoverage=30%, E-value=1e-53, Identity=96%"; Hit description =Glutamate 5-kinase
LAVFQIGARQQHLPDVDAVNGEQLFPQLDQPALPHRRQQLLGSDSSGQLGVAQVFAPGGDGAGGDDDDAVARGVLLRALAHQFDDVGAVQTQRSAGQHAGAQFHNQCLAAVHSISAVCNDEKKSAKAQREISTIRGQTGSGGEFDQFFFEIVGGFQPQFHGRQQLAQAAMEVAQGVFQLGVHFIILNVLRRPVAFFVEQAELVRIGEARLFRLQLHPPAPELALLRSGLYIDADSQTIKEKTVVFTLPFTQPAGHLQQRPVETVVNRGARDGDQLAAHRGGDNQLRLLFRAERIALPVAGDHRRRAAAPQQPLHFQRVAVQLHLQH

SEQ ID NO: 189991 - protein, 191 aa, Glycine max
  Coding DNA Sequence Number=SeqID_73213
  Subcellular localization annotation: CTP_CleavageSite=93; ConfidenceScore=5.41e-01
GQGRPRGKRSEAPTTSAPPETPTPSSSTSSLPPILTPIILPSSTQRPLPAPISAGPSDSIFTPQMLYSMLQSIHKGQSIIMQSLQGLGLPSIMSMDEFDAQVAWPGAQPSPSGRGGASATQEPIPEHTAAATVVEGEDELTPPKPFYFDAGVYMAQEEETSTDHIHEPSSTPVPDDAIPSAPASELEQPIP

SEQ ID NO: 189992 - protein, 68 aa, Glycine max
  Coding DNA Sequence Number=SeqID_73214
MDTSEPYTGAIRGTMHEPQANLGADQKFSPEKGKENPRGFALAHLRKKLIRPGAHGKCPKIIVIIGYI

SEQ ID NO: 189993 - protein, 433 aa, Glycine max
  Coding DNA Sequence Number=SeqID_73215
  Gene Ontology: Mol. function=nucleoside-triphosphatase activity; Cellular component=integral to membrane; Biological process=cobalt ion transport
  Homolog annotation: Hit_ID=Q1M3A6; Match level="QueryCoverage=55%, HitCoverage=94%, E-value=6e-52, Identity=46%"; Hit description =Putative ABC transporter component
  Pfam annotation: Domain name=ABC_tran; Domain location=210-393; Score= 187.5; E_value=3.3e-53; Accession=PF00005.17; Description=ABC transporter
MLIVLLSGGMRENTARIILAGIAGTQLFNALTAYIVSTAANAEQSRGVMFWLLGSLSGVRWADALLCFAVTLAGLLTVLYHARALDTFSFGAEVSATLGTQRDWRGRFCRAGDPAYHPHDCRAASSGDDPARIPGRLPFHGDCRPGIAHVNHPSGAANRRGDGASRRSGVRPDSVSQPGEIMKYVAVDKLSVTLQARSVLSDISFAAQRGQTVGLLGPNGSGKSTLIRALAGVQPCAYNGLEMGGTRLNQLSRRQRARTLAFVPQHAEMEAEMCVSDIVRLGRAPHRNAFSPWRTADETAVQHALSLMKLDALAGRSWQRLSGGERQRCQIARALAQQPDILLLDEPINHLDIQFQLELMRLIAALPVTVIVALHDLNLAAKFCQHLVVLQQGQVVASGEPAAVLTPALIQRTWQVEAIVNRSERGTMNIQYA

SEQ ID NO: 189994 - protein, 254 aa, Glycine max
  Coding DNA Sequence Number=SeqID_73216
  Gene Ontology: Mol. function=transcription factor activity; Biological process=regulation of transcription, DNA-dependent
  Homolog annotation: Hit_ID=Q48KT2; Match level="QueryCoverage=100%, HitCoverage=90%, E-value=2e-65, Identity=52%"; Hit description =Transcriptional regulator, LysR family
  Pfam annotation: Domain name=HTH_1; Domain location=7-66; Score=58.7; E_value=1.9e-14; Accession=PF00126.17; Description=Bacterial regulatory helix-turn-helix protein, lysR family
  Pfam annotation: Domain name=LysR_substrate; Domain location=88-251; Score=36.7; E_value=7.8e-08; Accession=PF03466.10; Description=LysR substrate binding domain
  Pfam module annotation: Pfam domain module=HTH_1::LysR_substrate; Domain location=7-66::88-251
MRPTLDIDLLRTFHAIARLGQFRAAAAFVNRSPAAVSVHIQRLEQLAGGRLLERDNQSVALTPLGNRLLASTLVLLNAHDDILRELQGAPLSGHIKLGLLDEYASHVIRHILPRFADSFPAVELEVSTAASQALAEQIGRNRLHLALVVQPSGRRCQTPLAVTAPVWAGGRSLALQANRPLPLALHAADCPYREAMLEALTAAGRPWRVILSSPSASVVASCVEAGLAVTLLDRARLSGAMRILEELPPVAPYE

SEQ ID NO: 189995 - protein, 63 aa, Glycine max
  Coding DNA Sequence Number=SeqID_73217
MEHLLVGDEQKRKTESKNAKKDDPRAANSSIPWGWLAQASPARPLTMSPPFSWISILPNLNLL

SEQ ID NO: 189996 - protein, 245 aa, Glycine max
  Coding DNA Sequence Number=SeqID_73218
  Gene Ontology: Mol. function=catalytic activity; Cellular component =nucleus; Biological process=electron transport
  Homolog annotation: Hit_ID=Q9LTK8; Match level="QueryCoverage=94%, HitCoverage=20%, E-value=6e-56, Identity=47%"; Hit description =Arabidopsis thaliana genomic DNA, chromosome 5, BAC clone:F14A1
  Pfam annotation: Domain name=AMP-binding; Domain location=1-221; Score=-104.2; E_value=0.0034; Accession=PF00501.18; Description=AMP -binding enzyme
  Subcellular localization annotation: CTP_CleavageSite=37; ConfidenceScore=5.19e-01
MVRSVTCKDSNAQAYFVNRLTTVPSLMRTILPGLQTHANMLVENSLKLLVLSGETFPLTLWEMLSTILPKTSILNLYGSTEVSGDCTYFDCKRMPLILKEEKLFSVPIGLPITNCDVMMLLNENGASNEGELYVGGSCIFRDYYNEPNNIMSDAFAKLPRSYACQGQLYFRTGDLVKQLPSGDFVFLGRKDRIIKINGQRIALEEVEELLREHPYINDAAVVCRNNEAELVLLEAFIILKKKERS

SEQ ID NO: 189997 - protein, 77 aa, Glycine max
  Coding DNA Sequence Number=SeqID_73219
MKRKGSGGDRSWTDSDDPMAAATSTGTKRGNEHRHEARQRAPARTAVTSTGTNGSDNAHEGSFALPRPIGLVRGHPF

SEQ ID NO: 189998 - protein, 306 aa, Glycine max
  Coding DNA Sequence Number=SeqID_73220
  Gene Ontology: Mol. function=catalytic activity; Biological process =electron transport
  Homolog annotation: Hit_ID=Q9LTK8; Match level="QueryCoverage=88%, HitCoverage=22%, E-value=4e-49, Identity=39%"; Hit description =Arabidopsis thaliana genomic DNA, chromosome 5, BAC clone:F14A1
MVEKVCNDDDFFMMGGNSLSAAHVAYGLGIDMKFLYYYPTPFKLCMALLQKKGSCSLHNRLDCCRQINTDRQDNHISMNHAENSRPLESRMILKDNDHDSFPSKRLKRGLIDVTSWGDESFPWYSPSLLSFSFSRCNKVLYKGKQAVIDTNQTTWSANVPRGSRGHMNNFWKVYMESCVDASPILVFKGTDIYLFIGSHSHKFLCINARSTTKVKLLPNNWFSGSVQWEIKLKGRIECTAAIVSDFSQVVVGCYMGKIHFLDFLNGRICWIFQTSGEVTGVEEVSVLETRSTFQHLKHDCPCFIVC

SEQ ID NO: 189999 - protein, 186 aa, Glycine max
  Coding DNA Sequence Number=SeqID_73221
  Gene Ontology: Mol. function=oxidoreductase activity, acting on NADH or NADPH; Cellular component=chloroplast; Biological process =electron transport
  Homolog annotation: Hit_ID=Q06FP8; Match level="QueryCoverage=99%, HitCoverage=65%, E-value=8e-80, Identity=82%"; Hit description=NADH -plastoquinone oxidoreductase subunit 7
  Pfam annotation: Domain name=Complex1_49kDa; Domain location=3-185; Score=227.7; E_value=2.5e-65; Accession=PF00346.9; Description =Respiratory-chain NADH dehydrogenase,
MADIGAQTPFFYIFRERELIYDLFEAATGPMLRASGIQWDLRKVDNYECYEEFDWEVQWQKEGDSLARYLVRIGEMMESIKIIQQALEGIPGGPYENLEIRCFDREKEPEWNEFEYRFISKKPSPTFELPKQELYVRIEAPKGELGIFLIGDQMVFPWRWKIRPPGFINLQILPQLVKRMEIGPIL

SEQ ID NO: 190000 - protein, 55 aa, Glycine max
  Coding DNA Sequence Number=SeqID_73222
  Homolog annotation: Hit_ID=Q9LTK8; Match level="QueryCoverage=82%, HitCoverage=4%, E-value=6e-10, Identity=57%"; Hit description =Arabidopsis thaliana genomic DNA, chromosome 5, BAC clone:F14A1
AHVLALDPNGSIVWKKTTDGPIFAGPCIPSVLPHEVLVCSRSGGVYSFKLVRTDR

SEQ ID NO: 190001 - protein, 133 aa, Glycine max
  Coding DNA Sequence Number=SeqID_73223
  Gene Ontology: Mol. function=phosphopantothenoylcysteine decarboxylase activity; Cellular component=cytosol; Biological process=coenzyme A biosynthetic process
  Homolog annotation: Hit_ID=Q9SWE5; Match level="QueryCoverage=80%, HitCoverage=51%, E-value=2e-41, Identity=68%"; Hit description =Phosphopantothenoylcysteine decarboxylase
  Pfam annotation: Domain name=Flavoprotein; Domain location=23-127; Score=54.5; E_value=3.6e-13; Accession=PF02441.9; Description =Flavoprotein
MAGSEPVRAEGETMAVDAAPRKPRILLAASGSVAAVKFANLCHCFSEWADVRAVSTSASLHFIDRAAMPKDVILYTDDNEWSSWKKLGDSVLHIELRKWADIMVIAPLSANTLGKSPPRAEAIFNPRVFNGDP

SEQ ID NO: 190002 - protein, 149 aa, Glycine max
  Coding DNA Sequence Number=SeqID_73224
MEAMKEQITTMMEAMISMRKMMEVYTATVVPASTTIEVGPTHPSSLNQVNHPTSDMVGQGGKALGSTGSLHFVQVQNKHSFPPYGLPPNYTPPNIADEDMTKSKGKDPLEGLGGPMTRARARKAKEALQQVLSILFEYKPKFQGEQSKV

SEQ ID NO: 190003 - protein, 40 aa, Glycine max
  Coding DNA Sequence Number=SeqID_73225
MAVELVPPPRRIVVKLGKGKCFMCWNFCWSSQYHVKWANV

SEQ ID NO: 190004 - protein, 249 aa, Glycine max
  Coding DNA Sequence Number=SeqID_73226
NELRDSKQLVKKLSVLEGTKQFLFALRHPQTQSLIHILSALNLSERSAFDATCLIAEIKPDAVLVQAAAVAAVSPFSQLQSEEEEEDSIPLPTSTLRVIKRCLLDKIGADMFENVAGNLVLREIFGTGFHGPLLAAKRAAEDVGSSFLQQHAASWAPSALKRFSLDKELRMMLAKALSGNSDPLLLSSSVLERGSVEEIYPSISYETPGFARGEVLDKRTVSEVYTFRVAVEGLRIALNNKGLRPVNRK

SEQ ID NO: 190005 - protein, 35 aa, Glycine max
  Coding DNA Sequence Number=SeqID_73227
MGTPVIIWPPKNPPTLKALVSDNVQRAVARPLRLP

SEQ ID NO: 190006 - protein, 96 aa, Glycine max
  Coding DNA Sequence Number=SeqID_73228
MRGTMHEPQQYLGANQKFSPKRKRILEVSHLHFKEKMSLEDTTSRRYHFKEKMSLEEAHHHRRPWIRAWRRKEMNEGRGREEHEILCSKRAPKSEV

SEQ ID NO: 190007 - protein, 74 aa, Glycine max
  Coding DNA Sequence Number=SeqID_73229
  Homolog annotation: Hit_ID=Q10Q39; Match level="QueryCoverage=86%, HitCoverage=4%, E-value=1e-07, Identity=46%"; Hit description =Nucleotidyltransferase domain containing protein, expressed
MGSGSNCIPIGIVSSKTPYVPKVLDQKRWSRAEARAAELIAQIQPNYASEAHRNAVVFNLQCLIMNSVPCQVID

SEQ ID NO: 190008 - protein, 881 aa, Glycine max
  Coding DNA Sequence Number=SeqID_73230
  Gene Ontology: Mol. function=nucleotidyltransferase activity
  Homolog annotation: Hit_ID=Q10Q39; Match level="QueryCoverage=86%, HitCoverage=84%, E-value=1e-106, Identity=43%"; Hit description =Nucleotidyltransferase domain containing protein, expressed
  Pfam annotation: Domain name=PAP_assoc; Domain location=153-246; Score=5.7; E_value=0.014; Accession=PF03828.9; Description=PAP25A associated domain
VFTFGSVPLKTYLPDGDIDLAVFAENQHSEDRLIQDVRNILENQGTNEDSEFHVKEVQYIQGEVKIIKCLIENFVVDISFNQIDGLGTLCFLEEVDNLIRKEHLFKESIILIKAWSYYESRILGSQHGLLSTYGLEILIIYLFNIYSHTLAGPLEVLFQFLNFFSKFDWNKYCISLRGPVPIRSLPKMKAEPPRYARKNCPELLLSEKFLDSCESNYGVKLSYREIRDKPFVCKHLNIVDPLRANNNLGRSISRGNFCRIKGAFSLGAKRIERLLSCTEDNIIAEFDLFFTNSWDRNGNGYWVDTETYNLLIRNKSVETSHEYAVEQPHGVSQNPDNHSEESKQMSGTSDVIVANTMNNKVLANRGQSPTYSSNEAHDMHHFPEFYFSSEFSHLYGEAPSHHHHNTGFSSEIQQSYGQISDDWRSEHAFDPENTSSGYYYDYEYDFGVNYENVFPTDEAMLMHQHQEEFGFPNLNEYQQAAVNVNSSDVPFPPPPPHVLASGYMHENSFGVLYGNWIDQSTIGTDLRENTSTESTTSRVQALQLGSSQRDVIDNKNFPPVEGGSSGPSFQVPTMFPFYNLPTETTFAATNYDILDGDFETHYMNLQYGRLCKNPKSLPMHLREQFPWYGKPKGVFNIEEHAHPPVRVMLPQRASRLRGNTNQSVGFWLPRFSDGTGTFFPKPSSSYHELWFWRRNRLQQDRYIEYQRYERKDNNGEREHNLFSNSEARLADLGQYKLENPGSNESSQKDERKDKDGEREQNLFLNSERMFPSLGRYKFENPGSNESSNQGESSHSGTSKVPNIGTGRDSKRFKKRDIRSLNGDADYLLGQKYFPFLVCASLTRVKLEKVNHLYKESVIIVRLLICPPYMCVIQRWHEEGFM

SEQ ID NO: 190009 - protein, 389 aa, Glycine max
  Coding DNA Sequence Number=SeqID_73231
  Gene Ontology: Mol. function=catalytic activity; Biological process =trehalose biosynthetic process
  Homolog annotation: Hit_ID=Q9FWQ2; Match level="QueryCoverage=79%, HitCoverage=81%, E-value=1e-91, Identity=53%"; Hit description =Putative trehalose-6-phosphate phosphatase
  Pfam annotation: Domain name=Hydrolase_3; Domain location=128-378; Score=-92.5; E_value=0.095; Accession=PF08282.2; Description =haloacid dehalogenase-like hydrolase
  Pfam annotation: Domain name=Trehalose_PPase; Domain location=129 -372; Score=264.4; E_value=2.3e-76; Accession=PF02358.7; Description =Trehalose-phosphatase
  Pfam module annotation: Pfam domain module=Hydrolase_3::Trehalose _PPase; Domain location=128-378::129-372
MENKKLATERVERNYRRRYQSNMKYLFILLVTFKIIKRKFTQLREAMGFQTSHSTKRIQQSIFKAKEDSIDAHENSLIRRTTLNFTDHTQTNSMFTLSSYNSWVVRHPSALNTFDRLMKGANGKRIIVFLDYDGTLSPIVNDPDRAFMSDEMRAAVYEIATYFPTAIISGRSRDKVKDFVKLNNLYYAGSHGMDIMAPSMPVTSSDGKHFGIARNTNGIEVPFQPAKKFLPAIREIIRVLKNEVKEIKGAMIEDNGFCLSVHFRQVQEKDYDVLEEKVKSVLENNPQFCLTEGKKVMEIRPSIKWNKGNAVEYFLDTLGLSSCSDILPVYIGDDRTDEDAFKVIQSREQGYPIIVSSIPRETNALYSLRDPSEVLIFLSRLAKWRRTSY

SEQ ID NO: 190010 - protein, 153 aa, Glycine max
  Coding DNA Sequence Number=SeqID_73232
  Gene Ontology: Mol. function=oxidoreductase activity; Cellular component=membrane; Biological process=electron transport
  Homolog annotation: Hit_ID=O64631; Match level="QueryCoverage=99%, HitCoverage=28%, E-value=1e-59, Identity=69%"; Hit description =Putative cytochrome P450
MHYLHAALTETLRLYPAVPAVLVLDKDGRSAEAHDILPDGHKLKKGDGVYYLAYGMGRMCSIWGEDAEEFRPERWLNNGIFQPESPFKFVAFHAGPRICLGKDFAYRQMKIVAMALVRFFRFKLSNRTQNVTYKVMFTLHIDKGLLLCAIPRS

SEQ ID NO: 190011 - protein, 89 aa, Glycine max
  Coding DNA Sequence Number=SeqID_73233
  Homolog annotation: Hit_ID=Q9LEX1; Match level="QueryCoverage=46%, HitCoverage=8%, E-value=3e-14, Identity=90%"; Hit description=CaLB protein
MSSPTTFTHDMSSPRCKGSVGDPTLSRDIAEIEYTKGGQPSLLDLAATLVIRESVEPLLEEYRPPGITSLKFSKLSLGNVAPKIEGINQ

SEQ ID NO: 190012 - protein, 777 aa, Glycine max
  Coding DNA Sequence Number=SeqID_73234
  Gene Ontology: Mol. function=protein kinase A binding; Cellular component=nucleus; Biological process=eye photoreceptor cell development
  Homolog annotation: Hit_ID=Q6EUI5; Match level="QueryCoverage=87%, HitCoverage=22%, E-value=0.0, Identity=54%"; Hit description =Putative lysosomal trafficking regulator 2
  Pfam annotation: Domain name=Beach; Domain location=2-297; Score =663.3; E_value=1.9e-196; Accession=PF02138.8; Description=BeigeBEACH domain
  Pfam annotation: Domain name=WD40; Domain location=458-496; Score =37.5; E_value=4.7e-08; Accession=PF00400.22; Description=WD domain, G-beta repeat
  Pfam annotation: Domain name=WD40; Domain location=540-578; Score =19.6; E_value=0.012; Accession=PF00400.22; Description=WD domain, G -beta repeat
  Pfam module annotation: Pfam domain module=Beach::WD40::WD40; Domain location=2-297::458-496::540-578
MTNQFQISNFEYLMQLNTLAGRSYNDITQYPVFPWILSDYSSENLDLSNPSSYRDLSKPVGALNPDRLQKFQERYTSFDDPVIPKFHYGSHYSSAGTVLYYLVRVEPFTTLAIKLHGGKFDHADRMFSDISATWNGVLEDMSDVKELVPELFYLPEVLTNENSIDFGTTKLGEKLDTVKLPAWAENPVDFVHKHRMALESEYVSAHLHEWIDLIFGYKQQGKEAIAANNVFFYTTYEGTVNIDKISDPPKIWGDFAYNKPLGTESARVKVQQRATQDQIAYFGQTPSQLLTVPHLKRKPLSEVLHLQQSMEFTVILTNLKTIFRNPKAIKPYAVPSPENCNLPAAAIHASSDMVVVVGLNAPAAQVAQHKWQPNTPDGQGTPFFFQHGKATSGSAGGNLIRMFKGPAGTGEEWQYPQALAFAVSGIRSQAIVSITCDKEIITGGHADNSIRLISSDGAKTLETAHAHCAPVTCVALSANSDYLVTGSRDTTVLLWRIHRALASHSSVVGESSTVSGTMPSTSSSSASPLLLEKNHRRRIEGPIQVLRGHHSEILSCCVSSDLRMVVSCSHSSDVLLHSIRKGRLIRRLDGVVADTVCLSSDGVVMTWNESQHILSTFTLNGILIAKTELPFSSSISCMEISVDGRSALIGINSQENGRAYNNSCNSQSSKSGIEAFYSESEETHDCNKINAPSPSICFLDLHTLEVFHVLRLKEGQDITALALNKDNTNLLVSTWDKQLIIFTDPAVSDKADMLSLKVVDQMLKLGWEGDGLKHLIK

SEQ ID NO: 190013 - protein, 164 aa, Glycine max
  Coding DNA Sequence Number=SeqID_73235
MEGEHEQLLDMHFFAPRYSEEEILTTSSILKPQLSSEVKREEDAYREESRANSETVSLLLPHRLDSGDDLSLLAIKLDHHVLVSITLPITQELRMTNEATTAVSYLVPVNSEDCAFLHGFFHPRQNLISESRYTIVLVGVIFFAGATACHDSEHNVVDLLLLLG

SEQ ID NO: 190014 - protein, 209 aa, Glycine max
  Coding DNA Sequence Number=SeqID_73236
  Homolog annotation: Hit_ID=Q6EUI5; Match level="QueryCoverage=71%, HitCoverage=7%, E-value=3e-24, Identity=37%"; Hit description =Putative lysosomal trafficking regulator 2
MGARFGPSKSSDSTSLGDIEDLIYKFLVFMLEHSMREKDGWKDTEATIHCAEWLSIIGGSSTGEQRIRREESLPIFKRRLFSGLLEFAARELQVQTQIIAMAAAGVAAEGLSPNAAKAEAENATHLSVALVENAIVILMLAEEHLRSQSKQSSSLRPTDGSPSPLSLFYPVHYNLKPLTNTSAESAELRGDRTSSSSNSGGVSLDVCIE

SEQ ID NO: 190015 - protein, 171 aa, Glycine max
  Coding DNA Sequence Number=SeqID_73237
  Homolog annotation: Hit_ID=Q67U53; Match level="QueryCoverage=88%, HitCoverage=55%, E-value=1e-40, Identity=50%"; Hit description=Plant viral-response family protein-like
MLEGHQVLGFGFFVIGLWHLFNHIKLHALCSMSYTSTLWFPTTKSRYLELKFIITSSTIFIALELFISPARHQPFNPDGSIPSDHLHNFEHSSMAMSFLVYATFALVLDKICSKAQYELTHFLGAIAFAQQFLLIHLHSRDHMGLEGQYHYFFATSHPCFFVHDPNGYWLP

SEQ ID NO: 190016 - protein, 186 aa, Glycine max
  Coding DNA Sequence Number=SeqID_73238
  Gene Ontology: Mol. function=organic anion transporter activity; Cellular component=integral to membrane; Biological process=organic anion transport
  Homolog annotation: Hit_ID=UPI00005F71AF; Match level="QueryCoverage =54%, HitCoverage=23%, E-value=3e-26, Identity=65%"; Hit description =COG3493: Na+/citrate symporter
  Pfam annotation: Domain name=Na_citrate; Domain location=1-95; Score=- 283.5; E_value=0.013; Accession=PF03390.6; Description=Bacterial sodium:citrate symporter
MLYVPLESVVAVFSVGYVVVCGSVVLSMGLVSFLIAPYLKMFPVEAAIVTCCHSGLGGTGDVAILSASNRMGLMPFAQIATRIGGASTVIGATLLLGCRGWIAPVFYFEDSRTHSVMSYFSESNIGQDFKGAYSSGPLLNDITAIPHFYGANMHTHIGDTIYGFNSNTDRDFLTATGGLDPRLRAR

SEQ ID NO: 190017 - protein, 54 aa, Glycine max
  Coding DNA Sequence Number=SeqID_73239
MVEEGSWKNLGGSNSRNLKKAIDRIHRLCILHDSQTTLLFLFDLGFNSNMWFFF

SEQ ID NO: 190018 - protein, 535 aa, Glycine max
  Coding DNA Sequence Number=SeqID_73240
  Gene Ontology: Mol. function=hydrogen:sugar symporter activity; Cellular component=integral to membrane; Biological process=transport
  Homolog annotation: Hit_ID=UPI00005F9843; Match level="QueryCoverage =60%, HitCoverage=90%, E-value=1e-104, Identity=56%"; Hit description= COG0477: Permeases of the major facilitator superfamily
IVAGIQLAEGLGHPKVAVRPPVAEQIAALEAIAVAVALCRQPLRREQQQAHLAETVFFGADHQPPFAVLAPDFRIAKMLNAVRRGQHRPVLDEAYAIFAGGQTLHFPHLAVVAGLAQPHVAGVKQRQHAVVIHGATGKTTVFVIGRIGRQGDGLVLPADQIAAGRVPPVHGPPVFAVGVMLEEGMIDAVNTDQAVGIVDPAGGRREMELRVVFVSALCAQGLDRMETGDKRRGGDRAPHQQIGVGKADAVITVARQRRQEAGHHLGDELKAHQDRQLYGVQQFHGGDHQCAADQAGAEHAQRHHATGQQQPLFGADAVHQQRRQEHAAGFEEDLQRVEEAHKHHQRPEARHTQQRERILQPQIFRFAERQAGHGVRLQLAHLAEQQQEYHGGGGGQPEIDVRIDIEDKTGQKGGAGPAERSPHAGAAEFETADAADSLGIRFQRADAGEEGGADKYPADQRAERQAAGQQRGVNVDKERAGQQQHHAEKLQQVLAQPKFVLNKPVQRLGAQRHQRDSGEDQAGLGAFQADLLIQP

SEQ ID NO: 190019 - protein, 77 aa, Glycine max
  Coding DNA Sequence Number=SeqID_73241
  Gene Ontology: Mol. function=transporter activity; Cellular component= integral to membrane; Biological process=transport
  Homolog annotation: Hit_ID=Q82MF2; Match level="QueryCoverage=61%, HitCoverage=10%, E-value=8e-10, Identity=68%"; Hit description =Putative integral membrane transport protein
MPCDRGHGLARGRCAPGGLTFVQRAQMIVAAQRHQRKQADHRGGDHVVGGNVDIAGLFDEAGDNQPGRAGKHRIGQR

SEQ ID NO: 190020 - protein, 691 aa, Glycine max
  Coding DNA Sequence Number=SeqID_73242
  Gene Ontology: Mol. function=heat shock protein binding; Cellular component=integral to membrane; Biological process=protein folding
  Homolog annotation: Hit_ID=Q94H83; Match level="QueryCoverage=99%, HitCoverage=99%, E-value=1e-172, Identity=43%"; Hit description =Putative heat shock protein
  Pfam annotation: Domain name=DnaJ; Domain location=66-127; Score =102.4; E_value=1.3e-27; Accession=PF00226.21; Description=DnaJ domain
MECNKDEAVRAKEIAERKFSEREYVGAKKFALKAQNLYPELEDITQLLTTIDIYISAENKVSGEMDWYGILGVSPFADEETVRKQYRKLALTLHPDKNKSLGAEGAFKLVSEAWSLLSDKTKRLEYNQKRSLKGFQHNNPNHVGSQSDAPSSNGYYNLKKNATSNVRAGKNNGRAPSAPVKKVETFWTICNRCRTHYEYLRVYLNHTLLCPNCNEAFVAVERGPPPNVFKPPNWSSHQRHQNSQHHAGSNNTNFQWGSHSRMAGFGSTDGSTSVAAQAASVVQQASERVRREGSFHKAEKPMKKRKTDDICINGYQGYMANHMATGHGAAGLGTFSEPGKANLETERNYGFSGLPGKHYSTRELSMFEIRNMLMDKSRIEIREKLQEWKLMAEAKINKDKENKRQKSTFNGKPTGSEKLRETAVNGNRHLDIDSFPVRTDDTVKKSQTYVTINVPDPDFHNFDLDRDENSFAEDQVWAAYDDDDGMPRYYAKIHKVISMKPFKMRISWLNSRSNSELGPIDWVGSGFYKTCGDFRTGKHEITESLNSFSHKVRWTKGTRGVVRIFPGKGEVWALYRNWSPDWNEHTPDEVIHKYDMVEVLEDFDEEQGILVTPLVKVAGFRTVFQRHMDCDQERRILKEEMFQFSHQVPNYLLTGQEADNAPKGCRELDPAATPLDLLQIATEANETTDNA

SEQ ID NO: 190021 - protein, 341 aa, Glycine max
  Coding DNA Sequence Number=SeqID_73243
  Homolog annotation: Hit_ID=Q1T493; Match level="QueryCoverage=84%, HitCoverage=58%, E-value=5e-25, Identity=26%"; Hit description =Nucleic acid-binding, OB-fold, subgroup
MCFIQKTPEGGFLEMILMDERLFFTKGTIVKEHELLEIPEHVYDFTTFEEILSGQASSDVLVDVIGQFVDIEQERYDNPKMVIHMKDPRLSNFMEKHETGPIIIILTLAKIKDPKGECPIIIQGSHDSKLLINENIVEIQQYRNRLDSVPVCESLSQAISQISSVFEASTIDKFFVNTPVKSVMEINEFDRELFCVTLAKIEKFFVANGWSYEGCSRCNVKGDPETTYICSGCGKSNTGTVARFRIEILVSQEKECAEFVLWDKECVQLLNVTAAELKKQLIDDGEVDPLAFPEAIECILGKMLAFKIKVQPRCRKSFVIQISDDEQIIDSIKLKLPSDEV

SEQ ID NO: 190022 - protein, 68 aa, Glycine max
  Coding DNA Sequence Number=SeqID_73244
  Homolog annotation: Hit_ID=Q1SM20; Match level="QueryCoverage=91%, HitCoverage=16%, E-value=3e-08, Identity=44%"; Hit description =Nucleic acid-binding, OB-fold
MARRINLIEEINDTKETWKLAVRITNMWFFQNPSKGGFLEMILMDDKGLKMGAAVKHFDFEKWKNPLK

SEQ ID NO: 190023 - protein, 96 aa, Glycine max
  Coding DNA Sequence Number=SeqID_73245
MDVMDWCEQNFAQVQKNACVWLAVESLVQNESGCLLVDPNGHNLERIDGDPVLRETRIWATWEYVSSVGGGQQGMVGLCAHCGCGKLVVHHRPTAT

SEQ ID NO: 190024 - protein, 69 aa, Glycine max
  Coding DNA Sequence Number=SeqID_73246
MEQTSKNFVPHCPEALRYAKVNLKSFEVGMFIPIFDFCYGLSDRGSQGTLEIPRTIIAVNVQLHSQLES

SEQ ID NO: 190025 - protein, 83 aa, Glycine max
  Coding DNA Sequence Number=SeqID_73247
MDTEKLCSVAISIKHKYVYAIGKNPTPTLTRDKAKMEYTSGRQPSSYELTFRVHFKMVTHHIIHVPSPKVSGREGGCRGKKRR

SEQ ID NO: 190026 - protein, 82 aa, Glycine max
  Coding DNA Sequence Number=SeqID_73248
  Homolog annotation: Hit_ID=O65717; Match level="QueryCoverage=46%, HitCoverage=5%, E-value=1e-11, Identity=84%"; Hit description=Cyclic nucleotide-gated ion channel 1
MSAFLNASCPIQDQNTTLFNFGIFLDALQSGVVESRDFPQNNRTLQCVHYFGDNFVELMSAMSVVLGTCSCAWTPYVCMLMS

SEQ ID NO: 190027 - protein, 74 aa, Glycine max
  Coding DNA Sequence Number=SeqID_73249
MVVLRASHVNLMFTFAMHSIILTIKISIPWIMGLNQAHVFKVHQVKVKYGSNQLAKVGVEDGSSYIASLFTSNT

SEQ ID NO: 190028 - protein, 56 aa, Glycine max
  Coding DNA Sequence Number=SeqID_73250
MHDAIKEQARGLSATMHHQKRKTLEEASLLSSESETQHDHRSTSTPYGSQRPRYSA

SEQ ID NO: 190029 - protein, 38 aa, Glycine max
  Coding DNA Sequence Number=SeqID_73251
MPTVDLLVFPFCVWSLISYVNLSRFRMAFSCKTRIANY

SEQ ID NO: 190030 - protein, 314 aa, Glycine max
  Coding DNA Sequence Number=SeqID_73252
  Gene Ontology: Mol. function=catalytic activity; Cellular component =nucleus; Biological process=spermidine biosynthetic process
  Homolog annotation: Hit_ID=Q4ADY5; Match level="QueryCoverage=100%, HitCoverage=91%, E-value=1e-136, Identity=71%"; Hit description =Spermine synthase
  Pfam annotation: Domain name=Methyltransf_11; Domain location=147 -255; Score=8.1; E_value=0.0086; Accession=PF08241.2; Description =Methyltransferase domain
  Pfam annotation: Domain name=Methyltransf_12; Domain location=147 -253; Score=14.2; E_value=0.025; Accession=PF08242.2; Description =Methyltransferase domain
  Pfam annotation: Domain name=Spermine_synth; Domain location=54-290; Score=334.0; E_value=2.6e-97; Accession=PF01564.7; Description =Sperminespermidine synthase
  Pfam module annotation: Pfam domain module=Methyltransf _11::Methyltransf_12::Spermine_synth; Domain location=147-255::147 -253::54-290
MEDGAGRGLECPKTMDGKASNGNGLEKEIPSCCLKAKASIPESEAKCHSTVVSGWFSASQTCSGKSGKAVYFNNPMWPGEAHSIKVEKILYKEKSEYQEVLVFESSMYGNVLVLDGIVQLTERDECAYQEMIAHLPLCSIHSPKNVLVVGGGDGGVLREVARHSSVEHIDICEIDKMVIDVSRKFFPQLAVGFEDSRVHLHVGDAVDFLKSAPEGKYDAIIVDSSDPVGPAQELVEKPFFDTIARALRPGGVLCNMAEKIHYLLSSSLACSGMIGFILCATEGPPVDFVNPINPIEKLEGANEHKRELQFYNSE

SEQ ID NO: 190031 - protein, 115 aa, Glycine max
  Coding DNA Sequence Number=SeqID_73253
  Gene Ontology: Mol. function=mRNA (guanine-N7-)-methyltransferase activity; Cellular component=nucleus; Biological process=mRNA processing
  Homolog annotation: Hit_ID=Q6K833; Match level="QueryCoverage=70%, HitCoverage=24%, E-value=3e-24, Identity=62%"; Hit description=mRNA cap guanine-N7 methyltransferase 2 (EC 2.1.1.56) (mRNA (guanine- N(7)-)-methyltransferase 2)
MSQPTQQRLYDFAKMALINIFVHPYATVCDLYCGDADADKWAHAQIGHYIGIDAPSSGIDQMRETWETHRKSYTAEFFELDPCTVTNLIFQYMQFFIEFLLEDSTPFISLNQPCL

SEQ ID NO: 190032 - protein, 271 aa, Glycine max
  Coding DNA Sequence Number=SeqID_73254
  Gene Ontology: Mol. function=mRNA (guanine-N7-)-methyltransferase activity; Cellular component=nucleus; Biological process=mRNA processing
  Homolog annotation: Hit_ID=Q5HZ60; Match level="QueryCoverage=98%, HitCoverage=70%, E-value=2e-85, Identity=60%"; Hit description=mRNA cap guanine-N7 methyltransferase 2 (EC 2.1.1.56) (mRNA (guanine- N(7)-)-methyltransferase 2)
MTDVVCCLQHLQLCFETEEKARKLLHNVSSLLKPGGYFLGITPDSSTIWAKYQRNVEAYHNKSSSMKPNIVPNCIRTENYMITFEVEEEKFPLFGKKYQLKFANDVSAETYCLVHFPSFIRLAREAGLEYVEIQNLTEFYDDNRAQLAGLLTHYVPNLLDPRGRLLPRSYDALGLYTTFIFQKPDPEIAPPIPTPLLPDVSYNLDENTILGTVEEEKTEHMDESVIEVTIWRDDEVINGHVVEPAIGLGKISEQKGILGPGPADLRFPEAL

SEQ ID NO: 190033 - protein, 70 aa, Glycine max
  Coding DNA Sequence Number=SeqID_73255
MASAYRRTISGPKKKILRNNIHHSVIELYNLICNNAHKYAHSKHHVRSRNSSRKEGQHCTDEISYPSSSS

SEQ ID NO: 190034 - protein, 608 aa, Glycine max
  Coding DNA Sequence Number=SeqID_73256
  Gene Ontology: Mol. function=receptor activity; Cellular component =mitochondrion
  Homolog annotation: Hit_ID=Q2QXR0; Match level="QueryCoverage=93%, HitCoverage=94%, E-value=7e-74, Identity=35%"; Hit description =Expressed protein
  Pfam annotation: Domain name=DUF668; Domain location=438-533; Score =189.3; E_value=9.2e-54; Accession=PF05003.3; Description=Protein of unknown function (DUF668)
MVAESWFRSLWKAPRKHDANSEKVVIEVLAFEIASLMSKLVNLWQSLSDKQIVRFREEITNSVGIRKLVSDDDHFIERLICLEILENMAHVAESVARLAKKCSDPIFKGFGNAFYEFITTGSDPYGWEFTGKKMEKKIKRMEKFISTNASLYQEMEVLADLEQTFTRVKANGESDGVTLMEYQKKVAWKRMEVKHLQDISLWNRTYDYTILLLARSLFTIFCKINHVFGLTEMVDVGRTTNSSVLNSDFIYRSQSVSTILQSSYQPSQNNIPRFSSGPLNAITARSGPIGQTTNKTSISHSGPLGDSSTKSGPILEKHSTNVNFYSGPLGRKFNPSVPVTGRKKKSKIWKFYGHSAAISGKETSTRSSRLTQVGPFKGCMAWDSSIFTDCQSSANGVHYGTQNLKDINSNPLGPGKVVHHTQSVFKPLCKLFNPPPETLGAAALALHYANVIIVIEKLAASSHLIGLDARDDLYNMLPRRVRASLKAKLKPYTKTLASSSSSSIYDPSLAEEWNEAMSSILEWLAPLAHNMIRWQSERSYEQQSFISRTNVLLVQTLYFANQEKTEEVITELLVGLNYVWKYGRELNAKALAECGSFRVDNEYPNLNG

SEQ ID NO: 190035 - protein, 71 aa, Glycine max
  Coding DNA Sequence Number=SeqID_73257
MAQSLFWIGMKGTITNFVAACHVCQRSKYQASSPAGDRNPPAAGPLARKAYGGRYLGRHLLHQKSVSRFQP

SEQ ID NO: 190036 - protein, 152 aa, Glycine max
  Coding DNA Sequence Number=SeqID_73258
MGKVEVAQEQMKADMEAVKEQMATMMEAMMSMKKIMEAMRYGRQRFGSTGDPHYVKIQNKHTFPPYDLPPNCIPPNVAYAPGEDVNNSAAILIKSRQPHHAHVSQPIGETYEIPHHNLANFEPCLGYAIEGQAVGGIPLQNTLEDPQFCPQP

SEQ ID NO: 190037 - protein, 108 aa, Glycine max
  Coding DNA Sequence Number=SeqID_73259
MGAYAKDEKLLIHFFQESLIGAAATRYTNLEPSRVHSWNDLMVVFVRQYQYNSDMTPVGCNYRTWVKRGMNPQRICPKVEGYGSPSGTPNDGKRDDNSDSRHITSVLL

SEQ ID NO: 190038 - protein, 55 aa, Glycine max
  Coding DNA Sequence Number=SeqID_73260
  Gene Ontology: Cellular component=photosystem I reaction center; Biological process=photosynthesis
  Homolog annotation: Hit_ID=O04006; Match level="QueryCoverage=60%, HitCoverage=23%, E-value=7e-12, Identity=88%"; Hit description =Photosystem I reaction center subunit VI, chloroplast precursor
MDKVEDEKNIEFVNEEDGQTKYGDKNVYFDLEDLGNTIGQWDLYGFDAPSPHNPF

SEQ ID NO: 190039 - protein, 96 aa, Glycine max
  Coding DNA Sequence Number=SeqID_73261
  Gene Ontology: Mol. function=catalytic activity; Biological process =trehalose biosynthetic process
  Homolog annotation: Hit_ID=Q45RR4; Match level="QueryCoverage=77%, HitCoverage=55%, E-value=1e-27, Identity=78%"; Hit description =Trehalose-6-phosphate phosphatase
MKKKATIEDVELLTKSWAALAEKVRLVLNEYPQLRLTQGRKVLEICLTIKWDNGKALEFLLESLGYENSNDVFPIYIGDDRTDEDAFRLTNAATPS

SEQ ID NO: 190040 - protein, 232 aa, Glycine max
  Coding DNA Sequence Number=SeqID_73262
  Gene Ontology: Mol. function=RNA-directed DNA polymerase activity; Cellular component=mitochondrion; Biological process=RNA-dependent DNA replication
MEELITFRAQMHGEPLKKQVERETRTPHMIKIESKKGVKNVVGLNKPLRHNATRIPHPELSYEEEEHEAKPEKCIFEVQGGKFLGFMLTHRGIEANLEKCTIIIAMRIPNTLKEMQRLTAQLRTKGPMQAQCLADFTIDLESKWWKLYVVCSSNEKGIDVGIILESLYEVILEQSLRFEFKKTNKQAEYEALLVGLRLVKEVEAKYLKCWSNSKLVTGQLNGEYHTKDPQMT

SEQ ID NO: 190041 - protein, 136 aa, Glycine max
  Coding DNA Sequence Number=SeqID_73263
MAKRPPQPTKKDHPRDRCPPHLGCLPHEPLKMGVPQPREMNTLKQKYTQEMENLQKENVVLREQYQKLQEDHETHLVSIAIIHRTHQAGTDEVEKTWREGISLITHNSKEQQMQRTDFIPLSMGSWKHNYHPDGRC

SEQ ID NO: 190042 - protein, 83 aa, Glycine max
  Coding DNA Sequence Number=SeqID_73264
GLRDRGSLVVKQSKHKGRVVLVWFRTCKGILQDSGTLKRVACGLDGGTRYFNDARPLEPERLKALRIQWATYYLKVKNETISV

SEQ ID NO: 190043 - protein, 60 aa, Glycine max
  Coding DNA Sequence Number=SeqID_73265
MVVEGQSKGYVCHKVPPLSHEREVSTKSTYAEAQSYNEDMKLTLNPTPTMAARLAVKRTS

SEQ ID NO: 190044 - protein, 157 aa, Glycine max
  Coding DNA Sequence Number=SeqID_73266
  Gene Ontology: Mol. function=histone deacetylase activity; Cellular component=nucleus; Biological process=histone deacetylation
  Homolog annotation: Hit_ID=Q1T5Y9; Match level="QueryCoverage=51%, HitCoverage=19%, E-value=1e-35, Identity=83%"; Hit description =Histone deacetylase superfamily
MLRQTRVALGIEVDDKMPQHEYYEYFGPDYTVHVAPSNMENKNSRHLLEEIRSKLLENLSKLQHAPSAQFQERPPDSELGEFMRLLIVIIGTRMAMFLVPTQPMDYTSQYPNQNQSQTSGSSPDSVSTSVNRISPSMSHANTLSNSDLSFATHGIPY

SEQ ID NO: 190045 - protein, 126 aa, Glycine max
  Coding DNA Sequence Number=SeqID_73267
  Subcellular localization annotation: CTP_CleavageSite=43; ConfidenceScore=5.21e-01
MTHQDFQVYSSVTALNKWINLTSLSLILSVATYPTAGGRCETRGMRVPRKEYVRSRHQRLFEENVGKTGKDAIYELLSERLGSCIYARGRRETLRCWTINDLSGWSTKAGLLLLRILNCDEEIRPT

SEQ ID NO: 190046 - protein, 77 aa, Glycine max
  Coding DNA Sequence Number=SeqID_73268
WVDSNTSVRTNDVGFTLVDLKKLAYQNYPFIMAEQVKQANDYTTQLSSSSSSYWCSISFVVYLEIDKKGHTPKIIGD

SEQ ID NO: 190047 - protein, 121 aa, Glycine max
  Coding DNA Sequence Number=SeqID_73269
MHTLKHAYNIKEVYTRTQRKREIDERENTTFAQKINRPNSLKIVPSGVANCRNLPFSGRATRGSRVRLPREEGARSRHQRLFEENVEKTRTCGLRTLSVKGEKTLRRGTINDLLFLKGEKR

SEQ ID NO: 190048 - protein, 46 aa, Glycine max
  Coding DNA Sequence Number=SeqID_73270
MVVVGLGEKVVHDDAENSYFENESYSEIVIPKRNKILFQNSYYEIE

SEQ ID NO: 190049 - protein, 526 aa, Glycine max
  Coding DNA Sequence Number=SeqID_73271
  Gene Ontology: Mol. function=bile acid:sodium symporter activity; Cellular component=integral to membrane; Biological process=sodium ion transport
  Homolog annotation: Hit_ID=Q13JU6; Match level="QueryCoverage=57%, HitCoverage=83%, E-value=1e-109, Identity=66%"; Hit description =Arsenite/antimonite exporter, ArsB like
  Pfam annotation: Domain name=LMWPc; Domain location=3-139; Score =96.1; E_value=1.1e-25; Accession=PF01451.11; Description=Low molecular weight phosphotyrosine protein phosphatase
MTRKVLFLCTGNSARSVLAEATLRAWGGDRFSAFSAGSQPTGQINPFALAQLQAEGMPIEGLRSKSWDEFVDAAPMDLVITVCDSAAAEACPVVFGDFIRSHWGLPDPAAVAGSDADKAAAFAQAHAIVKLRLRALLALPESLWSDRTTLQHALDRIGRLLPTDGAQGRQGQPAGCGADLADDHPDAAEGRLHCDAPVAAALEGHRRDAVHQLGGEAVLNGAAGLAVPAPCLRRLVARSTDRQLHRRADPAGGRALHRHGVRVEQPVPWRCQLHPEPGGVERRDHGGCLRAGGCTAAGPVGDHRAVGYPAAVGGPLHRGAGAGGGVAAALDTDASWRGGIAAGASQAWARLAVCAAAHTGPAVRLPGPADREATAGDRTDCGADPDPGLFHFRPGLPAQSSPGRGALRGRPFGVDWCQQFLRTGGSHRGGTVRRAFGGCAGDGGWCTDRGAGHVVCGADREPYSSLVRETRRALTHRSASKSIYVLRPALSSSAWWGTRTPRHQLRPMSHIPHAATDVAAPASATA

SEQ ID NO: 190050 - protein, 103 aa, Glycine max
  Coding DNA Sequence Number=SeqID_73272
  Subcellular localization annotation: CTP_CleavageSite=86; ConfidenceScore=5.33e-01
MAGLRKPVRLFDNACPPASPLVAPAGNPSAGHGGRSVEALCLPVSTSARFSNHVSARHLCVAAAVCPARSPCHEHTRILPPARAVRARQRGRALGNTAPARSA

SEQ ID NO: 190051 - protein, 410 aa, Glycine max
  Coding DNA Sequence Number=SeqID_73273
  Gene Ontology: Mol. function=two-component response regulator activity; Cellular component=intracellular; Biological process=two -component signal transduction system (phosphorelay)
  Homolog annotation: Hit_ID=Q8PFR3; Match level="QueryCoverage=38%, HitCoverage=76%, E-value=2e-47, Identity=67%"; Hit description=DNA repair protein radC homolog
VVAEDHRRRVVQQGAPHHFAGVDRCGVDGAVEQFLAGDQAVAIVQEQGHEDLPCLPPQAVLQIASDRGRVVADRFAVFQLGGQLRAGPRPGRRASSRAGRSSSTRNGPCACSRSRAVCTASRPPNPEPRNRASSSASESDVGPRAISFSRGRSCSGQSWMGMPASSPASAASPIGACRGSGSVDASVAPGLQVVEQFLVVLQAQLALGFGLLPADGLRAAPTALGDLVHIETGRQQLQHFLLACRQRRRLARKQQVACLQVVAQLLGDEYLPRHRGVQRLGQFGEIGALVDQATDALPQQSVQQAGMTGAGQHHHRQARAAHAQRVDQLRTVRAGTRHREVGQHRIAVVLVHQLQQLGAVTRTADDVHQVGLQHDTDAMQDHGMVVGDDDAWMHEAPQRSNRPRRAAANA

SEQ ID NO: 190052 - protein, 514 aa, Glycine max
  Coding DNA Sequence Number=SeqID_73274
  Gene Ontology: Mol. function=transferase activity, transferring phosphorus-containing groups; Cellular component=membrane; Biological process=peptidyl-histidine phosphorylation
  Homolog annotation: Hit_ID=Q8PCL9; Match level="QueryCoverage=100%, HitCoverage=58%, E-value=1e-146, Identity=58%"; Hit description=Two -component system sensor protein
APRRRADQFVHADPVAVDLQSFVAEAGHVQQVLDVAVQPFALDQDGVQQGTAIGCIHRRTVAGQAVGRTDHRRQRRAQIVRYRREQGRAQSLGLVADVGLFQFGHQPRAQRGLRDVIHHRFGQLPLLGQQARLRAGQVQAGHADRAVFAIQQRQEPPLRAGQSVGEAAAGLAVAQRPVGGGQIGIARLAAATGCGIGADPQPRRHVHGLFQCMPTRLRHLSVAGGTGQLAAQLLARTRMAVGGTQRDHLHAQARGQASGHQRGGQEQEHGDHALARADGEGEAWRDEQEVVGQEAQDRRHHRHAGAGARRHQHHRDDEHHRQVGHAHPTFGQPGHRTGQCSGDQCLCRLVADATHRRQQALAARARPRLRGADDGDLVVRAALDQLLGQGAVEHPRQRPFAGPAQHQGRHAIVRGVVEQGIGDARSVQQFGVAAQAPCQREGCIDLTPGRLVLASPLHGHHRPRCVAALGDAPRHAHQVFTLTAAINGHQHAATQRQVALAACGACFAQAAVDA

SEQ ID NO: 190053 - protein, 104 aa, Glycine max
  Coding DNA Sequence Number=SeqID_73275
MEELVFLLLFVDHKVVPGDMSWGSGDLGDVRWGVIAQNQAWLIPTQSGRAPGSQPIKEQSPRSKEACVAAGQLCILGGIWKLASGNRLPFVGNRLQGLKMETGC

SEQ ID NO: 190054 - protein, 333 aa, Glycine max
  Coding DNA Sequence Number=SeqID_73276
  Gene Ontology: Mol. function=DNA-directed DNA polymerase activity; Cellular component=membrane; Biological process=DNA replication
  Homolog annotation: Hit_ID=Q2P7B1; Match level="QueryCoverage=85%, HitCoverage=89%, E-value=1e-105, Identity=69%"; Hit description=DNA polymerase III delta' subunit
MRAGRGHPDHLAGHRQALAGIGQGQQQEHLVAQEVAYGRGQEEAAILHKRHQVAGAVGRIEPGCKLVQSLRRGQGIGAGLGQRQVGSEAQAQRRVFIAAPLLRQFHRTGLAGSQLFQLTAYFSAQAQAIFAQPVVGLAGMAAGGVQRFARQRLAMALLLQPGQCLVLRRQLELQALAAAADGLRQACRVAADQPQVAAGLRLFQRLQQRIGRRAVDRIGRVDDYHLRHAVLRGQRQLVGDLAHLLDDDLGTQLVAALVRNEADQLQVRVCARCDQLARARCVGCIALRQHMVSQRQRDLVLAQPGRAANQQAMTEATGVERGNRLVERALLPR

SEQ ID NO: 190055 - protein, 136 aa, Glycine max
  Coding DNA Sequence Number=SeqID_73277
MWIISDGRKMRFWLDKWLSPGVVLSSVLVVPISQVTINVTVLDLSDGMGRRYLCKNPFNPYGKIKFLGVDSGHEVTELLGEAEGTYGVLEELSELGGFGGDGVVRVEERRWWTEDWSKDSVNLRMDYTLTLLFLIK

SEQ ID NO: 190056 - protein, 128 aa, Glycine max
  Coding DNA Sequence Number=SeqID_73278
MDIILTKVLSEDNIRSFEAIYGPLTSNNIADSQEGLERRNLIQANAKTIRLSTIFATLDRRLIGENEQQAIKWLLPSRSLPSFIPFQNEGFQEIDPFSYPTWDTLPEEEQHALNVYGADGPAIHTLPP

SEQ ID NO: 190057 - protein, 130 aa, Glycine max
  Coding DNA Sequence Number=SeqID_73279
MLTPPYLVVEKDDGTHKLSVATYPSAGGRRVTRGMRVPRKEYARSRHQCLFEENVGKTGKDAIYELLSERLGSCIYARGRVFPFAPTYSSIVMRKSDLRSSFLCLNQVILFTLKGDHFKALDLKNDPFYL

SEQ ID NO: 190058 - protein, 111 aa, Glycine max
  Coding DNA Sequence Number=SeqID_73280
MITASIYRAPFLSSWFTTLVFLLEYARDNLVALARVMTFFLLVMGEVHNREGGFDGEIGKGLEGLGSEGGFFLDRLDRSEGFGSNDRDDAQTLDLQIVVELAPTAAPPQTV

SEQ ID NO: 190059 - protein, 73 aa, Glycine max
  Coding DNA Sequence Number=SeqID_73281
MAQRFNIQFRASRYITGLNQTSGASTFIFERLDILRDSIRHPSKKLLSFEFAQRFNIQFRASRYMTGLNQRSE

SEQ ID NO: 190060 - protein, 50 aa, Glycine max
  Coding DNA Sequence Number=SeqID_73282
MGHCAPECATHAFTKKVHQVKLKYGSNHHAKIRAKDGSSYIAASSTAKHI

SEQ ID NO: 190061 - protein, 68 aa, Glycine max
  Coding DNA Sequence Number=SeqID_73283
MERYLQHLVRQQAANHCGQFAAEVAWPGDWPDAQAGEEPTGSPGRMDEPRMDEDMTDLFNFLGGSGAT

SEQ ID NO: 190062 - protein, 184 aa, Glycine max
  Coding DNA Sequence Number=SeqID_73284
  Subcellular localization annotation: CTP_CleavageSite=56; ConfidenceScore=5.53e-01
LPSLGTGVWGANTFPVRKYNSRTFHQKVRRSRLFRFFRRFPQINVGGDSARIPFVEHASRESRVALPPKGRLRQGPNVKTNPLASHGGASVNAVVEDGPSRTKRLGDVATSRCFIYQSLQAACMVSRDGDERDECLFHLGESHDMETCPVVEELLQRLMDCGQLEVFIGGKEEPQICMQSEEKK

SEQ ID NO: 190063 - protein, 205 aa, Glycine max
  Coding DNA Sequence Number=SeqID_73285
  Gene Ontology: Mol. function=RNA-directed DNA polymerase activity; Biological process=RNA-dependent DNA replication
MGETHEVPRDHTLADSEPCLGYAIEGQAFGGVPLPNTLGGPQYRPQSQPLNFAVGRVPLAMVEKEKLDDIEERLRVIVGGGNYAFADMAELCLVPDVVIPPKFKVSDFNKYKGTTCPKNHLKMYCKKIGEYAKDENFLMHFFQESLIWAAITWYTNLESSRVRSWKDLMVAFIGQYQYNSDMVPDKMQLQNMFKREHESFKEYAQ

SEQ ID NO: 190064 - protein, 104 aa, Glycine max
  Coding DNA Sequence Number=SeqID_73286
  Gene Ontology: Mol. function=nucleic acid binding
  Homolog annotation: Hit_ID=Q8RYC3; Match level="QueryCoverage=52%, HitCoverage=30%, E-value=7e-20, Identity=83%"; Hit description =Expressed protein
MMKEGATVTLRNAKIDMFKGSMRLAADKWGRVEVTEPASFTVKEDNNLSLIEYELRFEKPVVPTVASYCCNRLCGSCSLSTEQMVDLSANGNWLPDHAFCYAIY

SEQ ID NO: 190065 - protein, 105 aa, Glycine max
  Coding DNA Sequence Number=SeqID_73287
  Gene Ontology: Mol. function=nucleic acid binding
  Homolog annotation: Hit_ID=Q5JML8; Match level="QueryCoverage=62%, HitCoverage=49%, E-value=4e-19, Identity=66%"; Hit description=DNA -binding protein-related-like
MADSKPGLRKPVFTKVDQLRPGTSGHTLTVKVVDAKMVMQKGRSDGPQSRQMRIAECLVGDETGMIIFTARNDQGSNCKVWDLSPTLEVWDSNMGFIRPWALQLQ

SEQ ID NO: 190066 - protein, 236 aa, Glycine max
  Coding DNA Sequence Number=SeqID_73288
  Gene Ontology: Mol. function=nucleic acid binding; Biological process= transport
  Homolog annotation: Hit_ID=Q8H6Q8; Match level="QueryCoverage=69%, HitCoverage=5%, E-value=2e-31, Identity=41%"; Hit description=CTV.20
  Pfam annotation: Domain name=MP; Domain location=6-181; Score=42.5; E_ value=1.5e-09; Accession=PF01107.9; Description=Viral movement protein (MP)
MDDWNIPEIPQDQLHVPETIKDKHNFDYIIKTVENNIPLGQDIGEEFHLLSKNSIYEHSRKYKYLHIGCVQVAIKPLIDMGIDAAVLMCLRDIRHNQFEDSLIGTVETSLGQGPIYFNCYPNKTVSLMDRNILDSLFLNIHFHGLDMNEGSIPVALIYRIQYKVMNTCASRVLLKPQKGETTLFITDMTKANVSLPRKIKCDEVTLPERWVMDKATPSIPRPAPTIEHIKQDNSGK

SEQ ID NO: 190067 - protein, 209 aa, Glycine max
  Coding DNA Sequence Number=SeqID_73289
MASHDEGRDKMAYLHLEEIQENWHIEPDVEEGAQNLKDPHHGPIVWVELEDAMFKCSSIARWNVVMGRTRPKTSNRHLYIKKVGVLPNAALRNEKSSLLQASTIILHESLGFANFSWRCRAKILIVEGKNPNNWDRVPDRGNHRKLHPSVKARGASLNMTRYPQSLRKRIHCQRHHDECPLRRNRQWISPFSPSGVAKSNPHNCCHPCQ

SEQ ID NO: 190068 - protein, 201 aa, Glycine max
  Coding DNA Sequence Number=SeqID_73290
MSSFLFDSTIGMGDNNYGEDTRHGAFDNESSSSEIEARRSGRDVRVSPRVHRNHSVWSLLPLPVIVDFEWVMDNVIKYKSSFTSTMSIFALQRQLKLANPKDSCKIIVEACRSDDFSFLRAALGNTPTFFMYKCLFEVLGLVLPMTTFQRAMLEHLNMASSNSTQTIGPCVSKKFFEFDSNVFHRFKDYFFKVLSTDVVAD

SEQ ID NO: 190069 - protein, 283 aa, Glycine max
  Coding DNA Sequence Number=SeqID_73291
  Gene Ontology: Mol. function=protein dimerization activity; Biological process=electron transport
  Homolog annotation: Hit_ID=Q2R1C3; Match level="QueryCoverage=82%, HitCoverage=36%, E-value=1e-55, Identity=42%"; Hit description=HAT family dimerisation domain containing protein
  Pfam annotation: Domain name=hATC; Domain location=158-238; Score =8.6; E_value=0.004; Accession=PF05699.5; Description=hAT family dimerisation domain
  Subcellular localization annotation: CTP_CleavageSite=21; ConfidenceScore=5.39e-01
MGHFMRLSMFSNFNSLKLLFVASTRFSSTIVMLKRFRSLKKGLQEMVISDKWSSYKEDDVDKAKFVKETLLKDIWWDKVDYILTFTAPIYDVIRKTNTNLASLHMSSTPLHCLVHSLNPRYYSLEWLSEDSYRLPPHQDVELTLERNKCFKRFANFSYGRKGFDDVDCLRDKGILDAKSWWLVHGVHAPTLQKISLKLLGQPYSYSCCERNWSTYSFIYSLKRNKMTPQKFLASEDGQTSNIGSLQDKILSELVHQEGNMLGKIERYEAKFGQSMEILLIDSL

SEQ ID NO: 190070 - protein, 153 aa, Glycine max
  Coding DNA Sequence Number=SeqID_73292
MGFAQGGILGGGGCQMEGYCSHCVGSALAKLLCPRLDGDKLFEGCKVFQEEKKDLAGLVEGITMEKDELFQAVADLKAQLKELESRLEESKLWVAKEREASNELEDELIMYKKRLWSSMRRTSIKPSSRPDTTIEGKTDEEQGAEEHGSDATV

SEQ ID NO: 190071 - protein, 58 aa, Glycine max
  Coding DNA Sequence Number=SeqID_73293
  Gene Ontology: Mol. function=carbonate dehydratase activity; Cellular component=chloroplast; Biological process=carbon utilization
  Homolog annotation: Hit_ID=P46513; Match level="QueryCoverage=76%, HitCoverage=23%, E-value=1e-17, Identity=95%"; Hit description =Carbonic anhydrase 2
TKYSGAGAAIEYAVLHLKVENIVVIGHSCCGGIKGLMSIPDDGTTARQVLYVAIACVS

SEQ ID NO: 190072 - protein, 185 aa, Glycine max
  Coding DNA Sequence Number=SeqID_73294
  Subcellular localization annotation: CTP_CleavageSite=45; ConfidenceScore=5.27e-01
MSAPEMSPLPSLVPRVLPSGVLAAMSPSSSSRSYVSLDYLYTSAEADSLWGCKFSKVFLQRSLTIMEKNRQEHIEALYKVRVYHLKVASAIVAFAEAVKLNHQLSSKVGNALAKLLCPRLDGGQLFERCKVVADLEAQLKESESKLEEFELRAAREREGGKELEEKLIMNNKEDCRSKLQDDESS

SEQ ID NO: 190073 - protein, 149 aa, Glycine max
  Coding DNA Sequence Number=SeqID_73295
  Subcellular localization annotation: CTP_CleavageSite=28; ConfidenceScore=5.18e-01
MSLQVQPQTQPQPLMQQQQQPVQVYPTSVTYESPPHHSNGSFGSVFVVLAIIIVISAVACCLGRLCNRRGGHSHNQKHVKPQKKQQQQQNHHNFRPKEVDIEFGFDKRIAASKPNGHGAGRGIKPLPHHGDVKTFEMKLGHQGKIRPGP

SEQ ID NO: 190074 - protein, 686 aa, Glycine max
  Coding DNA Sequence Number=SeqID_73296
  Gene Ontology: Mol. function=protein serine/threonine kinase activity; Cellular component=membrane; Biological process=protein amino acid phosphorylation
  Homolog annotation: Hit_ID=Q9ASK4; Match level="QueryCoverage=59%, HitCoverage=58%, E-value=1e-127, Identity=57%"; Hit description =Putative LRR receptor-like protein kinase
  Pfam annotation: Domain name=Extensin_2; Domain location=12-265; Score=-140.4; E_value=0.082; Accession=PF04554.4; Description =Extensin-like region
  Pfam annotation: Domain name=Pkinase; Domain location=320-593; Score =100.7; E_value=4.3e-27; Accession=PF00069.15; Description=Protein kinase domain
  Pfam annotation: Domain name=Pkinase_Tyr; Domain location=320-593; Score=115.6; E_value=1.5e-31; Accession=PF07714.7; Description =Protein tyrosine kinase
  Pfam module annotation: Pfam domain module=Extensin_2::Pkinase::Pkinas e_Tyr; Domain location=12-265::320-593::320-593
  Subcellular localization annotation: CTP_CleavageSite=6; ConfidenceScore=5.18e-01
MAKNTSSNESSSLNSDKDKASAPLPSSDDSESPKSTPPKSPPPSPPLPPSPPKKSAPPPTESPPAPAHSSPPTPSQSPPPTPPHSPPPSPSPPTPPPEKSPPSPSNSPPPPSTPPPSKDSAPPPSPSEPPPSPPPSPPPPPPQNSPPSPQSLTPPPHSLSPPTAISTPPSPASHVTPPPAPLGSGPNHPSPPRPPPSTQPKPRGTPPKSDPPSSSPSSGNNTGEIVGLALAGVFIIAFLALVIFFMFGRKQKRASVYAMPPPRKSHMKGGDVHYYVEEPGFGSGALGAMNLRTPSETTQHMNTGQLVFTYEKVAEITNGFASENIIGEGGFGYVYKASMPDGRVGALKLLKAGSGQGEREFRAEVDIISRIHHRHLVSLIGYCISEQQRVLIYEFVPNGNLSQHLHGSKWPILDWPKRMKIAIGSARGLAYLHDGCNPKIIHRDIKSANILLDNAYEAQVADFGLARLTDDANTHVSTRVMGTFGYMAPEYATSGKLTDRSDVFSFGVVLLELITGRKPVDPMQPIGEESLVEWARPLLLRAVETGDYGKLVDPRLERQYVDSEMFRMIETAAACVRHSAPKRPRMVQVARSLDSGNQLYDLSNGVKYGQSTVYDSGQYNEDIEIFKRMVNGSFDDSEFDMNSMEYRSTVSREMSGSRHSRMPYSEGSDSDFRVFHGQRSNTQNMS

SEQ ID NO: 190075 - protein, 56 aa, Glycine max
  Coding DNA Sequence Number=SeqID_73297
MAFVAYNVYKIQKLGTIIDSESNRHNFLRSQKDLSIKGSDQQGSGVKCYHLKFHKP

SEQ ID NO: 190076 - protein, 356 aa, Glycine max
  Coding DNA Sequence Number=SeqID_73298
  Homolog annotation: Hit_ID=Q5SMR4; Match level="QueryCoverage=42%, HitCoverage=27%, E-value=1e-26, Identity=43%"; Hit description=ALM beta-like
  Pfam annotation: Domain name=Mov34; Domain location=110-208; Score =7.5; E_value=0.0038; Accession=PF01398.11; Description=Mov34MPNPAD-1 family
MYKRSNEEKDVSSKKVRNCDTAESNIQSAIVDGEDTSEIPSFPLGNLSTSWCSLVCKPAAIKTANRYFLLQKVTQSWPSPALCFVETVPQDAQSSHVTAFNSGDGSSKSDNERDVHISMRLMEDFLDLAKENTEKDLETCGILGAYLEKGTLYLTTLIIPKQESASNSCQATNEEEVFKILNERSLYPVGWIHIRDETQQLTACFDHIYVTSYWWSKTTILIRKTNVPLHTCEVAVGNILSIYLRVGWVRPRGLDSGLIGEAYPNRPSLCWEHVLGTGCDIKNSKLTIDLVLVGLSLNHVWTHSLVLFYQVMIPEAFAIVLAPNDTSRRQDFTHTKNQTMAAPYMSTAPMCTKTPI

SEQ ID NO: 190077 - protein, 74 aa, Glycine max
  Coding DNA Sequence Number=SeqID_73299
  Subcellular localization annotation: CTP_CleavageSite=33; ConfidenceScore=5.41e-01
MADIQSKQEASSSTTFVSNSIFVCKRISYLLVFASARSQKFQCNVRIVSEMPIIGADLQTRGYSHSFFIFASFS

SEQ ID NO: 190078 - protein, 239 aa, Glycine max
  Coding DNA Sequence Number=SeqID_73300
  Gene Ontology: Mol. function=ATP binding; Cellular component =membrane; Biological process=defense response
  Homolog annotation: Hit_ID=Q1T033; Match level="QueryCoverage=90%, HitCoverage=99%, E-value=2e-44, Identity=48%"; Hit description =Disease resistance protein
MVEAALKGVFENLSSLIGKELGLFLGFDQDLKKRLASLLTAILAMHEDAEEKQFSDISLKDWLLKLRDAAHELDDIMDEYAYEKLQLEYEGVNSCLSEFVKISCLSSFHPMHVFSYYKTVKKMKSISERLEKIAQERIKFHLTVMVHERSLGRLRKTTLVQLIFNHEKVVNHSELRIWMLEMLVPGGVWNELYWRSFFQDIETHTFGKITRFKMHDLIHDLAQFVVKERVVVAFRMTMV

SEQ ID NO: 190079 - protein, 52 aa, Glycine max
  Coding DNA Sequence Number=SeqID_73301
MECFLSKPPSLDIVGIGDTEIHNFQINLKGSGSSRITRLTPNTKNGAKFRHW

SEQ ID NO: 190080 - protein, 141 aa, Glycine max
  Coding DNA Sequence Number=SeqID_73302
  Homolog annotation: Hit_ID=Q6CQE5; Match level="QueryCoverage=36%, HitCoverage=47%, E-value=2e-10, Identity=65%"; Hit description =Protein TAR1
MLLRGVYADLPRAPASWLVEIWVHGRLRRDKMVDEPRSRPITCEPVSSGPIDDPLRARTLPTRPQSGEASSVADRAQVPWKGAPERVRAPSCPDPVAPRGAVGESGCLGMQPQSGGKFRPRLNTGERPIANKYREGKMKRT

SEQ ID NO: 190081 - protein, 129 aa, Glycine max
  Coding DNA Sequence Number=SeqID_73303
MSPLVRNLVKKAVKLSLDDLKANHPQAFLSSRAVEIRSYAPDLAKTIAGLILSSSDLDFQGECFSLLGLQSQEVGTEIVENCIEERIVSVIEMNDKKSYNSQEPAPFLFEEDPVEELEFQENDSSPLDF

SEQ ID NO: 190082 - protein, 1092 aa, Glycine max
  Coding DNA Sequence Number=SeqID_73304
  Gene Ontology: Mol. function=protein binding; Cellular component =integral to membrane; Biological process=defense response to fungus
  Homolog annotation: Hit_ID=Q1SWI7; Match level="QueryCoverage=90%, HitCoverage=99%, E-value=0.0, Identity=33%"; Hit description=Leucine- rich repeat
  Pfam annotation: Domain name=LRRNT_2; Domain location=27-67; Score =50.5; E_value=5.7e-12; Accession=PF08263.3; Description=Leucine rich repeat N-terminal domain
  Pfam annotation: Domain name=LRR_1; Domain location=112-137; Score =9.4; E_value=5.1; Accession=PF00560.23; Description=Leucine Rich Repeat
  Pfam annotation: Domain name=LRR_1; Domain location=139-161; Score =11.7; E_value=1.8; Accession=PF00560.23; Description=Leucine Rich Repeat
  Pfam annotation: Domain name=LRR_1; Domain location=163-187; Score =8.3; E_value=8; Accession=PF00560.23; Description=Leucine Rich Repeat
  Pfam annotation: Domain name=LRR_1; Domain location=190-212; Score =15.9; E_value=0.15; Accession=PF00560.23; Description=Leucine Rich Repeat
  Pfam annotation: Domain name=LRR_1; Domain location=214-236; Score =0.7; E_value=2.1e+02; Accession=PF00560.23; Description=Leucine Rich Repeat
  Pfam annotation: Domain name=LRR_1; Domain location=238-263; Score =11.9; E_value=1.7; Accession=PF00560.23; Description=Leucine Rich Repeat
  Pfam annotation: Domain name=LRR_1; Domain location=265-287; Score =17.4; E_value=0.051; Accession=PF00560.23; Description=Leucine Rich Repeat
  Pfam annotation: Domain name=LRR_1; Domain location=317-338; Score =11.0; E_value=2.5; Accession=PF00560.23; Description=Leucine Rich Repeat
  Pfam annotation: Domain name=LRR_1; Domain location=343-371; Score =7.5; E_value=11; Accession=PF00560.23; Description=Leucine Rich Repeat
  Pfam annotation: Domain name=LRR_1; Domain location=394-416; Score =12.7; E_value=1.2; Accession=PF00560.23; Description=Leucine Rich Repeat
  Pfam annotation: Domain name=LRR_1; Domain location=418-440; Score =9.8; E_value=4.2; Accession=PF00560.23; Description=Leucine Rich Repeat
  Pfam annotation: Domain name=LRR_1; Domain location=442-464; Score =12.8; E_value=1.2; Accession=PF00560.23; Description=Leucine Rich Repeat
  Pfam annotation: Domain name=LRR_1; Domain location=466-488; Score =20.8; E_value=0.005; Accession=PF00560.23; Description=Leucine Rich Repeat
  Pfam annotation: Domain name=LRR_1; Domain location=490-512; Score =19.9; E_value=0.0093; Accession=PF00560.23; Description=Leucine Rich Repeat
  Pfam annotation: Domain name=LRR_1; Domain location=519-541; Score =13.4; E_value=0.82; Accession=PF00560.23; Description=Leucine Rich Repeat
  Pfam annotation: Domain name=LRR_1; Domain location=543-566; Score =12.6; E_value=1.2; Accession=PF00560.23; Description=Leucine Rich Repeat
  Pfam annotation: Domain name=LRR_1; Domain location=568-596; Score =4.9; E_value=34; Accession=PF00560.23; Description=Leucine Rich Repeat
  Pfam annotation: Domain name=LRR_1; Domain location=616-639; Score =11.5; E_value=2; Accession=PF00560.23; Description=Leucine Rich Repeat
  Pfam annotation: Domain name=LRR_1; Domain location=641-663; Score =3.3; E_value=70; Accession=PF00560.23; Description=Leucine Rich Repeat
  Pfam annotation: Domain name=LRR_1; Domain location=714-733; Score =11.2; E_value=2.3; Accession=PF00560.23; Description=Leucine Rich Repeat
  Pfam annotation: Domain name=LRR_1; Domain location=738-760; Score =8.1; E_value=8.6; Accession=PF00560.23; Description=Leucine Rich Repeat
  Pfam annotation: Domain name=LRR_1; Domain location=762-784; Score =9.6; E_value=4.7; Accession=PF00560.23; Description=Leucine Rich Repeat
  Pfam annotation: Domain name=LRR_1; Domain location=786-809; Score =14.3; E_value=0.46; Accession=PF00560.23; Description=Leucine Rich Repeat
  Pfam annotation: Domain name=LRR_1; Domain location=811-833; Score =7.7; E_value=11; Accession=PF00560.23; Description=Leucine Rich Repeat
  Pfam annotation: Domain name=LRR_1; Domain location=835-857; Score =12.8; E_value=1.1; Accession=PF00560.23; Description=Leucine Rich Repeat
  Pfam annotation: Domain name=LRR_1; Domain location=907-929; Score =7.4; E_value=12; Accession=PF00560.23; Description=Leucine Rich Repeat
  Pfam annotation: Domain name=LRR_1; Domain location=931-953; Score =15.8; E_value=0.16; Accession=PF00560.23; Description=Leucine Rich Repeat
  Pfam annotation: Domain name=LRR_1; Domain location=955-977; Score =17.0; E_value=0.068; Accession=PF00560.23; Description=Leucine Rich Repeat
  Pfam annotation: Domain name=LRR_1; Domain location=979-1000; Score =8.6; E_value=7.1; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1; Domain location=27-67::112-137::139-161::163-187::190 -212::214-236::238-263::265-287::317-338::343-371::394-416::418 -440::442-464::466-488::...
  Pfam module annotation: Domain location=490-512::519-541::543 -566::568-596::616-639::641-663::714-733::738-760::762-784::786 -809::811-833::835-857::907-929::931-953::955-977::979-1000
MNSSSIYILVFVQLWLLSLPCRESVCIPSERETLLKFKNNLIDPSNRLWSWNQNNTNCCHWYGVLCHSVTSHVLQLHLNSSHSPFNDDHDWESYRRWSFGGEISPCLADLKHLNYLDLSGNIFFGAGMSIPSFLGTMTSLTHLDLSLTGFMGKIPPQIGNLSKLRYLDLSFNDLLGEGMAISSFLCAMSSLTHLDLSDTGIHGKIPPQIGNLSNLVYLDLSSVVANGTVPSQIGNLSKLRYLDLSGNEFLGEGMSIPSFLCAMTSLTHLDLSGNGFMGKIPSQIGNLSNLVYLGLGGHSVVEPLFAENVEWVSSMWKLEYLHLSNANLSKAFHWLHTLQSLPSLTRLYLSNCTLPHYNEPSLLNFSSLQTLHLSVTSYSPAISFVPKWIFKLKKLVSLQLPGNEIQGPIPGGIRNLTLLQNLDLSENSFSSSIPDCLYGLHRLKSLDLSSSNLHGTISDALENLTSLVELDLSYNQLEGTIPTSLGNLTSLVELDLSHNQLEGTIPTFLGNLRNLREINLKYLYLSFNKFSGNPFESLGSLSKLSYLYIDGNNFQGVVKEDDLANLTSLERFFASENNLTLKVGSNWLPSFQLTNLDVRSWQLGPSFPSWIQSQNKLTYLDMSNTGIIDSIPTQMWEALSQVLHFNLSHNHIHGELVTTLKNPISNQIVDLSTNHLRGKLPYLSNAVYGLDLSTNSFSESMQDFLCNNQDKPMQLQFLNLASNNLSGEIPDCWINWPFLVEVNLQSNHFVGNFPPSMGSLADLQSLQIRNNTLSGIFPTSLKKTGQLISLDLGENNLSGSIPPWVGEKLSNMKILRLISNSFSGHIPNEICQMSLLQVLDLAKNNLSGNIPSCFSNLSAMTLVNRSTYPRIYSQPPNYTEYISGLGMVSVLLWLKGRGDEYRNILGLVTSIDLSSNKLLGQIPREITDLNGLHFLNLSHNQLIGPIPEGIGNMGSLQSIDFSRNQLSGEIPPTISNLSFLSMLDLSYNHLKGKIPTGTQLQTFEASNFIGNNLCGPPLPINCSSNGKTHSYEGSDEHEVNWFYVSASIGFVVGFLIVIAPLLICRSWRYAYFHFLDHVWFKLQSFRSGIITV

SEQ ID NO: 190083 - protein, 304 aa, Glycine max
  Coding DNA Sequence Number=SeqID_73305
  Homolog annotation: Hit_ID=Q9FHD0; Match level="QueryCoverage=98%, HitCoverage=16%, E-value=5e-11, Identity=24%"; Hit description =Genomic DNA, chromosome 5, TAC clone:K24M7
MRTHFLNNDYFALPPPQTFPFLHFPIPRLPPPPPSAVHHLLRFDPPIHLPLHLDPFPVHATLSTFLPAILPHRIRINSHDLATPSNPAIEAEVIFEDRVSEADIKFSNESKIIAFNDKNDDVYETIQFEIPELGTFLENVCVTETERMQMLSLTPEVENTLEMLKPEPSRQYPYEALESVLLVEDVISEYLMGENAYSLEGHISVQHQPHSDKNKFLILEVDEESLGTPTCLSLVDIVDSYFENIRSQNFDEQYQSVIEGKELLGSMKHNMMEFFSDECVSKKSLELSDLFPERDFMNMLETEH

SEQ ID NO: 190084 - protein, 848 aa, Glycine max
  Coding DNA Sequence Number=SeqID_73306
  Gene Ontology: Mol. function=receptor activity; Cellular component =myosin complex; Biological process=regulation of transcription, DNA -dependent
  Homolog annotation: Hit_ID=Q9FHD1; Match level="QueryCoverage=97%, HitCoverage=96%, E-value=1e-117, Identity=35%"; Hit description =Hyaluronan mediated motility receptor-like protein
  Pfam annotation: Domain name=M; Domain location=270-290; Score=5.1; E_ value=27; Accession=PF02370.7; Description=M protein repeat
  Pfam annotation: Domain name=M; Domain location=350-370; Score=3.4; E_ value=46; Accession=PF02370.7; Description=M protein repeat
  Pfam annotation: Domain name=M; Domain location=485-505; Score=2.8; E_ value=54; Accession=PF02370.7; Description=M protein repeat
  Pfam annotation: Domain name=M; Domain location=645-665; Score=2.4; E_ value=60; Accession=PF02370.7; Description=M protein repeat
  Pfam annotation: Domain name=M; Domain location=750-770; Score=3.4; E_ value=44; Accession=PF02370.7; Description=M protein repeat
  Pfam module annotation: Pfam domain module=M::M::M::M::M; Domain location=270-290::350-370::485-505::645-665::750-770
  Subcellular localization annotation: CTP_CleavageSite=47; ConfidenceScore=5.20e-01
MFKSRSKKNKIKAVFKLQFQATQVPNMKKSVLMVALVPDNVGKPTVKLEKVAVQDGTCLWENPIFESVKLVKDTKSGKLQEKIYHFVVSTVSSRFNCILSFTCLGYVAGKSNLYRFLQGSSKSGFLGESSIDFADFAAETEPLTVSLPLKFANSGAILHVTIQNVEGVHRDQSSFRNGEDNWNGSSRHLLSICSTDEGSHNADKDFPQLLPPLRQNSMPSRGTIETIATRAQMPHMGPMGSASDRSLGDYWRKSLEDTLPRERLQEPSDNVTENLKSEVASLKRKVEESEHELQSLQKLMEKECSRGQSMSRQIISLRDERNMIKTKYEQLLSQQNETKSSKALQTEIADARQQLEATKEEFLYEKEFSSNLQLQLQKTQNSNSELLLAVRELEAMLEQKNKELLENNKENEDATELDHLKQKIADQNGEIDNYYKQCEELNGHIKELNFECEVLKKENLNISLRLKHGEEQQVVLQNKHSASLATIEQLESQVQRLEEKIKNQADDFSETLIYINELENQVSDLERELKTQAEKFEKDFHAMKCAKLEQEERATQAEETLIKTRHNNDLRCQRLQDEYRSLSVEMALKVEENEKKTMEAYAEADEFRKQNKLMEKMLQKCNQELRLITNQNESKLQQLLNQIDSKQKAIEMMSQELEIKSKQLEDLQRHRDEQDEALSKQIQLLRIEIRKLMAEEHALSKTESKENMTTMLMLENNDEEEIRLGTLMSEVEILKTQHNELKHNLHTEQAEKENMKKKISQLEGELKKKEEELSAVEKRLKNSKGQATATNMNLASWHYESAASSSSTKDRNSMSKSEMHKMNHHFQGMSKILIPTVKRTFDMNTTNT

SEQ ID NO: 190085 - protein, 1147 aa, Glycine max
  Coding DNA Sequence Number=SeqID_73307
  Homolog annotation: Hit_ID=Q9FHD0; Match level="QueryCoverage=95%, HitCoverage=71%, E-value=1e-175, Identity=35%"; Hit description =Genomic DNA, chromosome 5, TAC clone:K24M7
NILAKIDLNNQDFGGTSFDDGKLAFDLVFCDDTIDECDIKQNEEFKKLLSDGMPLVDNHPVEVASGKVIEHVSSKQGSQEQLPEQKAERASLLFKSLSEISNLDYFLNPKEATGKGNCNYAVESTNANVCIPKVSSNELKVGAQSQVFHTVLHRVRLSDNIVALAGYFEKSYLAILHSDTEMTKMHNSDADYLKLLGLQKHKLIKYHVNGNNMAFAVLCAIKQAAWYLCFYGLHPAFLYLDKLCQNLEYLKSKLGFLQSLIKDEKGKVDSNVTMAHPSLTIVKKILQSYTKQNSSKTLIVAEEVFWYSLKNILLSLGLSFIELNDSYRNQPYANTVPKDTDTKTKELLISDCLLVSHKHVFPLFPLNKFDIILEYGGPYDSSRISELSQNLVELPHLHFLRVELDGHAALEALCEGVEMPPNIEMLMESETRLIFNHKESMNQNLERLLNFCPVEQSYDKKSSKVAPEADNHAPLIPAVKTEHDHKSMEVFPGTVMIVNTQNVDKEMIMSRRSSYQLILAMEKEGIQVVERDLDLPVDIILSSAICLAQYDSRNLGKKATPATEASSSLPLCIENIATDVLTLLSFYFRGCFLVFEGELNFLSTVMESSDRLYAAATSLGIDLQIFFSYSPELTNEVIVSCIKSATNMTRGLYPKMPDSVTFAESFLTEFPGINPLTAHYILSSGVMLNEFLAWSHEQRMHVLEKYHVPEESISLFSVFCRYGEPEDSKSIMTDCSSSVSSGLDSDRCCLYEVENERKRKNPISSDQIDEPSLDELLQFETLNQVVEAVPDSSTLPKPFDFGMSKNAGRSSDFANASFSMSEFFSQKQSTGAVTMRNLSGVSYSPGNCKAPHKSEKLKQPSLSLKNKELAQNEILGTALMGKGVNWHNFSNSEKLHGDIRGEVVDLTDNPLFDKSFATPDSMYFTSLMAETDQMRKNKIARKLSFDNSSHPASSSSKIWRSFKDTRGQVDNYPEPDFREDVFPPDFKPRKNIVVTQASMRNLESPFKEEISHLGITPFSFARQSAIILKNSPWTTEFINKVKEKSGLRQKSLSSENSGPYFGYPGSMSKTSKRINPSVIDLFKYQPNRASRNVPEQKRQKQSEGNSQTGDENGVRDQNRKLDSVLDNLSLKPMGISHDDSFKIYDPA

SEQ ID NO: 190086 - protein, 191 aa, Glycine max
  Coding DNA Sequence Number=SeqID_73308
LERRNLHKRLGNLQEGSIDVAVVKEFYANLYSPEDQAPKYARVRRRMIKIDADSLNELLQTPVLIEEGEPLPTYSRFCRLRYNPKEMEASLCIPGKGFVLKAEGQPWKLLRKDLTTLAQTWSIFSFTNLAPTSHTSVTGTDMNIGGLIFGQITIMAQCNSSRLGFPALITALCRSRVMQSYPARALDREDS

SEQ ID NO: 190087 - protein, 215 aa, Glycine max
  Coding DNA Sequence Number=SeqID_73309
  Gene Ontology: Mol. function=galacturonate binding; Cellular component=plasma membrane; Biological process=cell-cell signaling
  Homolog annotation: Hit_ID=P93788; Match level="QueryCoverage=81%, HitCoverage=85%, E-value=1e-19, Identity=40%"; Hit description =Remorin
  Pfam annotation: Domain name=Remorin_C; Domain location=103-212; Score=164.9; E_value=2e-46; Accession=PF03763.4; Description=Remorin, C-terminal region
  Pfam annotation: Domain name=Remorin_N; Domain location=35-101; Score= 33.8; E_value=5.9e-07; Accession=PF03766.4; Description=Remorin, N -terminal region
  Pfam module annotation: Pfam domain module=Remorin_C::Remorin_N; Domain location=103-212::35-101
MTEEQTKTAESESVTPPPAAAPSQAPPAAEAEHVPEAPKDVAEEKSVIPVPSSDDKPDESKALVLVEKTQEVAEVKPTEGSVNRDYVIKPHLSSDAVLARVATEKRLSLIKAWEESEKSKAENKAHKKLSSVSAWENSKKAAVEADLKKIEEELEKKKAEAAEKIKNKIAAIHKEAEERRAIIEAKKGEDLLKAEEQAAKYRATGTAPKKLLGCF

SEQ ID NO: 190088 - protein, 190 aa, Glycine max
  Coding DNA Sequence Number=SeqID_73310
  Gene Ontology: Mol. function=RNA-directed DNA polymerase activity; Biological process=RNA-dependent DNA replication
  Homolog annotation: Hit_ID=Q1SFC1; Match level="QueryCoverage=63%, HitCoverage=27%, E-value=2e-25, Identity=45%"; Hit description=RNA -directed DNA polymerase
MAQVISKPRYAEASGQVINRAKFPFYSGSISQHRFPCSKGSQGTKIHLQPIVNIIKNKLLAWKGKLLSFMGRILLDKSVIHNMLTYIFHVYLWPKYLLKDSGQWMKNFIWSGDVKLRKTTTVAWKAPPSPWIKINTYEAAKGNPGRACCDGLFMSPICNSWELLLQILALIVLSWLRLWQPLLLWKRPSL

SEQ ID NO: 190089 - protein, 123 aa, Glycine max
  Coding DNA Sequence Number=SeqID_73311
ALLISYEKVKNINNNLDISKGEIKSALRKSKERREEESKHKFYTGSATTRAYIQSLSNLLRFPFLVKILYKQRATKDVPSPVLFEQPSRCTLYLKRTTKDVPSLVFTITTKKLPASYTKFSNG

SEQ ID NO: 190090 - protein, 106 aa, Glycine max
  Coding DNA Sequence Number=SeqID_73312
MIHLVDAEWGRRFTLATTLVAAIATALASIIFFTLIMASIIVAICSFMASMSTSIYSCTSSALPFTLALAQIFNMVHDISVKVKLEVTGTSTALNVFGSRRRSDVT

SEQ ID NO: 190091 - protein, 375 aa, Glycine max
  Coding DNA Sequence Number=SeqID_73313
  Gene Ontology: Mol. function=metal ion binding
  Homolog annotation: Hit_ID=Q6ZGA0; Match level="QueryCoverage=77%, HitCoverage=84%, E-value=4e-56, Identity=41%"; Hit description =Putative S-ribonuclease binding protein SBP1
MLGGNNGNRLLPVFLDETQFRHQTNVSNQLQLFGNYLYSIATFLHAVLSTILFSSSCCYRHDYGISFPFLNRDVQAGCSVDPVNYFGNEHISSMIQPNKQSKEMEDISKQRLQISLNYNVHQDDADQLASIPNPNPVSTGLRLSYDDDERNSSVTSASGSMSATPSIILSFGDNIRTELDRQQEELDQYVKLQKEQLSKGVRDMKQKHVAALLTSIEKGINTKLKEKDVEIENMNRKNRELAERIKQVAVEAQSWHYRAKYNESVVNTLRNNLQQAISQGAEQGKEGFGESEVDDDASYIDPNNFLNIPAAPINSTHKSYQDMENLTCRACKTKTVSMLLMPCRHLCLCKDCEGFINVCPVCQLIKTASVEVYLS

SEQ ID NO: 190092 - protein, 44 aa, Glycine max
  Coding DNA Sequence Number=SeqID_73314
MEHKVDFKDNRSVDPERYTFSLTGRKPISLEDKRMLGEGYNPLL

SEQ ID NO: 190093 - protein, 331 aa, Glycine max
  Coding DNA Sequence Number=SeqID_73315
  Gene Ontology: Mol. function=translation initiation factor activity; Cellular component=eukaryotic translation initiation factor 3 complex; Biological process=translation
  Homolog annotation: Hit_ID=Q38884; Match level="QueryCoverage=99%, HitCoverage=100%, E-value=1e-126, Identity=69%"; Hit description =Eukaryotic translation initiation factor 3 subunit 2
  Pfam annotation: Domain name=WD40; Domain location=1-85; Score=12.6; E_value=1.2; Accession=PF00400.22; Description=WD domain, G-beta repeat
  Pfam annotation: Domain name=WD40; Domain location=141-179; Score =23.8; E_value=0.0006; Accession=PF00400.22; Description=WD domain, G- beta repeat
  Pfam annotation: Domain name=WD40; Domain location=186-224; Score =34.3; E_value=4.3e-07; Accession=PF00400.22; Description=WD domain, G-beta repeat
  Pfam annotation: Domain name=WD40; Domain location=283-321; Score =29.9; E_value=8.9e-06; Accession=PF00400.22; Description=WD domain, G-beta repeat
  Pfam module annotation: Pfam domain module=WD40::WD40::WD40::WD40; Domain location=1-85::141-179::186-224::283-321
  Subcellular localization annotation: CTP_CleavageSite=74; ConfidenceScore=5.64e-01
MRPILMKGHERPLTFLKTTTPPSGSPTTANASAPTAATTAPFGAATSQASSSSLFSIHLFNNIDTDRDSGRLITGSADQTAKLWNVQTGQQLFTFNFDSPARSVDFAVGDKLAVITTDPFMELPSAIHVKRIANDPAEQTGESVLLIKGPQGRINRAIWGPLNRTIISAGEDAVIRIWDSETGKLLKESDKESGHKKTVTSLAKSADGSHFLTGSLDKSARLWDTRTLTLIKTYVTERPVNAVAMSPLLDHVVLGGGQDASAVTTTDHRAGKFEAKFYDKILQEEIGGVKGHFGPINALAFNPDGKSFSSGGEDGYVRLHHFDPDYFNIKI

SEQ ID NO: 190094 - protein, 194 aa, Glycine max
  Coding DNA Sequence Number=SeqID_73316
MVPLEAFADGARIREEGAGGGVGIFVSIQVFGGARIALSLNGIELSTGLPDNAFGEDLISRWALSTITLVLSTVIWNIKKSFLGTTISTEVVVALSTSLMSSTEKTITTTNNNNKNTNIYGLVGFGALGIRFAKRANDPASQKPMQHPKHQRLAQNINDFFSPEVVIELFKVMAKLRIVAANRILVDTYFDARC

SEQ ID NO: 190095 - protein, 294 aa, Glycine max
  Coding DNA Sequence Number=SeqID_73317
  Gene Ontology: Mol. function=protein serine/threonine kinase activity; Cellular component=flagellin-based flagellum; Biological process=protein amino acid phosphorylation
  Homolog annotation: Hit_ID=O24431; Match level="QueryCoverage=89%, HitCoverage=51%, E-value=1e-106, Identity=72%"; Hit description =Calmodulin-like domain protein kinase isoenzyme gamma
  Pfam annotation: Domain name=Pkinase; Domain location=91-294; Score =202.9; E_value=7.2e-58; Accession=PF00069.15; Description=Protein kinase domain
  Pfam annotation: Domain name=Pkinase_Tyr; Domain location=91-294; Score=-46.7; E_value=1.3e-09; Accession=PF07714.7; Description =Protein tyrosine kinase
  Pfam module annotation: Pfam domain module=Pkinase::Pkinase_Tyr; Domain location=91-294::91-294
MGCCLSKKGSEPEEHIGYRHVAGAGGAGVYNNHKSHEPFATQTKPPPHQPYQLPEKHAPPQAPWRPPPSPKHVHNHDTITGKPFEDVKQHYTLGKELGRGQFGVTYLCTENSTGLQYACKSISRRKLVSRADKEDMKREIQIMQHLSGQSNIVEFKGAFEDKQSVHVVMELCAGGELFDRIIAKGHYSERAAASICRQIVKVVNTCHFMGVIHRDLKPENFLLSSKDDKGLLKATDFGLSVFIEEGKVYRNIVGSAYYVAPEVLRRSYGKEADIWSAGVILYILLSGVPPFWAG

SEQ ID NO: 190096 - protein, 47 aa, Glycine max
  Coding DNA Sequence Number=SeqID_73318
MKYYRVFAKKNEKVIGNKWDTYLDLLQSDYSEGSFFSPDMGLLRQNS

SEQ ID NO: 190097 - protein, 184 aa, Glycine max
  Coding DNA Sequence Number=SeqID_73319
  Gene Ontology: Mol. function=DNA binding; Biological process=DNA integration
MEMARCMMHEKGLPKKFWVEAVNTAVFLLNRLPAMEAQGKTPFESWYGHKPFVQNFTVFGLFVFLMCQRTKINADGSINKHKARLAEKRYAQEEIYVEQLEGFAIKGQENKILEKWLSFSKWKSNIKETFVSQKKYAKESLKKFLMENYKVGGSLDDTKSSSDYYFTFGFGVFCWTSKKQDILA

SEQ ID NO: 190098 - protein, 180 aa, Glycine max
  Coding DNA Sequence Number=SeqID_73320
  Gene Ontology: Mol. function=metal ion binding; Cellular component =nucleus; Biological process=multicellular organismal development
  Homolog annotation: Hit_ID=Q9LDT3; Match level="QueryCoverage=99%, HitCoverage=81%, E-value=7e-46, Identity=52%"; Hit description=Axial regulator YABBY4
  Pfam annotation: Domain name=YABBY; Domain location=1-130; Score =159.1; E_value=1.2e-44; Accession=PF04690.4; Description=YABBY protein
MVVTVKCGHCTSVLSVNMMKASFVPFHLLASLSHLEPKESSSEQDANKTLKRHNASMMTYSDCEEEDAIPMSNVVNKPPEKRQRTPSAYNCFIKEEIKRLKAENPDMAHREAFSTAAKNWANFPPTQCKEDEESCSSQTDQHVDLDSQVDPNAVVNEEEGQGLRGRKVPKNSILERTPFE

SEQ ID NO: 190099 - protein, 213 aa, Glycine max
  Coding DNA Sequence Number=SeqID_73321
  Gene Ontology: Mol. function=nucleic acid binding
  Homolog annotation: Hit_ID=Q1RVR4; Match level="QueryCoverage=73%, HitCoverage=49%, E-value=2e-13, Identity=30%"; Hit description =Peptidase aspartic, active site; Aldehyde dehydrogenase
MELEAHFKEAEKEGNPEVELRSRPLVAGYKCPKKNLKFLILEEDEWINNEGEITRLEGELENTFDNIEKNRLSVNGWTYQFAQLVDLLNHKYHDFISQELVQQLGLKVTPTQTYGLRLSDGNKKNAQGCCEQMEVQLGQMTITEKLFLFDLGGVYVILGIAGLKKLGDVKQGQLVKIQVQYGGSIDVAPFGACRPWIFFINGVLCFLKIMAAE

SEQ ID NO: 190100 - protein, 183 aa, Glycine max
  Coding DNA Sequence Number=SeqID_73322
  Homolog annotation: Hit_ID=Q1RYI2; Match level="QueryCoverage=40%, HitCoverage=11%, E-value=6e-08, Identity=37%"; Hit description =Ribonuclease H
MIPIWSSIIKSKYGCGFLLSPSVNINGSGSNFWRDLFSTRDLFCNNTICILGDGTFIKFWHDLWVQNYGSLMSNSLMDILEEMLDEPVADYVNHEIERSMDCEEAQFTALESSVAALKTTTRELKVTTTKFQKLSKKQTEVIAKVSKQCDDIKDLRKMMKMLMEQKGIMYNDTKNASMEQNNG

SEQ ID NO: 190101 - protein, 157 aa, Glycine max
  Coding DNA Sequence Number=SeqID_73323
  Gene Ontology: Mol. function=RNA-directed DNA polymerase activity; Cellular component=chromatin; Biological process=RNA-dependent DNA replication
  Homolog annotation: Hit_ID=Q1T2D5; Match level="QueryCoverage=77%, HitCoverage=9%, E-value=7e-24, Identity=40%"; Hit description=Chromo
MGPKSTLRLMRTLGSSLASLAQSTWSLLSNALAGASWEDHLQNLRTILATLVQHEFTANLKKCSFGQQEIEYLGHIISAKGVAMDTRKIKVELQWSLPKSVKSLRGFLGLAGRESSQAFYQLKQALTTALVLAMLHFSQPLAIKCDASGKGIRVVLS

SEQ ID NO: 190102 - protein, 234 aa, Glycine max
  Coding DNA Sequence Number=SeqID_73324
MPTRLNPKLSTRYYGPYRVVKKVGAVWENSRLRQNCQRNYKLNNKGYNRNKFWEQECLVQQEQKFHKQEESSTVPKQLLRYNRKNKREPEKCHGVVREDSALPCVKSERTSNNSESFISACTIMCGFLYASILPLVAVQYNINSFITNCRNLPFCGCRNMPFCGRAKARLTGALSKGGKMRGVATNEGISTSYVDKSGALAPTYPPSKRKPDLRSSFLRVNHTISFYLKGDHLK

SEQ ID NO: 190103 - protein, 155 aa, Glycine max
  Coding DNA Sequence Number=SeqID_73325
MGQKVVKRKIKDKGDGTSSPIVDLSGMEATIREEIVATKKLAKKKEMKNVTLLYEILMKDTSTMSKEQYKKHKITFVIKAVITKLVVFNVVVVILAIIKLHSLAKWIETLTSIDFGDKNIDGTLEDNDKEEIMREAVSTKVSNEEAVVPSNCRCS

SEQ ID NO: 190104 - protein, 122 aa, Glycine max
  Coding DNA Sequence Number=SeqID_73326
  Gene Ontology: Mol. function=2-C-methyl-D-erythritol 2,4 -cyclodiphosphate synthase activity; Biological process=terpenoid biosynthetic process
  Homolog annotation: Hit_ID=Q681X6; Match level="QueryCoverage=91%, HitCoverage=34%, E-value=4e-13, Identity=31%"; Hit description=MRNA, complete cds, clone: RAFL21-92-C23
MAPDTTALSYWLNWRFFLCALFILLTMGLASFLIWKYEEFNKSRNERRERQRETAGSLYEYEAWNTCLKGIHPAWLLAYRIISFLVLFSLLTANVVADGGGIFYFYTQSIVRVVEEHFLCSL

SEQ ID NO: 190105 - protein, 205 aa, Glycine max
  Coding DNA Sequence Number=SeqID_73327
  Gene Ontology: Mol. function=receptor activity; Cellular component =intracellular; Biological process=small GTPase mediated signal transduction
  Homolog annotation: Hit_ID=Q1S160; Match level="QueryCoverage=88%, HitCoverage=70%, E-value=9e-86, Identity=86%"; Hit description=AAA ATPase; Small GTP-binding protein domain
  Pfam annotation: Domain name=Arf; Domain location=9-138; Score=-74.5; E_value=0.00051; Accession=PF00025.11; Description=ADP-ribosylation factor family
LRDGSTHQGTVTSMEPNEGTFILHNEKTRKGKIKPVHVVDVPGHSRLRPKLDEYLPQAAGIVFVVDALDFLPNCRAASEYLYDLLTKGSVVRKKIPVLILCNKTDKVTAHTKEFIRKQMEKEIDKLRASRSAISAADIANEFTLGVPGEPFFFTQCSNKVTTADASGLTGEISQLEEFIREHNCLDKKRQKREKGVLGWGLGCSE

SEQ ID NO: 190106 - protein, 91 aa, Glycine max
  Coding DNA Sequence Number=SeqID_73328
MGLSGACITTYGAFHAILVHCFVNINKGCDQVFCIDPLFVRRQRVIACRVMYANRVCDPGLVVCRQCPKRALVVQVHGRYNTVKSCFGASN

SEQ ID NO: 190107 - protein, 123 aa, Glycine max
  Coding DNA Sequence Number=SeqID_73329
  Gene Ontology: Mol. function=double-stranded RNA binding; Cellular component=intracellular; Biological process=RNA processing
  Homolog annotation: Hit_ID=Q9LTQ0; Match level="QueryCoverage=69%, HitCoverage=24%, E-value=1e-09, Identity=41%"; Hit description =Similarity to CAF protein
MASSKFPAIIIAMLESACDKLNLELDGIDEALDLVNEGMGIVADVVVEATADCNAGELLGANVGGTEGGELAGIEIRVSEKQVVVHPLMMARLKTRALRTHPCTPRRVASDNESEIQEWKHHE

SEQ ID NO: 190108 - protein, 88 aa, Glycine max
  Coding DNA Sequence Number=SeqID_73330
  Homolog annotation: Hit_ID=Q5VMT5; Match level="QueryCoverage=88%, HitCoverage=5%, E-value=2e-19, Identity=56%"; Hit description =Putative Spo76 protein
MKPFFGAIVMPELLKHQDSDIKLIVAACLYEITQITAPEAPYNDDFLKDIFQLIVGTFSGLSNTSGSSFDQRVAILERVILNEVILFT

SEQ ID NO: 190109 - protein, 318 aa, Glycine max
  Coding DNA Sequence Number=SeqID_73331
  Gene Ontology: Mol. function=ribonuclease H activity; Cellular component=extracellular region; Biological process=RNA-dependent DNA replication
  Homolog annotation: Hit_ID=Q1RYI2; Match level="QueryCoverage=98%, HitCoverage=62%, E-value=1e-52, Identity=30%"; Hit description =Ribonuclease H
MNQAMLMKVSWNMCTRPNNLWVRMMPSKYKCEDDVLPVIDQHRQGTNLWQGIVKNWEHFKPNLIWRIGNGRQVRFREDYWVPGSSAHHDYVEWDKVVDGKFSTLFKGVWHWDGPDLIKFHLWKICQEILPTNALRVHQHMAMDDKCPVCNLHPESLHHALRDCKWMWVTGLLQTWLKLSLHNIMWNTVFGVILDRLWWRRNEWVFRNKLRDTNAVVMNVKSFLCDWNNNKKLQQNLTPDYINVSIEEAERWKRPLEGFAKVNCDGALHHIAAIASCGAVLHNDDGVFMQAYSRRLGHCSILEVELWAIFHGLNMVGNY

SEQ ID NO: 190110 - protein, 193 aa, Glycine max
  Coding DNA Sequence Number=SeqID_73332
  Homolog annotation: Hit_ID=UPI0000E478AA; Match level="QueryCoverage =55%, HitCoverage=26%, E-value=2e-13, Identity=33%"; Hit description =PREDICTED: similar to cortical granule protein with LDL-receptor -like repeats
  Subcellular localization annotation: CTP_CleavageSite=41; ConfidenceScore=5.34e-01
MSLPPEGYTSSPPEGCTSSPSEGFTSSTLEGFTSSPLECCTSSTLEGCMSSPSEGCTSSPSEGCMSSPLEGCTSLPSKGCTSSPLEGSRSSPSEGYTSSLSEGSTPAPSENSRDRAHKTPSGPEEVQQGPKFYKVPVAPSKVIMPPINRAFIEKYCTPKQAQARHRSSLGMASNGQQTHRHHLQSPPQLIYNG

SEQ ID NO: 190111 - protein, 183 aa, Glycine max
  Coding DNA Sequence Number=SeqID_73333
  Homolog annotation: Hit_ID=Q1SKD7; Match level="QueryCoverage=91%, HitCoverage=40%, E-value=9e-12, Identity=28%"; Hit description =Ankyrin
MAPKKLSTKRSRRDATGEGSSAALEFDSHHFRSAKHQQRFDANRGWSFHRERRVQLREDEYTDFQEEIARRNWTSLLTPMTKFDPKIVLEFYANVWPTEEGVRDMRSWVRGHWIPFDPDALSQFLGDPLILEEGQQCEFSQRRSQADGYDEEGFCPDHCREASADHAHQHDYLDPDMCRCNWL

SEQ ID NO: 190112 - protein, 93 aa, Glycine max
  Coding DNA Sequence Number=SeqID_73334
  Subcellular localization annotation: CTP_CleavageSite=53; ConfidenceScore=5.01e-01
MHTRKALGYLLYIPMYMGDGGNVMCPTISKPTLGLRPSHKTLLSQRALRGRARARLTGALSKGGKMCGVATNVDKSGAFAPTYPPLERKSDLR

SEQ ID NO: 190113 - protein, 42 aa, Glycine max
  Coding DNA Sequence Number=SeqID_73335
MEMRMCATIFILRGKSAEKQPKRSDMNPHSTKADLGSSRIKP

SEQ ID NO: 190114 - protein, 76 aa, Glycine max
  Coding DNA Sequence Number=SeqID_73336
  Gene Ontology: Mol. function=aldehyde dehydrogenase [NAD(P)+] activity; Cellular component=mitochondrial inner membrane; Biological process=aldehyde metabolic process
  Homolog annotation: Hit_ID=Q1SCN9; Match level="QueryCoverage=87%, HitCoverage=13%, E-value=3e-25, Identity=85%"; Hit description =Aldehyde dehydrogenase (NAD) family protein
MAEEIFGPVLPIITVEKIEESVEFISSRPKALAIYAFTKNQTLQRRLVSETSSGSLVFNDAILQYISGGGDIRCVR

SEQ ID NO: 190115 - protein, 211 aa, Glycine max
  Coding DNA Sequence Number=SeqID_73337
  Homolog annotation: Hit_ID=Q1RXW3; Match level="QueryCoverage=65%, HitCoverage=20%, E-value=2e-07, Identity=28%"; Hit description=Zinc finger, CCHC-type
  Pfam annotation: Domain name=zf-CCHC; Domain location=121-138; Score =23.7; E_value=0.00012; Accession=PF00098.13; Description=Zinc knuckle
MGYHYWKTRMQIFIEAIDLNIWEAIEIGPYIPTMVVGNATIEKPREQWDEEERRKKNKGIALKASSSIQEESDKEDLNEIKEDDGFNFFVNRFNKFLRNKGNQRRINFNSKKRGEDSSSVPKCYECNQPEHLRVNCPSFKKRMEKTDRKTFKDKKAKKAYITWEDNDMDSFKESENEVVNLSLMTKNYKSEEENFKMHSMTYIKNQSNLPN

SEQ ID NO: 190116 - protein, 258 aa, Glycine max
  Coding DNA Sequence Number=SeqID_73338
  Gene Ontology: Mol. function=RNA-directed DNA polymerase activity
MEILPTFGHNHGFVQQQIHMFSICSPLELEALKVGTLINHEQGCWRLDIIDQILNEDDKQVVISHALFQVFEYNEYKLVWHLTSSGEYTIKLAYHHLLEKMIQNQGLRISGNWMHIWKLQIPPKVKYKLQNQALVPTQARFQTKVHPQQSISRALQFLHKWKHARKSQLHSTPHTPQHAPNMKKPQIGFWKCNVDAAIFTSSNKFGVALCLSDHHGQFIQAKCICTDGTLEPKEVEAWGLLHALSKTGKLRKENIIIA

SEQ ID NO: 190117 - protein, 986 aa, Glycine max
  Coding DNA Sequence Number=SeqID_73339
  Gene Ontology: Mol. function=transferase activity, transferring phosphorus-containing groups; Cellular component=membrane; Biological process=two-component signal transduction system (phosphorelay)
  Homolog annotation: Hit_ID=Q9FT60; Match level="QueryCoverage=99%, HitCoverage=99%, E-value=0.0, Identity=55%"; Hit description =Histidine kinase-like protein
  Pfam annotation: Domain name=HATPase_c; Domain location=479-676; Score=138.5; E_value=1.8e-38; Accession=PF02518.16; Description =Histidine kinase-, DNA gyrase B-, and HSP90-like ATPase
  Pfam annotation: Domain name=HisKA; Domain location=368-433; Score =80.0; E_value=7.5e-21; Accession=PF00512.15; Description=His Kinase A (phosphoacceptor) domain
  Pfam annotation: Domain name=PAS_4; Domain location=227-334; Score =3.5; E_value=0.092; Accession=PF08448.1; Description=PAS fold
  Pfam annotation: Domain name=Response_reg; Domain location=838-979; Score=95.0; E_value=2.3e-25; Accession=PF00072.14; Description =Response regulator receiver domain
  Pfam module annotation: Pfam domain module=HATPase_c::HisKA::PAS _4::Response_reg; Domain location=479-676::368-433::227-334::838-979
MENDCIKDMDIEVVPSMWPEDIGMEVGKQFNIEKPGRDQDMLEEVTIIEEPTIVDFKRLMELTNFTEKGSSQLAYLMKQWEYKQANVVRLLREELDNLSKQRQDVELRKLEILEEHRFEEERHGADKRPVSILDDVYDGIWQDIPCRRSDVVVENKRSEIDAEYDTVMCWKQRALHSEKQLEASIQREQILEEKLQERIANIERQSSPVEELSQILKRADNFLHFILQNAPIVIGHQDKELRYCFIYNHFPSLQEEDIIGKTDVEIFTGAGVKEAQEFKREVLEKGLPAKREITFETELFGSKTFLIYVEPVFSKAGETIGINYMGMDITDQVRKRERMAKIREEIAVQKAKETELNKTIHITEETMRAKQMLATMSHEIRSPLSGVVSMAEILSNTKLDWEQRQLLDVMLSSGDLVLQLINDILDLSKVESGVMKLEATKFRPREVVRHVLQIAAASLQKILTLEGHVADDVPIEVIGDVLRMRQILTNLISNAIKFTHEGKVGINLYVVSEPTFAKAECIQKMTSSHSTISVNGVKEEKYLSKPQSDSDRNLLDGCQKHDDHPSQNHAFHEECRSPVKSECSMNGDTEEQPNSAETTVWIRCDVYDTGIGIPEDAIPTLFKRYMQVSADHTRKYGGTGLGLAICKQLVELMGGQLTVSSKEHYGSTFTFILPYKVSIACDHSDDLDELSDVENNDAASDDTIESFFQFQPRTLGSLFSSNGSSRTHKLLTHKIGYTSSHKLGGFSESLYSFPSNDIMSKGTCSADDASSVVEVPEMSESASSSGHSQKTKSNGEMSEAKSNELQQTTCQGHGKTNTTFQCVTNSSVSEVTKSTIIPKILLVEDNKINVMVTQSMMKQLGHSIDVVNNGVEAVRAVQRHTYDLILMDVCMPVMNGLQATKLIRTFEETGNWDAARNAGIEQSVQDPDCECSVPSTKRIPIVAMTANALSESAEECFANGMDSFVSKPVAFQKLKECIEQYLVNFS

SEQ ID NO: 190118 - protein, 65 aa, Glycine max
  Coding DNA Sequence Number=SeqID_73340
MLSYYSWHIENVLRVVKHCKEKFYEVQGYLHMFLCHDDLYLAGLVVVEAEAVDAGCGGGGRRGKH

SEQ ID NO: 190119 - protein, 371 aa, Glycine max
  Coding DNA Sequence Number=SeqID_73341
  Homolog annotation: Hit_ID=Q69J07; Match level="QueryCoverage=77%, HitCoverage=78%, E-value=5e-17, Identity=26%"; Hit description=Kelch repeat-containing F-box-like protein
  Pfam annotation: Domain name=Kelch_1; Domain location=129-175; Score =27.4; E_value=5.1e-05; Accession=PF01344.15; Description=Kelch motif
  Pfam annotation: Domain name=Kelch_2; Domain location=129-175; Score =20.7; E_value=0.0053; Accession=PF07646.5; Description=Kelch motif
  Pfam module annotation: Pfam domain module=Kelch_1::Kelch_2; Domain location=129-175::129-175
MSSTAEAPIHGDILEAIFSHVPLIHLVPASHVSNSWKRAVSSSLAHVRPIKPWLIVLTQSLRHSHVTTLHAYDPRSHVWLQIKNTARSHASPVRSSHSTLFYALTPSEFSFSLDALHLKWHYAPSPRVWRTNPVVARVGSRVVVAGGACEFEDDPLAVEMYDVNSQAWEACPSMPALLKSSTASSWLSVAVAGEIMHVTEKHSGVTYSFETISKTWKGPFSLRPHESVFHCVTGTLGERLMVAGLIGKVGNVKGVKLWEVRVRGGLGSGMEEVGEMPKEMVRKLFSGSELGSVEVTWIGDFVYVRNTSEPEELVLCEVLNHLNGVGCEWRSVRNAAVRCGARMVFCGGSVCMEDLQRAVMSENPTFSMKHV

SEQ ID NO: 190120 - protein, 189 aa, Glycine max
  Coding DNA Sequence Number=SeqID_73342
  Homolog annotation: Hit_ID=Q1SAV4; Match level="QueryCoverage=29%, HitCoverage=14%, E-value=3e-09, Identity=53%"; Hit description =Integrase, catalytic region
MVSRLLVGLLLGEQPYPQGCRSPRALPNVPTWCPQVDAQTIEPVPAWSGEWLFCPISCLESSWLSQATGGRECFGRRHPRESIEVDLRKWCCVINTSWWLHIWVVQVRGFVVVGDEKMEARLAFVAYDPLLVTLGWVRWKQLVEKMKGEQGCESNSNGPIICLPEAWREPPPEAKKEVGTFELPSAVPG

SEQ ID NO: 190121 - protein, 131 aa, Glycine max
  Coding DNA Sequence Number=SeqID_73343
  Homolog annotation: Hit_ID=Q6ZI86; Match level="QueryCoverage=41%, HitCoverage=18%, E-value=7e-15, Identity=70%"; Hit description =Dehydrogenase-like protein
MLEQAWAYLVGPGFHSKLDSVFWAKAKSRGSLRIKYAIITGPVREVEVGIEPHIGRRGVSGKSATVVSISGRNLCTDSNKVDGPFKVEEAETVNVPPLPTEKLLVLGGNGFVGSHICREALDRDLSVASLS

SEQ ID NO: 190122 - protein, 109 aa, Glycine max
  Coding DNA Sequence Number=SeqID_73344
MFFHHGHFVELQGENATTSGLLPQHQFCHLCRNNEDVSYFHIAGFPEAPPDSLPIDSPGSDREAYNNRRQRVDGAISRSPSTNRSNTSKGGAGGANNNKQEENGEACLP

SEQ ID NO: 190123 - protein, 120 aa, Glycine max
  Coding DNA Sequence Number=SeqID_73345
MRRKVFGAKLPDKEFKRIWAKWVKSGSGVGFGSRVGSIGSILGQLGSLSSATRRKALEVQQCPLGYRSSQVKHNPRSRWKMGSSNVKGFTMGGGDGGGDGKRGESVMGRGGGGMIGGGSR

SEQ ID NO: 190124 - protein, 261 aa, Glycine max
  Coding DNA Sequence Number=SeqID_73346
  Gene Ontology: Mol. function=helicase activity; Cellular component =membrane; Biological process=viral genome replication
  Homolog annotation: Hit_ID=Q1SN45; Match level="QueryCoverage=71%, HitCoverage=11%, E-value=5e-59, Identity=59%"; Hit description=AAA ATPase
  Pfam annotation: Domain name=DUF889; Domain location=1-105; Score= -8.6; E_value=6.4e-11; Accession=PF05970.5; Description=Eukaryotic protein of unknown function (DUF889)
MEYLSSDYIEKSETIGSWHFQSITTEFLNSLNTSGLPNHRIKLKIGSPIMLLRNLDQTQGLCNGTRLIVTRLAKHVIAAEIISGKNLGDNVYIPRMSMSPSQSSWPFKLLRRKFPIKLSYAMTINKSQGQSLSMVGLYLPKPVFSHGQLYVALSRVNSRQGLKVLIHDKDQKNMTSTTNVVFKEVFKNLTRHGIIKKYHIIPPLQYIKNQILTSNSRSWPNAHNQAQDKSTRLLPYNTNELKLLFRTKTLHLLRTSSIHNY

SEQ ID NO: 190125 - protein, 78 aa, Glycine max
  Coding DNA Sequence Number=SeqID_73347
  Subcellular localization annotation: CTP_CleavageSite=43; ConfidenceScore=5.18e-01
MSSCAQRVISSLSEKIVSSALSAIMALSQISLTRAKRKVGAKGAFAKKNPFLSLNCREWREEVLPCNGGLESFVGKFR

SEQ ID NO: 190126 - protein, 520 aa, Glycine max
  Coding DNA Sequence Number=SeqID_73348
  Gene Ontology: Mol. function=hydrogen ion transporting ATP synthase activity, rotational mechanism; Cellular component=proton -transporting two-sector ATPase complex; Biological process =intracellular signaling cascade
  Homolog annotation: Hit_ID=Q69T67; Match level="QueryCoverage=59%, HitCoverage=40%, E-value=1e-118, Identity=57%"; Hit description =Lustrin A-like
  Pfam annotation: Domain name=DUF231; Domain location=316-482; Score =211.6; E_value=1.8e-60; Accession=PF03005.6; Description=Arabidopsis proteins of unknown function
  Subcellular localization annotation: CTP_CleavageSite=22; ConfidenceScore=5.45e-01
MDSSKRLTFSEPFMSQGRKVISGFSLGVGVSLLFLTLILLNSTSLSVPKVQVFLQGSDSNSTSSFSWRFPFTTALSSNGSVSSLHRVDVRVSSSEGSEKTLLGNLTGDQKNASLYDGHEEDEHCCSLKNVTLAGKENAHVGNSSCNGDGVGKCEDGLLFKESNNDSVSVGGLLGECDIFDGKWVRDEFKPYYPLGSCPNVDRDFDCHLNGRPDSDYVKWKWQPNGCDIPSLNATDFLEKLRGQKLVFVGDSLNRNMWESMDYNCSVDFVSSPFIVQESTFKGINGSFETLRLDLMDQTSTTYHDADIIVFNTGHWWTHEKTSRGEDYYQVGNHVYPRLKVLDAYTRALTTWARWVDKNIDANRTQVFFRGYSVTHFRGGQWNSGGKCHKETEPISNGKHLRKYPSKMRAFEHVVIPKMKTPVIYMNISRLTDYRKDGHPSIYRMEYKTAEERTAAEQHQDCSHWCLPGVPDTWNELLPLEKLSKTPHPISDSLYIFNKCIFIDFPHLDVHLKGSLEFSLC

SEQ ID NO: 190127 - protein, 57 aa, Glycine max
  Coding DNA Sequence Number=SeqID_73349
MTDVETLVLLFEESNDVEYGNFYISGDVGTDVVSCAFYIVFHKATMLNMGTSTSVVT

SEQ ID NO: 190128 - protein, 93 aa, Glycine max
  Coding DNA Sequence Number=SeqID_73350
MVQRKDNELRGSSNEIVGGYHKWLKARMQELDWLPKLKVSSEEEAETPKESEEAQAVKERFKTMAIKVQKECNELRDVNVATAEALEQETKRA

SEQ ID NO: 190129 - protein, 94 aa, Glycine max
  Coding DNA Sequence Number=SeqID_73351
MVIDKLPDSQKQDAKKITCLRLQLSLTCITLLKNTKKNDLMYESISELQKKIKKTNMDICALTMLYDRRKGYKSKIPPLQRSLRSYSGWTRKIT

SEQ ID NO: 190130 - protein, 194 aa, Glycine max
  Coding DNA Sequence Number=SeqID_73352
  Subcellular localization annotation: CTP_CleavageSite=46; ConfidenceScore=5.44e-01
MATCPRLQRTACPCLQRTACPRLQRTTCPRLQRAARPRLQRTTRPRLQRVGTVVSPYQSLGHPPDLGGGPTMRAQPEGGYRAATMHTGARFHPSAARRRVWIMSTNMTTLTQIWMMLLLRNILPSDHNVNLPLPKYQLGRTHKTHSGPGGAQQGPGVSNSGYGPLSVLQGGRPPKQGIAHARHLVDPEKSNRVS

SEQ ID NO: 190131 - protein, 307 aa, Glycine max
  Coding DNA Sequence Number=SeqID_73353
MERGIFFNDPQTIYPKLIRMFWRNVEFANKKIIVFKVLGTDVTFSRNSIAKEIGCLIEGNTYQDGWEKNYDYDISRVHYKENVEKAGDQKTIVYNLMYERAKMWANILSKSVLHNKTNLKATKVALEKTLKEAPHMDLDAINKIKQKRLAKEITDEDRGLNSFCIAKKIQKIMTEHHKKKKTSKQSEKEGEEKLIAREQGTNKHHVQTKNKGLVKIALQKRKAGVQAALPQREPRPSKQLLKSENLYFLLPFPDVLRPGTQNSTLILVRRNGQSPSLETRRTQPHLSQIVSLLTKLLSFLSGSVQIP

SEQ ID NO: 190132 - protein, 73 aa, Glycine max
  Coding DNA Sequence Number=SeqID_73354
MKLETNLLEFLDFKEVFDVDGWLIICVYGGNLYNWNNLGRKGVRGGHCREFESLKVIEAVPESNKHENAVTRK

SEQ ID NO: 190133 - protein, 196 aa, Glycine max
  Coding DNA Sequence Number=SeqID_73355
MDEIEKVQEQMKADTEALKEKMATMVMMSIKEIVEVSATYQTRARARVMGEVEKVQEQMKADIEAMKEQMATMMEAIISMKKIREVDTVVVAATSAVAKVNPMPPSGLNQMNHPTLNMVGKDLGSTDGPMMCKFKTSTPSHHMACLPTIHHPMWHTLSMKISITPLRYSLRTNNLNLIRHISLKPWGRHMKFPTTI

SEQ ID NO: 190134 - protein, 36 aa, Glycine max
  Coding DNA Sequence Number=SeqID_73356
MGPFDTCHSSIGFLQLFRRSAGPPNLTLSAVRVKDF

SEQ ID NO: 190135 - protein, 58 aa, Glycine max
  Coding DNA Sequence Number=SeqID_73357
MDEIHYRRPLEDTDESKDLIKQVAPKGNPPHGIHESQLVRRLFYRQPAHLEYSDSFKI

SEQ ID NO: 190136 - protein, 246 aa, Glycine max
  Coding DNA Sequence Number=SeqID_73358
  Gene Ontology: Mol. function=metal ion binding; Cellular component =nucleus; Biological process=red or far red light signaling pathway
  Homolog annotation: Hit_ID=P93471; Match level="QueryCoverage=79%, HitCoverage=29%, E-value=4e-98, Identity=92%"; Hit description=E3 ubiquitin ligase protein COP1
  Subcellular localization annotation: CTP_CleavageSite=66; ConfidenceScore=5.29e-01
MYPPLELIHKRCTLSCSQSTTQVDVPSTCTTKDVPSNVLRQTSQTLLKKTSARQISKTASPVEHFRQALQKGCDVSIKELDTLLSLLAEKKRKMEQEEAERNMQILLDFLHCLRKQKVDELKEVQTDLQFIKEDINAVEKHRMDLYRARDRYSVKLRMLDDSGGRKSWHSSMDKNNSGLISSPLNLRGGLSSGSHTKKNDGKSQISSHGHGVQRRDAITGSDSQYINQSGLSLVRKKRVHTQVFLV

SEQ ID NO: 190137 - protein, 176 aa, Glycine max
  Coding DNA Sequence Number=SeqID_73359
  Gene Ontology: Mol. function=chitin binding; Cellular component =extracellular region; Biological process=chitin metabolic process
  Homolog annotation: Hit_ID=UPI000044A8F0; Match level="QueryCoverage =89%, HitCoverage=99%, E-value=6e-26, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHTLAFRGLHTLAFIGLHSLTVKGLHAIAFRGLHVLAVRGLHVLAFRGLHVLAFRGLHALTFRGLHVLAFRGLHALAFRELQALAFRGLHVLAFRGLQVLAFKGLHVLAFRELHILTFRGLHALAFRGLHVLNFRGLHAFTFRGLHVLAFRGLHALAFGGSKSAPLENSKSSTLNA

SEQ ID NO: 190138 - protein, 101 aa, Glycine max
  Coding DNA Sequence Number=SeqID_73360
MVEREKFDHIEERLRVIKGGRNYAFVDMAQLCLVPDVVIPPKFKVLDFDKYKGTTCPKNHLKMYCRKMGAYAKDEKLLMHFFQKSLTGPVVTWYTNLESSW

SEQ ID NO: 190139 - protein, 65 aa, Glycine max
  Coding DNA Sequence Number=SeqID_73361
MGPKSTIRLMRTVRQPASALDHASSIKRIIVVKHHPQIPLVGLNLTRTALRHNITKTKLSYLDVS

SEQ ID NO: 190140 - protein, 60 aa, Glycine max
  Coding DNA Sequence Number=SeqID_73362
MKVELAILCVGGVAGGPSPWRNVRRCIQKSDTLFIRVKQLNTLSPIRGGNDYEIIKGQHI

SEQ ID NO: 190141 - protein, 118 aa, Glycine max
  Coding DNA Sequence Number=SeqID_73363
MPNPAKFITETSISRLAGVTSTNWGNEACVDGGVGFVCELLVQDVVEYRSEPDHEMWRDSYLIRVHDIERRMREVEGKRLCVLENLTTLGFLLTIVNAHNRAQYWSKMKLRDTHKIGF

SEQ ID NO: 190142 - protein, 122 aa, Glycine max
  Coding DNA Sequence Number=SeqID_73364
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q8S8Z0; Match level="QueryCoverage=78%, HitCoverage=30%, E-value=8e-34, Identity=76%"; Hit description =Protein phosphatase 2C
LLKQYVVADPEIQEEKVDSSLEFLILASDGLWDVVSNEEAVAMIKPIEDAEEAAKRLMQEAYQRGSADNITCVVVRFLMNQGGSKELVAYPHNSSSAGKNPSVEEKSEPNIITKHNSNINFS

SEQ ID NO: 190143 - protein, 115 aa, Glycine max
  Coding DNA Sequence Number=SeqID_73365
MVFNKRWRSEISIVFEVKQRVQSKLQSLLMINKVEGNPRGDVSKDMSCVASCGEVLRDHASGFVLAFARKIGISPMMFAKLRTIQFGVQLSCDKGFSVVEVESDSQEAIKLILRV

SEQ ID NO: 190144 - protein, 210 aa, Glycine max
  Coding DNA Sequence Number=SeqID_73366
  Gene Ontology: Mol. function=protein kinase activity; Cellular component=plastoglobule; Biological process=protein amino acid phosphorylation
  Homolog annotation: Hit_ID=Q2JNP9; Match level="QueryCoverage=71%, HitCoverage=24%, E-value=3e-36, Identity=50%"; Hit description=ABC1 domain protein
  Pfam annotation: Domain name=ABC1; Domain location=101-209; Score =104.2; E_value=3.9e-28; Accession=PF03109.7; Description=ABC1 family
MRRESLESKFGHALGTYSSKSFNAIYRFGPFLALYRATIISFHVLRLMIWQLFVQDMGKRAVKALSTRPDILPTVYCQELAKLQDQIPPFPTDVAIKSIENHLGVPINEIFKDISPAPIAAASLGQVYKAHLHSGELVAVKVQRPGMSLSLTLDALLFNMIGGQLKRFAKARKDLLVAVNEMVRHMFDEIDYVLEGKNAERFASLYCWSA

SEQ ID NO: 190145 - protein, 50 aa, Glycine max
  Coding DNA Sequence Number=SeqID_73367
MAREQHTPTRPWIQDAVPLLVVLLIAAHVLAMEACVMEWEIPDYRQGIVP

SEQ ID NO: 190146 - protein, 204 aa, Glycine max
  Coding DNA Sequence Number=SeqID_73368
  Subcellular localization annotation: CTP_CleavageSite=35; ConfidenceScore=5.07e-01
MGKFVGCSDQRKQASKFSGKHGKTVNTNCLRKCIAAATNKSWLNAEESATSGVKYARHLTVGTEPPLGIGLTLYDLGTIRSISCLHYYNTPSTPYNFSIILFHFPVHTFANADRHVAAEPATGEGSDQDLRGIDELEHEKSHPATEPTPERSLPTQRVVRLTCAKTCSTAAGSGGRGRDAVTQRDGAAGESEEFGDATMGCRWQ

SEQ ID NO: 190147 - protein, 179 aa, Glycine max
  Coding DNA Sequence Number=SeqID_73369
  Gene Ontology: Mol. function=oxidoreductase activity; Cellular component=vacuole; Biological process=hydrogen peroxide catabolic process
  Homolog annotation: Hit_ID=O81772; Match level="QueryCoverage=75%, HitCoverage=55%, E-value=2e-34, Identity=44%"; Hit description =Peroxidase 46 precursor
  Pfam annotation: Domain name=peroxidase; Domain location=2-160; Score= 26.8; E_value=1.5e-10; Accession=PF00141.13; Description=Peroxidase
LAVNFLDEMDHFIICRDVSLMLQGNNTEQSDPGNRSVGGFSVIDSAKRILEKFCPRTVSCADIIALAAGDAVEIAGEPRTMIPTGAHTIGTAHCSSFRDHFQEDSKGNLRLIDKTLYSDYANELMKQCPAGVQPSVTVNNDPETSKGPITRTMSKRLQEDWARAAEEGPRVLMNLRVDF

SEQ ID NO: 190148 - protein, 183 aa, Glycine max
  Coding DNA Sequence Number=SeqID_73370
MAAEWRRKRERRRHFKEKMSLEEAHHHRRPWIRTWRKKEMNEGRGREEHEILCSKGALKSESRCLKIQGLKNPIFLGYPTYNMEPYIQGPNIMTSQSNMYKDNWTQPWPMGSEIYPKVHENPRAFFSSSSPIFLEPLAHGSCDWSLPREDCIMLSKTFEVSGSLFTVTDGWTPAGHCFISSLA

SEQ ID NO: 190149 - protein, 214 aa, Glycine max
  Coding DNA Sequence Number=SeqID_73371
  Gene Ontology: Mol. function=translation initiation factor activity; Biological process=translational initiation
  Homolog annotation: Hit_ID=Q1SQK2; Match level="QueryCoverage=80%, HitCoverage=43%, E-value=3e-32, Identity=68%"; Hit description =Translation initiation factor eIF-3b
MAINIDTEKIEASKCCPAGTGSTIIPNTVNKYMPRNYKYYGDENDVQEDNLKFDIGFGHIIVVPPYKFEKLEGVIRKIYCQIGLTIREDGFWMPVSHVTDKTLGYCFIEYNTPQEAGLAKEKTRGYRLDRSHICYVNMLNDFDRVVLNIFDVRTGKKMRNFNGSADDFATGGVTGGVSWPIFRWGGGNGDKYFARLGKNMISVYETKTFSLIDK

SEQ ID NO: 190150 - protein, 147 aa, Glycine max
  Coding DNA Sequence Number=SeqID_73372
  Subcellular localization annotation: CTP_CleavageSite=53; ConfidenceScore=5.26e-01
MPVSEASVSTMNGLSKSSRASTGALVMAVFICSNAEFAVKDQLNASLPSSELRGAANQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 190151 - protein, 92 aa, Glycine max
  Coding DNA Sequence Number=SeqID_73373
  Gene Ontology: Mol. function=RNA-directed DNA polymerase activity; Cellular component=chromatin; Biological process=RNA-dependent DNA replication
  Homolog annotation: Hit_ID=Q94HV4; Match level="QueryCoverage=98%, HitCoverage=7%, E-value=6e-15, Identity=51%"; Hit description =Putative retroelement
MTSAPVLALLDFDKPFIVETDASDTGMGVVLMQKGHPLCFDLRPGTSCNRLGRAKMASIPARAFVHHLNRSQELLRTNVTGRPNSRIALLSI

SEQ ID NO: 190152 - protein, 423 aa, Glycine max
  Coding DNA Sequence Number=SeqID_73374
  Gene Ontology: Mol. function=hydrolase activity, acting on ester bonds; Cellular component=nucleus; Biological process=multicellular organismal development
  Homolog annotation: Hit_ID=Q94K01; Match level="QueryCoverage=89%, HitCoverage=90%, E-value=1e-159, Identity=70%"; Hit description =Lariat debranching enzyme
  Pfam annotation: Domain name=DBR1; Domain location=234-367; Score =105.1; E_value=2.1e-28; Accession=PF05011.3; Description=Lariat debranching enzyme, C-terminal domain
  Pfam annotation: Domain name=Metallophos; Domain location=1-230; Score=74.7; E_value=2.8e-19; Accession=PF00149.18; Description =Calcineurin-like phosphoesterase
  Pfam module annotation: Pfam domain module=DBR1::Metallophos; Domain location=234-367::1-230
MKIAVEGCMHGDLDNVYRTLQQLEKSENTKIDLLLCCGDFQAVRNEHDLKSLNVPLKYRSMNSFWKYYSGAEVAPYPTIFIGGNHEASNYLWELYYGGWAAPNIYFLGAAGVVRFGNVRIGGLSGIYKSFDYKLGHFERPPYDHNTIKSVYHVREYDVRKLMQVKEPIDVFLSHDWPVRITDYGDWRELVRRKHYFKQEIEEKRLGSKPAAELLEKLKPHYWFSAHLHCKFAALVQHGEGGPLTKFLALDKCIPGRDFLQIVEIESDAGPYEIQYDEEWLAITRKFNPIFPLTYKGADFRGINLEMEDCLEWVRSKLQERGCKPFEFVRTAPCYDPSRSNFDGAFAVNPRNPQTESFVRLLELPYLFDRNPEAKDLSPYPSPSIQRGTAYDSEDIPIDDVADDDDDDEELPKVDNVETETSNL

SEQ ID NO: 190153 - protein, 91 aa, Glycine max
  Coding DNA Sequence Number=SeqID_73375
MEYVYFPFIITTDFLPVLIIPEDGAYGGFRRKNNMEDVALCGASRPWIFFINRVLCFLKIMAVEWRRKKDDWRRHFKEKMSQEEAHHHTKP

SEQ ID NO: 190154 - protein, 161 aa, Glycine max
  Coding DNA Sequence Number=SeqID_73376
MELLTCSIWSSIASSSPYTRNIGQEKRKVEEEDVVVAATQEDATFVQDEASKVVDNTIVHGVIIDLTNTSVMDETPEASNAAIADESTTSNKDTSIDKGEPDAIIFYSTGIGLAPLNYSQPASFTWDQVQDMIGQAMETFIKRQRQENEQFKIFMQNAITT

SEQ ID NO: 190155 - protein, 251 aa, Glycine max
  Coding DNA Sequence Number=SeqID_73377
MKGLGGLDDIYFASLIDKMLWDQWVYHVFNKMDEDSKHTLIAKGSVVAKQQKFSKNNLKAIKVDLEQSQKEAPQVDLDVINKRKQKRLAIAIADEDQALEPRVSIIPFIIPRHIKTRVTKANPKIGDKEWAVSFIGNKEDQASSSSDNESIDNTSIFPLRKHVSSTQPCPPSSPIHLERIRRVAPREPLINAQRFPLSFINGNPTPITPYSKFIYVELVEMETINVQAPTWTKYNIRIIHVRPLRLYQQMP

SEQ ID NO: 190156 - protein, 289 aa, Glycine max
  Coding DNA Sequence Number=SeqID_73378
  Homolog annotation: Hit_ID=Q1SXQ3; Match level="QueryCoverage=42%, HitCoverage=14%, E-value=3e-34, Identity=55%"; Hit description =Integrase, catalytic region
MKKFNMDDAKEMKTPMHPTTYLGLDEESTKVDGTQYKAMIGSLLYLTASRPDIIYLIGTSNLGILFNKSESFRLTSYYDADYAGDKVERKNINGSCQFIGGNLVTWICKKQGSTALSTAEAKYMSTMSTLMVLLTTLKHFIFFSEIQSLTLKLSVMATSNSPIAEIIPTLETIYSCRTLFRHLGTQKSGSKAQRDYYCARHIFNKPQTIYPELIMTFWRNAKFVNKKMIASKVLGVEVVLSNDSIAKATRCLHEGSTYQEGWEKNYESHITRELYRENDEKASDKKTTT

SEQ ID NO: 190157 - protein, 234 aa, Glycine max
  Coding DNA Sequence Number=SeqID_73379
  Homolog annotation: Hit_ID=Q1SMW8; Match level="QueryCoverage=45%, HitCoverage=7%, E-value=9e-22, Identity=56%"; Hit description =Integrase, catalytic region; Zinc finger, CCHC-type; Peptidase aspartic, catalytic
MSLEELVGTLKVREQEVQQDEGTKREKSLTLSSQKNKKASSSKEHVLRSSSKALKDNNSSEEDFDEDEFSFISHTTSDEFESNKEDEDTVEIPQKNLEMDMMERYMFMIRTPLSATSMTPIMVPEQWLLTTYDRRKVYVPISNFLSWWNNYFQRESKRKNNQSLKHNLLSISQLCDNGYNVSFNKDECVVLCKNGSPLFFAKRKGNLYKIRLGYLIDQKVSWLPSVKENPLAMA

SEQ ID NO: 190158 - protein, 464 aa, Glycine max
  Coding DNA Sequence Number=SeqID_73380
  Gene Ontology: Mol. function=RNA-directed DNA polymerase activity; Cellular component=nucleus; Biological process=RNA-dependent DNA replication
  Homolog annotation: Hit_ID=Q2HRL2; Match level="QueryCoverage=83%, HitCoverage=99%, E-value=7e-92, Identity=41%"; Hit description=RNA -directed DNA polymerase
MMNVEKINKAKELSESLVNLQELEESMLRQRAKIDWLRLSDGNNKYFHVAIKIRNQTNGIKKIMRNDGTYTTDQKAIETKVVAFYRNLMGKASGDLEGVDISAMEILIGSVTEVEITDALNGIDNDKALGLDGFGAYFFKKAWHIIKQDVIATVQDFFRNNRMYRAVNCSSVTLIPKHKGAKEIKDYRPIACCSTLYKIISKILANRLSKVLGTIVGNNQAAFVKGQKIHNHILLTYELIKGYERKRIYPRCFMQMDIQKAYDTVDWNALEKILNEVGCPQQFKNWIMIAVSTVSYRFNVNGYKTEIMEARRGLRQGDPISPMLFVIVMECLNRYLYKMQKDGDFNYHPKCDKLKITNLCFVDDLLLFSRGDKISIGMMMRAYESFSKATGLVVNPQKCRLFCAGIDAVTKREILEVSGFQEGQLPFKYLGVPAKSSTGQHNSYLMQEGYSLSIELCLHLLTIG

SEQ ID NO: 190159 - protein, 58 aa, Glycine max
  Coding DNA Sequence Number=SeqID_73381
MDKSLKVGEDEWRERERRSTKFCASNEPTNPRPSPRFSIKCAFMRHVKHEGHAQSVTI

SEQ ID NO: 190160 - protein, 138 aa, Glycine max
  Coding DNA Sequence Number=SeqID_73382
  Gene Ontology: Mol. function=protein serine/threonine kinase activity; Biological process=protein amino acid phosphorylation
  Homolog annotation: Hit_ID=Q1RZG3; Match level="QueryCoverage=45%, HitCoverage=9%, E-value=2e-11, Identity=50%"; Hit description =Protein kinase
EDRQRALLQLQLKVMSDKPKEDQEVNSKQTFSHSLCQGINTLNSNVKSDTAFKGGYYIITVFECYMVTFKDGLTTKSNKNIEALLKNHAALTLKRYRLSYIKQMTNNFKVKLGQGGFNTLYKGNLPNGSLVAIKMLNV

SEQ ID NO: 190161 - protein, 98 aa, Glycine max
  Coding DNA Sequence Number=SeqID_73383
MEGGQEVLTPIFDCRYKGFNFLEKGLKNDLETYFGKNSPFVKRRPLAKRIIVHALSCESQALSAQPLHLRLIHSTKLAKAELSQIQFDLDLAKQKPNR

SEQ ID NO: 190162 - protein, 283 aa, Glycine max
  Coding DNA Sequence Number=SeqID_73384
  Gene Ontology: Mol. function=DNA-directed DNA polymerase activity; Cellular component=intracellular; Biological process=response to DNA damage stimulus
  Homolog annotation: Hit_ID=Q8ZBZ9; Match level="QueryCoverage=68%, HitCoverage=55%, E-value=5e-90, Identity=87%"; Hit description=DNA polymerase IV
  Pfam annotation: Domain name=IMS; Domain location=96-283; Score=32.4; E_value=2.1e-11; Accession=PF00817.11; Description=impBmucBsamB family
IRRAIQHDDAVFGFLQGDPDGVGAVFQRGFDGDAGVFRRIGGAAAVGDDRRRVTGGGAGRQRAQRQRGSQQQMRKSDHVGYLFVVVVGAMRKIIHVDMDCFFAAVEMRDDPSLRDIPLAIGGSADRRGVISTANYPARRYGVHSAMSTAMALKLCPHLTLLPGRIAAYKEASLHIREIFARYTPLIEPLSLDEAYLDVTDSPQCNGSATLIAQEIRQAIADELNLTASAGVAPIKFLAKIASEMYKPNGQYVITPAQVPAFLQQLPLSKIPGVGKVTAKRLQA

SEQ ID NO: 190163 - protein, 119 aa, Glycine max
  Coding DNA Sequence Number=SeqID_73385
  Subcellular localization annotation: CTP_CleavageSite=83; ConfidenceScore=5.13e-01
GPGVSSSGYGPLSVLQGARITPAGHPVDPKKSNRVLGFPALITSLCQFYGVPVTPSKVIRPPTNRAFIKKYCAPMQAEDNKCTAATSRPPQLIHKKVRDRQVIMRPAQDVKEAILGGNL

SEQ ID NO: 190164 - protein, 217 aa, Glycine max
  Coding DNA Sequence Number=SeqID_73386
MPVRNRHPGKDRKMTLQLNPHTYSPSHRNAALSSPAQMYRKPGEMLLINAPDNAAVPATGRADFSRSSLPAHLHYLLTPRPGFSAGQHFVPEYPYMLDAALSVTARRGAVSLAPYHADSDKCALVIERQTLVKFDLPPLHDLVLSYIGLNTYFSEVRFYNCAGRIVAFRRLNASKKRHEVFCFAGMKPVSLVIETSQHSSILLDEMVWNQTVGAGAR

SEQ ID NO: 190165 - protein, 1453 aa, Glycine max
  Coding DNA Sequence Number=SeqID_73387
  Gene Ontology: Mol. function=two-component sensor activity; Biological process=two-component signal transduction system (phosphorelay)
  Homolog annotation: Hit_ID=Q1IB44; Match level="QueryCoverage=60%, HitCoverage=98%, E-value=0.0, Identity=55%"; Hit description =Putative sensory box protein
  Pfam annotation: Domain name=Acyltransferase; Domain location=62-192; Score=37.2; E_value=5.7e-08; Accession=PF01553.11; Description =Acyltransferase
  Pfam annotation: Domain name=EAL; Domain location=1207-1442; Score =377.4; E_value=2.2e-110; Accession=PF00563.11; Description=EAL domain
  Pfam annotation: Domain name=GGDEF; Domain location=1046-1193; Score =154.3; E_value=3.2e-43; Accession=PF00990.12; Description=GGDEF domain
  Pfam annotation: Domain name=PAS; Domain location=572-685; Score =34.3; E_value=4.4e-07; Accession=PF00989.14; Description=PAS domain
  Pfam annotation: Domain name=PAS; Domain location=798-911; Score =35.5; E_value=1.8e-07; Accession=PF00989.14; Description=PAS domain
  Pfam annotation: Domain name=PAS; Domain location=940-1051; Score =24.1; E_value=0.00049; Accession=PF00989.14; Description=PAS domain
  Pfam annotation: Domain name=PAS_3; Domain location=595-688; Score =19.1; E_value=0.0014; Accession=PF08447.1; Description=PAS fold
  Pfam annotation: Domain name=PAS_3; Domain location=821-914; Score =21.3; E_value=0.00086; Accession=PF08447.1; Description=PAS fold
  Pfam annotation: Domain name=PAS_3; Domain location=963-1054; Score =2.6; E_value=0.054; Accession=PF08447.1; Description=PAS fold
  Pfam annotation: Domain name=PAS_4; Domain location=579-690; Score =24.8; E_value=0.00032; Accession=PF08448.1; Description=PAS fold
  Pfam annotation: Domain name=PAS_4; Domain location=804-916; Score =30.7; E_value=5.3e-06; Accession=PF08448.1; Description=PAS fold
  Pfam annotation: Domain name=PAS_4; Domain location=946-1056; Score =7.0; E_value=0.041; Accession=PF08448.1; Description=PAS fold
  Pfam module annotation: Pfam domain module=Acyltransferase::EAL::GGDEF ::PAS::PAS::PAS::PAS_3::PAS_3::PAS_3::PAS_4::PAS_4::PAS_4; Domain location=62-192::1207-1442::1046-1193::572-685::798-911::940 -1051::595-688::821-914:...
  Pfam module annotation: Domain location=:963-1054::579-690::804 -916::946-1056
MFSVDQLLNTYWPGQQPAHWQKSLLKWAVREQEFQDFAQRYPHLKGVDMVEQVLEHLDVRCELSERDLEQIPTHGPVVIVANHPLGALDGLALLAAVSQVRRDVKIVANRMLMMLEPINNLMLPVDNMGNRTSREQLTRMQQHLDNQGALIIFPAGEVSRLSSRGVRDRHWHHSFLRLAARARAPLVPVHVVGRNSLAFYAAAKVAAPLALLMLVREMFRQRGTRIKLHIGEQIPFANWHDGHTPGKELAKRLRKHLYRIGQGRRGLFLTEAAIARPEDRAELKKALLESERLGTLPDGKQIYLWRRNGASWVPLLRELGRLREIAFRAVGEGSGRRRDLDKYDDDYYHLILWDDEALEIVGAYRFIPGAEQLARRGLQGIYSDSLFHYDERMLPIIQQGLELGRSFIQPAYWGKRGLDYLWMGIGAYIARYPQTRYLFGPVSISGTMPLAARDLLVAFYRLYFPTDLPLAKSRRPYPASLPEVLAQFTGDNYADDLRRLKHLLANLGTAIPTLYKQYSEVCEPGGVQFIDFGSDPDFNHCIDVCLKIKNYLNCASRPGQHRRTTMNNNSDVMYRLLVQSVVDYAIYMIKPDGTVANWNTGAQRAKGYTPEEIIGKNFALFYSEEDRRNGAPQRGLAIATATGRYETEGWRYRKDGSAFWAHVVIDAIRDEYGELLGFAEITRDCTEQQAQQRKQQEQEQRFRLLVEGVTDYAIYMLDLDGNVENWNAGAQRAKGYRTGSPEPYPGTPPDPPHGSAFWAHVIIDAIRDDAGKLIGYAKITRDCTEQQALLRKQREYEKTFRLLVEGVTDYAIYMLDLQGRVVNWNAGAQRAKGYMADEIVGQHFSVFYGSPERQARTPDANLGIALKTGRFEDEGWRYRKDGSAFWAHVVIDAIHDEEGKMIGFAKITRDVTERREHEQQLLRARDLAQAQSAKMSELSGFLDTIISNIPSCVIVEDAISREILMVNDKAEQLFGFSKSLIMHKRPHECMSAELSDYFNSLADIALRSEGIHAREQLLLTAGGERVLHTRATTISGKDMRQNYVMLIVEDVTDQPRRCASISSKGQTSATLCLDLDNFKNVNDALGHQIGDDLLRVVAKRLRSVLRDQDTLARIGGDEFAIVLPNVRNADEAAIVAQRLIEAIRPPVNVEGHNLSVGLSVGIALTSQATNTPEHMLRCADMALYEAKRNGRNRYEHFTLEMDNVARSRRVIENDLREAITGRQLKLYYQPITNETGIIGYEALMRWHHPIKGLIMPNDFIPIAEETGLIHMLGAYALYEACREAQSWETEQSVSVNLSPLQFKNSSLVSVVEGALRESGLAPHRLEVEITESVLLDDTLGNIRTLQSLKTLGVQIALDDFGTGYSSLSYLRSFPFDKIKIDKSFINDMGDSREALAIIRAITGMSRSLDIQITAEGVESNEQFVRLREEGCTLFQGYLFGRPQPSELRLKALE

SEQ ID NO: 190166 - protein, 638 aa, Glycine max
  Coding DNA Sequence Number=SeqID_73388
  Gene Ontology: Mol. function=protein dimerization activity; Cellular component=endoplasmic reticulum; Biological process=proteolysis
  Homolog annotation: Hit_ID=Q183D2; Match level="QueryCoverage=58%, HitCoverage=99%, E-value=1e-75, Identity=40%"; Hit description =Putative amidohydrolase
  Pfam annotation: Domain name=Gate; Domain location=80-183; Score =27.4; E_value=5e-05; Accession=PF07670.4; Description=Nucleoside recognition
  Pfam annotation: Domain name=M20_dimer; Domain location=430-539; Score=23.2; E_value=0.00091; Accession=PF07687.4; Description =Peptidase dimerisation domain
  Pfam annotation: Domain name=Peptidase_M20; Domain location=334-635; Score=106.6; E_value=7.5e-29; Accession=PF01546.18; Description =Peptidase family M20M25M40
  Pfam module annotation: Pfam domain module=Gate::M20_dimer::Peptidase_ M20; Domain location=80-183::430-539::334-635
MSEEKIMAAPQTVTASAGNYLALILAILFFSGLLYKVEGFSWLGAFDFTTLGGSFGTIKESGSTFLGAGGISAKAGFLFALSLAPTVMLALGVLEIFTHYGAIRAAHTLLTPLLKPLMGLPGRCGLALITDLQSTDAGAALTKEMADQQQIGKKELVVMSAWQYSGAGLINNYFAIGSALFASMSAPIIIPLLLMLPYCYSQSDAQCGDGLRTGGSAESARHHAVSWPRVCAADGNFRFARRGDHRAADCVAVILGQRRGGGEPDGQRSETVSRVLDHYHFLHEIPELGFQEVKTSAYIAGQLEQAGIKVTRGINQTTGIVAEIDSGVPGPVLALRADMDALGHVIDGVACARHTCGHDGHSSVVLTAAQELLQEGAIKKGRLKLLFQPAEELGAGALAMIEGGALDDVEMILGFHLRPLEECQVGQATPAVIYSACSTLEVTIKGVPAHAARPHLGVNALDAAVQAVQAVNSIHLAPGLTWSVKATRFLCDAGVTNSVPDEARVVWDLRSQENAPMELLKEKVSQAIQHSVAALGATAEVVVLKEMPAAEIDADATALLSAAIVDVLGEQGLLAAKTTPGSEDFFYYPVKNPQVKAGFWGLGTNLVPGLHHPQMRFELSSLEIGVKIFKAAVVRMLG

SEQ ID NO: 190167 - protein, 175 aa, Glycine max
  Coding DNA Sequence Number=SeqID_73389
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=UPI00005F78EF; Match level="QueryCoverage =99%, HitCoverage=75%, E-value=7e-59, Identity=63%"; Hit description =COG3484: Predicted proteasome-type protease
MSLLRRNCNDSEQPNLLNGRSLYDIALLVGATLREVIARDGEEFGGTLLLGGQIRGEEPRLFQIYPQGNFIEASVDTPYFQIGESKYGKPIIDRVLRYETSLSQAMQCALISMDSTLASNISVGLPLDAMVYHSDSFSDSEQYHITEQHPYFSQIRQLWSKGLLSVFSQLPPLKL

SEQ ID NO: 190168 - protein, 173 aa, Glycine max
  Coding DNA Sequence Number=SeqID_73390
  Gene Ontology: Mol. function=DNA binding
  Homolog annotation: Hit_ID=Q60DP5; Match level="QueryCoverage=85%, HitCoverage=31%, E-value=9e-13, Identity=29%"; Hit description =Expressed protein
MSVQSQSGSSNGTERSRTHWTPLLERYFIDLMLEHLQRGNRVGHTFNKQAWTDMLTSFNDNFGSQYDKDVLKTRYTNLWKQFNDVKSLLSHFGFSWDAARQMVVAADDDSVWDAYLKAHPDARCYRTKPVLNFDDLCVIYGHTVADGRYSLSSHDVNLDDQVQGQHLVETKSE

SEQ ID NO: 190169 - protein, 205 aa, Glycine max
  Coding DNA Sequence Number=SeqID_73391
  Gene Ontology: Mol. function=hydrolase activity
  Homolog annotation: Hit_ID=Q5PK26; Match level="QueryCoverage=90%, HitCoverage=85%, E-value=2e-56, Identity=60%"; Hit description =Hypothetical protein yjjV
MALLDKVRGRQAQDHYSIRQLEQTQAVVPQRIGDLIGRFRAQLAQYFKHITRALRAIWLALKTVQRHIGRIGFQQQRLQWQAGDGVAGFAGARIGNGAADTNRVAKGDETLRLLLAAGKAVHHATPRHIVTAQILRQLIVPSAGPPAAGFAAQNPALPYTDPARFPPSPRVLHPAFAARARYTAPDAAAPAGSPRQNGWHPRTAR

SEQ ID NO: 190170 - protein, 359 aa, Glycine max
  Coding DNA Sequence Number=SeqID_73392
  Gene Ontology: Mol. function=hydrolase activity; Biological process =lipid metabolic process
  Homolog annotation: Hit_ID=UPI00005F9527; Match level="QueryCoverage =86%, HitCoverage=74%, E-value=1e-130, Identity=72%"; Hit description= COG4667: Predicted esterase of the alpha-beta hydrolase superfamily
  Pfam annotation: Domain name=Patatin; Domain location=36-205; Score =87.1; E_value=5.3e-23; Accession=PF01734.12; Description=Patatin -like phospholipase
MTANTEGHPLGIRIPVSLDTFEPLALTPFKSKKIALVCEGGGQRGIFTAGVLDEFQRAGFNPFQLMLGTSAGAQNLSAFVCAQPGYARRVITRYTTSKLFFDPLRFVRGGHLIDLDWLVDITKQEFPLALSSAESLFAKGSEFYMCACRSDDYSAQYFNPTNLTWHDIIKASSAIPGFYRSGVLMDGVSYLDGGISDAIPVREAARRGADTIVVIRTVPSQMAYTPKWFKRMERWLSDSALQPMINILHQHEESYRQIQQFIEQPPDNLRIIEIFPPKPLASMALGSRLASLNQDYHLGRRSGRYFLATLGQWLSDAEPLARPIAVTPPAAVANAPDNRPVSTPPLAGNDADYDAGSLA

SEQ ID NO: 190171 - protein, 162 aa, Glycine max
  Coding DNA Sequence Number=SeqID_73393
  Gene Ontology: Mol. function=hydrolase activity; Cellular component =nucleus; Biological process=metabolic process
  Homolog annotation: Hit_ID=Q1SZI1; Match level="QueryCoverage=95%, HitCoverage=47%, E-value=2e-41, Identity=55%"; Hit description =Lipolytic enzyme
MSGGVVGDVGADTIAGKEDNVYIGVGVEPWLRADGGGVGNGPLEGIPSAVVGSEEGVFWGEAAVDGGDDNVGGSGDKVEVVVVGGIVGGACAEQAAMDVYQKEEFFCDGGSDDLREVKADGDVGLGVDGYVFGLDGDAGVDAGRDGSGAKEALDMVVFADAE

SEQ ID NO: 190172 - protein, 521 aa, Glycine max
  Coding DNA Sequence Number=SeqID_73394
  Gene Ontology: Mol. function=DNA binding
  Homolog annotation: Hit_ID=Q9FFJ8; Match level="QueryCoverage=61%, HitCoverage=60%, E-value=4e-19, Identity=23%"; Hit description =Arabidopsis thaliana genomic DNA, chromosome 5, P1 clone:MJJ3
MDRCLIDLLLEQVKHGNRLGQTFIAQAWNDMITTFNERFKSQYDKDVLKNRYKHFRKQFNDVDHLLQQGGFSWDDTREMIDAEDHVWDAYTKAHPEARSLRVKTLPDYWKLCVIFGAESSDARYVHLAHNADLSSELPMYITGEQKNGFFPNVYDAGSTIEWTESMEHYIVDLMIEQVNRGNRIGHLFNEQAWMHMVQAFNARWGLQSDKQVLMDQYFCLMKKHDDISNILSHSEFTWNETLQTLNAEDDVWDAYIKDHPDAISYKNKCLYLFHDLCKIFGNKLMEVSDVRVSDLEQLQLMEANDFTIEMDMDETNESLLNVSSVGISDQDPGRAKEIDADGSFGNLVVSSSNEIEIVAVGTSGNLDVDMDMTSGTCGNLDVTGDTQILSQDKQGPDEMATNGTRGDLELSGNTKITQHVRKRPNMMFQDSRPPKKKLGMKEALSEMASAVKALMNDKENNNTSFDDALSALRAMPDVDDDLVMDACDLLEDERKAKIFLALDISLRKKWLLRKLRQGKPT

SEQ ID NO: 190173 - protein, 795 aa, Glycine max
  Coding DNA Sequence Number=SeqID_73395
  Gene Ontology: Mol. function=binding; Cellular component =mitochondrion; Biological process=translation
  Homolog annotation: Hit_ID=Q338A4; Match level="QueryCoverage=86%, HitCoverage=93%, E-value=1e-167, Identity=28%"; Hit description =Pentatricopeptide, putative, expressed
  Pfam annotation: Domain name=PPR; Domain location=108-142; Score =21.2; E_value=0.0036; Accession=PF01535.11; Description=PPR repeat
  Pfam annotation: Domain name=PPR; Domain location=143-177; Score =33.4; E_value=8.1e-07; Accession=PF01535.11; Description=PPR repeat
  Pfam annotation: Domain name=PPR; Domain location=178-212; Score =16.5; E_value=0.082; Accession=PF01535.11; Description=PPR repeat
  Pfam annotation: Domain name=PPR; Domain location=213-247; Score =37.6; E_value=4.2e-08; Accession=PF01535.11; Description=PPR repeat
  Pfam annotation: Domain name=PPR; Domain location=248-282; Score =26.6; E_value=8.6e-05; Accession=PF01535.11; Description=PPR repeat
  Pfam annotation: Domain name=PPR; Domain location=283-317; Score =48.8; E_value=1.8e-11; Accession=PF01535.11; Description=PPR repeat
  Pfam annotation: Domain name=PPR; Domain location=318-352; Score =38.3; E_value=2.6e-08; Accession=PF01535.11; Description=PPR repeat
  Pfam annotation: Domain name=PPR; Domain location=353-386; Score =21.7; E_value=0.0026; Accession=PF01535.11; Description=PPR repeat
  Pfam annotation: Domain name=PPR; Domain location=494-528; Score =34.6; E_value=3.5e-07; Accession=PF01535.11; Description=PPR repeat
  Pfam annotation: Domain name=PPR; Domain location=529-563; Score =36.3; E_value=1.1e-07; Accession=PF01535.11; Description=PPR repeat
  Pfam annotation: Domain name=PPR; Domain location=564-598; Score =26.1; E_value=0.00012; Accession=PF01535.11; Description=PPR repeat
  Pfam annotation: Domain name=PPR; Domain location=599-633; Score =23.5; E_value=0.00078; Accession=PF01535.11; Description=PPR repeat
  Pfam annotation: Domain name=PPR; Domain location=646-680; Score =26.4; E_value=9.8e-05; Accession=PF01535.11; Description=PPR repeat
  Pfam annotation: Domain name=PPR; Domain location=681-715; Score =46.4; E_value=9.5e-11; Accession=PF01535.11; Description=PPR repeat
  Pfam annotation: Domain name=PPR; Domain location=716-750; Score =34.4; E_value=3.9e-07; Accession=PF01535.11; Description=PPR repeat
  Pfam annotation: Domain name=PPR; Domain location=751-785; Score =45.2; E_value=2.2e-10; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR; Domain location =108-142::143-177::178-212::213-247::248-282::283-317::318-352::353 -386::494-528::...
  Pfam module annotation: Domain location=529-563::564-598::599 -633::646-680::681-715::716-750::751-785
  Subcellular localization annotation: CTP_CleavageSite=70; ConfidenceScore=5.44e-01
MAVLVLCSSTMCSSNLSSCASSDTNVYVMSNNGFFGGIPLVKMKSFPNGSLVNWKKHGKRQLGLRVFETRCAHEVVVVNGKSKSSVSSEEVIGVLKCDESERNFSKSSYLHTLISGLLNLRRLDEELELFNNMESLGVEPTAYSYVLFIDYYAKLGDPEKALDTFEKIKKRGIMPSIAACNASLYSLAEMGRIREAKDIFNVLHNCGLSPDSVTYNMMMKCYSKAGQIDIDTKLLTEMLSKGCEPDIIVVNSLIDTLYKAGRVDEAWQMFARLKDLKLAPTVVTYNILLTGLGKEGKLLKALDLFWSMKESGCPPNTVTFNVLLDCLCKNDAVDLALKMFCRMTIMNCNPDVLTYNTIIYGLLKEGRAGYAFWFYHQMKKFLSPDHVTLFTLLPGVVKDGKVEDAIKIVMEFVHQSGLQTGNQVWGELMKCILIEAEIEEAISFAEGLVCNSICQDDNLILPLVRVLYKQKKALDAKQLFDKFTKTLGIHPTPESYNCLMDGFLGCNITEAALKLFVEMKNAGCCPNNFTYNLQLDAHGKSKRIDELFELYNEMLCRGCRPNIITHNIIISALVKSNSINKALDLYYEIVSVDFFPTPWSYGPLIGGLLKAGRSEEAMNIFEEMPDYQSSMQAQLMVKEGIRPDLKSYTILVECLFMTGRVDDAVHYFEELKLTGLDPDTVSYNLMINGLGKSCRLEVALSLLSEMKNRGISPDLYTYNALIIHFGNAGMVDQAGKMFEELQLMGLEPNVFTYNALIRGHSKSGNKDRAFSVFKKMMVVGCSPNAGTFAQLPNKC

SEQ ID NO: 190174 - protein, 90 aa, Glycine max
  Coding DNA Sequence Number=SeqID_73396
MAYELTLLGSAWIHPMVHVSILHHYNEPPLPNPTILPHISPEDLNHFNPTPMVLYPSLIPSIEDINSSIPTLNSITAGTHSPSSYPPYSS

SEQ ID NO: 190175 - protein, 92 aa, Glycine max
  Coding DNA Sequence Number=SeqID_73397
MQKNTQKGGQKGHSEAFSDPGLPMLVSGSPGPPNNFMVKGTEREVQRSIGEGLEKKKRKEEGRREKEAKSPLNRNCNQFLHRSSVVLRSSSG

SEQ ID NO: 190176 - protein, 85 aa, Glycine max
  Coding DNA Sequence Number=SeqID_73398
MTLNLKSPMEMRPLLSGKLASDQGLVVHLEFLPNSFSFNKGIVTQWLELGHFEVNNGRRSVPIQAWKGDIPMVECMDELYQNYER

SEQ ID NO: 190177 - protein, 640 aa, Glycine max
  Coding DNA Sequence Number=SeqID_73399
  Gene Ontology: Mol. function=transmembrane receptor activity; Cellular component=integral to membrane; Biological process=defense response to bacterium
  Homolog annotation: Hit_ID=Q1SI21; Match level="QueryCoverage=95%, HitCoverage=96%, E-value=0.0, Identity=83%"; Hit description =Nonaspanin
  Pfam annotation: Domain name=Cytochrom_B_C; Domain location=475-581; Score=-20.1; E_value=0.082; Accession=PF00032.8; Description =Cytochrome b(C-terminal)b6petD
  Pfam annotation: Domain name=EMP70; Domain location=57-598; Score =1136.6; E_value=0; Accession=PF02990.7; Description=Endomembrane protein 70
  Pfam module annotation: Pfam domain module=Cytochrom_B_C::EMP70; Domain location=475-581::57-598
MALIKDGKIYLTTVVYPLLKNCLYPYLSFCQLYPCKLDKGDSLQVKVNKLTSTKTQLPYSYYSLPYCAPSKIQDSAENLGEVLRGDRIENSLYVFKMREPQMCNILCNLKLDAKTAKEFKEKISDEYRVNMILDNLPLVFPLKRTDQDSTAYQLGFLVGLKGQYSGSKEEKYFIHNHLAFTVKYHKDMLTESARIVGFEVTPFSVKHEYEGKFDVKTTRLTTCDPHAKHTVVNSNSPQEVEEGKEIIFTYDVEFQESDVKWASRWDAYLLMNDDQIHWFSIVNSLMIVLFLSGMVAMIMLRTLYRDIAKYNELETQEEAQEETGWKLVHGDVFRPPNNSDLLCVYVGTGVQFFGMILVTMIFAVLGFLSPSNRGGLMTAMLLLWVFMGIFAGYSSTRLYKMFKGSEWKKVALRTATMFPAVVSTIFFVLNALIWGQKSSGAVPFGTMFALIFLWFGISVPLVFVGSYVGFKKPAIENPVKTNKIPRQIPEQAWYMNPVFSVLIGGILPFGAVFIELFFILTSIWLNQFYYIFGFLFLVFIILIVTCAEITIVLCYFQLCSEDYLWWWRSYLTSGSSALYLFLYATFYFFTKLEITKLVSAIFYFGYMLIASYAFFVVTGTIGFYACFWFTRLIYSSVKID

SEQ ID NO: 190178 - protein, 79 aa, Glycine max
  Coding DNA Sequence Number=SeqID_73400
MATSPGIIFYILNSKEASICALNGVCFARKHIKLEPGLPKIATCMMQQSQEGKDEPDFGHSLSDNISLRHKVVWRDSCT

SEQ ID NO: 190179 - protein, 95 aa, Glycine max
  Coding DNA Sequence Number=SeqID_73401
  Gene Ontology: Mol. function=ribonuclease H activity
  Homolog annotation: Hit_ID=Q84R37; Match level="QueryCoverage=89%, HitCoverage=34%, E-value=2e-17, Identity=55%"; Hit description =Putative ABA-responsive protein
MELELTQTTVRVSSRPADAAIARLIQGTKVLTSGGLDKLFQQTFRGFPKEKLLQPCACYISTNSGPLVETLYISTKRLEFCSDSIVPSSILPAVA

SEQ ID NO: 190180 - protein, 91 aa, Glycine max
  Coding DNA Sequence Number=SeqID_73402
MTSFDVANPLGEEHATDVVPTTGLYFQCHHSTRMVALGKVYDGAPPYTMWLMQMMGSRFMDEWSTGWMCMDSLSFSPYTMQMINVLKSAVH

SEQ ID NO: 190181 - protein, 141 aa, Glycine max
  Coding DNA Sequence Number=SeqID_73403
MEIIFRDHWFGLNMSPCTCCVLIVDVMEMSPQTVQTPRRRLGLWCKGAVTAEAGQPSSSATAKQNPNAVIASDISVKNGLNGDWLVVKRANNGNKGSRLSLREESWWRNNRSNGVDSEQQGDPPSQKVCGSLRKTGRLVNQ

SEQ ID NO: 190182 - protein, 512 aa, Glycine max
  Coding DNA Sequence Number=SeqID_73404
  Gene Ontology: Mol. function=catalytic activity; Cellular component =integral to membrane; Biological process=metabolic process
  Homolog annotation: Hit_ID=Q67UR5; Match level="QueryCoverage=86%, HitCoverage=86%, E-value=0.0, Identity=66%"; Hit description =Putative phospholipase D
  Pfam annotation: Domain name=PLD_envelope; Domain location=302-445; Score=-40.9; E_value=7.8e-05; Accession=PF08371.1; Description =Phospholipase Dviral envelope
  Pfam annotation: Domain name=PLDc; Domain location=201-228; Score =26.6; E_value=8.7e-05; Accession=PF00614.12; Description =Phospholipase D. Active site motif
  Pfam annotation: Domain name=PLDc; Domain location=481-507; Score =21.2; E_value=0.0038; Accession=PF00614.12; Description =Phospholipase D. Active site motif
  Pfam module annotation: Pfam domain module=PLD_envelope::PLDc::PLDc; Domain location=302-445::201-228::481-507
MWLLCEGVWPRPALDPSITDPYQLANHLTCRIFQEDPAILSFKLTLLEVNRGSSCIALNKVCASTSSSSHCKAWLVQSIPTNMPHLSHVPGTLSTGDVLRWLAANSTTRLHIIAQYWQLLPSPDDPRSGDYGYTQHQMHEFGADQGVALYEALDAAADRNVSIRLLSHSGVYPTFASEPSKLAFGRPNVENVRLLLENWWGSGIVHAKVWISDSRNVYIGSANNDWKSLTQVKELGIYFADCHEIAKKVEVYFDNLWTLASLNSSAYTKTVFDQDWQVERKVPCWSHFINHGERCMSPLPQYLETPHIAGYPILSEPYMFKLPFQTPGSNYLTKHLQGSYLSFAPPELLFGKYQADEQAWIDTIKSVGKKETVRISTMDWLGQSQFMDQTIYWSSLSSAISQVVFSKNVTVQILVAYWAHSINNTDEYLKSLLYTNNLCSSSKYNTCSGKVEIKYYVVPGFNMTGPAIKGGARTGNIYPDFTRVNHGKYAVSDVRAHIGTSNLVWDYFFTTA

SEQ ID NO: 190183 - protein, 420 aa, Glycine max
  Coding DNA Sequence Number=SeqID_73405
  Gene Ontology: Mol. function=DNA-directed RNA polymerase activity; Cellular component=nucleus; Biological process=transcription
  Homolog annotation: Hit_ID=Q1L6W5; Match level="QueryCoverage=99%, HitCoverage=41%, E-value=0.0, Identity=83%"; Hit description=RNA polymerase IV second largest subunit
  Pfam annotation: Domain name=RNA_pol_Rpb2_6; Domain location=1-317; Score=251.7; E_value=1.5e-72; Accession=PF00562.18; Description=RNA polymerase Rpb2, domain 6
  Pfam annotation: Domain name=RNA_pol_Rpb2_7; Domain location=319-418; Score=128.2; E_value=2.3e-35; Accession=PF04560.10; Description=RNA polymerase Rpb2, domain 7
  Pfam module annotation: Pfam domain module=RNA_pol_Rpb2_6::RNA_pol _Rpb2_7; Domain location=1-317::319-418
MTSDCLGKPDHSLGQSKIPPKAEFYNGQNAIVAVNVHLGYNQEDSLVMNRASLQRGMFRSEHIRSYKSEIDNKESSDKKRKPEDIVNFAKLQSKIGRVDSLDDDGFPYVGANLQSGDIIIGKCAESGADNSVKLKHTERGYVQKVVLSSNDEGKNFAVVSLRQVRSPVLGDKFSSMHGQKGVLGFLESQENFPFTRQGIVPDIVINPHAFPSRQTPGQLLEAALGKGIACGGILKQATPFSTPSVDAITEQLHRAGFSRWGNERVYNGRTGEMVRSLIFMGPTFYQRLHHMSEDKVKFRNTGPVHPLTRQPVADRKRFGGIKFGEMERDCLIAHGASANLYERLFTLSDSSQIHICSKCKKVANVILRPVSGGRKIRGPYCRHCESADDIVVAHVPYGAKLLCQELFSMGINLKFETQLC

SEQ ID NO: 190184 - protein, 135 aa, Glycine max
  Coding DNA Sequence Number=SeqID_73406
MEELINKTQNNPNATTSDWQLLNRISLPTPYYCHSAPTNKVRNHHRMMHAPDLNSQMQCVIVEVTQSCTVTPPPPLVISLGHKGVPYQVTHPLVQSTYCHNLYYFPCHMRHETWAPSSTMTMDELKILSHSLGDA

SEQ ID NO: 190185 - protein, 147 aa, Glycine max
  Coding DNA Sequence Number=SeqID_73407
MGDIEDAQEHMKVDMSDLKDQMVSMMEAMLGMKRLIESNAVTAAAKADPVLAYHLVLDIVGRGRDTLGHTNNPHLGYNRGAYPYGLPPNLTPPAVHDNMDHAAPIASKGQPPQPTGDVHEDPREGAHGDVDSYPPFPTEGLAPNALP

SEQ ID NO: 190186 - protein, 200 aa, Glycine max
  Coding DNA Sequence Number=SeqID_73408
MGLSAAIDEGRRRRRQSLRAIRLFVLQTAKKNVYTDNHSGISARQRDSNFSMTDLVSAEDDTAKKNVYTDNHSGISARQRDSNVSMTDLVSAEDDVNLRVSTGLSAAIVEGRRRRRQSLRAIRLFVLQTAKKNVYTENHSGISARQRDSNVSMTDLVSAEDDVNLRVSTGLSAAIDEVRRRRCQSSHAIRHFVLQTAKKN

SEQ ID NO: 190187 - protein, 54 aa, Glycine max
  Coding DNA Sequence Number=SeqID_73409
MGARDKSIMHKGNKNLDLVTDPMHAHSGPVLVQMMDPEKEEGPALVQMAQAEEI

SEQ ID NO: 190188 - protein, 130 aa, Glycine max
  Coding DNA Sequence Number=SeqID_73410
  Homolog annotation: Hit_ID=Q2HSF5; Match level="QueryCoverage=60%, HitCoverage=10%, E-value=1e-10, Identity=46%"; Hit description=IMP dehydrogenase/GMP reductase
MTKSKGKGKDPLEGLGGPMTRARARKAKEALQQVLSILFKYKPKFQGKKSKVKYISHQHSIRNTRSGVYWPCCLDHVVNDQKGKTQFDLLPQAINNHKVIIYYHLKSPYPWKDGVHDDPMNYSPKRVERF

SEQ ID NO: 190189 - protein, 379 aa, Glycine max
  Coding DNA Sequence Number=SeqID_73411
  Subcellular localization annotation: CTP_CleavageSite=64; ConfidenceScore=5.25e-01
MAPRKLPQSDPGRTPLEKAAALPSQLTRILTTTDSGVPSISSASRPSRDGHSSERGGRWAPLVTPMAKFNPEIVMEFYANAWPTEEGVRDMRSWVRGRVNTAKGGTRPLALTRMSLPNFCAFWVTSCPVTTTPISQSKCQLVYAILAQMSVHVAQLIADAIYQFVGTTPMRHPVDPEKCNRALGFPARITGLYQFYRVSVAPSEVIRPPVTRAFIEKYCMPRLAQGEAPQQPRDDQQQAAGAPPPPPESTFDHLRRLERYIRHVADQQAANHRGQFEAAVAWLGDWPEDQTGPAGAPGAEDKAEDDQDMADLIDTETPYDYPYLVIRRPQQLGNPVACGDTLRLSAPRYSEIPSPMTCKDRCGHLHPSRRYQRLSAETI

SEQ ID NO: 190190 - protein, 1052 aa, Glycine max
  Coding DNA Sequence Number=SeqID_73412
  Gene Ontology: Mol. function=protein serine/threonine kinase activity; Cellular component=integral to membrane; Biological process=protein amino acid phosphorylation
  Homolog annotation: Hit_ID=Q9FN37; Match level="QueryCoverage=97%, HitCoverage=99%, E-value=0.0, Identity=57%"; Hit description =Putative receptor protein kinase
  Pfam annotation: Domain name=LRRNT_2; Domain location=35-73; Score =30.8; E_value=4.7e-06; Accession=PF08263.3; Description=Leucine rich repeat N-terminal domain
  Pfam annotation: Domain name=LRR_1; Domain location=107-129; Score =18.4; E_value=0.026; Accession=PF00560.23; Description=Leucine Rich Repeat
  Pfam annotation: Domain name=LRR_1; Domain location=131-153; Score =16.6; E_value=0.092; Accession=PF00560.23; Description=Leucine Rich Repeat
  Pfam annotation: Domain name=LRR_1; Domain location=155-176; Score =9.1; E_value=5.5; Accession=PF00560.23; Description=Leucine Rich Repeat
  Pfam annotation: Domain name=LRR_1; Domain location=178-201; Score =7.6; E_value=11; Accession=PF00560.23; Description=Leucine Rich Repeat
  Pfam annotation: Domain name=LRR_1; Domain location=203-224; Score =7.4; E_value=12; Accession=PF00560.23; Description=Leucine Rich Repeat
  Pfam annotation: Domain name=LRR_1; Domain location=227-249; Score =13.2; E_value=0.97; Accession=PF00560.23; Description=Leucine Rich Repeat
  Pfam annotation: Domain name=LRR_1; Domain location=251-273; Score =10.2; E_value=3.6; Accession=PF00560.23; Description=Leucine Rich Repeat
  Pfam annotation: Domain name=LRR_1; Domain location=275-297; Score =17.8; E_value=0.039; Accession=PF00560.23; Description=Leucine Rich Repeat
  Pfam annotation: Domain name=LRR_1; Domain location=323-345; Score =16.8; E_value=0.077; Accession=PF00560.23; Description=Leucine Rich Repeat
  Pfam annotation: Domain name=LRR_1; Domain location=347-369; Score =13.1; E_value=0.99; Accession=PF00560.23; Description=Leucine Rich Repeat
  Pfam annotation: Domain name=LRR_1; Domain location=371-393; Score =11.4; E_value=2.1; Accession=PF00560.23; Description=Leucine Rich Repeat
  Pfam annotation: Domain name=LRR_1; Domain location=395-416; Score =11.6; E_value=2; Accession=PF00560.23; Description=Leucine Rich Repeat
  Pfam annotation: Domain name=LRR_1; Domain location=446-468; Score =8.5; E_value=7.5; Accession=PF00560.23; Description=Leucine Rich Repeat
  Pfam annotation: Domain name=LRR_1; Domain location=470-492; Score =17.9; E_value=0.036; Accession=PF00560.23; Description=Leucine Rich Repeat
  Pfam annotation: Domain name=LRR_1; Domain location=494-516; Score =18.9; E_value=0.019; Accession=PF00560.23; Description=Leucine Rich Repeat
  Pfam annotation: Domain name=LRR_1; Domain location=556-578; Score =1.0; E_value=1.8e+02; Accession=PF00560.23; Description=Leucine Rich Repeat
  Pfam annotation: Domain name=LRR_1; Domain location=580-602; Score =17.2; E_value=0.059; Accession=PF00560.23; Description=Leucine Rich Repeat
  Pfam annotation: Domain name=LRR_1; Domain location=604-626; Score =20.6; E_value=0.0055; Accession=PF00560.23; Description=Leucine Rich Repeat
  Pfam annotation: Domain name=LRR_1; Domain location=83-105; Score =1.5; E_value=1.5e+02; Accession=PF00560.23; Description=Leucine Rich Repeat
  Pfam annotation: Domain name=Pkinase; Domain location=768-1039; Score= 151.2; E_value=2.6e-42; Accession=PF00069.15; Description=Protein kinase domain
  Pfam annotation: Domain name=Pkinase_Tyr; Domain location=768-1039; Score=102.7; E_value=1.1e-27; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::Pkinase::Pkinase_Tyr; Domain ...
  Pfam module annotation: Pfam domain module=location=35-73::107 -129::131-153::155-176::178-201::203-224::227-249::251-273::275 -297::323-345::347-369::371-393::395-416::446-468::470-492::494 -516::556-578::580-602::604-626:...
  Pfam module annotation: =:83-105::768-1039::768-1039
MVLQRCYPMAFVQWGFLACLLCFSVGLETPARSCDKHDLLALKEFAGNLTKGSIITEWSDDVVCCKWIGVYCDDVVDGADASRVSKLILPGMGLNGMISSSLAYLDKLKELNLSFNRLQGELSSEFSNLKQLEVLDLSHNMLSGPVGGALSGLQSIQILNISSNLFVGDLFRFRGLQHLSALNISNNSFTDQFNSQICSSSKGIHILDISKNHFAGGLEWLGNCSMSLQELLLDSNLFSGTLPDSLYSMSALKQLSVSLNNLSGQLSKDLSNLSSLKSLIISGNHFSGELPNVFGNLLNLEQLIGNSNSFSGSLPSTLALCSKLRVLDLRNNSLTGSVGLNFARLSNLFTLDLGSNHFNGSLPNSLSYCHELTMLSLAKNELTGQIPESYANLSSLLTLSLSNNSFENLSEAFYVLQQCKNLTTLVLTKNFHGEEIPENLTASFESLVVLALGNCGLKGRIPSWLLNCPKLEVLDLSWNHLEGSVPSWIGQMHHLFYLDLSNNSLTGEIPKGLTELRGLISPNYHISSLFASAAIPLYVKRNKSASGLQYNHASSFPPSIYLSNNRLSGTIWPEIGRLKELHILDLSRNNITGTIPSSISEMKNLETLDLSNNTLVGTIPRSFNSLTFLSKFSVAYNHLWGLIPIGGQFSSFPNSSFEGNWGLCGETFHRCYNEKDVGLRANHVGKFSKSNILGITIGLGVGLALLLAVILLRMSKRDEDKPADNFDEELSWPNRMPEALASSKLVLFQNSDCKDLTVEDLLKSTSNFNQENIIGCGGFGLVYKGNLPNGTKVAIKKLSGYCGQVEREFQAEVEALSRAQHKNLVSLKGYCQHFNDRLLIYSYLENGSLDYWLHESEDGNSALKWDVRLKIAQGAAHGLAYLHKECEPHIVHRDIKSSNILLDDKFEAYLADFGLSRLLQPYDTHVSTDLVGTLGYIPPEYSQVLKATFKGDIYSFGVVLVELLTGRRPIEVTVSQRSRNLVSWVLQMKYENREQEIFDSVIWHKDNEKQLLDVLVIACKCIDEDPRQRPHIELVVSWLDNVGFDGSEQSSS

SEQ ID NO: 190191 - protein, 100 aa, Glycine max
  Coding DNA Sequence Number=SeqID_73413
  Subcellular localization annotation: CTP_CleavageSite=20; ConfidenceScore=5.04e-01
MPISPCGSISWSMSFRHRDRARKTSSGPGEVQQGPGFPALITSLCQSYRIPVPPNKDHARKTLSGPREVQQGLGVSSSDYGHLSVLRSACHPQQGHQAPY

SEQ ID NO: 190192 - protein, 79 aa, Glycine max
  Coding DNA Sequence Number=SeqID_73414
MAIEGFTMRRGERKGVNETPRRGGSVVVCSFLWTDSLFIAVEVGLRRRAQRNTPRLARVDRALSSRVVGLARSSVGSQA

SEQ ID NO: 190193 - protein, 644 aa, Glycine max
  Coding DNA Sequence Number=SeqID_73415
  Gene Ontology: Mol. function=DNA-directed RNA polymerase activity; Cellular component=nucleus; Biological process=transcription
  Homolog annotation: Hit_ID=Q17U53; Match level="QueryCoverage=93%, HitCoverage=57%, E-value=0.0, Identity=61%"; Hit description=DNA -directed RNA polymerase, putative
  Pfam annotation: Domain name=RNA_pol_Rpb2_1; Domain location=70-492; Score=99.8; E_value=7.9e-27; Accession=PF04563.6; Description=RNA polymerase beta subunit
  Pfam annotation: Domain name=RNA_pol_Rpb2_2; Domain location=264-434; Score=0.4; E_value=6.3e-05; Accession=PF04561.5; Description=RNA polymerase Rpb2, domain 2
  Pfam annotation: Domain name=RNA_pol_Rpb2_3; Domain location=507-574; Score=47.2; E_value=5.6e-11; Accession=PF04565.7; Description=RNA polymerase Rpb2, domain 3
  Pfam annotation: Domain name=RNA_pol_Rpb2_4; Domain location=610-644; Score=-15.4; E_value=0.086; Accession=PF04566.3; Description=RNA polymerase Rpb2, domain 4
  Pfam module annotation: Pfam domain module=RNA_pol_Rpb2_1::RNA_pol _Rpb2_2::RNA_pol_Rpb2_3::RNA_pol_Rpb2_4; Domain location=70-492::264 -434::507-574::610-644
MGHVGSSKDGTKVGLSAAAMDIDDDDDDDDDDLGDVDLDPTNSEILEELGEDMVKYWCKKASMLFFDEYGLISHQINSFNHFVAIGLQNTFDSFGDLVVTPGFDPSKKGENEHFRYASVKFGKVKLDKPMFWGGEGNAQEFKMLPRHARIQRMTYASKVKIQVKVQVGQNGVMPCNVYVPKKVRSDKFKTGKEEFLDREIMKEDEREIIIGRLPVMVKSDLCWMKDAEKDDDEFDHGGYFIVKGAEKTFIAQEQLYLKRLWVMNSPGWMIAYKSQMKRNRMVIKLVGNSRSEEVENGDMCLTVYFLSVEVPVWVLFFALGVSSDKEIVDLIGCGNDDVRIQNILFASVRDADEKCGAFRRVRNAVQYLEKCVKSVQFPPSESMQECLEMYVFPGISGLNRKARFLAYMVKGLLLAYTGRRKCDNRDDFRNKRLELASELLDRELKVHVAHARKRMAKALQRDLYGDRDVRPIEHYLDASIITNGLQRAFSTGAWSHPYKRMERISGVVANVGRTNPLQTMAELRRARQQVQYTGKVGDARYPHPSHWGKVCFLTTPDGENCGLVKNLSVTGLVSTDVTDVTESILLKLVDCGMQELVDDTSTHLGSMDKVLLNGDWVGVCPDSSSFVAELRSRRRRNELPHQGR

SEQ ID NO: 190194 - protein, 275 aa, Glycine max
  Coding DNA Sequence Number=SeqID_73416
  Gene Ontology: Mol. function=chorismate mutase activity; Cellular component=chloroplast; Biological process=aromatic amino acid family biosynthetic process
  Homolog annotation: Hit_ID=Q1SZ86; Match level="QueryCoverage=99%, HitCoverage=86%, E-value=4e-73, Identity=53%"; Hit description =Chorismate mutase
MAKAEYNYTVDSARASLVRQEDTIIFGLIERARFPLNSPTYNQSYTSIPQFRGTLLDFLVRHTEAIQAKTNEAVWSRCENGDLKNLGETDMAGRYINPEENPFFPENLPPSVVPRYPFSQFLHPAAAMININNAIWKLYFDELLPMFVASGDDGNYAQTAATDLSLLQAISRRIHYGKFVGEAKFRESPQGYEPLIRAKDKGALMKLLTYESVEEMVVKRVKKKAMVFGQEVSLDRDVKGITYKVDPSVVSLLYQKWLIPLTKNVEVEYLLNRLD

SEQ ID NO: 190195 - protein, 244 aa, Glycine max
  Coding DNA Sequence Number=SeqID_73417
  Gene Ontology: Mol. function=sequence-specific DNA binding; Cellular component=nucleus; Biological process=regulation of transcription
  Homolog annotation: Hit_ID=Q1SZ92; Match level="QueryCoverage=97%, HitCoverage=98%, E-value=4e-65, Identity=52%"; Hit description=DNA -binding WRKY
  Pfam annotation: Domain name=Rho_Binding; Domain location=27-97; Score=-2.4; E_value=0.043; Accession=PF08912.1; Description=Rho Binding
  Pfam annotation: Domain name=WRKY; Domain location=134-185; Score =80.8; E_value=4.1e-21; Accession=PF03106.6; Description=WRKY DNA -binding domain
  Pfam module annotation: Pfam domain module=Rho_Binding::WRKY; Domain location=27-97::134-185
MGMEPTCVDTSLNLNVIPSPHIAEEVLVEELRRLSNENKRLTETLKHVCENYVALQKHLNEFSQLRNANFDKEAGTVPSLKRKAESVNLFGINNYTECSTITEEETFKRPKHSTEPKVSKVLTRTDASDTGLYVRDGYQWRKYGQKVTRDNPSPRAYFKCSYAPSCPVKKKVQRSVEDPSVLGPIVTLDLVQSKVVDINAQNSSFQQFLVQQMATSLTRDPNFTAALASAISGRILDDTSVGKR

SEQ ID NO: 190196 - protein, 249 aa, Glycine max
  Coding DNA Sequence Number=SeqID_73418
  Gene Ontology: Mol. function=sequence-specific DNA binding; Cellular component=nucleus; Biological process=regulation of transcription
  Homolog annotation: Hit_ID=Q1SZ89; Match level="QueryCoverage=98%, HitCoverage=98%, E-value=5e-66, Identity=53%"; Hit description=WRKY DNA-binding domain, putative
  Pfam annotation: Domain name=FLYWCH; Domain location=78-148; Score =8.6; E_value=0.0082; Accession=PF04500.7; Description=FLYWCH zinc finger domain
  Pfam annotation: Domain name=WRKY; Domain location=89-150; Score =113.7; E_value=5.1e-31; Accession=PF03106.6; Description=WRKY DNA -binding domain
  Pfam module annotation: Pfam domain module=FLYWCH::WRKY; Domain location=78-148::89-150
MDQEVETLEAKLQRVKEDNRTLRVMLETLSSKCEKLQSHLQEINNEEQQVGTKSDQSGSVLLARPEFSMAQKPSQIFFKTHPKDNSLMVKDGYQWKKYGQKKVTKDNPSPRAYFKCSLAPSCPVKKRVQRSIQDKSILVATYEGKHNHGVFHDLLKPSSSIPETSIMINNLPMTNMPNDKDTVNIDLALYVKQQNDRGSKSKIEGYASPLVKDPDFIMPLAEAVVHSLKSQTYKQVGLNLNLGLPEPHL

SEQ ID NO: 190197 - protein, 270 aa, Glycine max
  Coding DNA Sequence Number=SeqID_73419
MKQKHAFFKSPNLNFCPFAHSHSVHRRLRVADILLADEDHDGDAVDFMDGVRETPSTKCFSPRRLVASLLAPLRPTKGLRLQQRRQNETGDLEAPSSSSLTNELKGSDDSTGQLHQSDTSFKLGVGCGLLYLIAASKNELGKMVELRKEMEMLLQNAKGELQSKDALLKPLKQSDALALSITDIQEVSSSSSHLSIHSNTQYVQPESKGDMVPNCFLEYNISEQDECAEEINELQAEFEIELQRLQMYLDGEAGFDDAQHEGVKVDCFIV

SEQ ID NO: 190198 - protein, 153 aa, Glycine max
  Coding DNA Sequence Number=SeqID_73420
  Gene Ontology: Mol. function=catalytic activity; Cellular component =endoplasmic reticulum; Biological process=cutin biosynthetic process
  Homolog annotation: Hit_ID=Q109K1; Match level="QueryCoverage=99%, HitCoverage=25%, E-value=3e-51, Identity=58%"; Hit description=CER1 protein, putative, expressed
MGHCNFEIIPTWLFNMFPLLKYLMYTPSFHSLHHTQFRTNYSLFMPFYDYIYGTTDKATNQLYDSALKREEETTDVVHLTHLTTPESIYHLRLGFPYLASKPYTPKWYLRLMWPMTAWSVFLTWAYGRAFIVEGCRFDKLKLQTWAIPKYNFE

SEQ ID NO: 190199 - protein, 279 aa, Glycine max
  Coding DNA Sequence Number=SeqID_73421
  Gene Ontology: Mol. function=protein serine/threonine kinase activity; Cellular component=plasmodesma; Biological process=protein amino acid phosphorylation
  Homolog annotation: Hit_ID=Q8LPJ1; Match level="QueryCoverage=57%, HitCoverage=48%, E-value=1e-18, Identity=55%"; Hit description =Protein kinase ADK1-like protein
MLQENLSSFRLVSTPPSPSSTSSFDGRKVYIIDHGLAKKYRDLQTPRHIPYKENKNLTGTTQFASVKTHLGIVGAECMIHRGLEDKLDLNYVKWLQIYLDIVSAGYQFDYIFYWTIWKYPQIGGSSSKGRWKAMHARPSVQKPEKVSVGKEIREKFSGAVEAFSRRNPTSPSPRGDHSKHRSFEEVAVHKDVYHDQEKGRNSSRYGSSSRRPIIPSSTRPSSSGDHTDSHTGQLSSSGNRPSTSHRNIQPMYETKQPTYMHSRSTRGNCDAGMQKLVNH

SEQ ID NO: 190200 - protein, 109 aa, Glycine max
  Coding DNA Sequence Number=SeqID_73422
MSAMDDKTLIQTHTLTIEEASKVKGTNPLMVEAACASMPLAKALTVLLGCKHSRVAEKRTTRVHVNQNEEFVIHLVLVVENLNQMKTIPLGAILAIVDPVVIGIVEKPE

SEQ ID NO: 190201 - protein, 229 aa, Glycine max
  Coding DNA Sequence Number=SeqID_73423
  Homolog annotation: Hit_ID=Q337C0; Match level="QueryCoverage=56%, HitCoverage=29%, E-value=9e-27, Identity=50%"; Hit description=IMP dehydrogenase/GMP reductase domain containing protein, expressed
MTNANCPQESLHLVSNGNLRACVSLCVMKGVSLCVYHEHVSLCVYHEDYGNVSIIALSVKDPILQTNYVVPKSKDEILTLSWMTLAMKSLCESHNDIWTLMTALELPVSDWEDKWIDVYLDISSKLLDICNAFSSELSCLNQGNLPLKCALHNLDSASSKQYLQACSLLDDWRQHVSSRNPRIEKCSFMLDNLVGSLDLPKGVYCSILWLVKEVIRLECGRHTFMGSIF

SEQ ID NO: 190202 - protein, 69 aa, Glycine max
  Coding DNA Sequence Number=SeqID_73424
MSDQVGKEGASASNPLRDWGLGFSPMRETTVKECGWARVRGACLFNKSNAFSKAVLHVTDVVMRLQRWF

SEQ ID NO: 190203 - protein, 75 aa, Glycine max
  Coding DNA Sequence Number=SeqID_73425
MVTTIPICPFPTWRRVKGSSDCEGCQEECMVHLQTLCGSNAFQVYFDDAKDSSQESRVKQVSRIKESFNQESRFK

SEQ ID NO: 190204 - protein, 79 aa, Glycine max
  Coding DNA Sequence Number=SeqID_73426
MELSTPPCAEASVQELACLGTSQVLTDRLCPGWVGIGQAWFWAIAPHLTSPRSPDPRDISPGGGRAMVHNKFSTSTKRA

SEQ ID NO: 190205 - protein, 48 aa, Glycine max
  Coding DNA Sequence Number=SeqID_73427
MRRVGGYEESIKVMSSYRRGDRRGKTFGFATMEGVEDVTFMECNLDTK

SEQ ID NO: 190206 - protein, 830 aa, Glycine max
  Coding DNA Sequence Number=SeqID_73428
  Gene Ontology: Mol. function=RNA-directed DNA polymerase activity; Cellular component=nucleus; Biological process=RNA-dependent DNA replication
MVTEAEYTDFSDMLEQIGLAEMDSQGDYFTWSNKHVEGTIYSRIDRVLANVSWFQNNLDVNLHIMPPNVSDHTLLWLQHRDRVILKKSHFKFINGSVDLDGYNDAVSASWREPITGRPMFVVWEKLMCLQPVLRNLSKPLMHLKQNILQARGNLQQAQLDLSIDLMNSTNIAKVKKCTDILIYFQELEENVLRQKAKIDWLKLGDGNNSFFYATVKSRANAKGMNMLRKIDGTICATQEDIENLVLEFYDAMRRGGQLSMEQRKFLVAPVNDQEILKALNGIGDLKSPGIDGYGAKFFKSSWDIIKDDINNAIYDFFNNDRLLKAFNCTIVTLIPKHEKAVSVKDYRPIARCTILYKIISKILTARLGKVLNSIVSPCQAAFVPRQQIHNHILLAYELIRGYARKNGTPRCMIQLDLQKAYHMVDWFALETILLETGIPKQFVKWIMLTVTSVTYRFNINGNYTKCMKANRGIRQGDPLSTMLFVIIMEYLNRLLHKMQRNPDFNHHSKCEKLNITNLAFADDVLLFAIGDCRSVEMLMQTLNTFSETTGLVGPLPFKYLGVSLTSKKLSISHYLSLIDRITGKINHWSNKLLSYAGWLQLIKSVTFSITIYWMQCFPLPKPRKYGGLNVIHLQTWNHVTMMKLLRSLSEKADNLWKDRGKFSMKTLYLKMRCEGSNEVVWNRLFCGNPARPRALMTLWQACHEFHDHLFFGCSVLGDVWKQVLEWIQVKHHPQEWNEKQKWIIRHSKGKGHKASILKLAVTETVYGIWKYRNAKIFEETVLLERIPEEGSSGRRDCIRAISAIHYLLGALAILLGARSMSLIPILKSFA

SEQ ID NO: 190207 - protein, 117 aa, Glycine max
  Coding DNA Sequence Number=SeqID_73429
MAKIEKVVKILEQELERLKQNRNGVGLSVLCKVIACAPKRKKQIGKNSWQVKKRLSREVPKVIVERSFSALSVIEESGRPSTSRSRTKREISALSAAGVFSQAQRTTGTKLESTYPH

SEQ ID NO: 190208 - protein, 234 aa, Glycine max
  Coding DNA Sequence Number=SeqID_73430
  Gene Ontology: Mol. function=RNA-directed DNA polymerase activity; Biological process=RNA-dependent DNA replication
MLTLLTHLYGLPPDFMPPVAYTIEPTQPMVEVLIPTNQPVYFMPPVNHKMTRVIEGVPTTCSNEQLQMLEERLKAIEGSNYGMVEAADLCSIPDVIIHPKFKAPEFDKYKGTSCPKSRLSIYFRKMEAHARDGKLLIHCFQDSLTGAALKCYMQLERAHIHSWKDLGDVFIRKYKYNIDLTPNGFELQSMSKKEYEAFKAQRWRVVAAQVEPPLSEKETTTLHIDTLCEPFYDK

SEQ ID NO: 190209 - protein, 136 aa, Glycine max
  Coding DNA Sequence Number=SeqID_73431
  Gene Ontology: Mol. function=RNA-directed DNA polymerase activity; Biological process=RNA-dependent DNA replication
  Homolog annotation: Hit_ID=Q1SNL3; Match level="QueryCoverage=68%, HitCoverage=23%, E-value=1e-09, Identity=33%"; Hit description =Immunoglobulin/major histocompatibility complex
MLKYPRLYQISSQQQQTIMQMGSNSGAVWDWQLNWRRPLFDSEIAMADDFIGKIAQKEILPHRTDSWWWKPDPGGKFSSKSAYRMLWGELTGTNQEAAFKDLWKLKIPPKAAVFAWRLIKDLRPYLYGGSHYLGSE

SEQ ID NO: 190210 - protein, 43 aa, Glycine max
  Coding DNA Sequence Number=SeqID_73432
MEVKTTFLNGELEEEIYMNQPEGFVEPDVILGIKLINKDDGML

SEQ ID NO: 190211 - protein, 220 aa, Glycine max
  Coding DNA Sequence Number=SeqID_73433
  Gene Ontology: Mol. function=catalytic activity; Cellular component =endoplasmic reticulum; Biological process=metabolic process
  Homolog annotation: Hit_ID=Q2HW67; Match level="QueryCoverage=94%, HitCoverage=33%, E-value=1e-64, Identity=54%"; Hit description =Sterol desaturase
MNQGEDLNIYGGLYVSRNPNLKVKIVDGSSLAAAVVLNNIPKGTTQVLLMGKLTKVAYALAFALCQRGVKVATMHKHDYERLKKSLTNSESNLIIAKGYTQMTWLVEDQLTEEEQLKAPTGALFIPYSQFPPRKYRKDCFYHCTPAMLIPSCVENVHSCEDWLPRRVMSAWRIAGIVHSLERWSTNECNYKMHNIDKVWRSTLQHGFQPLTTPIKEIAHC

SEQ ID NO: 190212 - protein, 113 aa, Glycine max
  Coding DNA Sequence Number=SeqID_73434
MMGICRFVQDHIYNTFDPSIMLTHDITRIIKGKFEGCWESYGEENKHNPQLANLWYEEFKVERARRVSKDIAKRDPEEVTKDGVSSKPSDDDIFYNIVGGMDNKGRVYGLGPN

SEQ ID NO: 190213 - protein, 149 aa, Glycine max
  Coding DNA Sequence Number=SeqID_73435
  Subcellular localization annotation: CTP_CleavageSite=30; ConfidenceScore=5.21e-01
MYHLLFLVTTTQVDVPSTCTTKDVPSNVLRQSSQAVSPLKLCEGETKDISGGRRETQKEFRRLVLVEFFLAKGEERHKRIQAVSPSFFWKREKRDTKRIQANKVWKPENFESFWQRNKKKDEKQMFQDFSKVVKEVVRVTQIQVKVLLL

SEQ ID NO: 190214 - protein, 215 aa, Glycine max
  Coding DNA Sequence Number=SeqID_73436
SLFDDEVPHVKNENEDEEELYIKDQCARQFGEEVDAHEDQDVLNAYDLDDIVLGDGAMSLSSEINAHYLELCDHEESSSMWDKFKDYVHGLNMPLLVHNLHWVHLAMKFVLKCLRSKRGKHFHIILYSSFLVLVFDIGGWIGADGFNLRLNSLKEGGHDEDQLKSMDLETQHGFDGLITRTRDKKMVNEAQLKMENMKPKLKLVKCLKNKENELT

SEQ ID NO: 190215 - protein, 34 aa, Glycine max
  Coding DNA Sequence Number=SeqID_73437
MASKPGILTNWPWKPLGSFKLMPFTVTVEVLRGF

SEQ ID NO: 190216 - protein, 144 aa, Glycine max
  Coding DNA Sequence Number=SeqID_73438
MLYQQDQLDLAATYIKHLKERIQKLKGEKEIFNIGSQLPLIEIKDLGLGIGVKLISGLNKNLMLYEVISVLEEDGAEVVTVNFSTVADKFFTRVMLRWLGGLLSLATLSSQSEEDTSCIFGNITSATLVEFGRKGWILLEKTEY

SEQ ID NO: 190217 - protein, 81 aa, Glycine max
  Coding DNA Sequence Number=SeqID_73439
MNLAVARGEKPTYPSLKAKRTDWDKLEPQLKKEVGTLGSSTLTLHFRRKKKNLMVMLRSTNVLATATELAPLAFPLSETEP

SEQ ID NO: 190218 - protein, 168 aa, Glycine max
  Coding DNA Sequence Number=SeqID_73440
MVSIVTKLQVLTVVGEGDTIIKALDDIVPEDDCGKLTDAMHAILHARGSKLKIDRILNICQASQSLSGQKNQNKFKTNSPVDGSDKAPGSIHKLTEETETKVIPIDKSPNSTNLAQSQESNHEVGSFGSLRKETNKCNDNNDTNEESKGKVVPDVGHNNNGLETGSKP

SEQ ID NO: 190219 - protein, 94 aa, Glycine max
  Coding DNA Sequence Number=SeqID_73441
  Gene Ontology: Mol. function=binding; Cellular component=thylakoid; Biological process=photosynthesis
  Homolog annotation: Hit_ID=Q2HPC2; Match level="QueryCoverage=91%, HitCoverage=20%, E-value=7e-19, Identity=55%"; Hit description=SGT1
  Pfam annotation: Domain name=CS; Domain location=15-76; Score=-5.3; E_ value=0.073; Accession=PF04969.6; Description=CS domain
MVVTIFAKGIPQHIIIVDFGEQILSVTISIPCKDAYAFQSGLFGKKLRIIGFPLSDRITKCRYEVLSTKIEIRLAKIDHIQWTSLEFNKGSTIA

SEQ ID NO: 190220 - protein, 96 aa, Glycine max
  Coding DNA Sequence Number=SeqID_73442
MLYVHIFILQDDADVRQIFNIFYNNPSLPFVELFAIIYDNNNPPSNQHGSTSNLEDLSDEYETCWVKNHDSDTDSSSGPDGSNMSPSHETIFKRDW

SEQ ID NO: 190221 - protein, 288 aa, Glycine max
  Coding DNA Sequence Number=SeqID_73443
MGLYVVAEQSTQLVALGKVYDTLATIHNVPYADDVVRAIGTFVGWPTHLVKPIFDEDSQKRLRIPVKSAEMDNVVATIDLLGELVKNLFEIYQKLIELAWDGAKFGIANVKDGFFITHAYVSEIILGDKCLNISILQLWLMFMNDWSTSIGYGSRYGFLEPQCIHNAKNKHEDCQHYIKTWVKESQREVYLGPYLNHVMKTLSTTLEGKADQAVPWWIELKSHVQRGYECGYYVMHWMWCIVSGGLKNEWNRWFSDRTPLSKESMTTLRNKWRDIFSRLRTWKLEKFR

SEQ ID NO: 190222 - protein, 185 aa, Glycine max
  Coding DNA Sequence Number=SeqID_73444
  Gene Ontology: Mol. function=protein serine/threonine kinase activity; Cellular component=integral to membrane; Biological process=protein amino acid phosphorylation
  Homolog annotation: Hit_ID=Q1T2W0; Match level="QueryCoverage=45%, HitCoverage=8%, E-value=1e-18, Identity=55%"; Hit description =Leucine-rich repeat; Leucine-rich repeat, cysteine-containing type
  Pfam annotation: Domain name=LRR_1; Domain location=110-129; Score =14.1; E_value=0.51; Accession=PF00560.23; Description=Leucine Rich Repeat
  Pfam annotation: Domain name=LRR_1; Domain location=135-157; Score =5.7; E_value=24; Accession=PF00560.23; Description=Leucine Rich Repeat
  Pfam annotation: Domain name=LRR_1; Domain location=159-181; Score =8.4; E_value=7.5; Accession=PF00560.23; Description=Leucine Rich Repeat
  Pfam module annotation: Pfam domain module=LRR_1::LRR_1::LRR_1; Domain location=110-129::135-157::159-181
MEDASHSQWCPPPISVIKVNVDEENGDALEFKFLATKCGLEVCWEEGFVRRVICETDCNNVVEIVQEPVEKRIRGTCSGCTVWRVAPRFTLEVLCQDSLGIPNSLSNALYLEVLDLSSNNIFGTIPSCLMTVSENIGVLNLKNNNLSSPIPNTITASCGLWTLNLRGNQLDGPIPNSLAYCSKLE

SEQ ID NO: 190223 - protein, 43 aa, Glycine max; identical to SEQ ID NO: 155516
  Coding DNA Sequence Number=SeqID_73445

SEQ ID NO: 190224 - protein, 79 aa, Glycine max
  Coding DNA Sequence Number=SeqID_73446
MNQKHKNPWKTEVARVLRMTKQKVEWTNLFVGRRRFLSSCACVEGRRYAMMFLSFSVSVDCEGCDYECLSFSVSVDCDL

SEQ ID NO: 190225 - protein, 147 aa, Glycine max
  Coding DNA Sequence Number=SeqID_73447
MASKKRKAPATPSHVRYDRSRFTSPEAWERYTDIIVPRKLLPERNLVIYHTEFDKFMEELERRRWDEELTSFEEGNIDDKSPKQVRVRGHLIKFDEDTLNTFLKTPVIIEEGETLSAYSRFALLRPNPQELAAKLCIPRRGFELNAD

SEQ ID NO: 190226 - protein, 285 aa, Glycine max
  Coding DNA Sequence Number=SeqID_73448
  Gene Ontology: Mol. function=nucleoside-triphosphatase activity; Cellular component=membrane; Biological process=ion transport
  Homolog annotation: Hit_ID=Q6A614; Match level="QueryCoverage=23%, HitCoverage=27%, E-value=2e-26, Identity=92%"; Hit description=ABC transporter ATP-binding protein
  Pfam annotation: Domain name=ABC_tran; Domain location=31-180; Score =12.9; E_value=1.2e-08; Accession=PF00005.17; Description=ABC transporter
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSIGMRQRLGIACAIVGDPAVLLLDEPTVGLDPASRIGVRSLLGELAEDRTVIVSTHLLEDLQEFVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 190227 - protein, 99 aa, Glycine max
  Coding DNA Sequence Number=SeqID_73449
MSAGLRCEGQVATICDENSSRRSDLVQPCPPGFQLGNWRVEERPEVYTTSIISDDESREGTNIEDPVVDFEQEASRMEEEEDEDVGLPPELERIIARED

SEQ ID NO: 190228 - protein, 92 aa, Glycine max
  Coding DNA Sequence Number=SeqID_73450
MTLMSMLLSLKSCMLVRNVSRICPLDLMMKYVQFQLISRLSVHPPLSATEESDRASASRPHAKREINALSLACVFSQAQRTIGAKPESTYPR

SEQ ID NO: 190229 - protein, 65 aa, Glycine max
  Coding DNA Sequence Number=SeqID_73451
MKSRDVSEIKRKQACVILEFRNVAKVEKRKSKPRRFRNVSVSNYAKILDRSSRFIVRSSFSSVFN

SEQ ID NO: 190230 - protein, 78 aa, Glycine max
  Coding DNA Sequence Number=SeqID_73452
MEMRAVGMVQTRSGHEIGIGPDDVDGDGVEVVVWFAVECLGSGTVVFWCGGDWCWVEEEKEEGLFMQRGNSNANEDYW

SEQ ID NO: 190231 - protein, 185 aa, Glycine max
  Coding DNA Sequence Number=SeqID_73453
DRVRWHPETNYGHSAPLSSRGGGPDDTQRQIMVILHLCHPEAANPMTQAASPMTCEEPLGPALFFTFCHPEAADSMPNNTQRLTSSSAPFVIQGQRVRRWTEIPYGHPRLSLTGRNEFGSIRMMFFSLSSSGNIQVQRREEFFSAGQRRLGAMAKGSVAVSNFVVFKTLKFIDASDAFSFLTERQ

SEQ ID NO: 190232 - protein, 190 aa, Glycine max
  Coding DNA Sequence Number=SeqID_73454
HSPPLEPPDIQVVVAGVSTKGSCAEAYTIPLAKKPSDLHIDIMGLYVVHDQCTKLVALGKVYDSAFTIHNIPYADDVVRVSVVKVYHGDAYGSPLQLLFVHLYLKEISMGVYRKAHQIVKYLKLKRMNPSIEHRELMLAKIKFRIEALLIEHPKLLNPRSLVRLNIQASSTDPSCKTTPDLDSPLRFRLT

SEQ ID NO: 190233 - protein, 236 aa, Glycine max
  Coding DNA Sequence Number=SeqID_73455
WIPFDEHAINQFLGHPPVLEEGQHCEFSQRRSQASGFDEEAINRLLCVPRQDFAQSVVGRRVSVHVAQLISDVIYQFARITPRRHPVDPEKSNRALGFPTMITGLCQFCGVAVAPTKLIRPPISRGQASQQPNEDQQQPATDAPPPPLQEVPSLESISNHLRRLELQMHRGQVQLNDTFYWYNMHQQSQDPHPFPWPTLDQFGATVASPGDWVNFETRLGPVGAPGGCWIKWPRNN

SEQ ID NO: 190234 - protein, 68 aa, Glycine max
  Coding DNA Sequence Number=SeqID_73456
  Gene Ontology: Mol. function=monosaccharide-transporting ATPase activity; Cellular component=membrane; Biological process =carbohydrate transport
  Homolog annotation: Hit_ID=Q8X5Q4; Match level="QueryCoverage=99%, HitCoverage=16%, E-value=4e-19, Identity=71%"; Hit description =Ribose import ATP-binding protein rbsA 2
MAATPILEMRAITRRFGSFYALKGVDLTVWPGEVHALMGENGAAGKFLSMVNPTPSGARKRRWRQGSP

SEQ ID NO: 190235 - protein, 400 aa, Glycine max
  Coding DNA Sequence Number=SeqID_73457
  Gene Ontology: Mol. function=transferase activity, transferring phosphorus-containing groups; Cellular component=membrane; Biological process=two-component signal transduction system (phosphorelay)
  Homolog annotation: Hit_ID=Q8X5Q3; Match level="QueryCoverage=92%, HitCoverage=49%, E-value=9e-74, Identity=45%"; Hit description =Sensor protein
  Pfam annotation: Domain name=HAMP; Domain location=290-360; Score =58.6; E_value=2.1e-14; Accession=PF00672.15; Description=HAMP domain
MSHSLHWHAGARGRLLMFNLLVVSVTLAVSLVAIFGFRHAGHIQEQAQAQTLADMNGSLALARDTANVAIAAVRLAQVVGALEYQSESARLQQTQQALQQSLSQLASAPLAAQQPALLARIRERSQMLEQSISQLLLEGHQRHLQRNVMLSGLWQAQLLLNRIDLLASDGAFLPLRQQTAALLTVAIQSATPQAAVQQLNSVLPIWSALPLQGVLAMQRARLVSTSQQLLPVAGQLEQSDIAIAYATYRIKALVAMLNEDITHYVQLVAQQSDARSATAHQELDSIIGFIGLFMLLALLITGYAGYYIYRNLGSSLTAIAHAMTRLAQGEKSVSVPGLARRDELGDLARAFNVFARNTASLAHTSQLLKEKSNQLESTFLAMRDGFALFDNSGQLVVWNA

SEQ ID NO: 190236 - protein, 490 aa, Glycine max
  Coding DNA Sequence Number=SeqID_73458
  Gene Ontology: Mol. function=phosphonate transporter activity; Cellular component=outer membrane-bounded periplasmic space; Biological process=phosphonate transport
  Homolog annotation: Hit_ID=Q66D25; Match level="QueryCoverage=59%, HitCoverage=95%, E-value=1e-128, Identity=75%"; Hit description=ABC periplasmic phosphonate binding protein, phnD precursor
  Pfam annotation: Domain name=SBP_bac_3; Domain location=14-274; Score= -90.8; E_value=0.046; Accession=PF00497.10; Description=Bacterial extracellular solute-binding proteins, family 3
MAFGVNAADAPKQLNLGILGGQNATQQIGDNQCVKTFFDKELGVDTQLRNSSDYAGVIQGLLGNKIDMVLSMSPASYASVYLQNPKAVDIVGVVVDDKDGSKGYHSVVIVKADSPYQKLEDLKGKSFGLADPDSTSGFLIPNQAFKKLFGGTVDNKYNDTFSSVTFSGGHEQDILGVLNGQFEGAVTWASMIGDYNTGYTSGAFTRMIRMDHPDLMKQIRIIWQSPLIPNGPILVSNSLPADFKAKVVTAIKKLDKDDHQCFIKAMGGKQHIGDTTLAEYQTIIDMKRELTKGDPRSAAVVARAGGAVPGRRQPRRVQPAHRLGVYSALLRLPGRNHSDAALASAVRRRAHRGLAGLLGLPPEYPAATDLGDPAAGAGGDHFLGAGGDRAGVSGGRQHLYPGLGAAGDPHAGGVLTHHAGAGVGGDVRDGVRHRRHSRLPGAGAAHHRQPDQAVLRIDRNRLQQTGARAGGLRRHAAAAHALRPVAAGEA

SEQ ID NO: 190237 - protein, 325 aa, Glycine max
  Coding DNA Sequence Number=SeqID_73459
  Gene Ontology: Mol. function=tryptophan-tRNA ligase activity; Cellular component=mitochondrion; Biological process=tRNA aminoacylation for protein translation
  Homolog annotation: Hit_ID=UPI0000E68C02; Match level="QueryCoverage =84%, HitCoverage=81%, E-value=1e-111, Identity=72%"; Hit description= tryptophanyl-tRNA synthetase
  Pfam annotation: Domain name=tRNA-synt_1b; Domain location=1-247; Score=136.1; E_value=9.6e-38; Accession=PF00579.15; Description=tRNA synthetases class I (W and Y)
MVADLQGLTDNGNNPQKISANVLNVVADYLAVGIDPHKTTICLQSALPALAELTMYYLNLVSVARLERNPTVKNEIAEKDFARSLPAGFLIYPVSQAADITAFGATHVPVGEDQLPMLEQTNEIVRRFNHIVGQAILTECQPLLSNVGRLPGLDGQGKMSKSRGNAIPLGAGADEVHKAVMSMFTDPGHLNVSDPGRVEGNMVFTYLDAFCEDAALVADLKAHYRRGGLGDVKIKRLLEDCLQSLLEPIRARRAEFIADKGELTRILQHGTRRAHQPLKPEKSYGSGTVKIGTARLSRAARRRIPQSIIGKGTRQGLQSAAARAG

SEQ ID NO: 190238 - protein, 367 aa, Glycine max
  Coding DNA Sequence Number=SeqID_73460
  Gene Ontology: Biological process=cell redox homeostasis
MNESYVLAEVSNENQTLVAVVQQGSRAAYFYIYPAEAYSDRYQVRACWLRNLAAAPLQEDRAALEQGQPPMLAAEYCRNLEGEAPLNPEGLMVVWSESDDGAALWYYGQLLAVIPGWSLYIDHSVCYSASCIKESPLAYPLGSASTNTQYAQAESTRQFWRSWQREEGNPWPKMQRDFQARYESHFGPSVKYYAIDQGKWPPMAITQHERDGIYYFLTMGVSIRPMPWVEILFNDEASRYRRMEMAIAIDSQYMTEDNAVQMASALAGFAHAPWARLTWIGEGHTLESDVAPLGYEGYILSSSFYPHNAHLTLPQQYGDPVNLFWASPVFTAERQLAHATPNGGHDLVNRLREQGVDHIFRPRQPVC

SEQ ID NO: 190239 - protein, 93 aa, Glycine max
  Coding DNA Sequence Number=SeqID_73461
LERIDGDPVLRETRIWATWEYVSSDGGGQQGMSGTWRYVAGVRRPWGRQASSWQSTDKRKTRPQSKEACGGWPAEAKMVSGNRLPRGVIDYQA

SEQ ID NO: 190240 - protein, 139 aa, Glycine max
  Coding DNA Sequence Number=SeqID_73462
MAKFDLEIVLEFYANAWPTEEGVRDMRSWVRGQWIPFDGDAISQFLRHPLILEEGQQCEYSQRRSQASGFDKEAITNFWIAPTRHLVDPEKSNRALGFPALIKGLCQFYGVSVTLSKLIRPPINRAFIEKYCMTRQAQG

SEQ ID NO: 190241 - protein, 60 aa, Glycine max
  Coding DNA Sequence Number=SeqID_73463
MGAKHLTRTKERSHVIKQRSPDEIRGVLIKALIHPYLTPMVGHLLVDSRGGGDVSVAAYY

SEQ ID NO: 190242 - protein, 336 aa, Glycine max
  Coding DNA Sequence Number=SeqID_73464
  Gene Ontology: Mol. function=DNA binding
  Homolog annotation: Hit_ID=Q1S0F5; Match level="QueryCoverage=71%, HitCoverage=58%, E-value=5e-27, Identity=30%"; Hit description=IMP dehydrogenase/GMP reductase
MGSNQAPLLKKRFYQVKIKSLEVASLQDLGQLMDQLQHQAFHKAYGKIWDLAMIEVSVEAIASLTQYYDQPLRCFTFGDFQLVPTVEEFEEILGCPLGRQKPYLFSGFYPSMARIAMVVKISMQELDQVKQNRNGIVGIPRRHLEEKAKVLADQGEWALFIDVLALLVFGLVLLPNVDGLVDLAAIDAFLAYHHSKESPVVAILADTYDTFDRRCINNGTRIVCYTPALYGGRVGVLSSCEGFSNVFLMGTRGCINYNPVLAIRQIGYPMRGAPSEKSITPFIARGFSDPNARILQGVCLQDAQMQELDWLPKLKVSNEEEVETPKESEDVQALKA

SEQ ID NO: 190243 - protein, 88 aa, Glycine max
  Coding DNA Sequence Number=SeqID_73465
MALVSACQQARLPLIDKRCVRVIVGCLRMPLDSWVTFLPEDVDIFGKGADDHIGLCLSIGLGVSELLGTDNRKVSLHVTGLSGHWIAK

SEQ ID NO: 190244 - protein, 117 aa, Glycine max
  Coding DNA Sequence Number=SeqID_73466
MRRHPTITRTHLLSSRDGESDDMRGYLMVIRTFCHLETASPMICRGASEPVDTQRLTPSSAPLSSRDSESDDMRGYLLVIHTFCHPEMAIPMTCGGTLWLSAPFVNQRQVSPLTRRD

SEQ ID NO: 190245 - protein, 333 aa, Glycine max
  Coding DNA Sequence Number=SeqID_73467
  Homolog annotation: Hit_ID=Q47522; Match level="QueryCoverage=19%, HitCoverage=87%, E-value=1e-21, Identity=73%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPQLNQFYKEHRCLWEIDTSYDGIEIIDADNRDQSVLSFIRKGKKDEMLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 190246 - protein, 154 aa, Glycine max
  Coding DNA Sequence Number=SeqID_73468
MDMNLGYLISHQISIIAQYDSSRLGFPALITALCKARGVTSDSRSLESLSPAINLAYIKKNCWNLDDPIVTFRGPRKARAHEPVPPEPFIFETDPVAQEGAAAQKPTSPVHISPTPIPEDSQPSAPVSKPEQPIVQDPPAAPVLDLNEHAEDQQ

SEQ ID NO: 190247 - protein, 179 aa, Glycine max
  Coding DNA Sequence Number=SeqID_73469
ARVLASQDEWAPFMDILTLLIFGVVLFPNVDGLVDRAAIDAFLSFYDHKESLVIAILADLYDTFDQRCEKNNARIVCYTLALYVCTNAGVLQRVHKAWEMSQRKDKELKGSSNGPIGGYHRWLKAYAQDLDWLPSLRTTKGMEVETPEEDEEDTKGERRTERRQYSHHQGLGARDQEGP

SEQ ID NO: 190248 - protein, 79 aa, Glycine max
  Coding DNA Sequence Number=SeqID_73470
MGSGNAMWLDSHVDLNESSFPWRKAICTFFRGLKGAWKHIRTLEFKWKNRRNSSYFGNGKIFGARTQEEGLIRIILTWF

SEQ ID NO: 190249 - protein, 44 aa, Glycine max
  Coding DNA Sequence Number=SeqID_73471
MSFTKGKIGVNEMAPKKLSMKRSRRDATGEGSNAASEFDSHRFR

SEQ ID NO: 190250 - protein, 88 aa, Glycine max
  Coding DNA Sequence Number=SeqID_73472
  Subcellular localization annotation: CTP_CleavageSite=76; ConfidenceScore=5.44e-01
TSFEAQNFVLLLPLSLHSSSPTFKLLSMASYGGELVLDSSSPSSGVSNHLSSFSIPLPLNFKKQRTPLMKKIQGLQAPHGATSRYFHT

SEQ ID NO: 190251 - protein, 101 aa, Glycine max
  Coding DNA Sequence Number=SeqID_73473
MVQLWFGIRVKEPGGPFGPANKSYPEPHELIVIHASSTIKSGAPRIDCLALFVRPPPSSPEPHELIVIHASSTIESRAPRIDCLALFVHPPPTNLIRSTMN

SEQ ID NO: 190252 - protein, 104 aa, Glycine max
  Coding DNA Sequence Number=SeqID_73474
MANKNISSNETYPPTLIPKTIPKLQNSLRVGKGNIGSKVLSKELIQGRLIWLEAYKNKLPKSSPNMHVKQEVSTRVKPRLLCKQSMGQNTPNKIDDDGSNSHQG

SEQ ID NO: 190253 - protein, 131 aa, Glycine max
  Coding DNA Sequence Number=SeqID_73475
MFIDGLRPQTKQLLDASAGGKIKLNTPKEATELIKNMLASDHAILLQVVPSMVRLMKQANVFPPKKTLKKFILWGINNGKGILKEDFQAFSRVPIINKDSIGHTLVTNSTKTKMDLRIGQSNKGPTFSRGR

SEQ ID NO: 190254 - protein, 104 aa, Glycine max
  Coding DNA Sequence Number=SeqID_73476
MEVNAAAVTAANAVAGVDLTPPSGLNQMNHPTSDVGDPHFVQIHNKHASPSYGLPPNYTPPNVAHTPVENVNNSTPIPIESQQPQSNHAHVYPWGRHMKYPITI

SEQ ID NO: 190255 - protein, 109 aa, Glycine max
  Coding DNA Sequence Number=SeqID_73477
MDRAHKTPSGPGGAQQGPEVPSSGYGPLDRAHKIPNGPGGVQQGPKSYGVPVAPSKFIKPPINRAFIKKYYAPRQAQGETPQQPRDGRQRATNALPPLLEFTLAHPRKG

SEQ ID NO: 190256 - protein, 63 aa, Glycine max
  Coding DNA Sequence Number=SeqID_73478
MVRNTKLKKLNKKVTALAIESNTKVTATIIERNRELWTIEREFRRMERNREFRREEQKWETES

SEQ ID NO: 190257 - protein, 284 aa, Glycine max
  Coding DNA Sequence Number=SeqID_73479
  Gene Ontology: Mol. function=homoserine dehydrogenase activity; Cellular component=chloroplast; Biological process=aspartate family amino acid biosynthetic process
  Homolog annotation: Hit_ID=Q66G76; Match level="QueryCoverage=99%, HitCoverage=36%, E-value=1e-129, Identity=89%"; Hit description =Bifunctional aspartokinase/homoserine dehydrogenase II
  Pfam annotation: Domain name=AA_kinase; Domain location=40-271; Score= 58.2; E_value=2.7e-14; Accession=PF00696.18; Description=Amino acid kinase family
MHCCSRAGEWASTAQVWRQQSGGCEVLSACGRDYGGIQPAGRHDGGIGRRQYHQPVDQLAEAQPERSPVCAPGAADVASLSQRSYQRPAAAGKRRAADRRVHSGSGTSGGAAGRQSRRGVLCRSGRARRDLAAWLDARDFLRAERAAQPQVDEGRSYPLLQQLLAQHPGKRLVVTGFISRNDAGETVLLGRNGSDYSATQVGALAGAARVTIWSDVAGVYSADPRKVKDACLLPLLRLDEASELARLAAPVLHTRTLQPVSGSDIDLQLRCSYQPEQGSTRIER

SEQ ID NO: 190258 - protein, 69 aa, Glycine max
  Coding DNA Sequence Number=SeqID_73480
MPNPDVEPLYMMALTIPQLFLKLLQMLWDATMFEVYNDHFALHIKHEDLSKIAHSVQCLGISVIQLWIF

SEQ ID NO: 190259 - protein, 299 aa, Glycine max
  Coding DNA Sequence Number=SeqID_73481
  Gene Ontology: Mol. function=transporter activity; Cellular component= membrane; Biological process=transport
  Homolog annotation: Hit_ID=Q7WEP2; Match level="QueryCoverage=99%, HitCoverage=54%, E-value=1e-138, Identity=84%"; Hit description =Putative binding-protein-dependent transport protein
DRDDGLLVDLVEVGVGEAAVVAGAQALGRVERGDPQLEQRRGFARFRRPAAHGEAELALGALGEVDRGGHGVDVGLDADAGQVLGHGLRHLAVIDVAVVGRRQRQLEAVGVAGFGQQLLGAFRVVLDFRGLGQRAEHAVGHELVGRRGHAVHDAGGDGLAIDGHGDRLAHSQVLQRVLAVGALDERARVARHVGLEEHQAGGGRGHEAELGVVLQALQVARGGVFDHVEVARQQAGQARAGGRHRHELHFLPVGFRAPSSFRCAPVAMPVPLTYDFRVYGSLPMAWKFFIKSATVGHGP

SEQ ID NO: 190260 - protein, 87 aa, Glycine max
  Coding DNA Sequence Number=SeqID_73482
MEASLCISGKGFILNTEGQPWKLLRKDLTTLAQTWSVLSYSNLAPTSCISDLNTDRARLVYGLITRMDMNIGDRGEWDLMPLPPMKI

SEQ ID NO: 190261 - protein, 89 aa, Glycine max
  Coding DNA Sequence Number=SeqID_73483
MQNSKRDVYLGAYLNAAHWQMVIILPKENVVIWFCSLHNRPNNYLKGIINSALKGFNDNPQSKSKVTLGGLLLNVIDKKEALSGYYVMH

SEQ ID NO: 190262 - protein, 260 aa, Glycine max
  Coding DNA Sequence Number=SeqID_73484
  Gene Ontology: Mol. function=carboxylesterase activity; Cellular component=cytoplasmic membrane-bound vesicle; Biological process =biological_process
  Homolog annotation: Hit_ID=Q6CBB1; Match level="QueryCoverage=99%, HitCoverage=78%, E-value=5e-87, Identity=60%"; Hit description =Similar to sp|P10768 Homo sapiens Esterase D
  Pfam annotation: Domain name=Esterase; Domain location=1-253; Score =159.0; E_value=1.2e-44; Accession=PF00756.11; Description=Putative esterase
  Pfam annotation: Domain name=Peptidase_S9; Domain location=73-254; Score=-83.8; E_value=0.092; Accession=PF00326.11; Description=Prolyl oligopeptidase family
  Pfam module annotation: Pfam domain module=Esterase::Peptidase_S9; Domain location=1-253::73-254
  Subcellular localization annotation: CTP_CleavageSite=48; ConfidenceScore=5.06e-01
MSFNLYLPPQAIQNSSQKVPVLIYLSGLTCTANNCSEKGFFQHGASKKAMSKRVETANKDVGGLNIQGEDDSWDFGTGAGFYVDATKEPYKGGYNMYTYVTEELPKTVFAAFPQLDESRVSITGHSMGGHGALTLFLRNPGKYKSVSAFAPISNPINCPWGQKAFGGYFGEDQQEKWKEHDATELVKKWKGPLDVLIDVGTGDNFYKQGQLLPENLEKAAKEAGVEGLKVRYQPDYDHSYYTMATFADDHVEHAAKYLFA

SEQ ID NO: 190263 - protein, 185 aa, Glycine max
  Coding DNA Sequence Number=SeqID_73485
  Homolog annotation: Hit_ID=Q6CQE3; Match level="QueryCoverage=31%, HitCoverage=73%, E-value=9e-12, Identity=47%"; Hit description =Kluyveromyces lactis strain NRRL Y-1140 chromosome D of strain NRRL Y- 1140 of Kluyveromyces lactis
MKFQRLPGPVGQGYRLVEYISVARVRPRTSKGITDLLRSRSLTELTRQIAPPTKNGHAPPPIESRKSSQSVNPYYVWTCTGGTTRPVKDRSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 190264 - protein, 274 aa, Glycine max
  Coding DNA Sequence Number=SeqID_73486
  Gene Ontology: Mol. function=metallocarboxypeptidase activity; Cellular component=membrane; Biological process=proteolysis
  Homolog annotation: Hit_ID=UPI00005F76AD; Match level="QueryCoverage =99%, HitCoverage=55%, E-value=1e-114, Identity=71%"; Hit description= COG2317: Zn-dependent carboxypeptidase
  Pfam annotation: Domain name=Peptidase_M32; Domain location=1-273; Score=34.2; E_value=2.4e-18; Accession=PF02074.6; Description =Carboxypeptidase Taq (M32) metallopeptidase
FDFDGGRLDISAHPFCGGVPEDVRITTRYNENDLLSALFGVIHETGHARYEQNLPRNWLDQPVGLARSTAIHESQSLFFEMQLGRSEAFLNRLLPAVRQRFGDQPAFSAENFIAWNQRVKPGFIRVDADEVSYPAHVILRYEIERALIDGDIEVDDIPALWDEKMQSWLGISTLGNYRDGCMQDIHWTDGGFGYFPSYTLGAMYAAQLMAAARRALPNLAQDIAGGDFNALFDWLRQNIWQHGSRFTTSQLIKNATGEDLNGEYFRQHLTARYL

SEQ ID NO: 190265 - protein, 56 aa, Glycine max
  Coding DNA Sequence Number=SeqID_73487
MGTTNTFCSISSKKYNLLVPPILEDRATVPLPLYYEPSAIALVFSRLDVEAILSND

SEQ ID NO: 190266 - protein, 60 aa, Glycine max
  Coding DNA Sequence Number=SeqID_73488
MEKELKDLESGICKKEKVEFESPIIRNFSDQKQFKEPNEIDQDLQMQSQHQNSVLVREFD

SEQ ID NO: 190267 - protein, 49 aa, Glycine max
  Coding DNA Sequence Number=SeqID_73489
MRMRKWREESEFLESQNAVGFESKNPFTSLMVPPFEEGQGRVVINYKIW

SEQ ID NO: 190268 - protein, 107 aa, Glycine max
  Coding DNA Sequence Number=SeqID_73490
MSFSRDFLSGNRLPKYVIDYQCPKMNYTAFAHWKLKITLCKVIDYTVLPLIDYPRMVIDYQRLISRYHPRYIAGQPPHKSPCFVDFVLLLVDCQELACLGTSQVLTD

SEQ ID NO: 190269 - protein, 86 aa, Glycine max
  Coding DNA Sequence Number=SeqID_73491
MASRKRKAPSTPTQVRFDRSRFTSQEAWERYTDIIVPRKLLPERNMVVYYTEFDEFNEELERCHWDEELTDFGDGNIDVAIVKEDC

SEQ ID NO: 190270 - protein, 716 aa, Glycine max
  Coding DNA Sequence Number=SeqID_73492
  Gene Ontology: Mol. function=N-acetyltransferase activity; Biological process=metabolic process
  Homolog annotation: Hit_ID=P76562; Match level="QueryCoverage=58%, HitCoverage=63%, E-value=1e-155, Identity=64%"; Hit description =Hypothetical protein ypfI
  Pfam annotation: Domain name=Abhydrolase_2; Domain location=448-653; Score=213.3; E_value=5.5e-61; Accession=PF02230.7; Description =PhospholipaseCarboxylesterase
  Pfam annotation: Domain name=DLH; Domain location=449-658; Score= -66.6; E_value=0.011; Accession=PF01738.9; Description=Dienelactone hydrolase family
  Pfam annotation: Domain name=DUF699; Domain location=3-133; Score =124.5; E_value=3e-34; Accession=PF05127.4; Description=Putative ATPase (DUF699)
  Pfam module annotation: Pfam domain module=Abhydrolase_2::DLH::DUF699; Domain location=448-653::449-658::3-133
MSRGHRGRYRRARARAVVTAPTKGATESIARFAGERFHFMAPDALLASSHQADWLIVDEAAAIPGPLLEKLVSRFPRVLLTTTVQGYEGTGRGFLLKFCGRFPGLQRYSLSTPVRWAAGCPLERIVASALLFDDTLLDRRPEGEVRITSLTPAAWERCPALVASVYELLCAAHYRTSPLDLRRMMDAPGQQFAVAEANPVIAGALWLVEEGGLSPALSRAVWAGFRRPRGNLVAQSLAAHGGSPLAATLRGRRVTRIAVHPHRQREGIGQALIRSTSGEDYLSVSFGYTEELWRFWQQCGFVLVRMGSHREASSGCYTAMALLAQSEAGHQLCQQAQQRLKRDARVLSAWNGEKIPVEDEWEATLNHDDWLELAGFAFAHRAFSTSVAALTRLLLAVDMPLPALRGKMEGKTEDIGQKALLVKLRSETAQALESVESRSSIKETTMKHDHFVVQSPDKPAKQLLLLFHGVGDNAVNMGQIGSWFAPVFPQALIVSIGGVEPCGPNGRQWFSVQGVTEENRQARIDAIMPTFIDIVRYWQQQSGVGADATALIGFSQGSIMSLESVKAQPGLVSRVIAFNGRFATLPTHATTQTTIHLIHGGEDRVIELSHAVAAQEALIREGGDVTLDIVDDLGHAIDDRSMQFALDHLRYTVPKHYFDEALSGVVVIVPLVVKIAVRGKIRFVGEKFFMVNALKVFNHVQQYADQKNQHQNPPVL

SEQ ID NO: 190271 - protein, 65 aa, Glycine max
  Coding DNA Sequence Number=SeqID_73493
MVSLGENGVTSDEDSWIVVVVVEGLSSWWRQVGGEGFGVVVAMGSKEKLGFVKSMYREQKDREFK

SEQ ID NO: 190272 - protein, 106 aa, Glycine max
  Coding DNA Sequence Number=SeqID_73494
  Subcellular localization annotation: CTP_CleavageSite=49; ConfidenceScore=5.10e-01
MDYVTSLLRLLSNTFRIVDILVTSSFTLTKMSWTKTRFTTPLPNLYGARVMGKAEEVQEKVKADMDAMKEKMATMMEAMMSMKKIMEVNAVTIESQQPQTDHSHVS

SEQ ID NO: 190273 - protein, 49 aa, Glycine max
  Coding DNA Sequence Number=SeqID_73495
MSMNAAHSPWLVFDGRQVHRIVQWCVKTDKGCVGLPTGCDAILNPKGIG

SEQ ID NO: 190274 - protein, 98 aa, Glycine max
  Coding DNA Sequence Number=SeqID_73496
MHDTKPEEKIIGQRTEVYRPTVQIAPKQRSKDLNRIWRGRQPKPRCRITVLVIEDVHVGRTCLRMIRGKTTCVEVSDFETSRVGLRWKRRPISRYRWR

SEQ ID NO: 190275 - protein, 299 aa, Glycine max
  Coding DNA Sequence Number=SeqID_73497
  Gene Ontology: Mol. function=transferase activity; Cellular component= mitochondrion; Biological process=steroid biosynthetic process
  Homolog annotation: Hit_ID=Q944G1; Match level="QueryCoverage=98%, HitCoverage=52%, E-value=1e-91, Identity=61%"; Hit description =Phosphomevalonate kinase
  Pfam annotation: Domain name=GHMP_kinases_N; Domain location=203-284; Score=33.5; E_value=7.4e-07; Accession=PF00288.16; Description=GHMP kinases N terminal domain
MAEVVTSAPGKVLMTGGYLILERPNPGLVLSTNARFYAIIKPIHHEIKPDSWAWAWTDIRLTSPQLCRQALYKLALKNLAIQTVSPRHLHLLLFKLFFSLLASIIELLLCSFWFWYFSDTRNPFVEYAIQYSVAAAYATFDQNKKELLHKLLLHGLDITILGGNDFYSYRNEIERRGLPLTPESLATLLPFSSITFNTDDADGGSCKPEVAKTGLGSSAAMTTAVVAALLHYLDVVKLSSSKDHWERKDVADLDMVHKIAQTAHCIAQGKVGSGFDVSSAVYGSQRYVRFSPEVISSTK

SEQ ID NO: 190276 - protein, 788 aa, Glycine max
  Coding DNA Sequence Number=SeqID_73498
  Gene Ontology: Mol. function=oxidoreductase activity, acting on the CH-NH2 group of donors, NAD or NADP as acceptor; Cellular component =membrane; Biological process=nitrogen compound metabolic process
  Homolog annotation: Hit_ID=Q93WZ8; Match level="QueryCoverage=100%, HitCoverage=32%, E-value=0.0, Identity=92%"; Hit description=NADH glutamate synthase precursor
  Pfam annotation: Domain name=GATase_2; Domain location=1-398; Score =478.7; E_value=7.2e-141; Accession=PF00310.11; Description=Glutamine amidotransferases class-II
  Pfam annotation: Domain name=Glu_syn_central; Domain location=494 -787; Score=641.5; E_value=7.2e-190; Accession=PF04898.4; Description= Glutamate synthase central domain
  Pfam module annotation: Pfam domain module=GATase_2::Glu_syn_central; Domain location=1-398::494-787
VVDFELPPPGKYAVGMLFLPTSNSRREESKNVFQKVAESLGHSVIGWRSVPTDNTGLGKSAVLTEPVIEQVFLTPSTQSKVDLERQMYILRKLSMVAITSALNLDNDGITDFYICSLSSRTIVYKGQLTPAQLKDYYFADLGNERFTSYMALVNILSSNFSSFSTNSIYSNKQHGEQPVTEEMQGWGMTSEALSWPGRQYLSGGVKKSFQLKWNRISGISTGAVALQYTIIDIHSRFSTNTFPSWDRAQPMRVLGHNGEINTLKGNVNWMKAREGLLKCKELGLSENELKKLLPIVDANSSDSGAFDGVLEFLIQSGKSLPEAVMMMIPEAWQNDKNMDPQRKAFYEYFSALMEPWDGPALISFTDGHYLGATLDRNGLRPGRFYVTHSGRVVMASEVGVVDIPVEDVSRKGRLNPGMMLLVDFEKHIVVNDDALKEQYSLARPYGEWLKKQKLELKDIVDSVHESERVPPSITGVVPASGDDVDMENMGINGLLVPLKAFGYTVESLEMLLLPMAKDGTEALGSMGNDAPLAVMSNREKLTFEYFKQMFAQVTNPPIDPIREKIVTSTECMVGPEGDLTEITEDQCHRLSLKGPLLSIEEMEAIKKMNYRGWRSKVIDITYSKGRGKKGLEEALDRICAEAHDAISDGYTTLVLSDRAFSRKRVAVSSLLAVGAVHQHLVKTLERTRVALVIESAEPREVHHFCTLVGFGADAICPYLAVEAIWRLQVDGKIPPKTNGEFYSKDELVKKYFKASNYGMMKVLAKMGISTLASYKGAQIFEALGLSSE

SEQ ID NO: 190277 - protein, 142 aa, Glycine max
  Coding DNA Sequence Number=SeqID_73499
  Subcellular localization annotation: CTP_CleavageSite=54; ConfidenceScore=5.10e-01
MAGEGSTSAPSECFWWQVFLLPIWTSGSHSVPRRSNSDFRLLFNYFSVILDLTRMESRSVGFEPTTSGCWRKNRPKAGEKRNGQVGVEEWHGLREKESQRSEKHTILGARTESSLGPSEGLDVTSSLFCFLDGCSPPSEGIS

SEQ ID NO: 190278 - protein, 115 aa, Glycine max
  Coding DNA Sequence Number=SeqID_73500
  Gene Ontology: Mol. function=transaminase activity; Biological process=metabolic process
  Homolog annotation: Hit_ID=Q93WZ8; Match level="QueryCoverage=96%, HitCoverage=6%, E-value=4e-43, Identity=65%"; Hit description=NADH glutamate synthase precursor
  Pfam annotation: Domain name=GATase_2; Domain location=59-115; Score=- 105.5; E_value=0.0052; Accession=PF00310.11; Description=Glutamine amidotransferases class-II
LYARSERTLPSENEKPRLNVRCPGPGRSPKLRVAVRSAMSAVPNKPLGLYDPAMDKDSCGVGFVAELSGESSRKTVTDALEMLVRMTHRGACGCEANTGDGAGIMVALPHQFYKE

SEQ ID NO: 190279 - protein, 115 aa, Glycine max
  Coding DNA Sequence Number=SeqID_73501
  Subcellular localization annotation: CTP_CleavageSite=70; ConfidenceScore=5.57e-01
MTSAPTWPKPQQTPHDTYQYAQHQPSFLARVGNSSNLALVQQRAPTQPQRAPTQNLAPAQPRPVGNSNPSTSTNSGRNFPVKKLAEFTPIPMSYTDLLPSLIANQMAVVTPKKIY

SEQ ID NO: 190280 - protein, 62 aa, Glycine max
  Coding DNA Sequence Number=SeqID_73502
MAEKTKKKLEEAAQSGSTEGVINLLSPIRRHVKWKIARTKETGQMTSEAAKEIIEKIDSLEE

SEQ ID NO: 190281 - protein, 129 aa, Glycine max
  Coding DNA Sequence Number=SeqID_73503
MAHIVDKIKTIDGSKETLKLAIRITELWFVGTPGRSEQAEMVIVDSDGNQIHVVYIIGVVDEVIFRHISPRRSYPCSVSNSLKASKLTINEPVAPIEEFNQKLSELGIEIHSVLTRRSQWSSQPSGSAQ

SEQ ID NO: 190282 - protein, 277 aa, Glycine max
  Coding DNA Sequence Number=SeqID_73504
  Gene Ontology: Mol. function=iron ion transporter activity; Cellular component=periplasmic space; Biological process=high affinity iron ion transport
  Homolog annotation: Hit_ID=Q6D643; Match level="QueryCoverage=73%, HitCoverage=74%, E-value=2e-51, Identity=51%"; Hit description=Hemin- binding periplasmic protein
  Pfam annotation: Domain name=Peripla_BP_2; Domain location=72-277; Score=93.7; E_value=5.7e-25; Accession=PF01497.9; Description =Periplasmic binding protein
MADRIHESWVTRKPGGDGFVTNCPAVRPAQRGHAGTGTLARAGDGADADRSRRMKALILTLLALLTLPAWATQRIITIGGDVTQIVYALDAQAQLVARDSTSQHPAAATRLPDVGYMRQLNAEGILALKPTLVLASALAKPSLVLQQVADAGVTVVEVSGDNRLDAITDKIATIGNALQREQAARALIDKVNKQRAQLPQRPLPVKVLFIMAHGGLRTQAAGAQTGADGAIRAAGLVNAMGAVPHYQQLSQEGVVAAAPDLVVVGEEGLRTLGGEQA

SEQ ID NO: 190283 - protein, 69 aa, Glycine max
  Coding DNA Sequence Number=SeqID_73505
MLQCERYFSHLKHDIKIPNGENARNWGCKHSAQISRRSNGGLREKERVLGEERRNEIVRQGRLRSQSEN

SEQ ID NO: 190284 - protein, 167 aa, Glycine max
  Coding DNA Sequence Number=SeqID_73506
  Homolog annotation: Hit_ID=Q6BTF8; Match level="QueryCoverage=91%, HitCoverage=23%, E-value=1e-24, Identity=34%"; Hit description =Similar to tr|Q92W30 Rhizobium meliloti Hypothetical protein RB0515
MREDPVQPENIHLDNPLTSREEVLRLVNDMLNAVAPWFKKDASRIDLANFTAHYGQQVASMETFSRLLWGVTPLLAGGSEPQHFSFYLQAIKNGTDPQHADYWGDVGPYDQRIVEMAAYGLLLALAGETVLAHFTETEKEHLWRWLKQCETQEIPDNNWHFFPILVQ

SEQ ID NO: 190285 - protein, 152 aa, Glycine max
  Coding DNA Sequence Number=SeqID_73507
  Pfam annotation: Domain name=zf-CCHC; Domain location=80-97; Score =31.1; E_value=3.8e-06; Accession=PF00098.13; Description=Zinc knuckle
EREMELQRLNQNEETDKKKRSIALKASSSMQAENEEEESEDEEDFSLFVKKFQKFVKKRRIERRQNFNNGRRSQEDSQILRCYKCNQLGHIKANCPSNEEWPEKSDKKRYEERRTKKAYIAWDDNDSSDGSEKEINLLTKDYESDENISQVD

SEQ ID NO: 190286 - protein, 113 aa, Glycine max
  Coding DNA Sequence Number=SeqID_73508
MVQKKDKKLRGSSNMVVGSYHKWLKAYAQGLDWLPNLRVIKEVEVEAPEEGEEVQAFRMELEKAQAVKEKFKSVAVRIRKENTELRDINIATTKALQQETKRARKEEYGRNKF

SEQ ID NO: 190287 - protein, 148 aa, Glycine max
  Coding DNA Sequence Number=SeqID_73509
MGDLEEVQEQMKADMLAFKEQMASMMDAMLGMKQLMESNMAIAAAVSSAAEADPTLSTTAHHPIPNMVGREGSTSRHINNPHSWYNRGTYPYGLPPNYTPPAIHEDVGHVPTLILEGEPPRHPDGVHENPQEHAQGDINSYCRSKASW

SEQ ID NO: 190288 - protein, 44 aa, Glycine max
  Coding DNA Sequence Number=SeqID_73510
MVRRGEKVAKRLSTAKRSFRALSAKENLAEHQHQSRVLSARSVR

SEQ ID NO: 190289 - protein, 89 aa, Glycine max
  Coding DNA Sequence Number=SeqID_73511
MVIDQSLFYDLTQLSSDGVPFEGALDDDWKCDFSVHDACRLVCTNQVDMTGRLLVGSLALESRILHYKSFLIGAAMVASFGYRKERDGS

SEQ ID NO: 190290 - protein, 116 aa, Glycine max
  Coding DNA Sequence Number=SeqID_73512
MSTAEDSFFRGISWKTSFVSTHGRSCLPMCSGKKLLPWNFAEDVFREIPRKKISSAVDITTAEDCFFRGISRKIGVGVATVLVVVVLVEWWCGGDDNGRGGIVATTMVAVVVEWSW

SEQ ID NO: 190291 - protein, 184 aa, Glycine max
  Coding DNA Sequence Number=SeqID_73513
  Homolog annotation: Hit_ID=Q1T3H7; Match level="QueryCoverage=44%, HitCoverage=12%, E-value=3e-10, Identity=41%"; Hit description=Zinc finger, BED-type predicted; HAT dimerisation
MDKSLKVGEDEWREKEQRSMKFCAANEPMGPKSTLRLMRILGPSPTSLTQSSWSLLSNALGGVRFENPFPRHLSMREHGSSPTQNVSYMCLTAHLIDNDWKLHKKILNFRQRKGIGLPSCEDWEYVEATLPFLSIFYEATLGISGTSYVTSNMYMLEVVGIWHGINDFLNCNIKDSATHKMAKI

SEQ ID NO: 190292 - protein, 108 aa, Glycine max
  Coding DNA Sequence Number=SeqID_73514
MEATLPSNWKSLTIKKYDGTSDPNEHLDIYVTQVNLNQVQVEATSTRKEIERPNFNKTSEEGRRDQSPREPRYTYYTPLSVSISHILDQALAIEILAMPKKDNTPPKA

SEQ ID NO: 190293 - protein, 242 aa, Glycine max
  Coding DNA Sequence Number=SeqID_73515
  Gene Ontology: Mol. function=transcription corepressor activity; Cellular component=signalosome complex; Biological process=red or far red light signaling pathway
  Homolog annotation: Hit_ID=Q8W207; Match level="QueryCoverage=94%, HitCoverage=52%, E-value=6e-96, Identity=76%"; Hit description=COP9 signalosome complex subunit 2
MASDADMEDYGFEYSDEEEVEQDVDIENQYYNSKGMVESDPEGALAGFAQVVQMEQEKAEWGFKALKQTVKLYYRLGRYKEMMEAYREMLTYIKSAVTRNYSEKCINSIMDYVSGSASQNFGLLQEFYQTTLRSLEDAKNERLWFKTNLKLCKIYFDIGEYGRMNKILKELHKSCQKEDGTDDHKKGTQLLEVYAVEIQMYTETKNNKKLKRASPGAAVKLCLGDLLVMGSNPNTASLHMQG

SEQ ID NO: 190294 - protein, 244 aa, Glycine max
  Coding DNA Sequence Number=SeqID_73516
  Gene Ontology: Mol. function=RNA-directed DNA polymerase activity; Biological process=RNA-dependent DNA replication
  Homolog annotation: Hit_ID=Q1SMQ1; Match level="QueryCoverage=56%, HitCoverage=32%, E-value=7e-10, Identity=33%"; Hit description =Nucleic acid-binding, OB-fold
MAEETNKASQWRMPIAVEEKMGTKFEIEKQMKEKNEGRRQSGRRRTKACWFTELLGAPAILLGAPSNALSFHISKCPNRSQSSKLGYLEAGVEWKVGNGEQVRFWCDEWVGDQSLATLYPRLFLNSLIKLRKLAKWEYGKREFRGMLRDLEQIVASCDLQRDRLDAWRWRGNPSGVYSVDSAYQQLLGDTLDQQIHRIFTTLWKQNIPLKVRFFLWRLFLNRLPTLDNLKKKNSSGISVEDDLF

SEQ ID NO: 190295 - protein, 77 aa, Glycine max
  Coding DNA Sequence Number=SeqID_73517
MENQESGHQDTTHGPGYTPSPFAGHAPSTTPNESIPPHEAKETTDNLEGTTQIGTRRLQSEIWQHFKKVKVNEQDKA

SEQ ID NO: 190296 - protein, 73 aa, Glycine max
  Coding DNA Sequence Number=SeqID_73518
MKTLNTSFDGKSDQPTSRWIEVKSHVQTRGYECGYVMHRMWNIVSGGLKNEWSMWFDDETVFDIEAITTIRKK

SEQ ID NO: 190297 - protein, 77 aa, Glycine max
  Coding DNA Sequence Number=SeqID_73519
MLECNVDIHHVYPLHCVWTKAQGNHTMQSYPARALDRRLQVDWAKDAREGPRVLMSLRVGYPRNIGIFSPCILGHLD

SEQ ID NO: 190298 - protein, 70 aa, Glycine max
  Coding DNA Sequence Number=SeqID_73520
MTGGTSGGMEARSKQWDNNKIEDFIDALLLPAINNQLVTATGCYNMTKCPKEIREIEVVMVEAPWLAQKI

SEQ ID NO: 190299 - protein, 248 aa, Glycine max
  Coding DNA Sequence Number=SeqID_73521
  Homolog annotation: Hit_ID=Q1RT14; Match level="QueryCoverage=44%, HitCoverage=11%, E-value=5e-42, Identity=69%"; Hit description =Glycosyl transferase, family 48
VLTPYYSEETAYSKNDLELENEDDEWTNFMERLDCKKDSEIWKKDEHILQLRHWASLRGVTLSRIVRGMMYYRRAIKLQAFLDMANEQEILDGYKAVIVPSEEDKKSHRSLYVKSRNKLCHNWSKSSCKITEDFVFVIFAAVETLLVLGCALGFQDGGVSVSSTTSKLANPNIRLPGTTSANSRASSAALGQKKLYAESQTGKSTFQKLLEPMLPQLPGISPYRIVLGNVKDKVLLLIHSGDKYLTKK

SEQ ID NO: 190300 - protein, 221 aa, Glycine max
  Coding DNA Sequence Number=SeqID_73522
  Homolog annotation: Hit_ID=Q53K35; Match level="QueryCoverage=32%, HitCoverage=3%, E-value=8e-15, Identity=50%"; Hit description=HEAT repeat, putative
  Subcellular localization annotation: CTP_CleavageSite=36; ConfidenceScore=5.17e-01
MVQNTILNWTSYKSSNFMAYCAPQNLSRCLPKIVPKLTKVGSVIKSPEISGLVPTLLKELCHPNEHTKYSFNILLQVRLLIMFSVVVSLAKQWAFEEPYVETITSENVLTWPHVGSKGRCSLQFVECPNDINGMIDAAKFDDLTLLLIDGSYGFEMNDKIEALDKYQPGTGSDEDEDAPNSTAKNGVHLQEHIDFHDGRWRRRAIFENDCVVNKINVCLFG

SEQ ID NO: 190301 - protein, 56 aa, Glycine max
  Coding DNA Sequence Number=SeqID_73523
MQVSSPGRAELTWASNPCTRVVKKGRGKKFFALWLSVISSPFLRLTILCIFRLPCG

SEQ ID NO: 190302 - protein, 275 aa, Glycine max
  Coding DNA Sequence Number=SeqID_73524
  Homolog annotation: Hit_ID=Q1S2E3; Match level="QueryCoverage=33%, HitCoverage=20%, E-value=6e-16, Identity=43%"; Hit description=UDP -glucuronosyl/UDP-glucosyltransferase
MEELLVLVLENGESLVDFGDQIPRSVGVEALYSFWQPNLFTWELDNVGSNSVAAVTVAIDRALENGGSGCGGDYGDINTMNGKEPSYVYYGNEIIYVTQIDELVTKIIVNAACHRPPRAHQHQPLLPLHHKRHLGNGATHGNHALCRDDHRHDREEKLEIPRGRWLQEREVELTIKVMQKKGSIEYYKNNPAMSMCTLEERFYPSPTWVMKAWETTQDEMMIAGGLHVVVFNKMVVFTVFNHFKIDTFEASCLILWQSTFWMNLVLGIICQEYMF

SEQ ID NO: 190303 - protein, 544 aa, Glycine max
  Coding DNA Sequence Number=SeqID_73525
  Gene Ontology: Mol. function=transferase activity, transferring hexosyl groups; Cellular component=integral to membrane; Biological process=metabolic process
  Homolog annotation: Hit_ID=Q1S2F8; Match level="QueryCoverage=89%, HitCoverage=98%, E-value=1e-149, Identity=54%"; Hit description=UDP -glucuronosyl/UDP-glucosyltransferase
  Pfam annotation: Domain name=UDPGT; Domain location=58-536; Score= -60.9; E_value=1.5e-07; Accession=PF00201.9; Description=UDP -glucoronosyl and UDP-glucosyl transferase
GSQAFPLCRGGGHPDKARGSHVWLHSQGVVYGGVEAKAGVGEPAEDDDMPREHDHKLKLVSLPFVSTSHLIPVVDIARLFAIHGVDVTIITTTATAAIFQSSIDRDRDRGHAIRTHVVKFPCEQVGLPEGVESFNSNTPRDLVPKIYQGLTILQDQYQQLFHDLQPDFLFTDMFYPWTVDAAAKLGIPRLIYVSGGYLAHSSQNTIEQFSPHTKVDSDTESFLLPGLPHELKMTRLQLPDWLRAPTGYTYLMNMMKDSERKSYGSLLNTFYELEGDYEEHYKKAMGTKSWSVGPVSFWVNQDALDKADRGHAKEEQGEGEEGWLTWLDSKTENSVLYVSFGSMNKFPTPQLVEIAHALEDSDHDFIWVVRKKGESEDGEGNDFLQEFDKRVKASNKGYLIWGWAPQLLILEHHAIGAVVTHCGWNTIIESVNAGLPMATWPLFAEQFYNEKLLAEVLRIGVPVGAKEWRNWNEFGDEVVKREEIGNAIGVLMGGEESIEMRRRAKALSDAAKKAIQVGGSSHNNLKELIQELKSLKLQKANHKS

SEQ ID NO: 190304 - protein, 78 aa, Glycine max
  Coding DNA Sequence Number=SeqID_73526
  Subcellular localization annotation: CTP_CleavageSite=40; ConfidenceScore=5.03e-01
MPVTVRNRRSFNVLIKDAKMPKGEGKKVILRLFLNPSSPRLASGSPRPPNNFMREKGAEREVLRSEGEGLERKKRKRS

SEQ ID NO: 190305 - protein, 110 aa, Glycine max
  Coding DNA Sequence Number=SeqID_73527
  Homolog annotation: Hit_ID=P48488; Match level="QueryCoverage=49%, HitCoverage=17%, E-value=1e-12, Identity=70%"; Hit description =Serine/threonine-protein phosphatase PP1
  Subcellular localization annotation: CTP_CleavageSite=40; ConfidenceScore=5.17e-01
MTILPSPFGIFTSLITTLNDHLFRTILAFNITSRLARIKRSSNDSPLTKLRSLEFKKIGLAEKDLFGGNTKLTNFCLDKLHLLRGSAFLRRKKPLDNIIKHILIHLGKIS

SEQ ID NO: 190306 - protein, 91 aa, Glycine max
  Coding DNA Sequence Number=SeqID_73528
MSPMEFPTIATYPLAGVRKGRDHGPRHLSPRENTSGVATNVYLRKTLEKQKNRSANIKNEGSGVVYTRGRLILTANKSRLRCWTLKRSFDF

SEQ ID NO: 190307 - protein, 131 aa, Glycine max
  Coding DNA Sequence Number=SeqID_73529
MAIEPLPPSRRIVDESGWEWQLLWRRLFREVEIDIVAKFMEDIKGMVLLPTKANLRRRNVDLNDASCPFCRSTKEDASHLFFGCDKILPLWWEALSWLNIAGAFPESPRDHFLQHSHGYLKGIRIQRWQTW

SEQ ID NO: 190308 - protein, 127 aa, Glycine max
  Coding DNA Sequence Number=SeqID_73530
MVCDIERRVSKVFNLFANFLFVKSEAESKEGNGLKLVGSNRKGGLVGRSENGVTGQVKDLQTWSSRHLTVEVSDSFAATLPGLQTQTCDDEASTASSGFGSDEKTIKAVFEQMKVRYNKACILLCLD

SEQ ID NO: 190309 - protein, 131 aa, Glycine max
  Coding DNA Sequence Number=SeqID_73531
MRIDTHYEKGTDERGTLRDGPNNSKELGGIWSSDNLTKGIANDAMPYIGFDSSSEDIEVISPILMSPRLELHESQVPPEVDWVDLMLEDYREDLEKDTPFEEDLSMNKEDSVMKLECMEEDSSQDSSKKSF

SEQ ID NO: 190310 - protein, 251 aa, Glycine max
  Coding DNA Sequence Number=SeqID_73532
  Gene Ontology: Mol. function=RNA-directed DNA polymerase activity; Biological process=RNA-dependent DNA replication
MNEEEDKLRKQLHEDLWRVASSVESIAWQKARSRWIKEEDCNSRYFHLTVNWKRRYNMLRGVRFEEPDWERPRLNGVRFKSIDQQHNDLLVARIEEEEVRAAIWDCGSAKSLGPDGLNFKFIKEFRDILKPDVLPFFNESHANGAIPKASNASFLVLIPKPNEFSPQRGLRQEDPLVPFLFNIVAEGLTGLMREAQDKNLFEGFKVGRDEVDIKGSKEGGQETSEVAAVVLVGEFKPAEECMGKLGDNLSA

SEQ ID NO: 190311 - protein, 189 aa, Glycine max
  Coding DNA Sequence Number=SeqID_73533
MPKVGLGDYVSDKDKFCMYKAKNKKNHIPYGIFFTQIMRNIGVDVSVMELSTRTTQLKETKQSLGESRRKAKIDKHLERKYAIQIEADIIAFVEAMSIEEHKKKEAEDTTLKVLVSKDSKEILEDIVLESLKTLFTDEIQRKIVQEATIVVVDGEPILEEAIIKSMQAQSALEAKQVEFEELERLQSTI

SEQ ID NO: 190312 - protein, 50 aa, Glycine max
  Coding DNA Sequence Number=SeqID_73534
MEIVGRKRLLVVEGLGDGKTSSWRWTSIRRLGDGCRGMKKGWFLGFLKCQ

SEQ ID NO: 190313 - protein, 88 aa, Glycine max
  Coding DNA Sequence Number=SeqID_73535
MEEERFNGEVLLKKSIAQGEKVLSILGNGKGYMEGCKGGLGGRLKKKEIEVFIVGVYGPCKLSKRKRDVGEMVKFKKDKRGDRWCFFG

SEQ ID NO: 190314 - protein, 59 aa, Glycine max
  Coding DNA Sequence Number=SeqID_73536
MQKIPKGRGKRIISGNFLNPSSPRLASNSPGSPKDFHVKREGRLIKGLEGPKGQELREE

SEQ ID NO: 190315 - protein, 164 aa, Glycine max
  Coding DNA Sequence Number=SeqID_73537
MRVSTKGSCAGPEGSRLLKELLNGDDDLMGLFVVVGQNIVLAGLGKVFENSFTIRNIRYENDVVKVQVVRTYMPHAEVPIPTSEVVVGPDKPPSKSIGEPNRLTSVAIDGPLGELVKKSYVVYTKPMELAWDGAKFGLPNATNGFFVTHADVTEIILAVDDVYE

SEQ ID NO: 190316 - protein, 59 aa, Glycine max
  Coding DNA Sequence Number=SeqID_73538
MTTEWRRRKGDWGRHFKEKMSQEQAHHRRKPYIRASRYPKIQGLKNPTLLGYPPYTMEP

SEQ ID NO: 190317 - protein, 214 aa, Glycine max
  Coding DNA Sequence Number=SeqID_73539
  Gene Ontology: Mol. function=DNA binding; Cellular component =intracellular; Biological process=DNA integration
MEIHMDRKSKQLWLSQHGYVEKVLDKFNTSNVKPVSTPFAKHFKLSINQCSKIDVEVKYMSKVLYASAVGCLIRSTTRYVFTFGGGPTCWKSIIQSLVAMSTIEAKYMVVAETSKEVVWLARLVKELGIEQGGIWLHYDSQSAIDLANNQVFHARTKHIDVRFHEIRELMTSGQVLLRKGKVGVKCKDHLLLGYKVGWGCRGKALAEHIMLYMD

SEQ ID NO: 190318 - protein, 96 aa, Glycine max
  Coding DNA Sequence Number=SeqID_73540
  Subcellular localization annotation: CTP_CleavageSite=28; ConfidenceScore=5.10e-01
MEPGKAPMVALLTWRTTRLVRRVAARARQSEGAAGERKPSTTRLTLASLSRERWRRRERARWRRSVAEMCWRQGKEVAVEDDIELVVEAGDALVQA

SEQ ID NO: 190319 - protein, 36 aa, Glycine max
  Coding DNA Sequence Number=SeqID_73541
MSVETALGTKGKYEVILELKKLELNIHYVTRIASCN

SEQ ID NO: 190320 - protein, 391 aa, Glycine max
  Coding DNA Sequence Number=SeqID_73542
MWLKGVKTPVVLSGNRDERAKRACARSLFIAAVKILDFQMNALSGPCRAKRAKRALCAKPECYSVEAELSVPCCAKLQLSLMASKKRKTPSTPTQARFDRSKFTSQETWERYTDIVVPRKLLPERNVVVYYREFDEFKEELERRHWDEKLTDFFVSSIDIAIVKEFYANLYDPEDKSPKGFELNVDGQPLKILRKNMTTLAHTWSVLSFSNLIPTSHTSDVSVDRAKLIYGIIMKMDMNLGYLISHHISLSAQHDTSRLGFPALITALCKARGVQSDSRSLENLSPAINLAYIKKNCWNLDDPTMTFRGPRKARGKRSEVPTTSAPPETPTPSSSTALVPFSAPVIPPTSTQMSLPAPISVGPSDFIFTPQVLHSMLQSIHRGQSIIMQSL

SEQ ID NO: 190321 - protein, 808 aa, Glycine max
  Coding DNA Sequence Number=SeqID_73543
  Gene Ontology: Mol. function=signal transducer activity; Cellular component=membrane; Biological process=signal transduction
  Homolog annotation: Hit_ID=Q13L86; Match level="QueryCoverage=35%, HitCoverage=91%, E-value=3e-71, Identity=47%"; Hit description =Putative isoflavone oxidoreductase
  Pfam annotation: Domain name=HAMP; Domain location=602-671; Score =65.5; E_value=1.7e-16; Accession=PF00672.15; Description=HAMP domain
  Pfam annotation: Domain name=MCPsignal; Domain location=702-808; Score=-2.3; E_value=1.6e-07; Accession=PF00015.11; Description =Methyl-accepting chemotaxis protein (MCP) signaling domain
  Pfam annotation: Domain name=NmrA; Domain location=32-269; Score= -35.0; E_value=4.1e-06; Accession=PF05368.3; Description=NmrA-like family
  Pfam module annotation: Pfam domain module=HAMP::MCPsignal::NmrA; Domain location=602-671::702-808::32-269
MAQRSMGDQNMQYTQRPAIAGGFAIGFHLSSGITGELGMAVLNAMAKKVQQHPLIKISVLLRSEAAHATSGPLKTRLDALQKLNITVAEGDLQKNSLSELSALFRTYDAIINCSGFVGGPGTQLRITQAVLKAGVARYFPWQFGVDYDVIGKESGQPVWDEQLEVRHLLRAQSNTDWVIVSTGIFTSYLFEPDFGVIDAGNKTVYALGDWNYALTLTTPDDIGQLTADIFFHQPAFQNDIVYIAGDTLTYAELADLMQSHWQSAVRRVLLSRERLREDAERHPRDTGAAYRLAFARPDGVAWPKQETFNYREHIATTSAAQWLTNQPAAVSRKLMLGFGVLLILSIAVASCGIKNLHDIAERAEKLSQLKGINDQFAQAKDARLQYVKTHDEKFIADNESRLQAIEGSINQLKTWRWDSAQTALIASLPAAMNLYRQHRAETVNEVHKRQSILQALRFSDETTAVAALARNYVSTQQDTATALNEIAKYLNGISIRVKLMALDNTEENRLALSGFIAETIQLIDEARPRLSADDSNALDKIAVTLAARRDSVQDYNASAEEEVEATRQLAIAGLHLTNTSNQLFTQQLAATHQDIARAILWMSLILAAAVVISILIAVFITRQITRPLAVTLNVARQIAQGDLSVQLQTSRKDELGELMQAVGEMSNDLRGIIGNIRSGVMQVSHASAEIAAGNNDLSARTEEQAAALEQTAASMEQLTATVKQNVENIHHSSELARATSEKANQGGSLVKGVVETMDQISASSGKIAEITTVINSIAFQTNILALNAAVEAARAGEQGRGFAVVASE

SEQ ID NO: 190322 - protein, 96 aa, Glycine max
  Coding DNA Sequence Number=SeqID_73544
  Gene Ontology: Mol. function=transcription factor activity; Cellular component=intracellular; Biological process=regulation of transcription, DNA-dependent
  Homolog annotation: Hit_ID=Q3J099; Match level="QueryCoverage=80%, HitCoverage=61%, E-value=3e-20, Identity=57%"; Hit description =Transcriptional regulator, ArsR family
  Pfam annotation: Domain name=DUF24; Domain location=12-94; Score =66.6; E_value=8.2e-17; Accession=PF01638.8; Description =Transcriptional regulator
MRRKHVVSDQKILFRLFAEPVMRHSQFMKSMPEISHKVLTQHLRKLERDGLITRTDFGEQPPRVEYALTHAGHNMMPVLLSMREFSRDNLSKPGQD

SEQ ID NO: 190323 - protein, 112 aa, Glycine max
  Coding DNA Sequence Number=SeqID_73545
MPMILAEGETLPAYSRYCRLPTDYKEIKAALCIPGRGKDLTTLAQVWSILSYSNLAPTSHTSDLTVDRAWLIFGLVSQMDMNVGALISGQITSIAQSNSSRLGFPALDHHPV

SEQ ID NO: 190324 - protein, 274 aa, Glycine max
  Coding DNA Sequence Number=SeqID_73546
  Gene Ontology: Mol. function=two-component response regulator activity; Cellular component=chloroplast; Biological process=two -component signal transduction system (phosphorelay)
  Homolog annotation: Hit_ID=Q1XXF3; Match level="QueryCoverage=78%, HitCoverage=91%, E-value=4e-55, Identity=49%"; Hit description =Response regulator receiver:Transcriptional regulatory protein- like
  Pfam annotation: Domain name=Response_reg; Domain location=36-152; Score=102.5; E_value=1.2e-27; Accession=PF00072.14; Description =Response regulator receiver domain
  Pfam annotation: Domain name=Trans_reg_C; Domain location=196-271; Score=84.3; E_value=3.9e-22; Accession=PF00486.18; Description =Transcriptional regulatory protein, C
  Pfam module annotation: Pfam domain module=Response_reg::Trans_reg_C; Domain location=36-152::196-271
  Subcellular localization annotation: CTP_CleavageSite=52; ConfidenceScore=5.11e-01
MNLAFDFFSTPSKKKLASISKDWMRSNKTGREGIVLPFSILDTSPLLTLALKASSLMGLQEKGYEISVAFDGRTGVQLVEANDFDLVILDIMLPEMNGLDVCKEIRKTNQHVPILFLTALGTSENIVLGLESGGDDYLVKPFKFIELVARVKSLLRRSVNNTATQEAVEPDADSEYIYQVSDLIVNDYTKKVTRAGEEVSLTSTEYKLLMYFLNNTEKVISRAEILDAVWGVNYELGTNVVDVYVNYLRKKLDNQDDQKLIHTVIGMGYVLKKP

SEQ ID NO: 190325 - protein, 118 aa, Glycine max
  Coding DNA Sequence Number=SeqID_73547
MTYTKKTDQMMFEAAKEIANKIVRFHGGAGFTGFHCRPWTLRSDVTIKQYFGPAPRTSHTSSSMSPKDMEQLSQKIRDQLEEWITEKVTRQVLALPPEPEDGRSTTHVSTKENVVIWF

SEQ ID NO: 190326 - protein, 80 aa, Glycine max
  Coding DNA Sequence Number=SeqID_73548
  Gene Ontology: Mol. function=3-oxoacyl-[acyl-carrier-protein] reductase activity; Cellular component=cytoplasm; Biological process= metabolic process
  Homolog annotation: Hit_ID=Q13JQ9; Match level="QueryCoverage=99%, HitCoverage=32%, E-value=2e-13, Identity=51%"; Hit description =Putative short-chain dehydrogenase
MKKLQDKVALVTGASKGIGAAIARQLAADGAKVVVNYAADKNGADKVVAAIEAAGGSALALAADVTDQSQVEALIQSTLA

SEQ ID NO: 190327 - protein, 229 aa, Glycine max
  Coding DNA Sequence Number=SeqID_73549
  Gene Ontology: Mol. function=transcription factor activity; Biological process=regulation of transcription, DNA-dependent
  Homolog annotation: Hit_ID=Q3KCN9; Match level="QueryCoverage=100%, HitCoverage=80%, E-value=2e-76, Identity=62%"; Hit description =Transcriptional Regulator, LysR family
  Pfam annotation: Domain name=HTH_1; Domain location=3-62; Score=77.1; E_value=5.4e-20; Accession=PF00126.17; Description=Bacterial regulatory helix-turn-helix protein, lysR family
  Pfam annotation: Domain name=LysR_substrate; Domain location=86-227; Score=-5.3; E_value=0.0019; Accession=PF03466.10; Description=LysR substrate binding domain
  Pfam module annotation: Pfam domain module=HTH_1::LysR_substrate; Domain location=3-62::86-227
MEWSDVRIFLAVMRSGSYGEAARRLGVSHPTVGRRIKVLEAQAHQALFRRTPYGLVLTDAGDAVLGLAESMENAALAMERRLAGNHPRLEGILRISCAEWFATAVLAPVLSELTQRHPAIVPEIIASYRLLNLSRRDADVAFRIVPFTEPDIVQRRLMSMPYALYGTPENARALQHDPASVGLILMNTAQAHFPDVVWLLDQFPQSRRAFTSTSRAVQAQMCQRGMGVA

SEQ ID NO: 190328 - protein, 98 aa, Glycine max
  Coding DNA Sequence Number=SeqID_73550
  Subcellular localization annotation: CTP_CleavageSite=38; ConfidenceScore=5.21e-01
MGFLRFFRLFPQINVGGDSAHLSSFGKRTREPHLARPQKSMLRQKVTIVLSFNAFFHLSTKILELSQYRVLLVRNRDNAHTHDPPVSRPLHHKAIWSD

SEQ ID NO: 190329 - protein, 135 aa, Glycine max
  Coding DNA Sequence Number=SeqID_73551
MGAKYLEVVKRGLHPNNGWSPDEIRFLPQPQPLHFALGRVLLALAEKGKLDHIEERLRAIEGGRDHAFANMTELYLVPDIVILLKFMVPDFDKYKGTTCPKNHLKMYYQKMGVYVKDEKLLMHFFQESLTGAAVT

SEQ ID NO: 190330 - protein, 304 aa, Glycine max
  Coding DNA Sequence Number=SeqID_73552
  Homolog annotation: Hit_ID=UPI00003CCC48; Match level="QueryCoverage =81%, HitCoverage=93%, E-value=2e-26, Identity=32%"; Hit description =COG5501: Predicted secreted protein
  Pfam annotation: Domain name=SoxZ; Domain location=206-304; Score =88.8; E_value=1.7e-23; Accession=PF08770.1; Description=Sulphur oxidation protein SoxZ
DPKLWDWLAAAYQGQGKQMLRHQALGESYVRKYDLPRAIDQFDIASKAKDGLVLTAIPFWLVSRKLEAAPWFAQAFEAKQTDQVMAALKATAVPVTPELQIEAPQKAENGAVVQVELTSHQPAGSVSSLRLLADANPTPLIASFEFGKQVMPKVVTRIKLAQSGEVIALLQQVSGQFQQQRREVVVLEDGCAGSEREEPFSTSMKMRARILEDGALGKNITELKIIILHPMRTGRSKNDDGQLMPAHFMQLMQVVLNGQVVVDAQTGTGISRNPYFTFYLKDAKAGDVIAVNWQDNLGYEGHGQ

SEQ ID NO: 190331 - protein, 189 aa, Glycine max
  Coding DNA Sequence Number=SeqID_73553
  Gene Ontology: Mol. function=transmembrane receptor activity; Cellular component=membrane; Biological process=defense response
  Homolog annotation: Hit_ID=Q1SI46; Match level="QueryCoverage=98%, HitCoverage=17%, E-value=3e-54, Identity=57%"; Hit description =Leucine Rich Repeat, putative
  Pfam annotation: Domain name=TIR; Domain location=46-176; Score =161.2; E_value=2.7e-45; Accession=PF01582.10; Description=TIR domain
MAYSSSGASQIKYVFLLLCDLLLVSGLTGEISVQISDNIPRIKYDVFVSFRGEDIRQGFLGYLTEAFHQKQIHAFIDDKLEKGDEIWPSLVGAIQGSLISLTIFSENYSSSRWCLEELVKIIECRETYGQTVIPVFYHVNPTDVRHQKGSYEKALSEHEKKYNLTTVQNWRHALKKAADLSGIKSFDYK

SEQ ID NO: 190332 - protein, 539 aa, Glycine max
  Coding DNA Sequence Number=SeqID_73554
  Gene Ontology: Mol. function=isomerase activity; Cellular component =membrane; Biological process=carbohydrate metabolic process
  Homolog annotation: Hit_ID=Q145V6; Match level="QueryCoverage=52%, HitCoverage=91%, E-value=3e-75, Identity=50%"; Hit description =KpsF/GutQ
  Pfam annotation: Domain name=DUF1239; Domain location=293-465; Score =143.6; E_value=5.4e-40; Accession=PF06835.3; Description=Protein of unknown function (DUF1239)
  Pfam annotation: Domain name=OstA; Domain location=475-539; Score= -27.4; E_value=0.083; Accession=PF03968.5; Description=OstA-like protein
  Pfam annotation: Domain name=SIS; Domain location=49-182; Score =117.7; E_value=3.3e-32; Accession=PF01380.12; Description=SIS domain
  Pfam module annotation: Pfam domain module=DUF1239::OstA::SIS; Domain location=293-465::475-539::49-182
MNTAKSGVRLVKSPDIVTRARGILLHEADEIRQLADRLGSAFEAAVNLILDCRGRIVVTGMGKSGHIGGKIAATLASTGTPAFFMHPAEASHGDLGMITAEDVVIALSNSGESDEIINILPAIRRIGARILSITGSENSTLSRESEVHLSAAVSHEACPLGLAPTASTTAALALGDALAICVLDLREFTAEDFARSHPGGSLGRRLLVRIKDVMRTGDAIPYIYEQATVQDAITQVSSKGMGFTAIVDAKLHPGETHTETAITLVMNKRPRLLGTQQMAVEAVNMMEQYKINGFLVIDEQQQLTVQEQGLSMSRLSRHDPDYMLHNFVSTRTNAAGMTKYVLAAVEMRHFPDNDYTELKRPRFTQFGLDKPYTQIYGQRGKISANGKLVEFNKQVKVVRQGTAQKGEMQLQTERLIMEPDTETAYTDLPVTIHQKPATVITGTGMRFDNKTETMQLFNRVHVHYERAPVATKPAIPTAPAKAGSRRWSGSALAEESDRDQPIELEADTVTVNDAKKISVYTGNVILNQGTLQIKADKMI

SEQ ID NO: 190333 - protein, 63 aa, Glycine max
  Coding DNA Sequence Number=SeqID_73555
  Gene Ontology: Mol. function=solute:hydrogen antiporter activity; Cellular component=integral to membrane; Biological process =potassium ion transport
  Homolog annotation: Hit_ID=Q3SLC3; Match level="QueryCoverage=100%, HitCoverage=9%, E-value=1e-15, Identity=61%"; Hit description =Monovalent cation:H+ antiporter-2, CPA2 family precursor
MLAYFMIGIVLGPHALGLLEDEESGRQVAEFGIVFLMFSIGLEFSLPKLYAMRKTLFGLSGGQ

SEQ ID NO: 190334 - protein, 168 aa, Glycine max
  Coding DNA Sequence Number=SeqID_73556
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=26%, E-value=8e-35, Identity=63%"; Hit description=Chromo
MEPELAMILYTYRTVLDVPSGLPPSRTHNHSIPLVEGAGPVKVKPYRYPHSRKDQIEENFHWNDHTSMAFYNLKAAITKAPVLALPDFSKAFTLETDASGIGIRAALSQEQHPIAFFSKKLTPRMQRQSAYIRESYAIIEAVAKFRHYLLGHRFVIKTDQRSLKSLTE

SEQ ID NO: 190335 - protein, 50 aa, Glycine max
  Coding DNA Sequence Number=SeqID_73557
MSALSATLDRLVRISEFRLSAHLLAQRMDSSGALSEMNRHSVNMHNSSFF

SEQ ID NO: 190336 - protein, 145 aa, Glycine max
  Coding DNA Sequence Number=SeqID_73558
  Subcellular localization annotation: CTP_CleavageSite=45; ConfidenceScore=5.69e-01
MPSLVTDVWGANTFPTTSFPVFPTFSSNKRWWRLRAYSFLGRRTRESRVALPPKGRLRHKVLEFDKYKGTTCSNNHLKMYCRKMGAYTKNEKLLMYFFKESLIGAAVTGYTNLEPSRVRSWKENERSRHQRLFEENSRKTKKMMV

SEQ ID NO: 190337 - protein, 158 aa, Glycine max
  Coding DNA Sequence Number=SeqID_73559
MVKEECKEVSVSSKRLAKKERHFEIKTNIKEISPLRQPPHFLLCQKTLVSIATPLRPEFIPQLKELLDEGLVHKSLNPCALLVPKIGVPMNPKRIKVIPERLTPPSVEGRSPEFHEPRDLRSNPFQGEVMMQSYPQGHWIEDFKMIGPRMQEKALGFS

SEQ ID NO: 190338 - protein, 104 aa, Glycine max
  Coding DNA Sequence Number=SeqID_73560
  Homolog annotation: Hit_ID=Q9FGQ4; Match level="QueryCoverage=62%, HitCoverage=39%, E-value=3e-11, Identity=56%"; Hit description =Arabidopsis thaliana genomic DNA, chromosome 3, TAC clone:K5K13
MAGTFFLLKQQNSLEIMSGKNTPNSIFFALDVHPNPIISKGDTLLFCNYLFSHSGVLQMKILEGNAGALTNFEVLDFCRAKGASKDPTRVIAKVAQSEYKVYDY

SEQ ID NO: 190339 - protein, 63 aa, Glycine max
  Coding DNA Sequence Number=SeqID_73561
MDNHEHANHRDTAQARIKNKGIRQHKVNDEAQNIDCCVQFLHLKTKIICPQLMTPQLIGEGND

SEQ ID NO: 190340 - protein, 107 aa, Glycine max
  Coding DNA Sequence Number=SeqID_73562
MWVKESHREIYLGPYFNHAMKKICSNLQGKDNAPPPPPQWIEAKSHVQQGAYECGYYVMHWMWYIVSGGLKNELHNYFSDGTSLDTDTMTTLRKKWAAYFLEVGKWM

SEQ ID NO: 190341 - protein, 284 aa, Glycine max
  Coding DNA Sequence Number=SeqID_73563
  Gene Ontology: Mol. function=protein-tyrosine kinase activity; Cellular component=integral to membrane; Biological process=protein amino acid phosphorylation
  Homolog annotation: Hit_ID=Q9FVN2; Match level="QueryCoverage=53%, HitCoverage=25%, E-value=3e-23, Identity=38%"; Hit description=Dual -specific kinase DSK1
  Pfam annotation: Domain name=Pkinase_Tyr; Domain location=160-284; Score=-132.3; E_value=0.00023; Accession=PF07714.7; Description =Protein tyrosine kinase
MQRRPQGEEKSSGKLIINDRMMDQTVVNQLSEFEEQMPSTFHREGITTQKISVNHMISPTKGDQLSQDQEEEINFIEMKIGLIPEPISGMIDQTKADQLVQDKTQTQRRCHDDLLDERQGEIILENSKSSACCICKSRRPNNAWTKDFNYEELLEATEGFSIENSLSEREDGPTFEGLLERQVKIVVKKYQVTTSHQEKILKSEVQLFISARHKNVVMLLGLCTNKSQLMIVYEQVCNGSLEQYLTRGSFQSLTWKQRLKVAMGTARGLKYLHGNNIIHGNIKP

SEQ ID NO: 190342 - protein, 249 aa, Glycine max
  Coding DNA Sequence Number=SeqID_73564
  Gene Ontology: Mol. function=adenosylhomocysteinase activity; Biological process=one-carbon compound metabolic process
  Homolog annotation: Hit_ID=O23255; Match level="QueryCoverage=39%, HitCoverage=32%, E-value=1e-28, Identity=55%"; Hit description =Adenosylhomocysteinase 1
MNASQGILYVLKTIEWLSIKLRRLKFQGSLSVKSLKLFHKCFSIQRCAILIIISHLWVNDKIISQAFSTHRSKHTKIAPNTDPDFLEDISQAIERHYIWGKKRHYLVVGDKVSHINSREEKSAIRLHLIEPLNSSVGVEEFLGLLIKFLGLDAFMDEEGSVITMIDDEVGSSAGDPVEGTLGAIVAAAWSWVEKMLQEHRCGPTKAMVYPLREKKKERKRVEWRGKKESGVVRKYSGVVEEETVLIEAS

SEQ ID NO: 190343 - protein, 91 aa, Glycine max
  Coding DNA Sequence Number=SeqID_73565
MNEDMKLTSSGSERQCGVAVRKKIRDIVEPTQRFDEDDDAKVTTLWRQGLPATMHHQKRKTLDKTSLLTSKLKTQHDHRSTSTPYVSQTRV

SEQ ID NO: 190344 - protein, 289 aa, Glycine max
  Coding DNA Sequence Number=SeqID_73566
  Homolog annotation: Hit_ID=Q1RTB4; Match level="QueryCoverage=81%, HitCoverage=62%, E-value=1e-16, Identity=27%"; Hit description=IMP dehydrogenase/GMP reductase
MIEVSVEAIASLTQYYDQSLRCFTFGDFQLAPTIEEFEGILGCPIGGRKPYLFSGGKTKEVLGEKVETMASQGEWVSFIDVLALLMFGTILFLNIDELVDLAAIDAFLAYHHNKENPVIAILAYAYDTFDVRCEKSSYRMCSGNDKANWEELLVGTIGAFISWFPWWKEGGAGVLCSCEGFPNVPLLGTRGFNEANTKMLQRIRKAWNKMGKKDKELKGRSNSVIGGYHKWLKSRTKRITWLQKLKGLNGEEEEVPEESEEVQALKAELEKTKVSKKRMKVVVTRVRKE

SEQ ID NO: 190345 - protein, 104 aa, Glycine max
  Coding DNA Sequence Number=SeqID_73567
MEEKKKKKLKEVAQSRSTDSVINRPSPIRRHVKWKMVRTKKTSQMTFEAAKEIADKIDVLIAIIGQPKHPDHVRAARAGVMIKQYFGLAPRTSHTSSMAPEDLE

SEQ ID NO: 190346 - protein, 232 aa, Glycine max
  Coding DNA Sequence Number=SeqID_73568
MAYQHGYWEGLDQEASGNPQGTSFVVQVEGTSFVVQVKGTSTWVVVTENKRGYICCGSVLVKGTSTRLFKENKEGQNNNDGLKIKPPLFPVVNYHVCTPRAKLDTQNKPEERIGKGLTFILLSHTHTLSQNILFHNLTPLLHRSRLRQAASSQFAVERDYSNYEEVSGTDSDEGLVIANLGIAPQIVDALAKKGIAKLFPIQVDMANIQKNKEEEKALKELKAKAQHKGSFG

SEQ ID NO: 190347 - protein, 68 aa, Glycine max
  Coding DNA Sequence Number=SeqID_73569
  Gene Ontology: Mol. function=mannosidase activity; Biological process= mannose metabolic process
  Homolog annotation: Hit_ID=Q1S3T6; Match level="QueryCoverage=96%, HitCoverage=5%, E-value=1e-18, Identity=89%"; Hit description =Glycosyl hydrolases family 38 C-terminal domain, putative
MLLNLGIYTKDKESEFSVLVDRATGGASIKDGEVELMLHSINTTFTTQGVFSMMIVEELGNHLTNKFA

SEQ ID NO: 190348 - protein, 94 aa, Glycine max
  Coding DNA Sequence Number=SeqID_73570
MAFTQTFRESKPGSLVKLACVSAIEDMLTLIESMLSIETSNPENLELQDALLAWIRELPLLLIQLGDKHTTCSQLVIISKTFNEIQQVVSRRSN

SEQ ID NO: 190349 - protein, 88 aa, Glycine max
  Coding DNA Sequence Number=SeqID_73571
MINKLYLAFWLPIYVTGIIEVGNAEITVLDSDVGSGETQKKTKETLLNGGNKRETRIHDDDDDDDDDNIVLLLDNMQYQNQFADIEYF

SEQ ID NO: 190350 - protein, 206 aa, Glycine max
  Coding DNA Sequence Number=SeqID_73572
  Gene Ontology: Mol. function=chitin binding; Cellular component =extracellular region; Biological process=chitin metabolic process
  Homolog annotation: Hit_ID=UPI000044A8F0; Match level="QueryCoverage =90%, HitCoverage=99%, E-value=1e-22, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTDPLDESISCFLIMVNPWVLVPSTPEDYMSSSSEGRTPSPSEDYTSSPSEDYTSSPSEDYTSSPSEDFTSSPSEDYTSSPSKGQHALTFRGLHVLAFRGPHALAFRGLHVLTFRGLHVLAFRGLHVLAFRGLHILTFRGLHVLAFKGSCTFNFRGLHVLAVKGSCTFTFVGLHALTFRGLHVLALRGLHVLTIRGLHALTSRGLH

SEQ ID NO: 190351 - protein, 71 aa, Glycine max
  Coding DNA Sequence Number=SeqID_73573
  Gene Ontology: Mol. function=6-phosphofructokinase activity; Cellular component=6-phosphofructokinase complex; Biological process=glycolysis
  Homolog annotation: Hit_ID=Q1SEA0; Match level="QueryCoverage=69%, HitCoverage=10%, E-value=1e-12, Identity=70%"; Hit description =Phosphofructokinase
MAVSLSKDDIESRKSNRYIPFYRITQGQNKVLITDRIWARLLSSTNLPSFTIAKTISEEKREEEANDHVPE

SEQ ID NO: 190352 - protein, 120 aa, Glycine max
  Coding DNA Sequence Number=SeqID_73574
  Subcellular localization annotation: CTP_CleavageSite=53; ConfidenceScore=5.04e-01
MVGLLPLDQKVMASNSGNSFAGRARISTFSKPHKARPLLGGKKYPKLVDLKISNSYEEEKLLWLVQVTEQCLRKNPKERITMNMVSLSDVEYDQKVHKTEKKACYFIQYSIKSMEIMIVT

SEQ ID NO: 190353 - protein, 92 aa, Glycine max
  Coding DNA Sequence Number=SeqID_73575
MDLEGKVQVNPSVVIGWAYEAQIDDFYRLGNLDNIFFDSILPPRVLDRRLQEDWTRAAKEGPRVLKNFRLSSNFSRKLLLRSFSKKFLKKAT

SEQ ID NO: 190354 - protein, 602 aa, Glycine max
  Coding DNA Sequence Number=SeqID_73576
  Gene Ontology: Mol. function=protein serine/threonine kinase activity; Cellular component=integral to membrane; Biological process=protein amino acid phosphorylation
  Homolog annotation: Hit_ID=Q9C890; Match level="QueryCoverage=52%, HitCoverage=44%, E-value=3e-55, Identity=38%"; Hit description =Protein kinase, putative; 86372-89112
  Pfam annotation: Domain name=Pkinase; Domain location=137-422; Score =66.3; E_value=9.6e-17; Accession=PF00069.15; Description=Protein kinase domain
  Pfam annotation: Domain name=Pkinase_Tyr; Domain location=137-422; Score=16.5; E_value=1.8e-13; Accession=PF07714.7; Description =Protein tyrosine kinase
  Pfam module annotation: Pfam domain module=Pkinase::Pkinase_Tyr; Domain location=137-422::137-422
MKADPVKQEQEWIGRNQYEEERSLRLTVITNDIIGQRNADQLIQGGEDVQSSPHEEMSRVTVISNDVIDEKNSNQKIQEKLQIKGSCDEGLKNANEAKVILENSKSSVCSICRSRRPYSGLQKKYTYEELEAATEGFSIKYSLCEGEYGPAFRGQLENNQEIVIKQHTFTSLQEQKVFISEFQLLINARHENVIMLLGSCIRLSQLLIVYEKACNGSLDQYLSRQSATSLTWGERVKVAIGVARGLKYLHENNIVHGGIKPSNILLNHEFKPMVGDFVFGKERCELKNVCKQKSIRNCGYTAPECQESEELSTEADVYSFGVVLVELIAGRMIADKILGQKCLVECLCIFRLQLFLLIGTASPNDRNVRSLLGRREYRQLVDPKVRSSYDEQELVSLFHITENCLKKNPKERFTMNMVVSALPCVANSNGLYVKEDFSPENSNVSDAKNSKGEEESLKENNLGTENTEEVRMNHREGEKEESLEEEDLDTENSEKVRRNHKEGEKEETLEEEEDLGTENREERVEQITCSRGNNEPEVSQECDTYTKCGEISKKTEEKEGSSTKLCQKWEGCLSYGGARKFYHQGAQEYTACKEFFGWCDSI

SEQ ID NO: 190355 - protein, 47 aa, Glycine max
  Coding DNA Sequence Number=SeqID_73577
MSPFPLFFAHNSQSIQTSPHSPQVWLKKGLSVYEGALSAILVLSASK

SEQ ID NO: 190356 - protein, 108 aa, Glycine max
  Coding DNA Sequence Number=SeqID_73578
MSSVISTTSTVAAPSYFDNPIIYKFQSVVHVDRNFIQIPSACHIQWGPTYPPYVTFDYNGEKHFIKIRRDGNKFYFADGLKDFRRALGIYEGLVVHFATPDRNTSVGY

SEQ ID NO: 190357 - protein, 68 aa, Glycine max
  Coding DNA Sequence Number=SeqID_73579
  Subcellular localization annotation: CTP_CleavageSite=47; ConfidenceScore=5.33e-01
MSDQATSIFSLGFVFRPPYLDVSSSEGSLSKTGSLSKRFPNMLRELYASLIGCQSLSGSASLSETPAT

SEQ ID NO: 190358 - protein, 34 aa, Glycine max
  Coding DNA Sequence Number=SeqID_73580
MWRSSTFVAMAFVWLNIEGKLRKHGVAKGCNLYV

SEQ ID NO: 190359 - protein, 79 aa, Glycine max
  Coding DNA Sequence Number=SeqID_73581
MEKRQQSYDPINLEALDDHIDWVMEGSPPFLTNEEFFHHRSFKFGNESNVHHEVTMGDYEFFNEGVLENDNDLLYAPWP

SEQ ID NO: 190360 - protein, 81 aa, Glycine max
  Coding DNA Sequence Number=SeqID_73582
MHIYENVTKHNNMRWNYLKEERLNQWPSIYPRLLTQIVTIVQEPLMPDIMEVILPSNWKKMTIEKYDATSDPDEHLDVYIT

SEQ ID NO: 190361 - protein, 386 aa, Glycine max
  Coding DNA Sequence Number=SeqID_73583
  Gene Ontology: Mol. function=receptor activity
  Homolog annotation: Hit_ID=Q1T4D0; Match level="QueryCoverage=99%, HitCoverage=78%, E-value=1e-108, Identity=58%"; Hit description =SPla/RYanodine receptor SPRY
  Pfam annotation: Domain name=SPRY; Domain location=283-384; Score= -1.5; E_value=0.04; Accession=PF00622.18; Description=SPRY domain
  Subcellular localization annotation: CTP_CleavageSite=46; ConfidenceScore=5.07e-01
MSQWIHVAVAASAVGCVSTLLLVFLWRWCHKRNHRRNFVEPASLTRVESVQGGISVSRLHQQQQPFQLDQGNKNNNKGNYNYYVFRGGGVSGKRSLFNWGDHPSMAADAVENGWSRFAFTGYKSYTPSPSKRSALLGVCAAPGGGSDFGRESEVEISWEVARGSAEFMQKVRLNPGIKKSHHHNNNNNAFSLSVASIIRGALPLPGPPLGNCAFPQEAYFEITILYSRGDEYEFVGKSVEGEKTKLLVQGNSNVKGNSEALVHVTSGNGSNKINNVEGEGGKGESVMFSFGLTAGGSVPLRVPGSYTGSIGFNSNGSLYLDGMKLVSESEKAEWVGTDRVIGCGFDPRQKKVFFTLDSELMHVIHCQTEEFGTPLFPILAANIDIL

SEQ ID NO: 190362 - protein, 113 aa, Glycine max
  Coding DNA Sequence Number=SeqID_73584
MATSQQEDATVSTTGVHQPNKEVQLAKFDIGEATKVKTKVMSTVATRWRQFKSTLTSKFVFAKSEGQQTQDVVTKYGLDPEAWKQFEETRLTPNWEGIRKRAQSIQKHNDCPH

SEQ ID NO: 190363 - protein, 172 aa, Glycine max
  Coding DNA Sequence Number=SeqID_73585
  Gene Ontology: Mol. function=transcription factor activity; Cellular component=nucleus; Biological process=regulation of transcription, DNA-dependent
  Homolog annotation: Hit_ID=Q1AND5; Match level="QueryCoverage=91%, HitCoverage=100%, E-value=7e-68, Identity=81%"; Hit description=DREB protein
  Pfam annotation: Domain name=AP2; Domain location=44-108; Score =142.7; E_value=9.8e-40; Accession=PF00847.10; Description=AP2 domain
MGWKWKWRVREIDMEEAGLGDCCSSNTTITRKSEKRKQQHQQQEKPYRGIRMRKWGKWVAEIREPNKRSRIWLGSYATPVAAARAYDTAVFHLRGPSARLNFPELLSQDDDVSTQQQGKMSADSIRKKATQVGARVDALQTALQQSSSTHSISSSHVSYEKPDLNEYPKPED

SEQ ID NO: 190364 - protein, 260 aa, Glycine max
  Coding DNA Sequence Number=SeqID_73586
  Homolog annotation: Hit_ID=Q1RTB4; Match level="QueryCoverage=45%, HitCoverage=27%, E-value=4e-11, Identity=33%"; Hit description=IMP dehydrogenase/GMP reductase
ASFIDIFALLIFGVVLFPNVEGLVDLATVDAFLAYHLSKESLVIAILTDVYDMFDRRCGMSGARNIYCTSAFYEGRIRVLSLCEGFPNVPLMGTRGCINYNPVLAISQLGYPIRGAPSKESVMPFIARGFSDPNARVLQGAAREEEAETSEESEEVQTLKVELQKAQIVKEKFESTTIKVRKNNNELKLRRAERDQLRVEGMILKDKFKECHRLEDEYVKVSVLQVEREARERVIDSLHREAIMWMDRFTFTLNGNQELP

SEQ ID NO: 190365 - protein, 80 aa, Glycine max
  Coding DNA Sequence Number=SeqID_73587
VGRDGGGRGSGGGAATKEGEFCIVTEKENGGMVELTVGNLVGDTTATTEVIEMAMGWRERWEQRDKMSSRLKVLYVLSQF

SEQ ID NO: 190366 - protein, 171 aa, Glycine max
  Coding DNA Sequence Number=SeqID_73588
MGADQVSVHVAPLISDAIYQFAGFAPMRHPVDPEKSNMALAFPAQEEDQQPAADVPPPPQEEVQSLRSISDCLDGIELQMHRYKRHVTSQQAANHRGQRQLNETFYCYNMHQQSQDPSPFPWPIPEQFEATVAWLRDEIDFEMQAGPAGTSGGGDEAQDNQNMADMLDFLL

SEQ ID NO: 190367 - protein, 75 aa, Glycine max
  Coding DNA Sequence Number=SeqID_73589
MLLMFCALESVSVEVHVNLRGSTGALSGGVLPGPLCGKLSRGHLLYGVNKDTKMEAKHKNGGLGAAKSCTARVLT

SEQ ID NO: 190368 - protein, 198 aa, Glycine max
  Coding DNA Sequence Number=SeqID_73590
  Gene Ontology: Mol. function=transferase activity; Biological process= protein metabolic process
  Homolog annotation: Hit_ID=Q9M3I0; Match level="QueryCoverage=50%, HitCoverage=17%, E-value=1e-32, Identity=65%"; Hit description =Putative glucosyltransferase
MGPKSTLRLMRTLGPSLASLAQSSWSLLSNALGGVIGSIVYQQSIGAVCILDWPKETMLLQFVSIEADTQQLIKAKVHKWKQTGVWIIYRHRLIRIGYNAGNLKSTMNCDYVKDYEFVAIFEADFQPTSGFLKKTVPYFKPYQLCNWYSDLSLATNWSNLLDSNSKEKDGILESRKLASKCCSQLSEIKKIEGVEEIE

SEQ ID NO: 190369 - protein, 42 aa, Glycine max
  Coding DNA Sequence Number=SeqID_73591
MGAKSDFTPLFKADVRPDSPKRADASPNLRREDPNESSGGPG

SEQ ID NO: 190370 - protein, 117 aa, Glycine max
  Coding DNA Sequence Number=SeqID_73592
MQKTEDIEVFGNGNVHIRALENDVDAPHKCLPSSLQVLPLISHQRRLTTYAPYGLLLAYQPNVACMHAPGALSSACELRWTLKLVADVEAVVVCLRLATAAGLAPAVVPASTCNIAQ

SEQ ID NO: 190371 - protein, 272 aa, Glycine max
  Coding DNA Sequence Number=SeqID_73593
  Gene Ontology: Mol. function=dimethylallyltranstransferase activity; Cellular component=mitochondrion; Biological process=cholesterol biosynthetic process
  Homolog annotation: Hit_ID=P49351; Match level="QueryCoverage=51%, HitCoverage=41%, E-value=9e-60, Identity=80%"; Hit description =Farnesyl pyrophosphate synthetase 1 (FPP synthetase 1) (FPS 1) (Farnesyl diphosphate ...
  Homolog annotation: Hit description=synthetase 1) [Includes: Dimethylallyltranstransferase (EC 2.5.1.1); Geranyltranstransferase (EC 2.5.1.10)]
  Pfam annotation: Domain name=polyprenyl_synt; Domain location=22-203; Score=-35.0; E_value=4.2e-07; Accession=PF00348.8; Description =Polyprenyl synthetase
MFHYASYFCQDVGKGEGSDDVGSDALDFEGLTPVDVRTAHDTGGVEDMSGLEREGVEEAANPAHVAVDEEVEGMRHRGAVGWEVQQNSVMPGFSGFMAGHVVACALLMAGEDLDKNVDVKNILVEMGTYFQVQDCFGDPQTIGKIGTDIEDFKCSWLIVKAFELSNEQQKKFLQENYGKPDPENVAKVKALYNELNLQGVFEEYESGSYVKLVSSIEAHPSKAVQVVLKSFLAKIYKRQKLLKNKRHAIARQLRKDLVELIQSGHEEIAFNQ

SEQ ID NO: 190372 - protein, 94 aa, Glycine max
  Coding DNA Sequence Number=SeqID_73594
MAPRKRAAKRARKATAREGSSAAPQAKIEFDRHRFRCEEHQRHFQVIEDWYCTSETPSGPSEVQYDTRVFGIDYRSLPILRSTGRPDKAHPTSY

SEQ ID NO: 190373 - protein, 60 aa, Glycine max
  Coding DNA Sequence Number=SeqID_73595
MEERNKRVVKLDDKRYFNISPQETYAAANDFEDKEALEVYVVVVELPYTIEAQIYDFFTD

SEQ ID NO: 190374 - protein, 161 aa, Glycine max
  Coding DNA Sequence Number=SeqID_73596
  Gene Ontology: Mol. function=kinase activity; Cellular component =nucleus; Biological process=regulation of progression through cell cycle
  Homolog annotation: Hit_ID=Q9M4K9; Match level="QueryCoverage=61%, HitCoverage=36%, E-value=1e-38, Identity=63%"; Hit description =Cyclin A3.1
  Pfam annotation: Domain name=Cyclin_N; Domain location=13-112; Score =86.8; E_value=6.7e-23; Accession=PF00134.13; Description=Cyclin, N -terminal domain
LPGIVAVEVTGRPEVPFHPEREVDPSKRPLMDYVQKIQRDVNANMRDVLVDWLVEAEVAIVGVASMLIASKYEEIKPPEVEDFCYITDNTYSKEEVVNMEAEILKALKFELGGPIVKTFLRCVSLLNLCPCCVNFACSSYFCLGILAHHLYAFAFLFAGDS

SEQ ID NO: 190375 - protein, 133 aa, Glycine max
  Coding DNA Sequence Number=SeqID_73597
MAERRNPMGKIPKIPFPSQEGALSSGKNTLENGGSNRENNKDHISQSRGSTLDGEEHIGEWKNSIGKITKITFPSQEGSALDGEEHVGEWRNPIGKITKITFPSQEGPLLTVKNTLENGGFNRENNKDHISQS

SEQ ID NO: 190376 - protein, 267 aa, Glycine max
  Coding DNA Sequence Number=SeqID_73598
  Gene Ontology: Mol. function=structural molecule activity; Cellular component=flagellin-based flagellum; Biological process=ciliary or flagellar motility
  Homolog annotation: Hit_ID=P16326; Match level="QueryCoverage=99%, HitCoverage=82%, E-value=8e-85, Identity=61%"; Hit description =Flagellar hook-associated protein 3
  Pfam annotation: Domain name=Flagellin_N; Domain location=1-108; Score=1.2; E_value=9.4e-05; Accession=PF00669.10; Description =Bacterial flagellin N-terminus
TQARDSQFALARSFANQGLSLEESTLSDVTTAIQSAQSTLISAGNGSLSDDDRASYATQLEGIRSQLLNLANSKDGNGRYLFAGYASDKPPFTEDASGKIIYSGGSDAITQKVDSERTMTVGHTGNSIFDQLTSNAKPEPDGSASQTNLFDMLDDAIAALKVPQNDADDATKQTFSAAMDKANRGFSNSLNNVLAVRSEIGTQLDELDTLDAKGDDRKVTLKDQMSTLVNVDYTEAISTYTMQQQLLQASYTTFSDMSKMSLFQMNK

SEQ ID NO: 190377 - protein, 189 aa, Glycine max
  Coding DNA Sequence Number=SeqID_73599
  Gene Ontology: Mol. function=ribonuclease activity; Cellular component=cytoplasm; Biological process=RNA processing
  Homolog annotation: Hit_ID=Q2NU48; Match level="QueryCoverage=30%, HitCoverage=4%, E-value=5e-11, Identity=53%"; Hit description =Ribonuclease E
PETPAPEVVHQAEPQAHTEVPVVNTDDLTPVAAPVDHQPAVISAADEAVAQETAAEAQPAVTPAEDTPPVVTEAVSAAEQAPIEVSPAVEAQVEEVLSAPVAAEAPVAPVTEPHAPVAARDTGVSHAETRFRHHATAPMTKAPAPAWEPEPVRHSDWVRPAFNFEGRGSAGGHSATHQATAPATRPESA

SEQ ID NO: 190378 - protein, 455 aa, Glycine max
  Coding DNA Sequence Number=SeqID_73600
  Gene Ontology: Mol. function=transferase activity; Cellular component= nucleus; Biological process=regulation of transcription, DNA-dependent
  Homolog annotation: Hit_ID=Q00M72; Match level="QueryCoverage=99%, HitCoverage=100%, E-value=0.0, Identity=96%"; Hit description=N -hydroxycinnamoyl/benzoyltransferase 1
  Pfam annotation: Domain name=Transferase; Domain location=4-451; Score=242.1; E_value=1.2e-69; Accession=PF02458.6; Description =Transferase family
MSTHVVRHVSECFVKPHCPGQESNQICNLTPWDIAMLSVHYIQKGLLFKKPPTTLVDQHDFIENLLEKLKHSLSLTLFHFYPLAGRLVTQKTQDPPSYAVLVDCNNNSDGARFIYATLDMTISDIISPIDVPPIVHSLFDHHKAVNHDGHTMPLLSIQVTQLVDAVFIGCSMNHVIGDGTSYWNFFNTWSEIFQAQAEGHEYDVPISHNPIHNRWFPELYGPLINLPFKNHDEFISRFESPKLRERIFHFSAESIAKLKAKANKECNTTKISSFQSLSALVWRSITRARSVPQEQRTSCKLATDNRSRMEPPLPKEYFGNSLHAVSGEATTRELLENGLGWAAWKLHLAVANHNASAVLDFLKEWLESPFIYQIGGFFDPYCVMMGSSPRFNMYGNEFGMGKAVAVRSGYANKFDGKVTSYPGHEGGGSIDLEVCLSPDTMSALESDDEFMSAVC

SEQ ID NO: 190379 - protein, 630 aa, Glycine max
  Coding DNA Sequence Number=SeqID_73601
  Gene Ontology: Mol. function=nucleic acid binding; Cellular component= nucleus; Biological process=mRNA export from nucleus
  Homolog annotation: Hit_ID=Q00M91; Match level="QueryCoverage=99%, HitCoverage=100%, E-value=0.0, Identity=86%"; Hit description =Poly(A)-binding protein
  Pfam annotation: Domain name=PABP; Domain location=533-604; Score =140.1; E_value=5.9e-39; Accession=PF00658.8; Description=Poly -adenylate binding protein, unique domain
  Pfam annotation: Domain name=RRM_1; Domain location=114-184; Score =99.1; E_value=1.3e-26; Accession=PF00076.12; Description=RNA recognition motif. (a.k.a. RRM, R
  Pfam annotation: Domain name=RRM_1; Domain location=205-275; Score =113.7; E_value=5.3e-31; Accession=PF00076.12; Description=RNA recognition motif. (a.k.a. RRM, R
  Pfam annotation: Domain name=RRM_1; Domain location=26-97; Score =91.0; E_value=3.6e-24; Accession=PF00076.12; Description=RNA recognition motif. (a.k.a. RRM, R
  Pfam annotation: Domain name=RRM_1; Domain location=308-378; Score =78.4; E_value=2.2e-20; Accession=PF00076.12; Description=RNA recognition motif. (a.k.a. RRM, R
  Pfam module annotation: Pfam domain module=PABP::RRM_1::RRM_1::RRM _1::RRM_1; Domain location=533-604::114-184::205-275::26-97::308-378
MAHIPQTPTNDAAASGANPSMTTISLYVGDLDHDVNDPQLYDLFNQVAQVVSVRICRDVATQQSLGYGYVNFSNARDAAKAIDVLNFTPLNGKTIRIMYSIRDPSARKSGAANVFIKNLDKAIDHKALFDTFSAFGNILSCKIATDASGQSKGHGFVQFESEESAQNAIDKLNGMLINDKQVYVGPFQRKQDRESALSGTKFNNVYVKNLFEATTEADLKSIFGEYGAITSAVVMRDVDGKSKGFGFVNFANVEDAAKAVEALNGKNFDGKEWYVGKAQKKSERELELKERNEQSTKETVDKYHGTNLYIKNLDDSVGDEELRELFSEFGTITSCKVMRDPSGISRGSGFVAFSIAEGASWALGEMNGKMVAGKPLYVALAQRKEDRRARLQAQFSQARPVAITPNVSPRMPLYPLGAPGIGQQLLYGQAAPSMIPQAAFGYQQHFVPGMRPGGAPNFYVPLVQQGQQGQRSGGQRGAGPMQQLQQPLPLMHQQMLPRGHVYRYPPGSNMQNIQLAGVPGGMVSYGIGQPMPTQALASALANATPEQQRTMLGEALYPLVDKLEHETAAKVTGMLLEMDQPEVLHLIESPDALKAKVVEAMDVLRKVTQQQSNSPADQLASLSLNDNVES

SEQ ID NO: 190380 - protein, 491 aa, Glycine max
  Coding DNA Sequence Number=SeqID_73602
  Gene Ontology: Mol. function=ATP-dependent peptidase activity; Cellular component=integral to membrane; Biological process=ATP -dependent proteolysis
  Homolog annotation: Hit_ID=Q00M73; Match level="QueryCoverage=99%, HitCoverage=100%, E-value=0.0, Identity=83%"; Hit description =Membrane protein-like protein
  Pfam annotation: Domain name=DUF81; Domain location=84-446; Score= -12.9; E_value=6.4e-05; Accession=PF01925.9; Description=Domain of unknown function DUF81
MAIEVRKKTSITAATTAIWLVSWSLIMAYNVSLAERVLKDQKSESFVAKERQGVMNSIIDFFRNDGEPTNDRVWPEMKFGWRIVVGSIVGFFGAALGSVGGVGGGGIFIPMLTLVIGFDAKSSTALSKCMIMGAAVSTVYYNLRFRHPTLDLPVIDYDLALLFQPMLMLGISIGVAFNVMFADWMVTVLLIILFIATSTKALFKGIDTWKKETIMKKEAAKMLESDSSPGYVSEEDYKSLPAGSADPRDEEVPLLKNIYWKELLVLVYVWVAFLIVQIIKTYTKTCSILYWVLNSLQVPIAISVTLYEAICLCNGTRVISSKGKENTDWMKLHKICLYCSCGIIAGIVSGLLGLGGGFILGPLFLELGIPPQVASATSTFAMVFSSSMSVVQYYLLERFPVPYASYFILVATIAALTGQHVVRKIIAIFGRASIIIFVLAFTIFLSAISLGGVGIENMVEKMENNEYMGFANICHVNLGGVFPTYRSGSFL

SEQ ID NO: 190381 - protein, 80 aa, Glycine max
  Coding DNA Sequence Number=SeqID_73603
MACDVVSSPRWLLVLKTYGGLNSEAAMQRSDDFDSGADDWRRVVEEKVVVMVRNLQVREKGIGIGLNWEKQKDTNFQSFI

SEQ ID NO: 190382 - protein, 714 aa, Glycine max
  Coding DNA Sequence Number=SeqID_73604
  Gene Ontology: Mol. function=steroid hormone receptor activity; Cellular component=nucleus; Biological process=regulation of transcription, DNA-dependent
  Homolog annotation: Hit_ID=Q00M88; Match level="QueryCoverage=99%, HitCoverage=95%, E-value=0.0, Identity=62%"; Hit description=N -hydroxycinnamoyl/benzoyltransferase 2
  Pfam annotation: Domain name=Transferase; Domain location=5-406; Score=200.4; E_value=4.2e-57; Accession=PF02458.6; Description =Transferase family
KGLLFKKPTPLVDRHDFIGNLLGKLKHSLSLTLSHFYPLAGRLVTHQTQNPPSYTVSVDCKNSDGARFIYATLDMTISDILSPVDIPLVVQSLFDHHKALNHDGHTMPLLSIQVTELVDGVFIGCSMNHSVGDGTSYWNFFNTWSHIFQAQAQGHETDLPISHRPIHSRWFPNDCAPPINLPFKHHDEFISRFEAPLMRERVFQFSAESIAKLKAKANMESNTTKISSFQSLSAHVWRSITRACSLPYEQRTSCRLTANSRTRMEPPLPQEYFGNSVNRVSAETTVGELLENDLGWAAWKLHMAVANHNNKVVLQSLKEWLQSPLIYQIGQAMDPYVVLISSSPRFNMYGNEFGMGKAVAARSGYANKFDGKVTSYPGREGGGSIDLEVGLLPHIMSALESDREFMNAVSIRIKDVQSEPRVLIDAIVASRVDAYKILAEIASSGVGDGNIFIFKILAHPNEVPNQIWNLTDWDIAMLSTNYIQKGLLFKKPATLVDQQDFMENLLEKLKRSLSLTLSHFYPLALVAESPTKPKTLPLILFSLIATSTPLFDQHKALNHDDYTMPLLSIQVTELVDAVFIGCSMNHVIGHATDVPIDNPESIAKLKAKANSESNTPKISSFQSLSALVWRSNLQGLLEKGLGWAAWKLHQAVARVVLQSLKVWLESPFVIQIGRFFDPLLCDDGWLAQAVKEVEALLESDEEFMNAVSVSNPLY

SEQ ID NO: 190383 - protein, 462 aa, Glycine max
  Coding DNA Sequence Number=SeqID_73605
  Gene Ontology: Mol. function=RNA-directed DNA polymerase activity; Biological process=RNA-dependent DNA replication
MAPLPKGYKTPNFTTLSVEDGKSTLEHVGRFTTQYGKASHNKFHNLQPQLDVNVTDLVALKRKVNESAMEFLERFRNMAGRCSVQFLEAKYATIVMGNMHFHLRKKLRAQECNDMNQLASKATRVEQLIIDKEQIQENKGRGPQLESIVDSDEYTTISIQGEAKIMASKIARIKLANKSISKMIVDIDLFPSIDNIMISCSPSKKKRRAIWQSKQVEHHEYNKGLCSSNTKLPITDEDPIPKGEKEWLRLKWENGMKTLRKTVKGKGSKEVSSSKVLKALQKAFVMKEDYPPTTCSSKEEQLIEEKGESKDICHGQPKTNKEELYTDLTDKAYINNKMLSRVIVNGRALLNVMPINTLEKIGTHALGVLVADITVGTKIKKMVEMIHANRFMFKVEVHIVEAIYYSPFMKLIQCLECMKRGRRMTRGMRVPRKEYAQSRHQRLFEENVGKTGKDAIYELLSE

SEQ ID NO: 190384 - protein, 724 aa, Glycine max
  Coding DNA Sequence Number=SeqID_73606
  Gene Ontology: Mol. function=zinc ion binding
  Homolog annotation: Hit_ID=Q00M69; Match level="QueryCoverage=87%, HitCoverage=80%, E-value=0.0, Identity=87%"; Hit description=Zinc finger protein
MAVMAEWYGRFFANRHRQFVKGGPLWQRHRPQWRVYMAEFWPSAIDNIFASYIPSMQGQRGTVGSMPETLEFDCGSASGNSTVDQQICWNNVNPAENQIPDYILSPGDMNSSYGNSIINREWQNLSGWSLGEPSSSNTPNEVNNNEQKRELGWSSTITAGALAGPRLEERRLEPANALSLDNVNTGPMYTRSPNSRLMSQNLNLNAGLADNGSDNSQHLELPNLNKSSGSANECIPPNVGSGSFLLPSGNNGFLVEDTDGRPGCSHDTRRVSCKRKAVEGNNGQSSDAGSSSYSQHTDGSAWHTIPTQVNAGSSSRRSISSEQVNARLGLGMGDGASENVPDSNIAGSSESFHRNFRLRLNPSNPPNSVPPTAFSTGSMIRHSGVPPSSQVSQRLHFVDNSLNLRSAPPIDNVVPQSQPLVIHVPALPRNRQSFRWSGGSSSRNIHSSNSVICADRDQQDASSRRMSRNMLEHPVFVPATDLRNLVQNPTVRASSSSSENLSIPGNVASSSRTGSNPATNPSSATTFSRSNPPQHPRRLSEYVRRSLFSPSSDAIGSPSHNYSSLRSGLSTSEPRALSSGSGANPRSASWLERQGDSEFGIPYSLRTLAVASEGGSSRLVSELRNVLGLMRRGGNVRFEMLCLGDLLVMGSNPETVSLHMQGAIMASKLVQSLYRSNSKNIITCPAPMQISFDEPVEEVEGSRSWKVFGRKRNRPRLASPECLV

SEQ ID NO: 190385 - protein, 314 aa, Glycine max
  Coding DNA Sequence Number=SeqID_73607
  Gene Ontology: Mol. function=nucleic acid binding; Cellular component= intracellular
  Homolog annotation: Hit_ID=Q1RZD5; Match level="QueryCoverage=97%, HitCoverage=86%, E-value=2e-17, Identity=35%"; Hit description=Zinc finger, C2H2-type
  Subcellular localization annotation: CTP_CleavageSite=48; ConfidenceScore=5.33e-01
MEFKYRDDQIQRTPSPLRHPLPSNTYVSNRPLQGGFPRNVSVPRVFLMAMPINVNEVFQRELEKEKIWRELEKEGIRREIIAREMTFAQQRELEDEVRKEIELERTFRISMQRSNGITFREPVSVSFNHSMGPLNNITMSGGLPFHLLSQASKQINKDKVIILNKPDDHCGEKRKAMTLAIDDNESLQKKSKKDWSCELCQISATRLDSRPESETLHPCLTPADTCKLESKEKGQVVQKGKGLGDLDDQNETTTSKQAQETSALSKGKKFEFWCELCQVQTQSEIVMQSHQNGKKHLRNMKKLNHNNDGVANLG

SEQ ID NO: 190386 - protein, 128 aa, Glycine max
  Coding DNA Sequence Number=SeqID_73608
MGFTYLGKRTNVPFTWGKLCIRAQYTSKAEAVGITSYMDLEEDILATLLLRDIRKKEKGKEEREREREREKGKGHEYDRTKISWNLRWKVVEVDEEVVGIIIITIIDCKIDSYNHGRSIFTFLFVITF

SEQ ID NO: 190387 - protein, 89 aa, Glycine max
  Coding DNA Sequence Number=SeqID_73609
MSYTVPTTKKMKHTNMGTLITTTIYDYYYATNKAKESKERKSRTDPFSFSLTFENSIRAITGKIEKSQKIVRDAAITFRRHVSPLRGKR

SEQ ID NO: 190388 - protein, 86 aa, Glycine max
  Coding DNA Sequence Number=SeqID_73610
MEEGVGLQCKIAEVNVKESEGSNEGASRKRGFKRRSKHKVLGFKAISKASRNSRENYDGFFLKIGINFIKHNILRRFSITALESAS

SEQ ID NO: 190389 - protein, 148 aa, Glycine max
  Coding DNA Sequence Number=SeqID_73611
MKIFCRKGSRVDLCHQAYDDDDYEGSFCDNPLLEKTSNESNLASIDSHRKCFPFRFGRVGNRQKIVILVTLLVFIIVVAFAVVIWIGIGKNPIDSEVAAQPTQKCNSFFINKSSMTCACLPCNDNYQTSPLKEITWNPRPFFNSTRTS

SEQ ID NO: 190390 - protein, 131 aa, Glycine max
  Coding DNA Sequence Number=SeqID_73612
MCIDTIKKKYKSEKARVSASNNTLSSSWPFYECLDALINLFAISFAVALEEPKSSRIGRTKTKTLALLLRWTRGMRRLAKAIERFGKFMRKWRQIVDLKKQRMKMFMDTQNLTVKQSSLNNLFKSRIAIMS

SEQ ID NO: 190391 - protein, 137 aa, Glycine max
  Coding DNA Sequence Number=SeqID_73613
MRIGSIEPIVDLFADEVDTEGDDGDAKARGGVAELIGEHRMLPPCIPSPEELSMDETEAQEAHGRAECDVMMILVRVCPSFSTSVSSSPGFLSFSFGLPNNPQIPKRRQVSDNNLFKEKCKIKGGHSLLCTCARAGG

SEQ ID NO: 190392 - protein, 98 aa, Glycine max
  Coding DNA Sequence Number=SeqID_73614
MKPLEFEFAFPHHDIYCHACLAHPLCVLQPCLLIGNYAHVSSTQEADRGGGEAYGAGVGVDTFKVRSGHGCGKGERLRELCPKRLREHVKIKGNESVN

SEQ ID NO: 190393 - protein, 87 aa, Glycine max
  Coding DNA Sequence Number=SeqID_73615
MAEPRGEREFMDLLLSPASKVLINWFEFCIVHTKSVNTMLFIPYRYVEGGMDLISKAIGNAAIESGAHVTNVEVFHQESLTFKLLPP

SEQ ID NO: 190394 - protein, 47 aa, Glycine max
  Coding DNA Sequence Number=SeqID_73616
MESHLKSFAVHVYNFSMCSLLAMSTSQVTHNKLHVKPPPNHNNFYQD

SEQ ID NO: 190395 - protein, 263 aa, Glycine max
  Coding DNA Sequence Number=SeqID_73617
  Homolog annotation: Hit_ID=Q1SMI5; Match level="QueryCoverage=49%, HitCoverage=7%, E-value=3e-29, Identity=70%"; Hit description =Prefoldin; tRNA-binding arm; t-snare; Protein kinase PKN/PRK1, effector
MEIISSLEYKLSCAEEDVHRLNSKIVDGVEKLQSSKQKCLLLETSNHTLQSELQSLAQKVGSQSEELNEKQQELGRLWGCIQEERLRFIEAELLSKLFSSCILSLRNSLDLLLLNLTVKWKYWGMWNLQKVKKTEDPHFQRVISFKLLPNEMKGTLHVISERLGRKWVDLCHQAYDDDDYEGSFCDNPLLEKTSNESNLASIDSHRKCFPFQFGRVGNRQKIVILVTLLVFIIVVAFAVVIWIGLGKNPIDSEVTAQMDLLRI

SEQ ID NO: 190396 - protein, 308 aa, Glycine max
  Coding DNA Sequence Number=SeqID_73618
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=1e-23, Identity=24%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
TRRPRYQRVARPRHQRAARPHLQRLHILAFQGLHALTFRGLHALTFRGLHAFAIRRLHVLSFRGLHVLPFRGLHAPAFRGLHVLTFRGLHALALRGLHALALRGLLVLAFRGLHVLAIRGLHVLVIRGLHALAIRGLHALTFRGLYVLALRTARLHALNMRGLLVHAIRGLHALTFRGLHVLALRSTHPYLQRATRPHHQRTARLHALTFRWLHAFTFIGLHALNFSGLQVLALRTTCRHLQTTTCPHTQKATRPHLQRTTRPHLEEYTSTPSESCTLSPSEGFTPSPSEDYMSSPSEDCTSSPSEDY

SEQ ID NO: 190397 - protein, 240 aa, Glycine max
  Coding DNA Sequence Number=SeqID_73619
MAAHGGHRWSWVVKNEVLGFGPGLAHPWALGATSSLVGIGLSAPLGAQRNFFSVGIGFSAPLGAQRNFLSVGIRLSAPLGTQRNFLSIRIGLSAPLGAQCHSLSVGIALSVPFMLSKRSKGLKEPGTYRSRMVLRVLCHIRCHMYFVDLGQHISPPSFESACGQKRLSRVEGAPKYGQMLCDVESGNLDKCKSYRSMKLVRSSVRVWHRHSTLVYVSLMEWARTRFVVRGLEGLHCGVKF

SEQ ID NO: 190398 - protein, 377 aa, Glycine max
  Coding DNA Sequence Number=SeqID_73620
MDREVISIGGSSSEDTHHGASDNESSILERLRASRCTGGGTTCLRERARPSATSPAREPIPTMVVLPPSSSREQGESVGTFGCLLAYDVGILLGFHHPHLSLLALSGVSKKLFEFDLNVFLRFKVLATYVVANGFPLMFNKDGEPCFPFYWQSNPTRRKQDDNIGVSGHKKLRAPISLRALRLVVGLTPSREITPVAGVDVSTTSSSFVVVSSSTVATPLLSAGVVTTSAPMMLSPPSLAPSVPPFAVLATAVPSSSSRSHFSLDQLYTSSDANSLYSANYKLEQKTPVSFVSAFYRNLIWSAGVQNAMDSTKVFLQRSLVIQEENGQWHQETLRKVASLEAEVTKWRPIAHTVWRQEHPKVANATIADVSLFSHIS

SEQ ID NO: 190399 - protein, 211 aa, Glycine max
  Coding DNA Sequence Number=SeqID_73621
  Homolog annotation: Hit_ID=Q3TCP4; Match level="QueryCoverage=33%, HitCoverage=20%, E-value=2e-08, Identity=37%"; Hit description=NOD -derived CD11c +ve dendritic cells cDNA, RIKEN full-length enriched library, clone:...
  Homolog annotation: Hit description=F630110J02 product:hypothetical protein, full insert sequence
MRWAESAALNSRWDRCQLLTIILLLRCEIGSIDLISVMAPNPMKMNMKQSANSTTTTIANKEILVRETMRISANLASTPLLEAPPPPSPIVGIICCEELDGRRWKYVAESDARGGFKKNSFRPVRLNFHNPRDHPLHEVLAFVTSYVVPEGFPDSVIPSYVPYMTWRALKHFFGGAMGVFTTQTLLSSVGVSRNRAAPGAVAINWILKDGA

SEQ ID NO: 190400 - protein, 1174 aa, Glycine max
  Coding DNA Sequence Number=SeqID_73622
  Gene Ontology: Mol. function=protein binding; Cellular component =ubiquitin ligase complex; Biological process=regulation of transcription, DNA-dependent
  Homolog annotation: Hit_ID=UPI000051A8F0; Match level="QueryCoverage =99%, HitCoverage=98%, E-value=0.0, Identity=40%"; Hit description =PREDICTED: similar to Cullin-associated NEDD8-dissociated protein 1 ...
  Homolog annotation: Hit description=(Cullin-associated and neddylation-dissociated protein 1) (p120 CAND1) isoform 1
  Pfam annotation: Domain name=HEAT; Domain location=165-201; Score =17.9; E_value=0.036; Accession=PF02985.12; Description=HEAT repeat
  Pfam annotation: Domain name=HEAT; Domain location=246-285; Score =3.5; E_value=16; Accession=PF02985.12; Description=HEAT repeat
  Pfam annotation: Domain name=HEAT; Domain location=326-360; Score =2.7; E_value=20; Accession=PF02985.12; Description=HEAT repeat
  Pfam annotation: Domain name=HEAT; Domain location=41-77; Score=5.0; E_value=11; Accession=PF02985.12; Description=HEAT repeat
  Pfam annotation: Domain name=HEAT; Domain location=544-582; Score =11.7; E_value=1.6; Accession=PF02985.12; Description=HEAT repeat
  Pfam annotation: Domain name=HEAT; Domain location=627-663; Score =2.0; E_value=25; Accession=PF02985.12; Description=HEAT repeat
  Pfam annotation: Domain name=HEAT; Domain location=881-917; Score =22.3; E_value=0.0017; Accession=PF02985.12; Description=HEAT repeat
  Pfam annotation: Domain name=HEAT; Domain location=953-992; Score =11.3; E_value=1.8; Accession=PF02985.12; Description=HEAT repeat
  Pfam annotation: Domain name=HEAT_PBS; Domain location=345-369; Score= 4.3; E_value=26; Accession=PF03130.6; Description=PBS lyase HEAT-like repeat
  Pfam annotation: Domain name=HEAT_PBS; Domain location=824-853; Score= 4.6; E_value=23; Accession=PF03130.6; Description=PBS lyase HEAT-like repeat
  Pfam annotation: Domain name=HEAT_PBS; Domain location=977-1009; Score=9.7; E_value=4.4; Accession=PF03130.6; Description=PBS lyase HEAT-like repeat
  Pfam annotation: Domain name=TIP120; Domain location=994-1161; Score =299.8; E_value=4.9e-87; Accession=PF08623.1; Description=TBP (TATA -binding protein) -interacting protein 120 (TIP120)
  Pfam module annotation: Pfam domain module=HEAT::HEAT::HEAT::HEAT::HEA T::HEAT::HEAT::HEAT::HEAT_PBS::HEAT_PBS::HEAT_PBS::TIP120; Domain location=165-201::246-285::326-360::41-77::544-582::627-663::881 -917::953-992::...
  Pfam module annotation: Domain location=345-369::824-853::977 -1009::994-1161
MANLALTGILEKMTGKDKDYRYMATSDLLNELSKTTFKADADLEVKLANIIIQQLDDAAGDVSGLAVKCLAPLVRKVSEVRVVEMTSKLCDKLLNGKDQHRDIASIALKTVVAEVSTQSLALSILQTLTPQLIKGITGPGMGSEIKCESLDILCDVLHKFGNLMAADHELLLSSLLSQLSSNQASVRKKTVACIASLSSSLSDDLLAKATVEVVTNLKKKVAKSEMIRTNIQMIGALSRAVGYRFGPHLGDTVPVLINYCTNASENDEELREYSLQALESFLLRCPRDISVYCDEILHLTLEYLSYDPNFTDNMEEDTDDEGLEEEEDDDSANEYTDDEDVSWKVRRAAAKCLAALIVSRPEILSKLYDEQKGCSFNTDMLQMDVFNTFIELLRQTGNVTKGQIDADEMRQQEVSKIVKSINRQLREKSIKTKVGAFSVLKELVVVLPNCLADHIGSLIPGIEKALNDKSSTSNLKIEALTFTRLVLSSHSPDVFHPYIKALSAPVLSAVGERYYKVTAEALRVCGELVRVVRPNIEGSGFDFRPYVHPIYNGIMSRLINQDQDQEVKECAISCMGLIVSTFGDHLNAELPACLPVLVDRMGNEITRLTAVKAFAVIAASPLRVDLSCVLEHVVAELTAFLRKANRALRQATLGTLNSLIVAYGDKIMLSAYEVIIIELSGLISDSDLHMTALALELCCTLMGDKRSNQSIGLAVRNKVLPQALTLIKSSLLQGQALMALQNFFAALVYSANTSFDSLLESLLACAKPSPQSGGIAKQALHSIAQCVAVLCLAAGDQKCSSTVKMLTDILKDDSSSNSSPFEEIKSAASYALGNIAIGNLPKYLPFILDQIDNQQKKQYLLLHSLKEVIVRQSVDKAEFQESSVEKILNLLFNHCESEEEGVRNVVAECLGKIALIEPVKLIPALKVRTTSPAAFTRATVVIAVKYSIVERQEKIDEIIYPEISSFLMLIKDNDRHVRRAAVLALSTFAHNKPNLIKGLLPDLLPLLYDQTIVKQELIRTVDLGPFKHIVDDGLELRKAAFECVDTLLDSCLDQVNPSSFIVPYLKSGLDDHYDVKMPCHLILSKLADKCPSAVLAVLDSLVDPLQKTINFKPKQDAVKQEVDRNEDMIRSALRAIASLNRISGGDCSVKFKNLMNEISKSQTLWDKYYSIRNE

SEQ ID NO: 190401 - protein, 91 aa, Glycine max
  Coding DNA Sequence Number=SeqID_73623
RTVEWILPTPTPYRLVEPVQVIEVTSSEEDPEEDLEELPPEPAVDALDFLEGDEDPLLEVDSPEEVMSASEADSTEDSGPREMAISGGSSS

SEQ ID NO: 190402 - protein, 38 aa, Glycine max
  Coding DNA Sequence Number=SeqID_73624
MALLFLPHFTLLPIMDTCYVSNVSDDVVPLNDIGSSFN

SEQ ID NO: 190403 - protein, 67 aa, Glycine max
  Coding DNA Sequence Number=SeqID_73625
MAGPPTQETKVDLLFIFQGAKYSQRWRLLCMTRILWAAQMLEQSVKAAYCWVTKRVRGASKARDTHS

SEQ ID NO: 190404 - protein, 211 aa, Glycine max
  Coding DNA Sequence Number=SeqID_73626
  Gene Ontology: Mol. function=nucleic acid binding; Cellular component= intracellular; Biological process=DNA integration
GFSKGGPGWLVCKLKRSIYGLKQSPRQRYKWFDSYMLRIGYKRCEYDCCVYLDDGSFIFLLLYVDYMIIVGNHLCDVNELKSLLSEDFDMKDLGPSKKILGMEIHKDKQSIRLWLSQQGYVKKVLDKFNMSNAKPVSTPLAKDFNHSVDQCPKTDVEVDYMSKVPYANVVGCLMYAMVCTRPDLAHVSDPLVAGYVDSDYASDLDDKISTK

SEQ ID NO: 190405 - protein, 104 aa, Glycine max
  Coding DNA Sequence Number=SeqID_73627
MVLHTFRQPEANEPVDTQRLTSSSAPFVIHRQRVRFYFHHLETFKSLDAQCLLVEATLLAWASWAATTSLFSPINRRKRAEQNVQPFWFRGDSSPFFIVLQSST

SEQ ID NO: 190406 - protein, 141 aa, Glycine max
  Coding DNA Sequence Number=SeqID_73628
MESGDMRRYPSGYPYKRFLLTLTRETSVIFCTFFHPDPWSPMTCGDTQAVKLGGRRRYPSGYPYKHSFAIPQTQSPGGSEPVEEQILTSSSAPFVIQTHGVRRGYRMVNRTFHQPEANEPVDTQRLTSSSGPFVIQTRGVR

SEQ ID NO: 190407 - protein, 218 aa, Glycine max
  Coding DNA Sequence Number=SeqID_73629
  Homolog annotation: Hit_ID=Q8H6Q8; Match level="QueryCoverage=62%, HitCoverage=4%, E-value=5e-19, Identity=34%"; Hit description=CTV.20
MEPEYWNKNPFKATAKAFPPVFHFKPTTINKTRTFYEFILIDSNSVSIKHFKDPKGQSLNTHSTIQILKVMQPRQFGPNLNQAKKFSAPFDRVGYTYRDYIDAWTKAFWHQNTRFKHSWLIYLKTNIIYNFPNWYNKIEGNKNFPSLQRHAFVKWWTQFDVSKVELEQVRLWFKAHPELLKAADPKTSLFLNQKSQLAAFLASARSKESLAKNLKEFL

SEQ ID NO: 190408 - protein, 219 aa, Glycine max
  Coding DNA Sequence Number=SeqID_73630
  Homolog annotation: Hit_ID=Q8H6Q8; Match level="QueryCoverage=50%, HitCoverage=3%, E-value=5e-12, Identity=35%"; Hit description=CTV.20
MEPEYWDKNPFKATAKAFPPGFQFKPTAINKIRTFYEFILIDSNSVSIKHFKDPKDQSLNTHSTIQILKVMQPRQFGPNLNQAKEFSALFDLVGYTYWDYIDAGTKVFWYNKIEGNKNFPSLQRHAFVRLWFKAHPELLKADDPKTSLFLNQKSQLATFLASAKSKESLAKNLKEVLQILQQEEDKGSSSKKEETNSSEEDDPFYQNEDDCFGISLNDD

SEQ ID NO: 190409 - protein, 163 aa, Glycine max
  Coding DNA Sequence Number=SeqID_73631
MSHRSSSVNGEDTSHKDPLSRILYELSSLKLGKEKLERKEKEKERVEISQDEREQIREEERRKILKELRKEKYASYSTHDSCKSLSEELRGYYEGRHRSHLRPHSHRREKERKPQEANINLPYFHGKDNVEAYLDWEMKVEKLFAWHHTSEERKDPLATLSFQ

SEQ ID NO: 190410 - protein, 137 aa, Glycine max
  Coding DNA Sequence Number=SeqID_73632
  Gene Ontology: Mol. function=RNA-directed DNA polymerase activity; Biological process=RNA-dependent DNA replication
MDIDPFHIHVNYIEPMQILMMGTLIGSPKVNTPLYEEENATVFDPPTDEMRCHVKPLHFTSMVEEQIIHKILVDGRVAFNILPRLMSQRFGKNIEDLISHNIVVSDFYGKPSDFEGRVNTCGMSSSINGSPEAFLLE

SEQ ID NO: 190411 - protein, 205 aa, Glycine max
  Coding DNA Sequence Number=SeqID_73633
MGEVDEVQERIKADIEALKEQMATMMEAMMSMKMMMEVNAAAVVVTSAVVEVDPTPPFDLNQINHPTSDMISQGGKKLGSTGGPHFVQVQNKHAFPPCGLPPNYAPPNVVHIPNENVNNSTPILVESQQPQADHAHWEEPLLQYLKKGKLDQIEERLRTAEGGQDYAFADMEDLCLVPDMVILPKFKVPEFDKYKGTTCPKNHLK

SEQ ID NO: 190412 - protein, 135 aa, Glycine max
  Coding DNA Sequence Number=SeqID_73634
MAIVVVEIKETTTVTVKIKETATKALEIIDTAIAAVGIKEVATAAEEERKMDTDVTVNKKVLVEKEKSKENVFEQKRRRIKIGLELVEHKLLIYEGKKPVKKAQRRFALNVMEVIKVEIERLLKVNFILTARYVD

SEQ ID NO: 190413 - protein, 182 aa, Glycine max
  Coding DNA Sequence Number=SeqID_73635
  Gene Ontology: Mol. function=RNA-directed DNA polymerase activity; Cellular component=intracellular; Biological process=RNA-dependent DNA replication
MSLERKEEVKKQFDVDFLVVARYPEWVANIVPVPKKDGKDNFPLSHIDILVDNTTNVSLFSFMDEFLGYNQIKMAPKDMEKTTFITLWGTFFYKVMSFGLKNAGQLTSGLWWRIEVDPDKEKAILEMPEPRTRSKSEFVQWDDDCQVAFERIKWCLMNPLVLVPPVPGRPLILYMTMLDESM

SEQ ID NO: 190414 - protein, 258 aa, Glycine max
  Coding DNA Sequence Number=SeqID_73636
MSSFLSDSAIGIGGSDLRGLIQQPLMDQEIISIGNSPSKDTHHGASDSESSSSERLRASRQIGGDTSCLRGRARPSAASQAREPILEKWWDVRASPRMRHSHSIGSPSSLLVVAGCEWVKLANPEDSYKVVIQACRSDDFPFLRAVAGSLAFFFMYKCLFEMKLTSKIGWVSLNNMSKKLSEFDLNVFHRFKDHFFKVLATDAAGLASGIVPPSTIPPIVEEGGQPAGEVGPVTGEAEVAPSAPSSILAKRKQDDNSG

SEQ ID NO: 190415 - protein, 66 aa, Glycine max
  Coding DNA Sequence Number=SeqID_73637
MTNSELTTRRGCNIAKVRLWPRRQRSCSAAEERGLNQMGVIVGAREGMNNMHFNCAYFSGVRLDST

SEQ ID NO: 190416 - protein, 47 aa, Glycine max
  Coding DNA Sequence Number=SeqID_73638
RNSLASSNDIGIGANSGAFFAGRFLPMLEPMSGLALPARRGWAGADV

SEQ ID NO: 190417 - protein, 172 aa, Glycine max
  Coding DNA Sequence Number=SeqID_73639
MDSGTKRLCIRCRPKLAIATIAFTEAVRSDHQLSSKVGNVLAKLLCTRLEGDELSTQCKGLQEEKKDLDSKVEDIMAERDELAKLESKLEESELRVAKEKEADKEIEEELTMYKKEAMKQHENDFSKAVDLGLFEPFKDVKDNVLLDEEDIAIKDEVGEKQGAEEQDNDATV

SEQ ID NO: 190418 - protein, 119 aa, Glycine max
  Coding DNA Sequence Number=SeqID_73640
MELFPLMVIRSVFDLPMVTGLVNQSGDGSSWPMEPEPWTLVVIVAVSERTKGIQGTNRLKILCLNTLEGTSFVVQVEGYIHLVVQREQGMVHPLWIFACKGFYKVIENLKNRWLLGDWM

SEQ ID NO: 190419 - protein, 68 aa, Glycine max
  Coding DNA Sequence Number=SeqID_73641
MASDLSFLFVGIRFDRKKFNADIASDTDSAMILSTAKDEGEKTIEPLEEEKVVAINDEEEEAQGNLFR

SEQ ID NO: 190420 - protein, 135 aa, Glycine max
  Coding DNA Sequence Number=SeqID_73642
MRSKSSTGDLVPLDLEIEATCRRNNAKRKRKILQDRTTPPILEEPQSSESSSIFPQKRESTTGAPEANIMAEDQPRRVTLEDYSSSAVPQFFTIKLAGVLEDALRMSLFSFSLSGEAKRWLHSFKGNTLRLGMKW

SEQ ID NO: 190421 - protein, 526 aa, Glycine max
  Coding DNA Sequence Number=SeqID_73643
  Homolog annotation: Hit_ID=Q00M66; Match level="QueryCoverage=99%, HitCoverage=100%, E-value=0.0, Identity=95%"; Hit description=Remorin
  Pfam annotation: Domain name=Remorin_C; Domain location=408-519; Score=78.3; E_value=2.3e-20; Accession=PF03763.4; Description =Remorin, C-terminal region
MAEVGFQERSSWRVGLRARYSSPDSVVFTLESNLSLFSYASASVDRCSFSSDSHDHDSFVSEISLDMRWWWHNNNNNGKDYKHATRAFNFGKIDADIQEPVELDSARNSFSLALKEAASLDLNNASGSGSLPRLQTLKKTSISSRRSGTATFPSPGTLNYRVAMHKGWSSERVPLHAGATRKHVLPFNNGKTLPSKWEDAERWILSPVSADGTGRASLNAPQRRPKSKSGPLGPPGVAYHSMYSPAAPVFEVGNGGSFMEGSPFTGDGLIICTGGHGGALSVRTEPCMARSASVHGCSKIQSQSSSMPLQEDKFGGFKDVGTNVSRATSRRDMATQMSPQGSSRSSPNLRPSFSASTPSTLPVTELRTVGSSKVDIRDVQVDEHVTVTRWSKKHRALFTGRGSEKVESWKKELSTQSSTWDVSETSKPASKTRSEEAKISAWENLQKAKAEAAIRKLEMKLEKRRASSMDKIMNKLRLAQKKAQEMRSSVPHNQTDRVVRTSHKASSFLRTSQMRSLSGCFTCHVF

SEQ ID NO: 190422 - protein, 258 aa, Glycine max
  Coding DNA Sequence Number=SeqID_73644
  Gene Ontology: Mol. function=transcription regulator activity; Cellular component=nucleus; Biological process=regulation of transcription
  Homolog annotation: Hit_ID=Q00M67; Match level="QueryCoverage=93%, HitCoverage=94%, E-value=1e-129, Identity=93%"; Hit description =Bhelix-loop-helix transcription factor
  Pfam annotation: Domain name=HLH; Domain location=156-203; Score =27.8; E_value=3.7e-05; Accession=PF00010.16; Description=Helix-loop -helix DNA-binding domain
MEQQHMDMMTMMMLQHLPEFSEPYTHTMEGFHPPSEEFCGNNNNNIRNTMQLADLIDNNNPLSPIPWSSSYSFTHLPASTTEISFSNNSHPTTPIMLQEHEQQYEGANANPYGGEKRNSMAAMREMIFRMAAMQPIHIDPESVKAPKRRNVKISKDPQSVAARHRRERISERIRILQRLVPGGTKMDTASMLDEAIHYVKFLKTQVQSLERASSANNNIRPLNAAGQIGFPVASTPYFPLPSKPYQAPNMDNMHDTYH

SEQ ID NO: 190423 - protein, 43 aa, Glycine max
  Coding DNA Sequence Number=SeqID_73645
MHLARSGRKKLVPKYLPEKAPSTDKTKRCNPTVGAWLTGTVLV

SEQ ID NO: 190424 - protein, 149 aa, Glycine max
  Coding DNA Sequence Number=SeqID_73646
  Homolog annotation: Hit_ID=Q9LTY1; Match level="QueryCoverage=85%, HitCoverage=17%, E-value=2e-47, Identity=75%"; Hit description =Mitotic checkpoint protein-like
MPEGQNSGHRNMALQPMALSREAGKLVDSYISDKMLQLKEQIATLEKREERYKTVFADRISVFRRACCELFGYKIVMDEHQRSNGIPVTRFTLQSIYAQSDDEKLEFEYESGNTNILANHYTSQPEVSRQDLILYFFDHDHQYDCEGFV

SEQ ID NO: 190425 - protein, 539 aa, Glycine max
  Coding DNA Sequence Number=SeqID_73647
  Gene Ontology: Mol. function=transporter activity; Cellular component= membrane; Biological process=oligopeptide transport
  Homolog annotation: Hit_ID=Q1S4B7; Match level="QueryCoverage=93%, HitCoverage=91%, E-value=0.0, Identity=69%"; Hit description=TGF -beta receptor, type I/II extracellular region; ABC transporter related
  Pfam annotation: Domain name=MFS_1; Domain location=29-459; Score =11.5; E_value=9.4e-05; Accession=PF07690.6; Description=Major Facilitator Superfamily
  Pfam annotation: Domain name=PTR2; Domain location=91-443; Score =235.9; E_value=8.8e-68; Accession=PF00854.12; Description=POT family
  Pfam module annotation: Pfam domain module=MFS_1::PTR2; Domain location=29-459::91-443
MEASPSTLDWRGRPSNPAKHGGMIPAAFVLGLQAFEIMAIAAVGNNLITYVANDMHFPLSKAANLVTNFVGTIFLLSLLGGYLSDSYLGSFWTMLLFGFVELSGFILLSVQAHVPQLKPPPCNVNDGEQCVEAKGMKAMIFFVALYLVALGSGCVKPNMLAYGGDQFEQNDPKQLKKLSTYFNAAYFAFSVGQLVSLTILVWVQTHSGMDVGFGVSAAVMAMGLISLICGTLYYRNKPPQGSILTPVAQVLVAAFSKRNLPSSPSSMIRVEQVEQVKILLSVIPIFSCTIVFNTILAQLQTFSVQQGRAMDTHLTKSFNIPPASLQSIPYILLIFLVPLYDTFFVPFARKFTGHESGISPLRRIGFGLFLATFSMVAAALLEKKRRDAAVNHHKVLSIFWITPQYLIFGLSEMFTAIGLLEFFYKQSLKGMQAFFTAITYCSYSFGFYLSTLLVSLVNKITSTSSSSAAGWLHNNDLNQDRLDLFYWLLAVLSFLNFLNYLFWSRRYSHAPSALPQPNNAKEINPYSQLHDHHHNNIIP

SEQ ID NO: 190426 - protein, 669 aa, Glycine max
  Coding DNA Sequence Number=SeqID_73648
  Gene Ontology: Mol. function=RNA-directed DNA polymerase activity; Cellular component=exocyst; Biological process=exocytosis
  Homolog annotation: Hit_ID=Q5Z4V4; Match level="QueryCoverage=95%, HitCoverage=94%, E-value=0.0, Identity=55%"; Hit description =Putative Exo70 exocyst complex subunit
  Pfam annotation: Domain name=Exo70; Domain location=46-636; Score =611.2; E_value=9.5e-181; Accession=PF03081.6; Description=Exo70 exocyst complex subunit
MEASRIENLIRAKKSLKISLEKSKSVGLALEKAGPRLDEIGVRLPSLGSAVRPIRAEKDALAAVGGHINRAVGPAAAVLKVFDAVHGLEKSLLSDPRTDLAGYLSVLKRLQEALRFLGDNCGLAIQWLEDIIEYLEDNSVADKVYLANLKKELKNLRESQHGELDGGLLDAALSKLEDEFRLLLGENSVPLPMASASGDQACIAPSPLPVSVVHKLQAILGRLIANDRLDRCVGIYVEVRSSNVRASLQALNLDYLEISVAEFNDVQSIEGYIAQWGKHLEFAVKHLFEAEYKLCNDVFERIGLDVWMGCFSKIAAQAGILAFLQFGKTVTESKKDPIKLLKLLDIFASLNKLRLDFNRLFGGAPCVEIQNLTRDLIKSVIDGAAEIFWELLVQVELQRPNPPPMDGNVPRLVSFITDYCNKLLGDDYKPILTQVLIIHRSWKRQSFQEKLLVNEILNIVKAVEQNVETWIKAYDDPILSNFFAMNNHWHLCKHLKGTKLGELLGDSWLREHEEYKDYYSSFFLRDSWGKLPGHLSREGLILFSGGRATARDLVKKRLKKFNEVFEEMYAKQTSWIMLERDLREKTCQLIVQAVVPVYRSYMQNYGPLVEQDAAVSTKYAKYTVQKLEEMLLCLYRPRPVRHGSLRSPTFSAKYGNGVPDLRRTASAVV

SEQ ID NO: 190427 - protein, 228 aa, Glycine max
  Coding DNA Sequence Number=SeqID_73649
MGGLKLYVNIPKFERGRGRVQPQSTGGREHTRLVEQGRRETYQAQKHTATPGLVRGSFADVVARREPRIQQRRTSAVQNAKTNTSRSEVHLDRPMTAPKWLQDAWVGRLKNLALLDRVEENMLWDWGLDVVPKYIGDDMVLLPGLTEDKAKQMMEEGNAGREVMFYSVERWNKKMRAGSRLTWVQCWGVPLVAWDPTHLREIVTAIGEVVEVDEEMEDLRKMDRARLL

SEQ ID NO: 190428 - protein, 183 aa, Glycine max
  Coding DNA Sequence Number=SeqID_73650
  Homolog annotation: Hit_ID=Q00M77; Match level="QueryCoverage=60%, HitCoverage=56%, E-value=7e-12, Identity=43%"; Hit description =Defective chloroplast and leaves protein
  Subcellular localization annotation: CTP_CleavageSite=65; ConfidenceScore=5.43e-01
MALLSLLPKTAPHALSLTNPSSSTPLILPFSFQCLPHPLPSPLSSLKATFSDGGDNLRGKPLVPQAFEEEDDDDDNKWVDWEDLILEDTVPLVGFVRMILHSGQYRLTEYLSKSGVSCSIRVFNLILKLNSLSPNMGVQCCHFYAEFLGSTIMTLSAIAAAMGVVVAASILRPLIIFGKSPAN

SEQ ID NO: 190429 - protein, 81 aa, Glycine max
  Coding DNA Sequence Number=SeqID_73651
  Gene Ontology: Cellular component=chloroplast
  Homolog annotation: Hit_ID=Q00M77; Match level="QueryCoverage=70%, HitCoverage=28%, E-value=3e-28, Identity=98%"; Hit description =Defective chloroplast and leaves protein
MAFGLGVTIMCNKVIPALATVKDIGYHPDFERSRCLFIVRQDGELVDFSYWKCIKGLIRKNYPLYADSFILRHFRKKSRNL

SEQ ID NO: 190430 - protein, 417 aa, Glycine max
  Coding DNA Sequence Number=SeqID_73652
  Gene Ontology: Mol. function=DNA binding; Cellular component=nucleus; Biological process=regulation of transcription
  Homolog annotation: Hit_ID=Q8H131; Match level="QueryCoverage=55%, HitCoverage=60%, E-value=9e-85, Identity=67%"; Hit description =Putative NAM (No apical meristem) protein
  Pfam annotation: Domain name=NAM; Domain location=46-173; Score =293.2; E_value=5.1e-85; Accession=PF02365.6; Description=No apical meristem (NAM) protein
MAIAAANSSPTMSLSHSQSQEDATTASTTNKPVDVDDNDDHEHDMVMPGFRFHPTEEELVEFYLRRKVEGKRFNVELITFLDLYRYDPWELPALAAIGEKEWYFYVPRDRKYRNGDRPNRVTTSGYWKATGADRMIRTENFRSIGLKKTLVFYSGKAPKGIRTSWIMNEYRLPQHETERYQKPLIKSQDTLDQDGEAEISLCRVYKRAGVEDHPSLPRCLPTRPSSSRASHDNNKKHNEMVQHNINMGFVGQLKPPTTEHIVDKINETEASSDVNTALGLSKYNAAYRAAMGALSTTMALPVVPMDHEEGLMMMQQQSKQAAAHVPTIFSAGPSSSNNSGVVNMDDLNRLMSYQQQYYNVQSQSHPNQFSTLLMQPSAVVSLSSLPNPLPPTFSDRLWDWNPIPEPPNQEYSNMSFK

SEQ ID NO: 190431 - protein, 212 aa, Glycine max
  Coding DNA Sequence Number=SeqID_73653
  Gene Ontology: Mol. function=protein disulfide oxidoreductase activity; Biological process=cell redox homeostasis
  Homolog annotation: Hit_ID=Q6YTI3; Match level="QueryCoverage=60%, HitCoverage=59%, E-value=2e-51, Identity=72%"; Hit description =Thioredoxin-like protein
  Pfam annotation: Domain name=AhpC-TSA; Domain location=86-199; Score=- 23.6; E_value=0.08; Accession=PF00578.11; Description=AhpCTSA family
  Pfam annotation: Domain name=Thioredoxin; Domain location=90-202; Score=42.3; E_value=1.7e-09; Accession=PF00085.10; Description =Thioredoxin
  Pfam module annotation: Pfam domain module=AhpC-TSA::Thioredoxin; Domain location=86-199::90-202
  Subcellular localization annotation: CTP_CleavageSite=68; ConfidenceScore=5.31e-01
MPQVVISGQNSKSFVNVRLDTQKKVKSRISHVVFSLVPRHSHGNLCFGGTKVEPLVKIRHTFFPSRIRVAEEYQEGLSDEDDDLCPVECVREFTTDEEFSKILDKAKETGSLVVVDFFRTSCGSCKYIEQGFAKLCKKSGDHEAPVIFLKHNVMDEYDEQSEVADRLRIRAVPLFHFYKDGVLLEAFPTRDKDRIVAAILKYSSLEREDILG

SEQ ID NO: 190432 - protein, 205 aa, Glycine max
  Coding DNA Sequence Number=SeqID_73654
  Gene Ontology: Cellular component=mitochondrion
  Homolog annotation: Hit_ID=Q00M76; Match level="QueryCoverage=83%, HitCoverage=66%, E-value=1e-74, Identity=84%"; Hit description =Aromatic-rich family protein
  Subcellular localization annotation: CTP_CleavageSite=26; ConfidenceScore=5.25e-01
MPPFLSTSKALCSLASRKSGGSQLIRSSKSSGKHDGCRCITTAITGGHHNHPSVSRIGFSSLIGGSCNSNNHYYNYNVVQSRRFLGCGDGEEGILSRTYEERRVLGYSTEQLFEVVSAVDFYHGFVPWCQRSDILRHYPDGSFDAELEIGFKFLVESYVSHVELDKPKRIKVFNLLWYMFGLNCTYGWSDSGIKKTLHSAPSSSI

SEQ ID NO: 190433 - protein, 95 aa, Glycine max
  Coding DNA Sequence Number=SeqID_73655
  Gene Ontology: Mol. function=calcium ion binding
  Homolog annotation: Hit_ID=Q94LH2; Match level="QueryCoverage=82%, HitCoverage=50%, E-value=2e-12, Identity=48%"; Hit description =Putative calmodulin-like protein
  Pfam annotation: Domain name=efhand; Domain location=21-49; Score =24.4; E_value=0.00042; Accession=PF00036.22; Description=EF hand
  Pfam annotation: Domain name=efhand; Domain location=57-85; Score =17.7; E_value=0.043; Accession=PF00036.22; Description=EF hand
  Pfam module annotation: Pfam domain module=efhand::efhand; Domain location=21-49::57-85
MAFIERNVSSDGKRVMTVEQFRRWLMTAFDANGDGRISKSELRRAVRLTGGLFASWNSGLAFRSADANQDGFIDENEFRNLAQFADKHFNVKITR

SEQ ID NO: 190434 - protein, 892 aa, Glycine max
  Coding DNA Sequence Number=SeqID_73656
  Homolog annotation: Hit_ID=O04394; Match level="QueryCoverage=67%, HitCoverage=91%, E-value=0.0, Identity=67%"; Hit description=Dem protein
  Pfam annotation: Domain name=Chloroa_b-bind; Domain location=703-861; Score=161.0; E_value=3e-45; Accession=PF00504.12; Description =Chlorophyll A-B binding protein
  Pfam annotation: Domain name=VID27; Domain location=1-617; Score= -396.5; E_value=1.1e-09; Accession=PF08553.1; Description=VID27 cytoplasmic protein
  Pfam module annotation: Pfam domain module=Chloroa_b-bind::VID27; Domain location=703-861::1-617
MGANHSREDLLESSDSEQEEYETFEDATEGSAERKPSTPSSLDDVEAKLKALKLKYSSSSSAPAVNNAVKLYVHIGGNTPKAKWVTSDKLTSYSFVKTHSDADTDEEIDNNDDSDNDNDNDDYDESNEKPFWVLKVGSKIRSKVGPEMGLKSFPEQRRVDFVVRGVWAMKFFSDQDQIDFIDSFQKCLFENTHGVEATEANKLKIYGKDFAAWAKPETADDSMWEDAEEAFTKSPTLVRSNQDLKEEFEEASNGGIQSLALGALDNSFLVSDNGIQVVKNFAHGIHGKGAFVNFSDGYQKGGGGSSYCTPKKTLLMRAETNMLLMSPMGGGKLHSTGLHQLDIETGKVVSEWMFGKDGTEITMRDITNDSKGAQLDPSGSTFLGLDDNRLCRWDMRDRNGMVQNLDDSNAPVLNWAQGHQFSRGTNFQCFATTGDGSIVVGSLDGKIRLYSVNTMRQAKTAFPGLGSPVTHVDVTFDGKWIVGTTDSYLILICTLFTDKNGTTKTGFSGRMGNRIAAPRLLKLNPLDSHLAGANNKFRNAQFSWVTENGKQERHIVATVGKFSVIWNFQQVKDGSHECYRNQQGLKSCFCYKIVLRDDSIVESRFMHDKFAVTDSPEAPLVIATPMKANLSTGIGADNQKTMAVAIGRSFSIQPGSLFNNKSLDRGSPAGRLSWLGDGAAATPRYRQTCVGAQQRPTWLPGLDPPPHLDGTLAGDFGFDPLGLAEDPASLRCPCLNFLVKSMQLLRVTGISKIPVWFEAGAVKYDFANTKTLFLVQLVLMGFVETKRYMDFVSPGSQAKEGSFFGLEASLKGLEPGYPGGPLLNPLGLAKDINNAHDWKLKEIKNGRLAMVAMLGIFVQASVTHVGPIDNLVEHLSNPWHKTIIQTLANSSS

SEQ ID NO: 190435 - protein, 52 aa, Glycine max
  Coding DNA Sequence Number=SeqID_73657
MHKSETTVRGYGECVSSSHSKFSVQRYGKTALFDFDDSSVSVSTTPVKLELE

SEQ ID NO: 190436 - protein, 953 aa, Glycine max
  Coding DNA Sequence Number=SeqID_73658
  Gene Ontology: Mol. function=actin binding
  Homolog annotation: Hit_ID=Q1RYE3; Match level="QueryCoverage=97%, HitCoverage=100%, E-value=0.0, Identity=47%"; Hit description=IMP dehydrogenase/GMP reductase
  Pfam annotation: Domain name=DUF827; Domain location=307-834; Score =791.3; E_value=5.5e-235; Accession=PF05701.2; Description=Plant protein of unknown function (DUF827)
  Pfam annotation: Domain name=Prefoldin_2; Domain location=441-542; Score=-4.8; E_value=0.04; Accession=PF01920.10; Description =Prefoldin subunit
  Pfam module annotation: Pfam domain module=DUF827::Prefoldin_2; Domain location=307-834::441-542
MEDVEDKIPPVSSSKIAEETPLVEHVGDKLPSESSPKIAEETPLAEHVGDKLPSEASPKIAEETPLAEHVGDKLPSEFSSEIVEETLLAEHVGDNQPSASSLKIDEETPLAEHVIDNSESSSKTAEELPLVEHVIDKLPSESTTKIAGDMPLADPPEENTEVINPHGDQSSTEAPTIPLSNGKMEPGTHLPVDEFSELAVLPNASVDQTLIQDAAVDVTEKSQQVTSAEDSEPGAIENVSDMHESQDDVSNITADSDVDNEIRLSASSSETKDLQSDHNELTMAMGTVGSLPRAKLFDAKRGHIDTTAPFESVKEAVSKFGGIVDWKAHRIHTVERRTLVEQELEKAQEDIPEYKKQAEAAEQEKGQVLKELDSTKRLIEELKLNLERAQTEERQARQDSELAKLRVEEMEQGIADESSVAAKAQLEVAKARYTAAVSDLIAVKEELAALHKEYASLVTDRDVAIKKAEEAVAASKEVEKSVEDLTVELIAAKESLETTHAAHLEAEEQRIGTVMARDQDSLNWEKELKQAEEELQRLNQQISSAKELKSKLETASALLIDLKAELTAYMESKLKQEGGPEESEKKTHTDIQEAVASARKELEEVNLNIEKATAEVTILKVAATSLKSELEQEKSTLASIRQREGMASIAVASLEAELEKTRSEIALVQMKEKEAKEKMTELPKKLQLTAEETNEANLLAQAAREELQKVKAEAEQAKAGVSTFQSRLLAAQKEIEAAKASENLAIAAIKALQESESTRSKNQVDPSNGVTLSLEEYYELSKRAHEAEERANMRVAAANSEIDKAKESELKAFEKLDEVNREIAARRESLKLAMEKAEKAKEGKLGVEQELRNWRAESEQRRKASESGQGVVNQGKSPRGSFEGNQGVNNFDRTSDAGNPAHFMTSPKANVQADNDEGGSSPESKHGKKKKKSIFPRVLMFFARRKTHSTKSG

SEQ ID NO: 190437 - protein, 107 aa, Glycine max
  Coding DNA Sequence Number=SeqID_73659
MMLSCQYNSFHETSQIHSLSYLKCGTSTHLPLHTLRCGQRTGATAPAHGGDFVPARERVTNDVLSPKFPSHYLKRTWSTRGMAVASSVSRRTSKRLSSASSSTHRRS

SEQ ID NO: 190438 - protein, 711 aa, Glycine max
  Coding DNA Sequence Number=SeqID_73660
  Gene Ontology: Mol. function=binding; Cellular component=nucleus; Biological process=metabolic process
  Homolog annotation: Hit_ID=Q00M75; Match level="QueryCoverage=88%, HitCoverage=97%, E-value=0.0, Identity=55%"; Hit description=PPR -repeat containing protein
  Pfam annotation: Domain name=PPR; Domain location=107-141; Score =41.3; E_value=3.4e-09; Accession=PF01535.11; Description=PPR repeat
  Pfam annotation: Domain name=PPR; Domain location=208-242; Score =43.0; E_value=1.1e-09; Accession=PF01535.11; Description=PPR repeat
  Pfam annotation: Domain name=PPR; Domain location=303-337; Score =21.6; E_value=0.0028; Accession=PF01535.11; Description=PPR repeat
  Pfam annotation: Domain name=PPR; Domain location=404-438; Score =47.7; E_value=4e-11; Accession=PF01535.11; Description=PPR repeat
  Pfam annotation: Domain name=PPR; Domain location=439-473; Score=8.9; E_value=0.66; Accession=PF01535.11; Description=PPR repeat
  Pfam annotation: Domain name=PPR; Domain location=505-539; Score =37.0; E_value=6.6e-08; Accession=PF01535.11; Description=PPR repeat
  Pfam annotation: Domain name=PPR; Domain location=540-574; Score=4.9; E_value=2; Accession=PF01535.11; Description=PPR repeat
  Pfam annotation: Domain name=PPR; Domain location=576-610; Score=2.3; E_value=4; Accession=PF01535.11; Description=PPR repeat
  Pfam annotation: Domain name=PPR; Domain location=642-676; Score=3.7; E_value=2.7; Accession=PF01535.11; Description=PPR repeat
  Pfam module annotation: Pfam domain module=PPR::PPR::PPR::PPR::PPR::PP R::PPR::PPR::PPR; Domain location=107-141::208-242::303-337::404 -438::439-473::505-539::540-574::576-610::642-676
  Subcellular localization annotation: CTP_CleavageSite=41; ConfidenceScore=5.50e-01
MVKTKVGECSMYASMGKTYLKTNVSSANPNHLTFSLLIKACLSSSSSFSRGSPTAWLQVNQIQTQLLKRGIDQFLYVNTALIDFYMKLGFTTHARQLFEDLPSADVVSWNVLICGYSQHGHPHDALQLFVHMLRESFRPNQTTIASLLPSCGRRELFLQGRSVHAFGIKAGLGLDPQLSNALTSMYAKCDDLEASQLLFQEMGEKNVISWNTMIGAYGQNGFEDKAVLCFKEMLKEGWQPSPVTMMNLMSANAVPETVHCYIIKCGFTGDASVVTSLVCLYAKQGFTDMAKLLYECYPTKDLISLTGIISSYSEKGEVESAVECFIQTLKLDIKPDAVALISVLHGISDPSHFAIGCAFHGYGLKNGLTNDCLVANGLISFYSRFDEILAALSLFFDRSEKPLITWNSMISGCVQAGKSSDAMELFCQMNMCGQKPDAITIASLLSGCCQLGYLRIGETLHGYILRNNVKVEDFTGTALIDMYTKCGRLDYAEKIFYSINDPCLVTWNSIISGYSLYGLEHKAFGCFSKLQEQGLEPDKITFLGVLAACTHGGLVYAGMEYFRIMRKEYGLMPTLQHYACIVGLLGRAGLFKEAIEIINNMEIRPDSAVWGALLSACWIQQEVKLGECLAKNLFLLNYKNGGFYVSLSNLYAIVGRWDDVARVRDMMRDSGGDGSSGVSVIEVTPLRDINNNLCPSEVYLNTSTWQHLCLC

SEQ ID NO: 190439 - protein, 95 aa, Glycine max
  Coding DNA Sequence Number=SeqID_73661
  Gene Ontology: Mol. function=calcium ion binding
  Homolog annotation: Hit_ID=Q94LH2; Match level="QueryCoverage=81%, HitCoverage=50%, E-value=1e-11, Identity=49%"; Hit description =Putative calmodulin-like protein
  Pfam annotation: Domain name=efhand; Domain location=21-49; Score =24.2; E_value=0.00046; Accession=PF00036.22; Description=EF hand
  Pfam annotation: Domain name=efhand; Domain location=57-85; Score =18.0; E_value=0.034; Accession=PF00036.22; Description=EF hand
  Pfam module annotation: Pfam domain module=efhand::efhand; Domain location=21-49::57-85
MAFMERNVWSDGKRVMTVEQFKRWLMTAFDTNGDGRISKAELRRAVRLTGGFLASCSSGRAFKSADANRDGFIDDNEFRNLAHFADKYFNVRIAR

SEQ ID NO: 190440 - protein, 357 aa, Glycine max
  Coding DNA Sequence Number=SeqID_73662
  Gene Ontology: Mol. function=metal ion binding; Cellular component =integral to membrane; Biological process=ubiquitin cycle
  Homolog annotation: Hit_ID=Q8GW38; Match level="QueryCoverage=84%, HitCoverage=75%, E-value=1e-77, Identity=54%"; Hit description=RING -H2 finger protein ATL1D
  Pfam annotation: Domain name=PHD; Domain location=152-194; Score= -0.5; E_value=0.064; Accession=PF00628.19; Description=PHD-finger
  Pfam annotation: Domain name=zf-C3HC4; Domain location=150-191; Score= 36.6; E_value=8.4e-08; Accession=PF00097.15; Description=Zinc finger, C3HC4 type (RING finger)
  Pfam module annotation: Pfam domain module=PHD::zf-C3HC4; Domain location=152-194::150-191
  Subcellular localization annotation: CTP_CleavageSite=46; ConfidenceScore=5.63e-01
MNWVHSQICHSTDAINNPSSICSSSSSASLPYSSGYKKQLASPPPLASSSGTRISPALVFIFVILAIVFFISGLLHFLVRFLIRHRSSSSSSISQSNRYPDDMSESDDPYQRQLQQLFHLHDSGLDQALIDALPVFLYKDIIGLKEPFDCAVCLCQFSEQDMLRLLPLCNHAFHIDCIDTWLLSNSTCPLCRGSLYDPGFAFENPVYDLEGVREEDGVSGSVPGEGVCDNKHAENHTISGKRVFSVRLGKFRSSNIVEGVETGGGGESSTSNLDVRRCYSMGSFQYVVADSDLQVALCPNRGDGGGVSDSSMRQLKGRLTNYGNSSTDDVEGKKINITRKGESFSVSKIWQWSKKDK

SEQ ID NO: 190441 - protein, 252 aa, Glycine max
  Coding DNA Sequence Number=SeqID_73663
  Gene Ontology: Mol. function=GTP binding; Cellular component =intracellular
  Homolog annotation: Hit_ID=Q9FLE0; Match level="QueryCoverage=74%, HitCoverage=43%, E-value=6e-46, Identity=47%"; Hit description=GTP -binding protein-like
MKVLACIATTRSRTAVTLTLTKVLNRHADYTFASRVDTAGWLQMQSTPGIMQSRKSLLQAHIIALVLDAEEACQALPNGLATHGHHSIGKIINARRSMKHAEVIIARWAVEEGRGLVVIVNKMNLPRGKHQSSSYEKVMEIVPQEIQTIIPQVKGIPVVFISALEGRGRTTVLNQVMSRHSWKGQAAQPKVKYFTQSLKENFDLGGIPIRLMQRFVTKKDASGSETRTSKNSHSVGRVIERTVSDKRSVLVE

SEQ ID NO: 190442 - protein, 261 aa, Glycine max
  Coding DNA Sequence Number=SeqID_73664
  Gene Ontology: Mol. function=DNA-directed DNA polymerase activity; Cellular component=DNA polymerase III complex; Biological process =DNA replication
  Homolog annotation: Hit_ID=Q0WNH1; Match level="QueryCoverage=99%, HitCoverage=41%, E-value=2e-91, Identity=66%"; Hit description =STICHEL
YGHRYPSTLGSWDGTTTSVNDGDGDDEIDDHLDLPGRQGCGIPCYWSKRTPKHRRMCGSCYSPSLSDTLRRKGSSMLCGSQSIYPTHRRSASASHKRRLSLRSARGVIPLLTNSGDVREGSSVGTGWSDDELSTNFGELDLEGLSRLDGRRWSSSCRSQEGLEIVALNGEGEYESTPENNRSFSQKYRPMFFGELFGQNIVVQSLINAVSRGRIAPVYLFQGPRGTGKTSTARIFAAALNCASPDESKPCGYCRECVDFIS

SEQ ID NO: 190443 - protein, 495 aa, Glycine max
  Coding DNA Sequence Number=SeqID_73665
  Gene Ontology: Mol. function=DNA-directed DNA polymerase activity; Cellular component=DNA polymerase III complex; Biological process =DNA replication
  Homolog annotation: Hit_ID=Q2QW40; Match level="QueryCoverage=82%, HitCoverage=35%, E-value=6e-54, Identity=36%"; Hit description =ATPase, AAA family protein, expressed
MVNESELERLKNALKLLSEAEKQLRTSSERSTWFTATLLQLGSTPSPDLTQSSSSRRQSCKTTEDDPSSVSRDVTSCTHKSDPQYVPQKSAYTASQQKAVNDNSHHQKDISSKIEGFSLKSKPSSSPVIDDGSTVVSSDDLMVGNTMFRCIDSGKLCYIWVHCIERCHSKTLRQLLHNHGKLVSVCEVEGVLVAYVAFEDADIKVRVERFLRSITNSMEMVLRRNVEVRIIHLPNGEGENQVNLPGLKQAESTVAGEKEQRKSHMNGTESYSSFPPLLDGNLQSTAASSDILAEGNGVRERRQDNPMQRIESIIREQRLETAWLQAVEKGSPGSLSRLRPEKNQVLPQNGVDPIESMDSTRFPSHQHWEDDPNDEVKVLSLKNGRIPQKDQIGRKTDRFPMSPSLLHDNSLATISGKDNLGYESGSGAGGCGFLCWNKSKPRRVIKLLHENLNKHNMSRCVVSRSKVAPRFERVERQLLHCLVTAVGANKRGRGR

SEQ ID NO: 190444 - protein, 136 aa, Glycine max
  Coding DNA Sequence Number=SeqID_73666
  Gene Ontology: Mol. function=nucleotide binding; Cellular component =membrane; Biological process=DNA replication
  Homolog annotation: Hit_ID=Q2QW40; Match level="QueryCoverage=76%, HitCoverage=8%, E-value=1e-38, Identity=77%"; Hit description=ATPase, AAA family protein, expressed
MNADGSLRDAETMLEQLSLLGKRITTSLVNELVGVVSDEKLLELLELAMSSDTVETVKRARELMDSGVDPMVLMSQLAGLIMDIIAGSYAVIDTKPDDSFFGGRSFVCYDGGILDFVPKPDHWAEQDKDQLLDPLP

SEQ ID NO: 190445 - protein, 174 aa, Glycine max
  Coding DNA Sequence Number=SeqID_73667
MASLWQIILGWIPSMLDGCQVNRIVFAWIYIEFVIQACLVDIQGLDWRPLVHAHDLSTFGHCGVMLALSCLLLVRLDSHNLSRQGRELHLQLQDEDDGSELVECSVANQRKVREQALTEGSHKVDIACSLYLFPYETKEWISVKLDGAPNKGGLPSHSHERLYTSGANVDGRKG

SEQ ID NO: 190446 - protein, 276 aa, Glycine max
  Coding DNA Sequence Number=SeqID_73668
  Gene Ontology: Mol. function=polygalacturonase activity; Biological process=carbohydrate metabolic process
  Homolog annotation: Hit_ID=Q1SGW6; Match level="QueryCoverage=88%, HitCoverage=47%, E-value=1e-115, Identity=79%"; Hit description =Glycoside hydrolase, family 28
  Subcellular localization annotation: CTP_CleavageSite=88; ConfidenceScore=5.39e-01
MVENTGQGGGIWFQLFHPKTAPFASHKTLFVFLWVATLASVLVWQRTTISGFLVLGGVPVRTPPKLRPVVFCLTEFGGVGDGVTLNTEAFERGVGAISKLGDKGGGQLNVPPGRWLTAPFNLTSHMTLFLARDAVILAVQDEKYWPLMPALPSYGYGREHPGPRYSSLIHGQNLVDVVITGHNGTINGQGQTWWTKYRQKLLNHTRGPLVQILWSSNIVISNITLRDSPFWTLHPYDCKNVTVKKVTILAPVSHAPNTDGIDPGKYLLQNAIFFIS

SEQ ID NO: 190447 - protein, 114 aa, Glycine max
  Coding DNA Sequence Number=SeqID_73669
  Subcellular localization annotation: CTP_CleavageSite=56; ConfidenceScore=5.67e-01
MTKEVIHGHNFAMPQLHFSSSPSSYAFFSLRNPLSVGKLAQASCLLRAKGINSPRRASWNSPRRVACLGLKFSLSPGKLDASLGVFRVRNLHEKIILPFLLALFLDLTNNHQNL

SEQ ID NO: 190448 - protein, 303 aa, Glycine max
  Coding DNA Sequence Number=SeqID_73670
MKLAIMMETTMGSSLLMGLIPLKSLSVKVIEGKLRCDGVIAHICAAGISDYLDLLLYLFFYPHHDSYVTSLGVLQGQTIFCVMTNTAMVSEMCNARTWALLGEDGTCPAYASCLTCVSRSWCFILACRIVRKLVRPYNEEHEVLASVANVMRCDWLVAYYTLKRSTKVSKLSMDHGGSPSFRKAYRCSSGSVVPSYQLRLSGFQPKGMLASMMRSTKRSQRVVYPTGRCMWERLRTSLVLTVRRGCDFPWPSAFSAPSYGVLHVRNAILELLESIGIYHGCWWRVGAFERGLMSKARLSANHG

SEQ ID NO: 190449 - protein, 103 aa, Glycine max
  Coding DNA Sequence Number=SeqID_73671
MRFLAFLLCFAPLLCSLSLILSELMLDFSNFSLKKGFLSSKARLVPFSRLALVSEYLLSELCALSAGRDKRLAERADDALSTQTLLRFSSRFSQLAKRVKCLA

SEQ ID NO: 190450 - protein, 85 aa, Glycine max
  Coding DNA Sequence Number=SeqID_73672
MSRGRVSSGGVNHAPRPAPVQGGNCGSLFRTIDEGIAFGVGSAVAHRAVDSIFSPQSGNTCNAPTKAFQDPFRPVLMILASVMGG

SEQ ID NO: 190451 - protein, 51 aa, Glycine max
  Coding DNA Sequence Number=SeqID_73673
MDSKVAMTKSWWLDVRKRIGDDSAKWLLGFMRETRVCEESGYETTRRGSLN

SEQ ID NO: 190452 - protein, 262 aa, Glycine max
  Coding DNA Sequence Number=SeqID_73674
MKIFEWMQNRINGSNGKKKQSNSISTTHYMRHEPCKQEFSDWPQALLAIGTFGGSNLKEDSGGRSNHAAEDSSSFQDCTQEVTLEDVGNLQSEFSIFFKGQNLAAEQEEHTNDLIKENDSLCDGSNASRGNFYPSNSIIFSRGKDCSLDHSSKKGVGKKSLSFLLKKMLACKSGFQPTPLFKDPLSTESRMEKILRAILQKKIYPQGSCSTTPFVKKYLEATPISQFDDEEDDDEEEELAAAAAENGSKWVKTDSEYIVLEI

SEQ ID NO: 190453 - protein, 383 aa, Glycine max
  Coding DNA Sequence Number=SeqID_73675
  Gene Ontology: Mol. function=protein-tyrosine kinase activity; Cellular component=integral to membrane; Biological process=protein amino acid phosphorylation
  Homolog annotation: Hit_ID=Q1RTK1; Match level="QueryCoverage=89%, HitCoverage=57%, E-value=1e-147, Identity=74%"; Hit description =Sugar transporter superfamily
  Pfam annotation: Domain name=Pkinase; Domain location=72-342; Score =16.3; E_value=1.6e-09; Accession=PF00069.15; Description=Protein kinase domain
  Pfam annotation: Domain name=Pkinase_Tyr; Domain location=71-342; Score=-37.9; E_value=3.8e-10; Accession=PF07714.7; Description =Protein tyrosine kinase
  Pfam module annotation: Pfam domain module=Pkinase::Pkinase_Tyr; Domain location=72-342::71-342
MIFLFVKRSRRGDGELRVVSRSRSNSTEEVLMVQVPSMRGGVGDKKKEGNKRGDIVMVNEERGVFGLQDLMKASAEVLGNGGLGSMYKAMMGTGLCVVVKRMREMNKIGKDVFDAEMRQFGRIRHRNIITPLAYHYRREEKLFITEYMPKGSLLYVLHGDRGTSHSELTWPTRLNIVKGIARGLKFLYSEFSTYDLPHGNLKSSNVLLTDDYEPLLSDYAFQPLINPKVSVQALFAFKSPDFVQNQKVSQKTDVYCLGVIILEIITGKFPSQYHSNGKGGTDVVQWAFTAISEGTEAELIDSELPNDANSRKNMLHLLHIGACCAESNPEQRLNMKEAVRRIEELGAFLIVKKYKFNFIALAKYMQLSKENHFWTASFKFVET

SEQ ID NO: 190454 - protein, 47 aa, Glycine max
  Coding DNA Sequence Number=SeqID_73676
MARIPNKIRSSDGSKEALKLAVRITDLWFVGTPDKSEQAEMVFVDSE

SEQ ID NO: 190455 - protein, 145 aa, Glycine max
  Coding DNA Sequence Number=SeqID_73677
MGNPTMHKHNKGLSNSNTRRSSCICVLVCIIIMTFVVGHYSDHHHRRQQILDNIREHLLCDGIKKDYIMHIWHGELTDMQSGYQAEAFDVEMGNLLEDMICDLRQESFEQAHAPMYNTLQTDSKKSLFLGVQQFLDTVIIGVKFG

SEQ ID NO: 190456 - protein, 69 aa, Glycine max
  Coding DNA Sequence Number=SeqID_73678
MGATIPIDMPDHDVGDPLYMMTLTIPQLFLKSLQVMWDAIVFGAYDSNRYASGEGRCVWIPRATVHTEI

SEQ ID NO: 190457 - protein, 122 aa, Glycine max
  Coding DNA Sequence Number=SeqID_73679
MSLPSAVHVSSTFEFGGMLHDCLSVDLQVQSSILHFYRSPMNVNACCSCVLHLRVWSYASCLPKCGPSSAILYSPFFSKPHECHCLALFMCPPPSSLELCFVIALVWTLKCNPPFSTFFAAP

SEQ ID NO: 190458 - protein, 55 aa, Glycine max
  Coding DNA Sequence Number=SeqID_73680
MPPDTMELAGKCPSAVLVVLDSLVDPLQKTIHFKPKQDGVKQEVDRNEDMIRSAF

SEQ ID NO: 190459 - protein, 336 aa, Glycine max
  Coding DNA Sequence Number=SeqID_73681
MMIAETATKEPGRYYTFQSPLPADVFFELRLRTLPHNAQPILDETSGMCIGYSVAQAPGLWQIYDTQGHFLRLEEAPLEAPLIDPTDIALIAFGVFRIFRAGRVLFETSTRAAVRVKLSQATIMFLRARLKTGLSAGNLKMTETAARHMYEPGRYVPLHIQEKAIRYGRRMADPRKGEGMFRYETEMKARMFDFRNEGFVFTISPFERVVDNETDPVNHLWDWVKSYVEFSVSGVKVQFQTEFTVGELKELRATFSRYYEAVMARHEIESFSFRSQLNQLNMVLSKITGDDIVIIEYVLRPEHHADSIQIKGELAINESYFPDILRQLEEMISWPE

SEQ ID NO: 190460 - protein, 212 aa, Glycine max
  Coding DNA Sequence Number=SeqID_73682
  Gene Ontology: Mol. function=nucleoside-triphosphatase activity; Cellular component=exodeoxyribonuclease V complex; Biological process=viral genome replication
  Homolog annotation: Hit_ID=UPI00005FA09B; Match level="QueryCoverage =95%, HitCoverage=32%, E-value=3e-81, Identity=75%"; Hit description =COG0507: ATP-dependent exoDNAse (exonuclease V), alpha subunit - helicase superfamily I member
  Pfam annotation: Domain name=Viral_helicase1; Domain location=8-185; Score=-52.0; E_value=0.017; Accession=PF01443.9; Description=Viral (Superfamily 1) RNA helicase
MPVPASALLDACVAGYRDYLRLTAEGADAATVLAAFGRFQVLCALREGPFGVAGLNERIELGLQRAGLIDRKPGVLGRWYRGRPVMIGRNDSALGLFNGDIGITLPDEHGDLRVHFQLPDGSIKSVQPSRLPAHETAYAMTVHKSQGSEFDHTVLVLPNHFLPVLTRELVYTAITRARKLLSLYATEAVLLRAIRTPTQRRSGLAERLQATE

SEQ ID NO: 190461 - protein, 418 aa, Glycine max
  Coding DNA Sequence Number=SeqID_73683
  Gene Ontology: Mol. function=nucleoside-triphosphatase activity; Cellular component=exodeoxyribonuclease V complex; Biological process=viral genome replication
  Homolog annotation: Hit_ID=UPI00005F9275; Match level="QueryCoverage =43%, HitCoverage=15%, E-value=9e-77, Identity=74%"; Hit description =COG1074: ATP-dependent exoDNAse (exonuclease V) beta subunit (contains helicase ...
  Homolog annotation: Hit description=and exonuclease domains)
MQVLLNTPLDDSGVTLSALTPQHKQAELQFYLPINRLLQAKALDALVKRYDPLSARCPALDFHQVQGMLKGFIDLVFCWQGKYYLLDYKSNWLGEDSSAYTRPAMEQAMAEHRYDLQYQLYTLALHRYLRHRLPDYDYRRHFGGVIYLFLRGVDAAHPGNGIFTCLPELELAVALGVLRPLDVQFARVVASEDEPDILLAAACLSAEAGAGHVCLMLEQLQADTLFEGRQPALALAVWEAAGRPDSARWQQRLAASAAVGDGSGATPLVLRGPRLYLQRMWQNEGEVAAFIGGEGESLAVPEAELRTILDRLFGAASDEPDWQKIAAAVAATRRIAVISGGPGTGKTTTVAKLLAALVQLDESARLRIQLAAPTGKAAARLTESLGSASRQLALTPAQQALFPTEAATLHRLLGAQPS

SEQ ID NO: 190462 - protein, 88 aa, Glycine max
  Coding DNA Sequence Number=SeqID_73684
  Subcellular localization annotation: CTP_CleavageSite=22; ConfidenceScore=5.06e-01
MNPKAISLLSPVITTKKLYPLLAMNPKVVSFLDPVINQEANPLLTMNPKAVSLLSPVINQEDLLLKTVTKSQSLEKLFVRMEEERKIE

SEQ ID NO: 190463 - protein, 44 aa, Glycine max
  Coding DNA Sequence Number=SeqID_73685
MTSCILCSYCSIVTHCCSVQANISRRLATSGLYFKSKGICTQKQ

SEQ ID NO: 190464 - protein, 341 aa, Glycine max
  Coding DNA Sequence Number=SeqID_73686
  Gene Ontology: Mol. function=DNA binding; Biological process=DNA integration
MEDEELAVILLDSFPPSYENFVSRNGDEAFVFELLVTNSSKGQKKKCKDGKKIKVDPKDIINYYKEPSHWTRDCLNKGKKDSFAALVQNDSSLVSDLVLPIDEQLQQHSKQWILDSGYSYHICPHKHWYVTYEKKFGDNVLMGNDVSCKSVAIGGVMQIRWKWKSMVMQGTKQGNLNILQDFTMICSIFDVSQSGSHASNDSSDNSLWHWCLGHISEKVNTTCYLVNRSPSTAIDFKIAIKLWSNRLAKYLILKMFGCSIYYHVSKNVAFGKLSMFPFKSNEDLGKVEDVIKQGACSKVLASHLKEVSLAIRELLKEVFLKEASQGSFLKKASQGSYLVYK

SEQ ID NO: 190465 - protein, 101 aa, Glycine max
  Coding DNA Sequence Number=SeqID_73687
MCTFKDVITSATSLKVAFKDGAYFNNVLECLDVAEKSTITRFSARVTNDTLSSSSHMSSVSRGYGSRVNFDITSFASSRGIAPPGWTSRVHSAIRSNTSAT

SEQ ID NO: 190466 - protein, 194 aa, Glycine max
  Coding DNA Sequence Number=SeqID_73688
  Homolog annotation: Hit_ID=UPI00005F81F5; Match level="QueryCoverage =33%, HitCoverage=50%, E-value=7e-14, Identity=68%"; Hit description =COG3772: Phage-related lysozyme (muraminidase)
DLQPVKKAVDGLVKVQLNEYQRAALYSFTYNVGTSAFSKSTLLKRLNSGDQAGATVAIWSAHFAWRMDQMTFSLRIYLITIAVMIAIAIGYGEIRYLNGWYAHSDKVNADYALKKQKAEAKLVPTEQKAAAASADGKVIYRTITRNVVTYVQNPNRTRCDFDDDAVRLRQQAIDAANHISGFDEPAVQAKSSGK

SEQ ID NO: 190467 - protein, 241 aa, Glycine max
  Coding DNA Sequence Number=SeqID_73689
  Pfam annotation: Domain name=SWIM; Domain location=164-196; Score =26.7; E_value=8.1e-05; Accession=PF04434.8; Description=SWIM zinc finger
MVEGESITTTGCDNWARLCHDLLGVIPEGSDLKGAKVSLVACKPSTKWEPTRPNAVEIGGACLLIQVWAWERFLFVAPTIRQEPNAVIPLQHDNGIMVLKTPNFTSRRWLEWMVKKCSGSTYKIDTTKYWYGGAFNTRNLGNLNMFFGRLNLPLTHSTHGRETWSVILNKNYCECGAFQAYKYSCSHVIVVCAHVNINRYQYMDKVYKIKTTIQGSTLLLWVDHYGNWNSLGCKETIPERS

SEQ ID NO: 190468 - protein, 225 aa, Glycine max
  Coding DNA Sequence Number=SeqID_73690
  Gene Ontology: Mol. function=DNA binding; Biological process =regulation of transcription, DNA-dependent
  Homolog annotation: Hit_ID=Q69V36; Match level="QueryCoverage=95%, HitCoverage=93%, E-value=4e-44, Identity=45%"; Hit description =Transcriptional factor B3-like
  Pfam annotation: Domain name=B3; Domain location=124-218; Score=74.5; E_value=3.4e-19; Accession=PF02362.12; Description=B3 DNA binding domain
MVAAIAYEESRRKRVEENKKRMEALNLPLLSQALQKSSPSPKSSPVKHRAIQKEVVVVRRSSRVANLPSPVYKEIVIDRVTMPRRSYDKYRDYANRVYASDEAREEALEKAEKLMSGLESEYPAFIKSMLQSHVSGGFWLGLPVHFCKSNLPKKDEVVTLIDEDGTEYSTIYLAGKTGLSGGWRGFAIAHDLADGDALIFQLIKRTTFKVYIVRAICPPDDKQLE

SEQ ID NO: 190469 - protein, 345 aa, Glycine max
  Coding DNA Sequence Number=SeqID_73691
  Homolog annotation: Hit_ID=Q00V37; Match level="QueryCoverage=31%, HitCoverage=60%, E-value=4e-12, Identity=31%"; Hit description =Homology to unknown gene
MARGKWVCSYKKTTLLVCFFNIAVALYVLRSLYASLYIYSGNVSRNAALYSPDQIRKMEESIQIRWEFKPVELIKWVKALEAEFSSETEAVKLPWHLKQNIIDEILQRLRSLNSSRTDIAMEREVVESWRKEKLEEVKSALVKGTSNSTIPHEEADCVMLLDNALQTGNGCFTNLSHLVFNFLGMLVRALESDWAVLCEEIGLWIPAQKFILGLTKYTFSPEEEVLPGRPVSPECHAELHTDYDGAAVRWGLTFHKDSAADCCQACLDHAKHAKEGEKKCNIWVYCPSEFGCHSPDIYQHKHQECWLKYAEKPRLNFKDKYPESYRNSHPSAPVIVPWVSGVISS

SEQ ID NO: 190470 - protein, 466 aa, Glycine max
  Coding DNA Sequence Number=SeqID_73692
  Gene Ontology: Mol. function=protein phosphatase type 2C activity; Cellular component=protein serine/threonine phosphatase complex; Biological process=chromatin modification
  Homolog annotation: Hit_ID=Q6YTI2; Match level="QueryCoverage=88%, HitCoverage=93%, E-value=1e-160, Identity=65%"; Hit description =Putative calmodulin-binding protein phosphatase
  Pfam annotation: Domain name=PP2C; Domain location=33-288; Score =83.9; E_value=4.8e-22; Accession=PF00481.12; Description=Protein phosphatase 2C
MSARSEHQSVPLSVLLKRELANEKIEKPEVVILHGQASENKKGEDFTLLKTECQRVLGDGVSTYSVFGLFDGHNGSAAAIYAKENLLNNVLSAIPSDLNRDEWVAALPRALVAGFVKTDKDFQEKAQTSGTTVTFMIVEGWVLTVASVGDSRCILEPSEGGIFYLSADHRLESNEEERVRITSSGGEVGRLNTGGGTEVGPLRCWPGGLCLSRSIGDMDVGEFIVPVPHVKQVKLSTAGGRIILSSDGVWDALSAEMALDCCRGMPPEAAATHIVKESVQAKGLRDDTTCIVIDILPLEKPPTSVPTQKKPVKGMLKSIFRKKSSESSTFIEKEYLEPDVVQELYEEGSAMLSERLETKYPLCNMFKLFICAVCQVEIKPGEGISIHEGLTNPGRLRPWDGPFLCSSCQEKKEAMEGKRTSGFPLLHAQELKISFAKTLKHVTSKCRARTRDVPVFGTHWILMGTY

SEQ ID NO: 190471 - protein, 922 aa, Glycine max
  Coding DNA Sequence Number=SeqID_73693
  Homolog annotation: Hit_ID=Q94HG6; Match level="QueryCoverage=30%, HitCoverage=86%, E-value=3e-95, Identity=59%"; Hit description =Putative dihydroflavonal-4-reductase
  Pfam annotation: Domain name=3Beta_HSD; Domain location=452-705; Score=-0.8; E_value=5.5e-13; Accession=PF01073.9; Description=3-beta hydroxysteroid dehydrogenaseisomerase family
  Pfam annotation: Domain name=B3; Domain location=847-922; Score=10.9; E_value=0.0043; Accession=PF02362.12; Description=B3 DNA binding domain
  Pfam annotation: Domain name=DUF829; Domain location=142-417; Score =131.4; E_value=2.5e-36; Accession=PF05705.5; Description=Eukaryotic protein of unknown function (DUF829)
  Pfam annotation: Domain name=Epimerase; Domain location=451-677; Score=141.2; E_value=2.8e-39; Accession=PF01370.11; Description=NAD dependent epimerasedehydratase family
  Pfam annotation: Domain name=NAD_binding_4; Domain location=453-661; Score=27.6; E_value=1.9e-10; Accession=PF07993.2; Description=Male sterility protein
  Pfam annotation: Domain name=NmrA; Domain location=451-685; Score= -95.6; E_value=0.012; Accession=PF05368.3; Description=NmrA-like family
  Pfam annotation: Domain name=Polysacc_synt_2; Domain location=451 -642; Score=-168.8; E_value=0.0023; Accession=PF02719.6; Description =Polysaccharide biosynthesis protein
  Pfam annotation: Domain name=RmlD_sub_bind; Domain location=450-719; Score=-182.3; E_value=0.025; Accession=PF04321.7; Description=RmlD substrate binding domain
  Pfam annotation: Domain name=adh_short; Domain location=449-607; Score=-52.9; E_value=0.017; Accession=PF00106.15; Description=short chain dehydrogenase
  Pfam module annotation: Pfam domain module=3Beta_HSD::B3::DUF829::Epim erase::NAD_binding_4::NmrA::Polysacc_synt_2::RmlD_sub_bind::adh _short; Domain location=452-705::847-922::142-417::451-677::453 -661::451-685::451-642::450-719::449-607
MWGFGGRYYWERKVACEKVDGIVVVFAWMSSEEKHLMKYVDLYSSIGWNSLDLIPKVYGDSLSIDICYPSNILKSCCLGHTWDQGLKTNSSKRIHTVKGGVAEGAGGFFPEKATILAVDILNELVEVLKIRPCPIVFASFSGGAKACMQKVLQIISGNSEAHNMDDYQIVRDCISGYIYDSSPVDFTSDLGVRFLLQPSVLKVSHPPRFASWIANGIASGLDSLFLSRFESQRAEYWWTLYSTIVPYLILCSENDNLAPFQVISNFFQRLKDLGGDVKLLKWSASPHVGHFRHHPIDYKAAITEILGKAVAIYHSKNSRIEDEKQGIEGTKDEITDPFSELRKAAMFSTSFQGFALAPSDNLSSSSTEYYVGKGVGTIADERKGGFIHLPSRPSINANGVLGQILFDVCVPKNVEDWCIRSNSKNALVADHPLAANCVARKEAEAEETMKILVTGASGFLGGKLCDALVRQGYSVRVLVRSTSDISALSPHIEIFYGDITDYASLLAACFSCTLVFHLAALVEPWLPDPSKFFSVNVGGLKNVLAAVKETRTVEKLLYTSSFFALGPTDGIVADENQVHHEKYFCTEYEKSKVAADKIAVQAASEGVPIVLLYPGVIYGPGKVTAGNVLARMRFSGRLPGYVGYGNDRFSFSHVEDVVEGHIAAMKKGEAGNRYLLTGENASFKHVFDMAAAITHTKKPLFSIPLWLIQLYGCLSVFFSRITGMLPLISPPEDVKYKNKYPFQFLKVSVLNYTILIALVGIGQNIALIDAPKKKDLVKAMEDVNVKNKWKKKGRNNKACGTTPYPQFSISTTGSNIRVLEHVFREDAYFSKLPVSIINIVSSKFVATNSAPPAMWSTTSRATMGSPDACGNLPKEDEVMTLIDEDGNEYPTIYLARKTGLRGGWKGFAVAHDLADRDAVIFN

SEQ ID NO: 190472 - protein, 50 aa, Glycine max
  Coding DNA Sequence Number=SeqID_73694
MIDEIYCVMNGNSMGKGICGEEGHAQEEQANLSLVIRVGSCGVGTLAAQK

SEQ ID NO: 190473 - protein, 151 aa, Glycine max
  Coding DNA Sequence Number=SeqID_73695
SATDRWPLSLKTHLIRTLFGKSVGDCLDAIFSRSMKYPFFAQFEVYPGQRFTRYAILGDDVCIADENVASLYRQTVACFQAGPAARKRSLPVLTWISGDGIRRPEATSSRGRSLALGDRLAAFSDRGSLAVVWVELKPSPLEPYAGELARA

SEQ ID NO: 190474 - protein, 40 aa, Glycine max
  Coding DNA Sequence Number=SeqID_73696
MTHITNMTSINYYPSEEPVFRLENSKDLDIEPVFRLENSK

SEQ ID NO: 190475 - protein, 147 aa, Glycine max
  Coding DNA Sequence Number=SeqID_73697
  Gene Ontology: Mol. function=nucleic acid binding
  Homolog annotation: Hit_ID=Q1SFR5; Match level="QueryCoverage=46%, HitCoverage=12%, E-value=3e-12, Identity=55%"; Hit description =Integrase, catalytic region
MTGEKCMFQCLTLMHGGTVTFKGNQKGKIAGVGKISIDPYPHIDNVLFVKGLKQNLISISQLCDSGLDVSIVSKVLGKEVMLSMDTIAQVTGCIKEGSMYQEDWEETYKSDTPKAPFSIPLWCLTIVSLLFSLFSPYDLVITHFFEG

SEQ ID NO: 190476 - protein, 174 aa, Glycine max
  Coding DNA Sequence Number=SeqID_73698
MANVDCRHQLEGKTKRKGASSQKGERAGVATNVYLRKTLEKPKRGLKILRRRIRELFMHGEASLARLFIGKWALGAMAARLGELSLSHEAMSSPRRASFLTWKSFGGPGEPKASLGELGSKKTKEKTLLPSFLGISCLPDRNIECSLFCTVTGIQHRKSTSTDSPRTKLGYDIN

SEQ ID NO: 190477 - protein, 224 aa, Glycine max
  Coding DNA Sequence Number=SeqID_73699
MTKAIQQIPQQLQVAISKKTQQAFIIFQNIHGNYNQVGDNKPQKRPNLWDRTAKLEEALTKLTKVVITNHKNTKVMIKSIETQIDQLAKKLQTSSIGFSATTKENPKGHCKAIISTIECDVEGEEEKEVEESTMLEEEMKAQANPSTQGMKSLVYPLLFDFSKLSIHKQGDDERMAKFEKYMVMLQGKKDDLIAKTGHSGQSSRGPQNQQKVLKEEIAKIKDKS

SEQ ID NO: 190478 - protein, 271 aa, Glycine max
  Coding DNA Sequence Number=SeqID_73700
  Gene Ontology: Mol. function=RNA-directed DNA polymerase activity; Biological process=RNA-dependent DNA replication
MAFLHWRGSGRKGIERWGKEDYEKNREITRQPHLAINDGIKKAKGSGTSHMREEITHGTVQMTEQKVGLIGYLFLVIGWSVGMVSHNMSLIGTFQIIAQLVKSILSDWVRVLNSWFQDKRKQQQIVKDLNELEEHGDLRKNNLKGLHADGVWEENPSRVKEEVKKFFDNRFIDECFERPKLDGVQFSKISNKDNAYLIVDSEKEEVKVAIRECDSLNSLRLDCFDFLFVKEFWNLLKVDILRSLKDFHGHGTLPRGTNSYSKALISKHGNP

SEQ ID NO: 190479 - protein, 253 aa, Glycine max
  Coding DNA Sequence Number=SeqID_73701
MAPKKLLTKRARKTTTGEGSSASLQAESEFDGHHFRSEEHQCRFKAIKDAINQFLGYPLVLEEGQCCEYTERKSQVSGFDEEIIGQLLCSPGQDFARSVTRRRVQIMHNSMTTLTQIWMTLLLGNILPSIATPRHLVDPENFNRTLGFPTLITGLCQFYGVLITPTKLIWPLINRPFIEKYHMPRQAQQPGMELYMQHLADQQATNYRGQASTVAWPRDRPNFQAGAGPTEASRDENKAEEDGDMADVMDFFL

SEQ ID NO: 190480 - protein, 208 aa, Glycine max
  Coding DNA Sequence Number=SeqID_73702
MGVFYHEEPPNHPKRCKYLVATFIKEVFSSCQSFAARLSTSSFEDEYPVSDFDEEQELFISAVISRTMEKQKHKPNVLRHNFSWVYSPATKELYFTTQAVAPQEKVESDQESDEGEEFLSVKSYFSRCSSSPSGGEAFYSVKTNLSRCSSLNELDLSKYRRPSVIQEFCHCEGWPFGLCRRAVLLPPLPKSPSESWLSLKMQPTSNKP

SEQ ID NO: 190481 - protein, 137 aa, Glycine max
  Coding DNA Sequence Number=SeqID_73703
  Gene Ontology: Mol. function=protein dimerization activity
  Homolog annotation: Hit_ID=Q2R1C3; Match level="QueryCoverage=71%, HitCoverage=12%, E-value=2e-15, Identity=40%"; Hit description=HAT family dimerisation domain containing protein
MLMDHWTKSSIPLHCLAHSLNPRYYSHEWLSEDPSRVPTYQDVELSDERKKCFRRYFDDVNVSRQVNLEFANFSSGREGFHDVDSLRDRGELDAKSWWLVHDAHAPTLQRFPLSYSGNHLHLLAMKGIRAPIISYIV

SEQ ID NO: 190482 - protein, 144 aa, Glycine max
  Coding DNA Sequence Number=SeqID_73704
  Gene Ontology: Mol. function=signal transducer activity; Cellular component=spindle; Biological process=signal transduction
  Homolog annotation: Hit_ID=Q5SCA7; Match level="QueryCoverage=85%, HitCoverage=34%, E-value=5e-33, Identity=50%"; Hit description=CDC20 protein
  Pfam annotation: Domain name=WD40; Domain location=8-49; Score=13.6; E_value=0.7; Accession=PF00400.22; Description=WD domain, G-beta repeat
  Pfam annotation: Domain name=WD40; Domain location=85-123; Score =20.8; E_value=0.0048; Accession=PF00400.22; Description=WD domain, G- beta repeat
  Pfam module annotation: Pfam domain module=WD40::WD40; Domain location=8-49::85-123
MNSELQLWDAETSKPDHCAAVKALSWCPYDSSVLASGGGTEDRSIKLWNVCGLEWNRHHKELLSGHGFSTSAHHNQLCMWTHPSMTKVGGLDCHASRVLHLCQSPDGLTVVSVGADKTLRFSDVFGPPVNNTSEISNLDNLLSL

SEQ ID NO: 190483 - protein, 112 aa, Glycine max
  Coding DNA Sequence Number=SeqID_73705
MTSHLVASIEKAQEVLIGTKEEDALENNLQGCIKLHGTFGKTLVTTTIIVQFIVIKLQSSYNDKLGRLTLNELRAVISKIHLVMKFLSNEMQVITLKGDQTKARECYKESLK

SEQ ID NO: 190484 - protein, 283 aa, Glycine max
  Coding DNA Sequence Number=SeqID_73706
  Gene Ontology: Mol. function=superoxide dismutase activity; Cellular component=chloroplast; Biological process=superoxide metabolic process
  Homolog annotation: Hit_ID=Q53D73; Match level="QueryCoverage=86%, HitCoverage=77%, E-value=1e-104, Identity=73%"; Hit description=Fe -superoxide dismutase 1
  Pfam annotation: Domain name=Sod_Fe_C; Domain location=115-238; Score= 181.9; E_value=1.5e-51; Accession=PF02777.8; Description =Ironmanganese superoxide dismutases, C-term
  Pfam annotation: Domain name=Sod_Fe_N; Domain location=20-111; Score =105.6; E_value=1.5e-28; Accession=PF00081.12; Description =Ironmanganese superoxide dismutases,
  Pfam module annotation: Pfam domain module=Sod_Fe_C::Sod_Fe_N; Domain location=115-238::20-111
MTYCMSCTCGDLDVYVGLVMHIFPILYGENSQSALEPIMSQETLEYHWGKHHRTYVDNLNRQIDGTDLDGNSLENTIVITYNKGDILPAFNNAAQACMLAWNHDFFWESMKPGGGGRPSGDLLNLIERDFGSFEKFLDEFKTAASTQFGSGWAWLAYKESRLDVENAVNPLQSDEDKKLVVVKTPNAVNPLVWNYYHPLLTIDVWEHAYFIDFQNQRRDYISVFMDKLVSWDAVSSRLEQAKALIKEREREAERKRREEEEKRTSSEAIPEIYSDGDADLDAE

SEQ ID NO: 190485 - protein, 120 aa, Glycine max
  Coding DNA Sequence Number=SeqID_73707
  Homolog annotation: Hit_ID=Q33B99; Match level="QueryCoverage=84%, HitCoverage=15%, E-value=5e-17, Identity=45%"; Hit description =Expressed protein
MPVASKTRNMLEGLVKEGSLKWLLGKKSYFGEEFEEMENSPSAGKNFIRELSPVANLVVRRCSKILRTSSSDLLESFNQEASDSMKHPSRYARNFLEYCCFKTRLGLIFEDHGSNIQEQF

SEQ ID NO: 190486 - protein, 81 aa, Glycine max
  Coding DNA Sequence Number=SeqID_73708
MATIALSSRYGSKLAYDTGIWGESYRLFAAKFISWLVGIVVDLGMAFVDNWAVGKEEEWQSQHGFLPLSQPLHLPQFSQSS

SEQ ID NO: 190487 - protein, 525 aa, Glycine max
  Coding DNA Sequence Number=SeqID_73709
  Gene Ontology: Mol. function=protein dimerization activity; Cellular component=nucleus; Biological process=regulation of transcription, DNA-dependent
  Homolog annotation: Hit_ID=Q1SR56; Match level="QueryCoverage=34%, HitCoverage=84%, E-value=2e-63, Identity=68%"; Hit description=HAT dimerisation
  Pfam annotation: Domain name=hATC; Domain location=419-502; Score =96.0; E_value=1.1e-25; Accession=PF05699.5; Description=hAT family dimerisation domain
MGKEMLVVTFLMSVWASSSEMGGCEGETGAHSCCERARAVMVGMRILCSVLLYPSTFSPKELSSSAGKGSRAPKSPRNSFTSMARVTRSEGDDDAPRPRARRDVGARGGHAMGRATGSTRLRLRLPVMAMYACALTLSCVMVVVGWVGKLEWIKWNWFCLWLVSGMERRMLCVQDGLSTIKDIIFNIRESVKYINHNDARLKAFCDVVEKKRLKERKLVIDCPTRWNSTFNMLSTALKFKTAFASYKEREPHYNYAPSLEEWNQVEKVCKLLEFLILLLMSSQVKQILDKEIEEEDLFMREMVGPMKKKFDKYWGECNMLMAIASVLDPMCKFHMVSICFPLIYSKEVVDENIKEVKSSFEELYDEYVGLSLQESTSSVVNLDDNISSSSQFNTSVVTGFDEIMSMLREKEAASPIKSELQDYLDEGIYAPNTNSFSALDWWRNNSMKHKILSKMVADIPAIPISNVASESTFSAGGRVIDEFRSKLNEESIEALICGGDWFRQKYNVKKKSKAEKEEIQITLKF

SEQ ID NO: 190488 - protein, 269 aa, Glycine max
  Coding DNA Sequence Number=SeqID_73710
  Gene Ontology: Mol. function=pyridoxamine-phosphate oxidase activity; Biological process=pyridoxine biosynthetic process
  Homolog annotation: Hit_ID=Q9ZPY1; Match level="QueryCoverage=97%, HitCoverage=96%, E-value=5e-25, Identity=57%"; Hit description =Expressed protein
  Subcellular localization annotation: CTP_CleavageSite=64; ConfidenceScore=5.11e-01
MGSLAWKQLLLNALESNAHLKHSSFMQLATLGTNGTPSNRTVVFRGFQDNTDNIQINTHARTPKESNSWEQFRINGDVDIIDGLNPDPLKLQLLRSFSLHPYGQDGTFATIVELGVLHYLYARAPCKIKKPLFSLIKSGEVKQNTWAFFSLVHFGGGGGNSDGDGVVVVMIMVGGDRLAVQREKSWFASSLRSRLQYLLPNPGLPCLNEQALPEISLDPSIGPVDAFCLLILEPNQVDYLNLKSNQRLTFKSSVSDAAKKSWIVERVNP

SEQ ID NO: 190489 - protein, 253 aa, Glycine max
  Coding DNA Sequence Number=SeqID_73711
  Gene Ontology: Mol. function=nucleic acid binding; Biological process= RNA-dependent DNA replication
  Homolog annotation: Hit_ID=Q1T6D0; Match level="QueryCoverage=75%, HitCoverage=42%, E-value=2e-44, Identity=41%"; Hit description=Zinc finger, CCHC-type; Lipocalin
MENFFYQETIANSGKVSALNGTTGDRPPKPPNGDGEGLRSPFTTSLRDKVLGKPTEPKEIRNLLREGTMQMELEGGNRLLPKFSLDATVFTKLCESWKKFLVLKLLGKRIGFLALRDKLKSQWKCSGGFDLMDVDNGYFLITFDFEDDKNKAIKDNIDTTLVWILFPNLGMVYYDDSVLLTIALAMGTPLRVDMNTANLVRGRFTRVCIEIDLTVLVGKFYLNGKWYNVEYEGIGKLDQQDTIGEDTANPKIP

SEQ ID NO: 190490 - protein, 1180 aa, Glycine max
  Coding DNA Sequence Number=SeqID_73712
  Pfam annotation: Domain name=WD40; Domain location=222-273; Score =21.5; E_value=0.0031; Accession=PF00400.22; Description=WD domain, G- beta repeat
  Pfam annotation: Domain name=WD40; Domain location=472-513; Score =6.9; E_value=5.7; Accession=PF00400.22; Description=WD domain, G -beta repeat
  Pfam annotation: Domain name=WD40; Domain location=686-745; Score =18.3; E_value=0.028; Accession=PF00400.22; Description=WD domain, G -beta repeat
  Pfam annotation: Domain name=WD40; Domain location=72-112; Score=1.3; E_value=26; Accession=PF00400.22; Description=WD domain, G-beta repeat
  Pfam annotation: Domain name=WD40; Domain location=758-796; Score =7.8; E_value=4.5; Accession=PF00400.22; Description=WD domain, G -beta repeat
  Pfam module annotation: Pfam domain module=WD40::WD40::WD40::WD40::WD4 0; Domain location=222-273::472-513::686-745::72-112::758-796
MREAEKMNPIDHLPLRLLRSDTVPPAPTLSESTVDFLPDFSGYSWIAYAASSLLTISHFPSPLSPHQTRIGPIFRQSFQLSADPLAAVAWSPSSPSSGDLAAAADNCISLFRHDSATAKGSFCWSQNAVLVQHTKVANIRWTGSGDGIISVGMEVVFWKKSNKCWEVAWKFKADQPQTLVCATWFIEGPSATAAHPSKEHIEGSLTNEKSKCVLVCQSNGLSEYSKVKLHHPLPVVMIQWRPSRGKLSNRYGKCSVRHVLLTCSLDGTARLWSEIDNGKARRTGKDINDQKNTGCSFCVVAVIEINQSLNGTLGSDIFVRWGTDFEGIFRTGEEAAKQVFSKEGFEHDVRNCDWLVGFGPGMLLSFWAVQCLDDVSPLRFPRVTLWNKHEIQNHDIANVYKFNSSDFKNAFFLHKIIILRSSLSGPPIICSSLQLLPCNSLVWSNFRIQMIHDAVEKSIDNVNTDNISSHLTGGVLNLDGHSGRILKVSLHPCTSKVQLAVSLDSNGLLLFWSLSNISNCILGCPTLVPTMELYGKLATQDSCSLYTSLTWAPSILDDKLVFFMGHTRGIDCFIVNICQSEEENIECHYLCTIPFSGHGPYEDGPFDIFTIPLNSTCDKTFRNNKLMLLAIWMGRFQALSWEVNLHSFDMSTNCCECNFDVKSIDNCSVWAFESTFANKKYCITVNPCSCEFLSSNDLVTSFAVADSGTLSHRQQEFGLANDLCSSYPAYILATGSSDGILKLWKSKPGNSLTQHLPWELVGSFVAHDGPIKDICLADCGEKIATFCYESNSNAINTIHIWDAVPLISAGTFILEDKIKTESDVIALKWLPLGTGELLLGVCLQNELHVYAPKRCVGTTLSNSVNFPKKNIWVRIAYAHTSIPIYDFLWGPRAAAVVIHGNYFSIFSHWLFHEDKRQGSKFRPGDSKPNTYNCEDEIYEDILSSVFTEYDIGAFREQSLGDSHADFDSVQSSKINMKDNSSSLFLAKEQLKSELLTKVGLWSILEVAEIISGSLPTYHPDVLITNISSGNWKRAYVAVRHLVECLTSYDTQKRHISKRIGLPNILLSYYLEGCISKGSQPKGFQWGGDTTSITSISQAQGSLFQFPYHSGSIVENESISSSTKSELNGFIESLEKFPDLPFLIDIEKMQILAIIDLLSEVSSPHSSSAYQSLDEPGRRYS

SEQ ID NO: 190491 - protein, 833 aa, Glycine max
  Coding DNA Sequence Number=SeqID_73713
  Homolog annotation: Hit_ID=Q4WS81; Match level="QueryCoverage=18%, HitCoverage=11%, E-value=3e-24, Identity=39%"; Hit description=WD repeat protein
MEKLARAQYLKNKNPKDCALLYIALNRVQVLAGLFKISKDEKDKPLVGFLSRNFQDEKNKAAALKNAYVLLGKHQLELAIAFFLLGGDHSSAINICAKNLGDEQLALVICRLVEGHGGSLEHHLITKYILPSAIDKGDYWLASLLEWEMGNYYQSFYRMLEFSVNPVPWESTVMSNCGPFLDPTVGFYCQMLATKNSMRNAVGEQNSAILLRWATLMTVAALKRCGNPLEALEYFSSSLSMSETADQESELGDSHDVLSSTLKPLPRKCSNWLSANVSVHLEFHIKLNLALCYLSKLIKEHPSWPDTFAEYNGEASYSDEYMMQYAKSVESFKQKLYTGLALFEQSMENSQQNSSIDSKPKFLDALQCRFEAWLQKNSEALLYMSEPFLVAQSNGRNPYDIDMVNLKKLIPNIGQLLAQTSLMSNIENLQLSKCAEDKLVADLKHLIPDDERWKILGTCLWQHFSRFMISNLNLVLAKLEDEKIRLVSFSLCDLLMTTVTHISSYHVKQHAEFLWQKVGNDLNVMTLKWLTQKSEFSQNQNLDILEQGNRKDNYSVHQLLWDHCADPKLISDCFAQEKLNWPNDLDQMNTKGWNDLSIIMTGLHKTDDTCGDGCKFSTGSSNHEVGTPVKGTSLSGHAFARTNQKDISYTNFAVFQSPREMYKRNGELLEALCINSTDQREAAVAGNRKGIMFFHLEDEIPFSAKSDDLLWATADWPQNGWAGSESTPAPTCVSPGVGLGSKKGAHLGLDGATIGVDSSDWPSNDLTGGKVLGRLGYTGIGASGLGWEVQQDFEDFVDPPATLENISTRALSSHPMRPFFLVGSSNTHIYLWE

SEQ ID NO: 190492 - protein, 385 aa, Glycine max
  Coding DNA Sequence Number=SeqID_73714
  Gene Ontology: Mol. function=binding; Cellular component=kinesin complex; Biological process=defense response
  Homolog annotation: Hit_ID=Q6Z901; Match level="QueryCoverage=98%, HitCoverage=70%, E-value=1e-147, Identity=48%"; Hit description =Kinesin light chain-like protein
  Pfam annotation: Domain name=TPR_1; Domain location=124-157; Score =22.1; E_value=0.002; Accession=PF00515.18; Description =Tetratricopeptide repeat
  Pfam annotation: Domain name=TPR_1; Domain location=167-200; Score =16.7; E_value=0.054; Accession=PF00515.18; Description =Tetratricopeptide repeat
  Pfam annotation: Domain name=TPR_1; Domain location=208-241; Score =2.5; E_value=2.7; Accession=PF00515.18; Description=Tetratricopeptide repeat
  Pfam annotation: Domain name=TPR_1; Domain location=250-283; Score =7.5; E_value=0.68; Accession=PF00515.18; Description=Tetratricopeptid e repeat
  Pfam annotation: Domain name=TPR_1; Domain location=292-325; Score =13.4; E_value=0.14; Accession=PF00515.18; Description=Tetratricopepti de repeat
  Pfam annotation: Domain name=TPR_1; Domain location=5-33; Score=2.6; E_value=2.6; Accession=PF00515.18; Description=Tetratricopeptide repeat
  Pfam annotation: Domain name=TPR_1; Domain location=82-115; Score =15.1; E_value=0.084; Accession=PF00515.18; Description =Tetratricopeptide repeat
  Pfam annotation: Domain name=TPR_2; Domain location=124-157; Score =26.0; E_value=0.00013; Accession=PF07719.7; Description =Tetratricopeptide repeat
  Pfam annotation: Domain name=TPR_2; Domain location=167-200; Score =22.6; E_value=0.0014; Accession=PF07719.7; Description =Tetratricopeptide repeat
  Pfam annotation: Domain name=TPR_2; Domain location=250-283; Score =12.0; E_value=1.3; Accession=PF07719.7; Description=Tetratricopeptide repeat
  Pfam annotation: Domain name=TPR_2; Domain location=292-325; Score =14.6; E_value=0.36; Accession=PF07719.7; Description=Tetratricopeptid e repeat
  Pfam annotation: Domain name=TPR_2; Domain location=42-75; Score=6.2; E_value=6.3; Accession=PF07719.7; Description=Tetratricopeptide repeat
  Pfam annotation: Domain name=TPR_2; Domain location=82-115; Score =13.2; E_value=0.97; Accession=PF07719.7; Description=Tetratricopeptid e repeat
  Pfam module annotation: Pfam domain module=TPR_1::TPR_1::TPR_1::TPR _1::TPR_1::TPR_1::TPR_1::TPR_2::TPR_2::TPR_2::TPR_2::TPR_2::TPR_2; Domain location=124-157::167-200::208-241::250-283::292-325::5 -33::82-115::124-157::...
  Pfam module annotation: Domain location=167-200::250-283::292-325::42- 75::82-115
MKGRYLAEAHVQAMQFDQAENFCKKTLEIHREHCSPASLTEAADRRLMALICEAKGDYELALEHLVLASMSMIANAQDNEVAAIDVSIGDIYLSLCRFDEAVFAYQKALTVFKSTKGESHSCVALVYIRLADLYYRTGKLRESKSYCENALRIYSKPVAGTTAGEIASGLTEISAIYEALNEPEEALKLLQKAVKLLEDIPGQYRTVAGIEAQMGVMFYMVGKYMDAWKSFENAITKLRASGEKKSAFFGVVLNQMGLACVQLYKIGDAAKHFEEAKEILERECGTYHSDTLGVYSNLAATYDALGRVEDAIEILEYILKMREEKLGTANPDVDDEKKRLFELLKEAGRVRNRKGKKSLENLIDSNSLKMKKEGKKRWAAFGLRT

SEQ ID NO: 190493 - protein, 445 aa, Glycine max
  Coding DNA Sequence Number=SeqID_73715
  Homolog annotation: Hit_ID=Q9ZPY4; Match level="QueryCoverage=98%, HitCoverage=98%, E-value=4e-36, Identity=30%"; Hit description =Expressed protein
MATAEVRAAWQRAVNRCFVQEDAKRAPKLACCQSSCATSKLFDAGAASAADEYDHAAASVTHFNQKSSFSNVIPDSRWWLLQLQANYEFQKGLTYEQLNALEDEVENLNVRNEQKTCKGDANHFGDENHEYISSMEGMQEVYSKNSKAYRQPMDMIAKHETMKIDSVGCTMSKHTNDFFFDSDYSWIGVEKALPRWRTTDRDELACFVLRKSLNHVENCDLPPPQKYLRGQPCADICDIKIRTSSFDQEAKSCAFSNLKVQAKRSLESELMHRMLVPSTNKGHLNFDWDKYSRSYPIIHGGVTEQVFEGNPNKAQLMEALCHSQTRARKAEEAAKQACAEKEHTIALFFIQASQLFAYKQWFQLLQLEALNTQVKNKDQPISTLFPWIRRKPGETKLKFGYAIQEMLGKPESEIATYAVAFALGLSLVGAGLLLGWTVGCMLPSP

SEQ ID NO: 190494 - protein, 146 aa, Glycine max
  Coding DNA Sequence Number=SeqID_73716
  Pfam annotation: Domain name=WD40; Domain location=7-44; Score=22.1; E_value=0.002; Accession=PF00400.22; Description=WD domain, G-beta repeat
MVYSFSNDFCLNFMTTGSVTKVVTIPNTNLFLTGSTDGDVKLWDAQSTKLIHHWSKIHEKHTFLQPSSRGFGGVVRLMPWAVVALSNSWPLKKKYPSVIRLFTMRKYGRGSLYVALSLLMQGGCFRIQTHDQLVRHNFTVIPGLAL

SEQ ID NO: 190495 - protein, 268 aa, Glycine max
  Coding DNA Sequence Number=SeqID_73717
  Gene Ontology: Biological process=regulation of transcription
MGGCEVEFEADQCKIPKLPLLNPPTMHSPERPGMKTPPLFTSASVPFGWEEEPGKPRPCTDIVSFSNPTPKCLELPPRLLLDSQNNNKSNKLSSPTTVLEGPYPYVATTNTCNSPSFRMNEDLYGSFGSERGKLGTMVLNQGVGIKEEEKEKGWFGSWREKALKREASGGGGSYVFPSSVEKDPECVGTHKKVRSMRKRNRPGSFTNPFHAKSSVWCLKFYFAKTCVMMYKACNFLAVYIWAGVVLKSSFPEWLFGQHPVVEIHNEGF

SEQ ID NO: 190496 - protein, 68 aa, Glycine max
  Coding DNA Sequence Number=SeqID_73718
MTVTMAVIGGRAGTTARREEEAKKKEEGCATTMKMYKKERERRESVEAKREWRGIKVGSLSQFDVAQG

SEQ ID NO: 190497 - protein, 114 aa, Glycine max
  Coding DNA Sequence Number=SeqID_73719
MGSVLSEPQRPLVGEKKLMTEKTKKKLEEAAQFGSIEAVIDPPSPIKRHVKWKMARTKKTGQMTFEAAKEIAEKIDSLEEQVSQGSFVPHGRQDVLTASIGRLEHPSHVRTAGA

SEQ ID NO: 190498 - protein, 136 aa, Glycine max
  Coding DNA Sequence Number=SeqID_73720
MARVGLLRLCRCLLLLVDLLGEVLRLWNGPVWRRMSWWFLLGFLWWFMLGEACLSREVKRSRCTWNNTSVKRSQLKLLINNVSPLNGFMIVEKRISSLDTQKCSCDARMACVIGTFYSCCARQMFDQMSASQQLVA

SEQ ID NO: 190499 - protein, 117 aa, Glycine max
  Coding DNA Sequence Number=SeqID_73721
MLSEICLPKVFRNYGSITEAPENIFQKRGGACRPVASSLSNPTSKMLWKGLESNCYLHPNLDKFTPYFCIFGCFLSGMLRNFTDYATMLFLTSGMLRNFTDYLTMGVKYLEAVKRVN

SEQ ID NO: 190500 - protein, 56 aa, Glycine max
  Coding DNA Sequence Number=SeqID_73722
MISNDRVQEGGEKKKMRSQSSRYEASPNPTLSSSQRHCLPPSSVINASPSSTLTVK

SEQ ID NO: 190501 - protein, 51 aa, Glycine max
  Coding DNA Sequence Number=SeqID_73723
  Homolog annotation: Hit_ID=O81728; Match level="QueryCoverage=90%, HitCoverage=19%, E-value=4e-12, Identity=70%"; Hit description =Expressed protein
MLCKLVPVPRKKKPGLNPVYLNVYDLTPINGYAYWLGLGVYHSGVQVCWVT

SEQ ID NO: 190502 - protein, 106 aa, Glycine max
  Coding DNA Sequence Number=SeqID_73724
MDLLYNGRWLPSMPALKIKALSDHAISSSRKMTFIMEMNCALVTCWSWVRIRKQPLCICKGKVAYNIPPPYLRIAKSLWAMGSLITQDFVGKGWCGVEGRSWLALT

SEQ ID NO: 190503 - protein, 124 aa, Glycine max
  Coding DNA Sequence Number=SeqID_73725
MATTSGSSATVDHGKRPQGQESTILGMLATSEPSKRKLGLCGKSLALGIESKDSWEVEAQTRRESIMSTTLSFYSITTKKNILKSLPPIMFMDEDFEGKEKSHNDPIVVKVEVANFLVCKVLID

SEQ ID NO: 190504 - protein, 61 aa, Glycine max
  Coding DNA Sequence Number=SeqID_73726
MKDCKKLNKMWDGTWIQFMECVKCIGACACGMQAKSWMSVGEVNMKVVTWEVLLVLSVNDE

SEQ ID NO: 190505 - protein, 310 aa, Glycine max
  Coding DNA Sequence Number=SeqID_73727
  Gene Ontology: Mol. function=DNA binding
  Homolog annotation: Hit_ID=Q1SWX1; Match level="QueryCoverage=95%, HitCoverage=60%, E-value=1e-35, Identity=30%"; Hit description=IMP dehydrogenase/GMP reductase
MGSSQAPLLKKRFYQVKIKNLGVSNLKDLGQFIGQLQRQAFRRAYGKIWDLTMAEVSTKAIASLTQYYDQPLRCFTFGDFQLTPTIEEFEEILGCPLGGRKPYLFSGFYPSLARIFKARTLASQDEWAPFIDVLALLIFRVVLFPNMDELVDLTVIDAFLAFYDCKESPVVAILADLYDIFDRRCEKNHARIFCCTPALYVWLVSHLFRKGERHIFQLEGHRSCAKKKEANWDQLLASKERSSVNWFPRWKEGITDVLISCGEFPNVPLMGTRGCINYNPVLTIRQLGYPMRGAPVGSSGLRIIKKGGLN

SEQ ID NO: 190506 - protein, 86 aa, Glycine max
  Coding DNA Sequence Number=SeqID_73728
MLQEVESRKKALKSDLKKAKDSTKALQDEVEHLNQEFALFKVNAAMAKEALKIDLNLLEVEIHKTHEEKALYQVKFILKDTDLFPL

SEQ ID NO: 190507 - protein, 136 aa, Glycine max
  Coding DNA Sequence Number=SeqID_73729
  Gene Ontology: Mol. function=chromatin binding; Cellular component =chromatin; Biological process=chromatin assembly or disassembly
  Homolog annotation: Hit_ID=Q1SAV4; Match level="QueryCoverage=98%, HitCoverage=34%, E-value=7e-43, Identity=64%"; Hit description =Integrase, catalytic region
MDSLAISSRIVTHFFISAFWRELFRLCGTQLRMSTTYHPQIDGQAEVLNCVLEQYLRSFVHDRPSQWFKHLALTEWSYNTSIHSGTGISPFEATYGKPPPSIPQYLQGTSRVAVVDDILTTRTKLHATLRRRLHKA

SEQ ID NO: 190508 - protein, 93 aa, Glycine max
  Coding DNA Sequence Number=SeqID_73730
MVATLSVATPSHVDHDMLREDGPKASKDAIAHFQARTWGIVEFWSDEYEKAFHESQKAQEDLTKAEMELVEPNNTTETLMQSTEESHKSLEDT

SEQ ID NO: 190509 - protein, 131 aa, Glycine max
  Coding DNA Sequence Number=SeqID_73731
  Gene Ontology: Cellular component=mitochondrial matrix
  Homolog annotation: Hit_ID=Q1SAV4; Match level="QueryCoverage=39%, HitCoverage=13%, E-value=2e-11, Identity=59%"; Hit description =Integrase, catalytic region
MSIVDWKWDFSTSPPTKLVLVRWEGAAPEDTTWEDWEQLWTSYDLEDKVFLPDGGDVNNLEPNRPKIYSTRSKYLSDFVDLKAKVQEKFYEYLDVRGVNNELAVFLHEYMMNKDRIELLRWMDSLKSFMER

SEQ ID NO: 190510 - protein, 164 aa, Glycine max
  Coding DNA Sequence Number=SeqID_73732
MSTTKFEILSRQPKVTPLLNRRFMKGRSDMRVQPNASFDFERLLKAYIKGIIFPLFLHLLYVFLLPSASFSSLVVFVLFGQPFPFDILPFYSLVISINLGILIILMEMSRRKFTPMTTTTCLVSPLAMPLSPMVIRFILMLGRERPSHLCPFHFRVLSTLIRRP

SEQ ID NO: 190511 - protein, 250 aa, Glycine max
  Coding DNA Sequence Number=SeqID_73733
MAAEWRRKRERRRHFKEKMSLEEAHHHRRSWIRAWRKKEMNEGKGREEHEFLCSKRALKSEQILASSEADSCSKIALTILSTRESSRFPSFTWRWSTMTLAAEVREDLYFKTLSLNHLQPATTKGDILISPMLLPLFTPPKEERGRITVTRTSSLIVVEGRTLPRGREAPLLVRSEARTLSEEEDSLSEAPRRVSFDEEPPIEMTSRSMMGCSIELLESLPLPPIPMAESNKREDILKDGSTLSKEARRQ

SEQ ID NO: 190512 - protein, 311 aa, Glycine max
  Coding DNA Sequence Number=SeqID_73734
  Gene Ontology: Mol. function=nucleic acid binding; Cellular component= intracellular; Biological process=regulation of transcription
  Homolog annotation: Hit_ID=Q39262; Match level="QueryCoverage=70%, HitCoverage=85%, E-value=9e-27, Identity=37%"; Hit description=Zinc finger protein 3
  Pfam annotation: Domain name=zf-C2H2; Domain location=134-156; Score =19.7; E_value=0.01; Accession=PF00096.16; Description=Zinc finger, C2H2 type
MEGLSMKEPCFCDRPTSSSIFSSSAPPPEAPPSPSTPLQHPHEKKKQLCVEELEEELENKEPKKQHVSVTLLDLNIISGGEDESCTLEEGPELNLITCLDAGSSSDNANSSSETTTTTTTNPLGNSDATEPRVFSCNYCHRKFYSSQALGGHQNAHKRERSIAKRGHRFGSQIMAFGLPLLHHNNNNNNNNRFASMASLPLYHSNRGTLGIQAHSLIQKPSSSSHHHHVNGFGGSYAHHHGWSRPIIDQQPGIAKLAVPDFHHRTKSALSASQSSVASNKEIGGCVASGGTCLKTTTNQEEMKHLDLSLKL

SEQ ID NO: 190513 - protein, 1122 aa, Glycine max
  Coding DNA Sequence Number=SeqID_73735
  Gene Ontology: Mol. function=translation initiation factor activity; Biological process=regulation of translation
  Homolog annotation: Hit_ID=Q76E23; Match level="QueryCoverage=99%, HitCoverage=59%, E-value=4e-52, Identity=37%"; Hit description =Eukaryotic translation initiation factor 4G
  Subcellular localization annotation: CTP_CleavageSite=91; ConfidenceScore=5.55e-01
MSFNQSKSDKSDAVYRKSGRSGSFNQQRGPFGGAYGKGGGGGAGPSPSLSSSRSFNKKSNNNAQGGQSRVNPTPVNSTESNSTYAARTVPNGSYVQPQIHGGSDAPITNATAKSSELLAAQRSSRAVPKAPTSQPPSMSPDPAAPTTPAKADASKAFPFQFGSISPGFMNGMAIPARTSSAPPNIDEQRRDQARHDSLRPVPSMPTPPVPKQHLVKKDTGVADQSNAGEIHTGIRAKKDTQMSPLPPASQMQKPSVISLSGMSMPMPYHHQSQASVHFGGPNPQIQSSAPLQMPLPMPLPIGSGAQVQQQVFVPSLQPHPIHPQGIMHQGQSMGFTPQIGPQLTHQLGNMAIGISPQYPPQQGGKFAARKTTPVKITHPETHEELRLDKRTDAYSDGGSSGSRHHSGMPSQSQPAQQFAASHPINYYPSSSYSTNSLFYPTTSSLPLTSSQITPNSQPSRFNYAVNHGPQNASFINSSSHSSLPVNKAGTSIPGNAESPNPEIFQDVHNTILSAPSGVTSVSIKPTGGSGVVVDSSFSNSSTQKSGSSSSSLTSSDAFETTEITSQQSKVSSDSSVLSSLPSLSAASTMKPTSASLLLPASAVSEDSISVLPNNEGGKKESLSRSNSLKDNQKKIQKKGQSQHQVAVQSPSVVNVPFQAVDGDIPDEVSETVGTKTNHSAAITSEDLSAAASDTLSATIESLTCAVEMKTNDSTQVSACASAEGPVTQVMDNLNNHKIAELDELSHQDKPLQPNILEMGGKTENLSLQGSKQSVSDGGTELKQPKKGTVKLSTEFVTLKTKESTSCSAECDTTADNNGMSVSTKLDSKDVCLNRNDSVVSNEAVSSNSGTSDQQSADLLEATSKQCKDDSAENAGSVSVSLPASGTKDRPISESSKVKPTSKGKKKRKEILQKADAAGSTSDLYNAYKGPEEKKETIISSEKTESGSTSGNLERLPTDTAQPDAVANEQSKQSKAELDDWEDAADMSTPKLEVSDETEQVSDGSAITAKKYSRDFLLKFAEQCTDLPEGFEITADIDEALMSVNVSSHVIERDSHSTGRIIDRSGGMSRRGSGVIEEDKWSKVSNAFHSGMRLDGVGGNAGFRPGQGGNFGVLRNPRTQTPL

SEQ ID NO: 190514 - protein, 76 aa, Glycine max
  Coding DNA Sequence Number=SeqID_73736
MDGWFVWKQNLQKSTGLKAPDGLMWKTILDCHPAAPITMSGTCYNRFPILAKKVSEHMHSPHPKDFSGEAFPPLYP

SEQ ID NO: 190515 - protein, 675 aa, Glycine max
  Coding DNA Sequence Number=SeqID_73737
  Gene Ontology: Mol. function=translation initiation factor activity; Cellular component=eukaryotic translation initiation factor 4F complex; Biological process=regulation of translation
  Homolog annotation: Hit_ID=Q76E23; Match level="QueryCoverage=99%, HitCoverage=39%, E-value=0.0, Identity=58%"; Hit description =Eukaryotic translation initiation factor 4G
  Pfam annotation: Domain name=MA3; Domain location=494-608; Score =61.1; E_value=3.7e-15; Accession=PF02847.7; Description=MA3 domain
  Pfam annotation: Domain name=MIF4G; Domain location=58-280; Score =212.1; E_value=1.3e-60; Accession=PF02854.9; Description=MIF4G domain
  Pfam module annotation: Pfam domain module=MA3::MIF4G; Domain location=494-608::58-280
GGMQRNSPDGERWQRATSFQQRGLIPSPSTPQTPLQMMHKAEKKYEVGKVTDEEQAKQRQLKGILNKLTPQNFEKLFDQVRAVNIDNVVTLNGVISQIFEKALMEPTFCEMYANFCFHLAAALPDLSQDNEKITFKRLLLNKCQEEFERGEREQEEANKVDEGEVKLSNGEREEKRTKARRRMLGNIRLIGELYKKKMLTERIMHECIKKLLGQYQDPDEEDIEALCKLMSTIGEMIDHPKAKEHMDAYFEMMRSLSNNMNLSSRVRFMLKDVIDLRKNKWQQRRKVEGPKKIEEVHRDASQERLAQASRLGRGPGNNPPRRIPMDFGPRGSSMLSPNAQMGGLRGLPTQVRGYGSQDARMEDRQTYEARTLSVPLPQRPLGDESITLGPQGGLARGMSIRGPPAVSSSTGLNGYNNLSERTSYSSREDPASRYTPDRFAGSTAYDQSSVQDRNMNYGNRDLRNANRILDKPVVTSPARAQGTAASQNISAERLQDMSMAAIREYYSARDVNEVVLCIKDLNYPGFHPSMVSLWVTDSFERKDTERNLLAQLLVKLVKSQDGPLGQAQLIKGFESVLSTLEDAVNDAPKAPEFLGRIFAKAITEHVVSLKEIGRLIHEGGEEPGSLLEAGLAADVLGSTLEVIKMEKGDAVLSEICTSSNLRLETFRPLEPLTSR

SEQ ID NO: 190516 - protein, 107 aa, Glycine max
  Coding DNA Sequence Number=SeqID_73738
  Gene Ontology: Biological process=protein transport
MTSSHGNIDDVEKTVDEINEQTENMKQIQVALSTPIGATTYFNEDKLEVELEDLEGVELEEQLLQPATTAPTATVHVPAGLQPTRSVSSKPTTEEDELAALQDKMAL

SEQ ID NO: 190517 - protein, 164 aa, Glycine max
  Coding DNA Sequence Number=SeqID_73739
MEILVVVVLVDAYDTFDRRCEKSSARIVCCTPVLYVWLVSHFFGHESRPVCHLQGHHMCAEKGKANWEQLLAGMLKARTQEITWLPKLKISSEEEAKVPEESKDVQALKVKLERTQVVKEKFKTTAIRVRKECDELRDVNVATAEALERETKRARKKEWGRNKF

SEQ ID NO: 190518 - protein, 437 aa, Glycine max
  Coding DNA Sequence Number=SeqID_73740
  Gene Ontology: Mol. function=protein dimerization activity
  Homolog annotation: Hit_ID=Q1SIN2; Match level="QueryCoverage=67%, HitCoverage=48%, E-value=7e-27, Identity=27%"; Hit description=Zinc finger, BED-type predicted
  Pfam annotation: Domain name=zf-BED; Domain location=71-110; Score =32.0; E_value=2e-06; Accession=PF02892.5; Description=BED zinc finger
MTNRSCTGSVNASIPLSSVTPSQCPIELAGAPLLSERVLEIPKEVTQQGTEAPSPFGQAKVQNRKTTRAFSNVWMQYNRVNNDAFCKYCGKSYKANNSKYGTTNLIRHARDYMNNPNREVDKKQKTINVGKKSKDDPNVVSMKLVEFNQGRILIALAKIILDEISLKFVENEGFRKFMEEAEPYFKIPSRSIIARCCIQVFNDEKKKLKLDNASANNVAISYLVRGLSVWNDHTLLNGEFMHMRCSAHILNLIVSDGLKEIDSSISKVRVVCKSVRSSPSRLTTFKSCTEEFSVNSKAMLTLGVPTRWKSTYLMLDVAEKFEQASYCFEYVEAAYVLNLLTSEGGYPKDVDWKRARVFEMYDVEKSKEMVKKFDDLIIKLFADYAIQHPISIESSTLASNIDSQLNSDQVFEQLPSIAALDLMTLQQTAPLFSLLDF

SEQ ID NO: 190519 - protein, 81 aa, Glycine max
  Coding DNA Sequence Number=SeqID_73741
  Subcellular localization annotation: CTP_CleavageSite=45; ConfidenceScore=5.31e-01
MEHVSNPWIQPILIFTKKSGSNLDPWAKKSTLRFMRTLGPSLVALAQASWSLLSNTLGGVRSENPFHGHLAMREHGSSPTQ

SEQ ID NO: 190520 - protein, 100 aa, Glycine max
  Coding DNA Sequence Number=SeqID_73742
  Gene Ontology: Mol. function=RNA-directed DNA polymerase activity; Cellular component=mitochondrion; Biological process=DNA integration
MELEQLDVKTTFHHRRLEEDILMPQPEGFEVEGMENSIYRLKRSLYGLKQSPRQLYKRFNEFIISHGYIRSPYNSCVYLNKVEDDSHIYLPLYVDDMLID

SEQ ID NO: 190521 - protein, 254 aa, Glycine max
  Coding DNA Sequence Number=SeqID_73743
  Homolog annotation: Hit_ID=Q8H6Q8; Match level="QueryCoverage=35%, HitCoverage=46%, E-value=3e-09, Identity=34%"; Hit description=CTV.20
MPLRTLFLLPHQALIPEISGEGSNGQIGKEDEDEFDLKEMREKERKRRDILDSSSSIFAVIWFHRNVSIRLKKKLRNLNLEAAIEEQINNLLIETSEEETKTSSSVLSDENLNLIQQDDQLSSTDDDGQINTLTREQDLLFEAINSIPDPQEKKVFLEKLKKTLEIKPRQKDFITNNKFDVSNIFKRLENSSAKPTTIQDLQTEINNLKREVKELRQQQEIHQIILSQLEEDSDSESVNNSEENQPDNLEDDIF

SEQ ID NO: 190522 - protein, 265 aa, Glycine max
  Coding DNA Sequence Number=SeqID_73744
  Gene Ontology: Mol. function=protein serine/threonine kinase activity; Cellular component=cytoplasm; Biological process=protein amino acid phosphorylation
  Homolog annotation: Hit_ID=Q6T2Z9; Match level="QueryCoverage=43%, HitCoverage=36%, E-value=2e-58, Identity=95%"; Hit description=CDK -activating kinase
MSPHSMFVNEVCKVGLDMKDVVCDRNLIENMVNDFMGHGKEEFLNSAREVAMLANHSVRVDVGAVMFSDRGASSIIIRPYEDDASNSESSLQHPEAISQLVNLNQNVYENPNQGTVSHEEYFRVLDEMKTKSYSYDTDKDANIYDGNTSCLATSDPLFPGTSDVDQLSRIVSVLGNINEETWPSCSKLPDYGSISFGNVENPSGLEACMPNCSPNEVSLVQRLVCYDPAKRTTTMELLQDKYFSEEPLPVPISELRVPLTRNGQD

SEQ ID NO: 190523 - protein, 293 aa, Glycine max
  Coding DNA Sequence Number=SeqID_73745
MEQHEMGFHKAIRMVEFFAKHLDLGHFDLFKDVKDNVLLDEEDIVVEEKDVGKEQDFNIHLVEGLDDHSSGSIFRLVEPGPLTMVLVVLKEANLGFLMHRQTCIPAWIKPLAMRDSPRMDLGFCEPFVMRDSPRTNLRFCEPLEKRDSARADLRFYEPLEKRDSPRVNHGFCEPLAMRDSPRAGLGFCKPLAMQDSLRVDLGFCEPLENRDSPKADLGFCKPLMMQDLPRTDLGFCKLVELRPERVCILGTHPVQIGVVGAHSPFAIGLFDHDDIGEPGGKAEFSDEVDFEEL

SEQ ID NO: 190524 - protein, 62 aa, Glycine max
  Coding DNA Sequence Number=SeqID_73746
MNSTMSLQSQKRSPVCDKDELRQKEKEEERPRSLKANHNGLPKSIPTLSGTLSFPSFLRPAK

SEQ ID NO: 190525 - protein, 734 aa, Glycine max
  Coding DNA Sequence Number=SeqID_73747
  Gene Ontology: Mol. function=protein dimerization activity; Cellular component=nucleus; Biological process=regulation of transcription, DNA-dependent
  Homolog annotation: Hit_ID=Q6YVY0; Match level="QueryCoverage=92%, HitCoverage=91%, E-value=1e-175, Identity=51%"; Hit description =Putative auxin-responsive factor
  Pfam annotation: Domain name=AUX_IAA; Domain location=533-705; Score=- 84.2; E_value=0.0019; Accession=PF02309.7; Description=AUXIAA family
  Pfam annotation: Domain name=Auxin_resp; Domain location=278-357; Score=173.4; E_value=5.5e-49; Accession=PF06507.4; Description=Auxin response factor
  Pfam annotation: Domain name=B3; Domain location=133-256; Score=80.1; E_value=6.8e-21; Accession=PF02362.12; Description=B3 DNA binding domain
  Pfam module annotation: Pfam domain module=AUX_IAA::Auxin_resp::B3; Domain location=533-705::278-357::133-256
MAHLGCCNLGGPGSSGTSLPEKGLKDDDLYRELWKLCAGPLVDVPRTGDRVFYFPQGHMEQLQASTDQELNQEIPHFNLPAKIFCRVVNIQLLAEQDTDEVYACIALLPESDQTEPTNPDPNISEPPKQKFHSFCKILTASDTSTHGGFSVLRKHATECLPALVFSPFELPLTETEWVNVEDMTQATPTQELAAKDLHGFEWKFKHIYRGQPRRHLLTTGWSTFVASKRLVAGDAFVFLRGEHGQLRVGVRRLARQQSPMPSSVISSQSMHLGVLATASHAVMTRTMFLVYYKPRTSQFIVGLNKYLEAVNNKFSLGMRFKMRFEGDDSPERRFSGTIVGVGDVSAGWSNSQWRSLKVQWDEPATIPRPDRVSCWEIEPFVASTALNVTQPAVKGKRSRPADVSSSAASGFWYHGSSNELSQLGAATAEVQSKENQVVPCSLRQKDIINSNPIDANNSSISSRVRMEGVWPSSPHLNVTPNLFSDPNNNSVLARSPISGYLNVPSRSSDGPTCEHVEDGKKIENSLDCWLFGVNLTNNCSNVIITTPSERELRGPISSSVAPSGPKESIPAAACETERVQTPNYSLSNKGQKQIISEASPNEWQNKQATVPSMRTRTKVQMQGVAVGRAFDLTTLSGYDDLIEELEKLFEIRGELHSQDKWAVTFTDDENDMMLVGDDPWPEFCNMVKRIFICSREDLKKMKCCKLPASSSEVEEVLLSPDSQNRDETQQSHMP

SEQ ID NO: 190526 - protein, 257 aa, Glycine max
  Coding DNA Sequence Number=SeqID_73748
MGIGPIDEDHDLVAVTVPVTRKVAEAGIDKVLIFKGNEEEKICTTFMERKELWWGQRQNGRWQKGRGGGQQLKGEDLPANVRRHIGNKAAKEEWQREADDTIGQGFKLGKCVAGIFVEGGHKTHLQGLKKTRPRRQLVVVEHPLKPVEDWPVEVEGGYLESFVIRGTMVVKNLTNLEYPKTWHQSRRSEEPQGSYEEGVKTRNNLVQFGVEEALGEGECTLVLSQEGHNLLKARQGVRTCIIGHGKGSMKAPNDGAL

SEQ ID NO: 190527 - protein, 600 aa, Glycine max
  Coding DNA Sequence Number=SeqID_73749
  Gene Ontology: Mol. function=RNA-directed DNA polymerase activity; Cellular component=chromatin; Biological process=chromatin assembly or disassembly
MDLAQGFHQIRMVESDIPETTFCTHQGHYEYVVMPFRLCNAPSTFQATMNDLIRPFIRKFIHVFFDDILVYSHNFDEHLDHLDQVLHTLQQGEFNLKLSKCVFGQHSIDYLGHIVLTNDVEPEPSKIQAMLDWPYELLPPFFQELCPTRLSIDPTFVQGSVFMETDASNMGIGFVLMQMGHPIAYFSKQFCPKLLRSSTYICELHAITIATPEQHIYIAKLLGYDYTIQYKAGHSNVVADALSRIREPSPEALWIMNVPHFQFLDDLKHELFQMEESISLLNVNFFWIGMKQDIRQYITQCLDCQQTKYIPQRPAGLLQPIPPPPSPWEDMALDFITGLPNYQGATVILTIIVCKLHGFPKSLISDRDPIFMSRFWCELFKLNDTKLRMSMTYHPKVTASPRCLTAWCNNTWAASCTRNLSSGESFHVLLNGSSSMETIDFLLTSRQDMFIHLKRKIEHTQEKMKSSVGSHRWDISFHVDDWVYVKLRPYRQTSLAGNNYQKLGKCYYGPYQVIERVGLVAYKLALPASAKIHPMFHCLLLKPHSEDSIWENWTELQASYHLEDKVILEAIGNDSNPESEANHMPKRIIKRPQRWEEFIH

SEQ ID NO: 190528 - protein, 57 aa, Glycine max
  Coding DNA Sequence Number=SeqID_73750
MPDSDEEGNIGALELPAENLEEQQQHQEELMQQYLEENTLMLQMIWKSTSRLLLAKA

SEQ ID NO: 190529 - protein, 116 aa, Glycine max
  Coding DNA Sequence Number=SeqID_73751
MEATRVAMEALAGTARRRRRRVVLLACWVASRVSYCSIMSGDNGSNGQRVAPESYPHACLVRVRRGTCRQITESKILKAEQNVDWISPSVHLLEDLFQHPSMMVRPRPLVFVDRKH

SEQ ID NO: 190530 - protein, 156 aa, Glycine max
  Coding DNA Sequence Number=SeqID_73752
MSVSNIFWPTSTRGFQSVLTMTEKQEDRHTRPDVEERTQNLKSPHYWPTVQVKLGRGHIQVLRQRTLKCGQGQNDTQDLKQTSIHKEQGRMARRRPKNREVITPASLNDQLANVLRVHQHHLALKRNDTRRQSQIGLVLQHVFPHPVLARNGWDRR

SEQ ID NO: 190531 - protein, 101 aa, Glycine max
  Coding DNA Sequence Number=SeqID_73753
GLFPEEPWCLPTWMAKSYLHPDSPSTVSLVTIFKRNEPGFEALVLTGRIILSYLLGWGQTMNSRNQSRYLGTDASGDGVTTDRSLPLLCAKQAENAAQGSP

SEQ ID NO: 190532 - protein, 59 aa, Glycine max
  Coding DNA Sequence Number=SeqID_73754
MSDKGDEYYKRYDEIGKHSGSFAKLIQKHGICAQYTMPGSLERQFRRHLLNCGLIGHLT

SEQ ID NO: 190533 - protein, 107 aa, Glycine max
  Coding DNA Sequence Number=SeqID_73755
  Gene Ontology: Mol. function=RNA binding; Cellular component =ribonucleoprotein complex; Biological process=regulation of translation
  Homolog annotation: Hit_ID=Q9FYT6; Match level="QueryCoverage=77%, HitCoverage=11%, E-value=1e-21, Identity=57%"; Hit description=CRS1
MQKLFSQVINTAKLLETESGGILVSVDKLKEGHAVIVYRGKNYKRPSRKLAKNLLTKREALRRSLEMQRIGSLKFFARQREQAISKLEVKQEDLQQEKEIALREFEN

SEQ ID NO: 190534 - protein, 820 aa, Glycine max
  Coding DNA Sequence Number=SeqID_73756
  Gene Ontology: Mol. function=protein serine/threonine kinase activity; Cellular component=nucleus; Biological process=protein amino acid phosphorylation
  Homolog annotation: Hit_ID=Q9C9P0; Match level="QueryCoverage=72%, HitCoverage=94%, E-value=1e-132, Identity=37%"; Hit description =Protein kinase, putative
  Pfam annotation: Domain name=APH; Domain location=359-542; Score= -9.5; E_value=0.027; Accession=PF01636.13; Description=Phosphotransfer ase enzyme family
  Pfam annotation: Domain name=Pkinase; Domain location=357-630; Score =163.6; E_value=5e-46; Accession=PF00069.15; Description=Protein kinase domain
  Pfam annotation: Domain name=Pkinase_Tyr; Domain location=357-630; Score=128.7; E_value=1.7e-35; Accession=PF07714.7; Description =Protein tyrosine kinase
  Pfam module annotation: Pfam domain module=APH::Pkinase::Pkinase_Tyr; Domain location=359-542::357-630::357-630
  Subcellular localization annotation: CTP_CleavageSite=81; ConfidenceScore=5.23e-01
MLSLSSTTTIITATILVFYLHHTTSLPPHAQLSTCHVTSFNCGTITNLSYPFTGGDRPSFCGPPQFHLNCQNGIVPELIISSVSYRVIHVNSEAHTLNLARLDLWNETCTNVYVNSTFDGPTFSYGSGNQNLTLFYECEASSRITETPENLFHCWSNGDKNNSYSLVGPFPLDPILEVVECDEHVKVPILIELADRLVKNRSLLGEVLMKGFNVNYMNPYETECFECLASGGVCGFDSDNDEPICICGDQLCATPGSSKVAVAIGASVGAVGALVVILGCVYFVLQRRRKIAYNKQRSSMDLFMPPSSGDTFASTTNTSQSLSSYQSSNTDPMPPRSNYFGVQVFTYEELEEATKNFDSSKELGEGGFGTVYKGELKDGRVVAVKRHYESNSRRIEQFMNEVQILARLRHKSLVTLFGCTHRHSRELLLVYEFIPNGTVADHLQGRSTKSTNLLPWPIRLNIAVETAEALAYLHAKGVIHRDVKTNNILLDDNFRVKVADFGLSRDFPNHVTHVSTAPQGTPGYVDPEYYQSYQLTDKSDVYSFGVVLVELISSLQAVDINRNRSDVNLANMAINKIQNQELLEFVDPYLGFERDYAIRRMTTGVAELAFRCLQQEREIRPSMNEVVEILRGINSSDGLGAREETKVLEVRTDEAILLKVSPVSPDSVVDKWVSDLTLSPQCPLSTNSSSSPPNAPSPAAPPAALPPAPSSTSAAARPYACSSPAAASVPRRKIRLPSPTPRPASATSSRTSSSHRHRLLPSRTKKQSSTISSSNNNNNKISTKNSSLTPPSASGSAPDLPSGAAPPLSGRYRRSSATGY

SEQ ID NO: 190535 - protein, 68 aa, Glycine max
  Coding DNA Sequence Number=SeqID_73757
MFCKNQVFMLHESEALFTHVQPLSSFCKLKLNPLKRHNLHVEVQKYFYKVVPSVKCSITFITEKLDYL

SEQ ID NO: 190536 - protein, 74 aa, Glycine max
  Coding DNA Sequence Number=SeqID_73758
MESAKRYKAVLRLNGWGIMRSARNVLVPVESVESLMVNSNVSARMDAKGRTDSVASVENNSPKLDGAMRESLRK

SEQ ID NO: 190537 - protein, 97 aa, Glycine max
  Coding DNA Sequence Number=SeqID_73759
MVYPADGLSSEIYEKRSHKFLESKQIVFVYFSSNCHKSMLTGVAPSRVTPLLEKSHIPLSYVAALLPLPFGTDHETNISLVLSKVEEFHDDLICIII

SEQ ID NO: 190538 - protein, 38 aa, Glycine max
  Coding DNA Sequence Number=SeqID_73760
MKHRMPSKFLRLKLRTNVTSENILMGISLDMPKGLKVI

SEQ ID NO: 190539 - protein, 78 aa, Glycine max
  Coding DNA Sequence Number=SeqID_73761
  Gene Ontology: Mol. function=lipid binding; Biological process=lipid transport
  Homolog annotation: Hit_ID=Q41378; Match level="QueryCoverage=58%, HitCoverage=51%, E-value=1e-13, Identity=63%"; Hit description=Lipid transfer protein
  Pfam annotation: Domain name=Tryp_alpha_amyl; Domain location=13-78; Score=32.8; E_value=1.2e-06; Accession=PF00234.12; Description =Protease inhibitorseed storageLTP f
EELENDDEVCYVCSGGCSTSSSGGAITSGAKPSNACCTKLKQQKPCLCGYLKNASLKQYVNSPNARKTVASCGIPFPT

SEQ ID NO: 190540 - protein, 94 aa, Glycine max
  Coding DNA Sequence Number=SeqID_73762
MPKRRRLNMDFKNKANNNALGQTPTSLHERAEGISGFFRGSVKHAIAVSKLRNDAKIRASLSTETASQVGRFHFDRWVPLVVEFQRMTTALHGG

SEQ ID NO: 190541 - protein, 392 aa, Glycine max
  Coding DNA Sequence Number=SeqID_73763
  Gene Ontology: Mol. function=DNA binding
  Homolog annotation: Hit_ID=Q9LW00; Match level="QueryCoverage=60%, HitCoverage=91%, E-value=2e-27, Identity=37%"; Hit description =Arabidopsis thaliana genomic DNA, chromosome 3, P1 clone: MSJ11
  Pfam annotation: Domain name=MBD; Domain location=102-171; Score =27.4; E_value=5.1e-05; Accession=PF01429.10; Description=Methyl-CpG binding domain
MASAVEKEGGAREETFSLELPAPPGWKKQWSIALRLRGGVEWPPTALEALVSEHLAIALPFVAQITVFCRCSSVCAVARQPLSSPSVFSSIFHRELGFQLHFHNSGGTHLALSREFIPKKAGTPKKNEIVFTAATGEEIHNRKQLEKYLKAHPGGPAVSEFDWGTGETPRRSTRISEKAKAAPPSVSEPPKKRTKRSSASQKETSQEEKEQEIKEAEMQEADDTTKDDNDIGKEKDVVKENQDDKCVEDTDVNKSTNSGEEAKAVENVEVPIDEKSNAADGELPALKDKVDDKGTEGSEVFLRKDEVKIEQPQEETKEYRGSGEPEKSETCTTADKTVEVEGVDKEEHVKSTHEFEVGEMEGTKVIGEEHHKLDEINKKAETELTVNGNHGS

SEQ ID NO: 190542 - protein, 424 aa, Glycine max
  Coding DNA Sequence Number=SeqID_73764
  Gene Ontology: Mol. function=binding
  Homolog annotation: Hit_ID=Q5QMW8; Match level="QueryCoverage=98%, HitCoverage=37%, E-value=1e-152, Identity=62%"; Hit description=HEAT repeat-containing protein-like
  Pfam annotation: Domain name=HEAT; Domain location=154-190; Score =9.8; E_value=2.8; Accession=PF02985.12; Description=HEAT repeat
  Pfam annotation: Domain name=HEAT; Domain location=193-229; Score =19.1; E_value=0.016; Accession=PF02985.12; Description=HEAT repeat
  Pfam module annotation: Pfam domain module=HEAT::HEAT; Domain location=154-190::193-229
GQVEWGAFEWMHVECFPNLIQLACLLPQKEDNLRSRISKFLLSVSESFGDSYVTCIMLPVFLIAVGDDADLTFFPTSIHSRIKGLRPRSAVADRLSTMCVLPLLLAGVLSAPGKHEQLAEYLRKLLLEENSMQNQSTKHTPEIINAIRFICIYEENHGMIFNILWEMVVSSNASMKINAAKLLKVIVPHIDAKVASTHVLPALVTLGSDQNLTVKYGSIDAFGAVAQHFKNEMIVDKIRVQMDAFLEDGSHEATIAVIRALVVAISQLTAMPNSSSDLMRRRERANAFCEAIRALDATDLPANSVRDLFLPAIQNLLKDLDALDPAHKEALEIIMKERSGGTFESFSKVMGAHIGLPSSVTSFFGESGLLGKKETTEPPSEATVSPKAAAPSPAEDTRFKRIMLGNFSEMLRGKAKAPEEGQNQ

SEQ ID NO: 190543 - protein, 82 aa, Glycine max
  Coding DNA Sequence Number=SeqID_73765
MMQCPTDIDNCAAGFLTHSRSNFVLLQPDDIDAEWPSRPRHHVGSLPNLVVTVLKVYVVRLEEDQPPKAAVDSRCGALLDGI

SEQ ID NO: 190544 - protein, 78 aa, Glycine max
  Coding DNA Sequence Number=SeqID_73766
  Homolog annotation: Hit_ID=Q1SWI6; Match level="QueryCoverage=49%, HitCoverage=17%, E-value=5e-09, Identity=61%"; Hit description =Leucine-rich repeat, plant specific
MGSKVVAEDSIPVATVGMIMIPRPKPIGRIYEIILKLQKCLTLTWDAHTLSACLHHQVNLKVFHFFILNLWTLHKVQP

SEQ ID NO: 190545 - protein, 464 aa, Glycine max
  Coding DNA Sequence Number=SeqID_73767
  Gene Ontology: Mol. function=oxidoreductase activity; Cellular component=chloroplast; Biological process=metabolic process
  Homolog annotation: Hit_ID=Q1RST5; Match level="QueryCoverage=99%, HitCoverage=92%, E-value=0.0, Identity=90%"; Hit description=Nadp -dependent glyceraldehyde-3-phosphate dehydrogenase
  Pfam annotation: Domain name=Aldedh; Domain location=24-463; Score =560.4; E_value=1.8e-165; Accession=PF00171.12; Description=Aldehyde dehydrogenase family
  Pfam annotation: Domain name=LuxC; Domain location=69-464; Score= -162.4; E_value=0.071; Accession=PF05893.4; Description=Acyl-CoA reductase (LuxC)
  Pfam module annotation: Pfam domain module=Aldedh::LuxC; Domain location=24-463::69-464
MAGSGTFAEIIDGDVFKYYAQGHWNKSSSGKFVPIINPTTRKTHFKVQACTQKEVNRVMESAKTAQKSWAKTPLWKRAELLHKAAAILKEHKAPIAECLVKEIAKPAKDAVTEVIRSGDLVSYCAEEGVRILGEGKFLVSDSFPGNERTKYCLTSKIPLGVVLAIPPFNYPVNLAVSKIAPALIAGNSIVLKPPTQGAVAALHMVHCFHLAGFPEGLISCVTGKGSEIGDFLTMHPGVNCISFTGGDTGIAISKKAGMVPLQMELGGKDACIVLEDADLDLAAANIVKGGFSYSGQRCTAVKVALVMESVANTLVKRINDKIAKLTVGPPEIDSDVTPVVTESSANFIEGLVMDAKEKGATFCQEYVREGNLIWPLLLDNVRPDMRIAWEEPFGPVLPVIRINSVEEGIHHCNASNFGLQGCVFTRDINKAMLISDAMETGTVQINSAPARGPDHFPFQRLMGH

SEQ ID NO: 190546 - protein, 63 aa, Glycine max
  Coding DNA Sequence Number=SeqID_73768
  Homolog annotation: Hit_ID=Q9SNX8; Match level="QueryCoverage=59%, HitCoverage=7%, E-value=6e-13, Identity=89%"; Hit description=NADP -dependent glyceraldehyde-3-phosphate dehydrogenase
MAYHRYSIRYDHIIMPSYSLILCGNKGLKDSGIGSQGITNSINMMTKVKTTIINLPAPSYTMG

SEQ ID NO: 190547 - protein, 191 aa, Glycine max
  Coding DNA Sequence Number=SeqID_73769
  Homolog annotation: Hit_ID=Q1T1F7; Match level="QueryCoverage=90%, HitCoverage=36%, E-value=2e-19, Identity=33%"; Hit description=IMP dehydrogenase/GMP reductase
MTTILHLYPIRQLLSDNHSYHLRGVFLDALRDLMQSGTYAWGATALVYMYDNLNEASKSTVRQLAGYITLLKCWIYEHFPSIGSALATEDYDERRLCACQWTSGKALPVSMYHRCLDKLTHDVVCWIPYGDHRSFREFEVISLFFGHLRLGPLTVIHQSKRVLRQFAYIQTILPHPTAPSVSIEEMDDRWM

SEQ ID NO: 190548 - protein, 97 aa, Glycine max
  Coding DNA Sequence Number=SeqID_73770
MCNFHAFKELHRLSSLEADACGANTFPARKQLPNLLFLKFVGPLLVFLTFFSNKRWWRLRAFFFLGRRTREPRVALPPKGRLRQLVTPLGSFFFKKS

SEQ ID NO: 190549 - protein, 63 aa, Glycine max
  Coding DNA Sequence Number=SeqID_73771
MICPSRCHEEMHNVIKEQAKGVALAPMYPQPIGPPRPPRKLRDEVTSLPERAAVQPPPLISYK

SEQ ID NO: 190550 - protein, 555 aa, Glycine max
  Coding DNA Sequence Number=SeqID_73772
  Gene Ontology: Mol. function=ubiquitin thiolesterase activity; Cellular component=intracellular; Biological process=ubiquitin -dependent protein catabolic process
  Homolog annotation: Hit_ID=Q1RSU1; Match level="QueryCoverage=99%, HitCoverage=77%, E-value=0.0, Identity=79%"; Hit description =Peptidase C19, ubiquitin carboxyl-terminal hydrolase 2; Zinc finger, UBP-type
  Pfam annotation: Domain name=UCH; Domain location=178-523; Score =221.0; E_value=2.7e-63; Accession=PF00443.19; Description=Ubiquitin carboxyl-terminal hydrolase
  Pfam annotation: Domain name=zf-UBP; Domain location=60-126; Score =12.9; E_value=0.0043; Accession=PF02148.9; Description=Zn-finger in ubiquitin-hydrolases and other protein
  Pfam module annotation: Pfam domain module=UCH::zf-UBP; Domain location=178-523::60-126
MLLRNPSLYTNPEPCQHLAEYKLKHGFDGYKAIQKLLVISPIGKASVKKPNTKVPRCGFCNGCEGRFYLCLICSSFSCLDHTLLHPQSETGHAVFVDIERAELFCGVCRDQLYDPDFDQVVMSKHSLGVASGVTGNESIGQRLIKRRRLASGVVGLDLQKSKCRVSTKDLREKSCYPVGLRGLNNLGSTCFMNSVLQVLLNAPPFRDYFLSGGHRLEACHHRRTADLMCCLLCDVNAIFSAAYSGDRSPYSPAQFLYSWWQHSANLACYEQQDAHEFFISMLDAIHEKESKTRNGSKGNGDCQCIAHKVFYGLLRSDVTCMACGFTSTTYDPCVDISLNLDTNVSSTEKGKKLTKQNEDGSMSTLFGCLDLFTRPEKLGSDQKLYCRNCRERQDSLKQMSIRKLPLVLSLHVKRFEHSFVKKSSRKIDRYLHFPFSLDMSPYLSSSILRARYGNRIFNFGGDQSDMFSEFEIFAVVTHSGTLESGHYVSFVRLRNQWYRCDDAWITVVDEATVRASQCYMIFYVQKLQHNKANEDPSHVPNSPGRELFLPIAGFC

SEQ ID NO: 190551 - protein, 84 aa, Glycine max
  Coding DNA Sequence Number=SeqID_73773
MSLSLCFIGLDVLRFYALKKEEEEELQMSSTLQNFNALIVKPMIIQCFDQKCKKYRKEGQTGHFKHFSEPWLTQASLWLAWGPK

SEQ ID NO: 190552 - protein, 57 aa, Glycine max
  Coding DNA Sequence Number=SeqID_73774
EKGSENDVSYANKLLKPIGGNMDDVVLMDGVKDNGVLEEAPKESLSIMDQKLGGSEF

SEQ ID NO: 190553 - protein, 72 aa, Glycine max
  Coding DNA Sequence Number=SeqID_73775
MILAPNYDKGSHNAFGRLKKSLQDTTKINCDDSYLASLALVACGVVLRNDKGDFLKAFSTRLGHYTILEVEL

SEQ ID NO: 190554 - protein, 654 aa, Glycine max
  Coding DNA Sequence Number=SeqID_73776
  Gene Ontology: Mol. function=two-component response regulator activity; Cellular component=nucleus; Biological process=two -component signal transduction system (phosphorelay)
  Homolog annotation: Hit_ID=Q6K8X6; Match level="QueryCoverage=56%, HitCoverage=54%, E-value=1e-107, Identity=58%"; Hit description =Putative response regulator 9
  Pfam annotation: Domain name=Myb_DNA-binding; Domain location=208 -258; Score=42.7; E_value=1.3e-09; Accession=PF00249.21; Description =Myb-like DNA-binding domain
  Pfam annotation: Domain name=Response_reg; Domain location=20-133; Score=103.5; E_value=6.3e-28; Accession=PF00072.14; Description =Response regulator receiver domain
  Pfam module annotation: Pfam domain module=Myb_DNA-binding::Response _reg; Domain location=208-258::20-133
MTVVENHTMDDLRDQFPIGMRVLAVDDDSTCLMVLETLLRRCQYHVTTTKNAITALNLLRENKTMFDLVISDVHMPDMDGFKLLELVGLEMDLPVIMLSVNDDPKMVMKGITHGACDYLLKPVRIEELQNIWQHVIRRKKIDSKEQNKTSDYDKTNSDSGNGRGSAATGNSDQNGKPSKKRKDQDEDDDEENDTDHDNEDPSTQKKPRVVWSVELHRKFVSAVNLLGIDKAVPKKILDLMNDEKLTRENVASHLQKYRLYLKRISCGANRQANMVAALGTADSSYLRMGSLSGVGHLQTLTGPQQFHNNAFRPFPPGGMIGRLNTSVGLNNHGLSSSEALQLSHAQNLNNSINDPLKFQSSIACGNQNAIQGMPMSIGLDQLQHNKGVSVSVGPIQNMSPLIDARPTFAVSNRLSDQIPKVTMGCSPSPVLDVSNNALVLKADSENTQGRGVYENLTSVASQHSQFSLPLLGHGRCSDIWSSPMRSSGTNSYPPSETLQGGNLSGASSITSLSNQSHDSQTDMHSQGLIFTNNSGQISNNVPFLGWDDHNHDSSYHSNVIGNSIDSLIDPEGHTSINSTYNRNLDFNFCDPLQMKHDGIMGLSDENSLKQQHRYIMNQQKSQNSRAPNNIGSLEDFVSSMMKQGTDIAKFGPTN

SEQ ID NO: 190555 - protein, 53 aa, Glycine max
  Coding DNA Sequence Number=SeqID_73777
MEKKLERKEVRNKGFEQGFVFQSTRIEDRYTRQHLIRFSSPGARFSTSLMSSH

SEQ ID NO: 190556 - protein, 118 aa, Glycine max
  Coding DNA Sequence Number=SeqID_73778
  Subcellular localization annotation: CTP_CleavageSite=49; ConfidenceScore=5.54e-01
MNNVTLLTSVLRKININFTRLPHKPFVTLTLTLVVLKPLSSLSLTVSVSLAHSESTLSVSLALGLTLNHGLGVIVTLTLTIYWCFGCFRQCRIFIGVLVVFDKVGLPKYPSHTTKQIM

SEQ ID NO: 190557 - protein, 72 aa, Glycine max
  Coding DNA Sequence Number=SeqID_73779
  Subcellular localization annotation: CTP_CleavageSite=55; ConfidenceScore=5.57e-01
AKRSSRAKWTLWAQFASTAKRSFSALSMTRESRRAQESRSRDKCEISLLSETFVSCQAQRTIGAKPKPTYSR

SEQ ID NO: 190558 - protein, 139 aa, Glycine max
  Coding DNA Sequence Number=SeqID_73780
MDIDEDVDIPLILGHPFMLTASCVEFEEKVLKPHYDTHRFTSEDAWNRYADNVLGRNILLERNVKLFVTEFDEFRTELVRRNWHKTLTNLMEGSIDVALVKEFYANLYVPGDKPPKQVRVRGHLINFEADSLNTFLETL

SEQ ID NO: 190559 - protein, 69 aa, Glycine max
  Coding DNA Sequence Number=SeqID_73781
MVNNIFTLSRYKENMVQPKPSVGLKGKPHQHALTHHAFLYFNKQRLGPPRPKSCFGIYPNSRKLSASKN

SEQ ID NO: 190560 - protein, 216 aa, Glycine max
  Coding DNA Sequence Number=SeqID_73782
MRAFGTMAARLGELMLSPEEIGSPKYHKLGAHCFGVQPKEKPSSDEVNHKTGCYYQTINHNPFVVDSPSNRVCQWKRDFVVVFERNFSFTTELPNSKFSFIHQEQPIIEEANFDNEAHAASTDMAMEVYNSHHPSQEYVRFIETTLLKTREALAKALQNRVYVEREAKRWKILGEYLFKKCVDTFLDSSSDDESRDEFFCMLEEKEEATKQKKEKK

SEQ ID NO: 190561 - protein, 854 aa, Glycine max
  Coding DNA Sequence Number=SeqID_73783
  Gene Ontology: Mol. function=actin binding
  Homolog annotation: Hit_ID=Q9LLQ7; Match level="QueryCoverage=30%, HitCoverage=88%, E-value=3e-90, Identity=79%"; Hit description =Phosphatidic acid phosphatase alpha
  Pfam annotation: Domain name=DUF827; Domain location=12-514; Score= -1.3; E_value=2.1e-10; Accession=PF05701.2; Description=Plant protein of unknown function (DUF827)
  Pfam annotation: Domain name=PAP2; Domain location=644-783; Score =95.3; E_value=1.8e-25; Accession=PF01569.12; Description=PAP2 superfamily
  Pfam module annotation: Pfam domain module=DUF827::PAP2; Domain location=12-514::644-783
MDGAELGSKRVGSVKAAVNFYDDKKPSSRTRELHRARRDIGRYKESKWTAESVTAQAEPELSNAKKTAEHLSSMIEESSYKAKTQMIDVESLEKRGKSQHGAIVVAKRNENYEYAQVMRELEYLKKELFKLKLDVASVMDQKSRAEKEIEASNSKMLSCLTTAEELRREIEEANEEQVLAELARIEASKELADIEAQREKEANQFSFNLEIARRKLKEAIEEIDESKELEMKLAVTISDVDFLQNELKSVKDMNKRVQGDGSVKQLEGIFRKGEESEYSIVLQTITEELEAARKELALVREEGFQFMASMDVIRNELKHVTAETDRLKKKEGKVDSTVQNLNSKILRAKSKLEAVSAAEEKVRSIVMSLSHTLEKLKTETADAKKENEDVSQEVAASKEEIQKVEFEIDMTEERLQGIMQELEVAKASEALALEKLKTLTETTMRERALTTQHSSMITISKFEYEYLTNHAASAQEIADKKVAAAEAWIEALKASEKEILMETKIAQRELKETKLEQEQEVYTKEKMLSRRVVSSSEEFDNWPRKREKSSSKNFQRAMSRKSIKLNGTITPARGAKFQKTASPAARHISPFTIKKRKKEFRTREVQLGSHTVSSHGYAVARTHKHDWLILLLLVLIVIGLYVIHPFHRFVGKDMMTDLKYPLKSNTVPVWAVPVYDKWGDVICHGDKKVIKEGYKSFPSGHTSWSFAGLGFLSLYLSGKIKAFDRKGHVAKLCIVFMPLLFASLIGISRVDDYWHHWQDVFAGGLLGLTVATFCYLQFFPPPYHSEGWGPYAYFRMLEESRGMTQVPTVQNSGQELLAEAQVESQEEQGLHGCMGLTLSRDHNATFDDVESGRG

SEQ ID NO: 190562 - protein, 50 aa, Glycine max
  Coding DNA Sequence Number=SeqID_73784
MTNFKDVIFVSDTDTKSLKVENTRHPFSQAKHTKIRDPASSTTSDHVYKQ

SEQ ID NO: 190563 - protein, 853 aa, Glycine max
  Coding DNA Sequence Number=SeqID_73785
  Gene Ontology: Mol. function=binding
  Homolog annotation: Hit_ID=Q5QMW8; Match level="QueryCoverage=99%, HitCoverage=59%, E-value=1e-148, Identity=54%"; Hit description=HEAT repeat-containing protein-like
  Pfam annotation: Domain name=HEAT; Domain location=616-653; Score =4.6; E_value=12; Accession=PF02985.12; Description=HEAT repeat
  Pfam annotation: Domain name=HEAT; Domain location=675-711; Score =7.3; E_value=5.5; Accession=PF02985.12; Description=HEAT repeat
  Pfam annotation: Domain name=HEAT; Domain location=714-750; Score =22.5; E_value=0.0015; Accession=PF02985.12; Description=HEAT repeat
  Pfam annotation: Domain name=LisH; Domain location=152-178; Score =15.6; E_value=0.022; Accession=PF08513.1; Description=LisH
  Pfam annotation: Domain name=LisH; Domain location=6-32; Score=2.5; E_ value=1.1; Accession=PF08513.1; Description=LisH
  Pfam module annotation: Pfam domain module=HEAT::HEAT::HEAT::LisH::Lis H; Domain location=616-653::675-711::714-750::152-178::6-32
MDVERSSLCNCVVNFLLEENYLLTAFELLHELLDDGRDDQAIRLKQFFSDPNLFPPDLISRLNSLRVADPQTLLEEKEAAEEKLAISDYELRLAQEDISKLKSELQKKAENHNELKAEKISGDVSVNDGQQIQQKKNSSFTDLGPLKETERRDLNCAVKEYLLIAGYRLTAMTFYEEVTDQNLDSWHNTPASVPDALRHYYYQYLSSTSEAAEHVSHCILPKLVLRLYSRNKGAEKLFDYMVLLHMTLLYGLRVLILMISLSLETIIQPSKLLFHRHFSLSHGFYMLFVTNQLSQKLLGLQWHIDIMAMLTSSLVFKLNWSVYVGFRTTEQEKFSLLRENETLLNANKRLNQEKENLLKNKDMADAQIVTLTKSLDAMQKDLKDKENLVQVLKQSLEHQRKELNDCRAEITSLKVHIEGSHLGNNLVISDVNNVQSESLEKYKEEMKKLQMENEWLKEKNIRSPEPGNFVGSEKENLQINDKVIEIHEDQGAISDPIDVALGAVHNEDAQSPVVQTLAQYADKHEDTLPELFNPANTNNAFKNIKNVSEQNVGQQAEDSSLLVKSDSVNDGAISERTASSLYSWLEEILKHYYLLGLGTIQILADALPKIVPYVLINHREELLPLIMCAIERHPDSSTRDSLTHTLFNLIKRPDEQQRRIIMDACVNLAKNVGEMRTETELLPQCWEQISHMYEERRLLVAQSCGELADFVRLEIRNSLILSIVQQLIEDSASVVREAAARNLAMLLPLFPNMDKYFKVEDMMFQLVCDPSGVVVETTLKELVPAVIKWGNKLDHVLRVLLSHIVNSALRCPPLSGVEGSIESNLRVLGERERWNIDILLRMLAELLSWVHQK

SEQ ID NO: 190564 - protein, 282 aa, Glycine max
  Coding DNA Sequence Number=SeqID_73786
MESLSPMSIYDGIKSYLRRRRYRRLHGGTTVVRRKMAIIRLRGPRRNWRVRAIPRLRWVMRSPLKMLTKLKNAYMNFMLRLSRNVGAINSDNIFEVKRIPKARQVYKGYSSDEFEARLIFEISKTLVASYELHPIVDKSYPSISTQQPQQVSKAKVMESRTNADSFWTWNANNDNNQKQFSVTKFLGNNKPPKPQTSVLGPGFGAGIGCGAGIGLGLVGGFGYGGWPFNHMHLVFGLGMGCGVGVGFGFGQGIGYDFNFRTRKSRKSKKNFSDPQNTIVIQI

SEQ ID NO: 190565 - protein, 111 aa, Glycine max
  Coding DNA Sequence Number=SeqID_73787
  Gene Ontology: Mol. function=DNA binding; Biological process=DNA integration
  Homolog annotation: Hit_ID=Q1SXQ3; Match level="QueryCoverage=84%, HitCoverage=15%, E-value=4e-19, Identity=40%"; Hit description =Integrase, catalytic region
MDIKSGFLNDFIEEEVYVRQPPNFVDHTLLDHIFKLQKASYGLKQAPYAWASDQERQQRFLHPATKYTKELLKKFKMEDAKTMKTPMHASNLLSKGELDFNLILENHILRL

SEQ ID NO: 190566 - protein, 100 aa, Glycine max
  Coding DNA Sequence Number=SeqID_73788
  Gene Ontology: Mol. function=RNA-directed DNA polymerase activity; Biological process=RNA-dependent DNA replication
MAAHSATQHSSFEIMYGFNPLTPLDLFPLPNNFVLKYKDGDEELKSRSNSLKEGRDGENQKRNKDTEAIQGLGGPMTRARAKKEKEALNQMVATFIEPDS

SEQ ID NO: 190567 - protein, 74 aa, Glycine max
  Coding DNA Sequence Number=SeqID_73789
  Subcellular localization annotation: CTP_CleavageSite=44; ConfidenceScore=5.47e-01
MAKRSTSVLSELSTRLALSSNSLTHAKRNNGAKRLKSVNFRECRAEQGAKFSSFREISEFLSDCEIPRGGGDIP

SEQ ID NO: 190568 - protein, 46 aa, Glycine max
  Coding DNA Sequence Number=SeqID_73790
MDLITSLSAPLHAYLYQNKAFEVMTARPGELLLHPEATLLAQASWN

SEQ ID NO: 190569 - protein, 193 aa, Glycine max
  Coding DNA Sequence Number=SeqID_73791
  Gene Ontology: Mol. function=RNA-directed DNA polymerase activity; Biological process=RNA-dependent DNA replication
MAVFCLVPDVIIPPKFKVSDFAKYKGTAYPKNQLKMYCQKMGAYTKDEKLLMHFFQESLVGAVVTWYTNLESSQVYSWKDLIVAFIRQHQYNSVIAPDIMQLQNMCKQEHESFKEYAQRWRDLAAQVAPPMMEREMITMIVNTLPVLYYKKLVGYTPSSFADLVFTGERIEVGLRRGKFDYPVIEAVPKSNKH

SEQ ID NO: 190570 - protein, 153 aa, Glycine max
  Coding DNA Sequence Number=SeqID_73792
  Gene Ontology: Mol. function=DNA binding; Cellular component =mitochondrion; Biological process=DNA integration
MEDAKPMKTPMHASNPFRKEESSKLVQQTIYRDYARDGVERKSSSGGCHYIGHCLISWASKKQNSISLSTTEAEYGSIASYCSQLLWVKYQLEDYSSLENNILVYCHNTSAIDLSKNQIQHSKAKHIEKRYHFIYNYVQKDVFDIKFIDTYHQ

SEQ ID NO: 190571 - protein, 371 aa, Glycine max
  Coding DNA Sequence Number=SeqID_73793
  Gene Ontology: Mol. function=RNA-directed DNA polymerase activity; Biological process=RNA-dependent DNA replication
MKRLMRRRHVPFHYHRDLHNKLQRLTQGNKSIDEYYKEMEEDGEIMSDFSSDFVPSSDEEEHEEEKEAEGDLFMVRRMLGSQAVELDECQRENIFHTRLKLREKLKKYAKHANKGRKQVVFEPGDWVWIQMRKERFLAQRTSKLQPRGGDPFQVLSIINDNAYMIDLPSDYGADGFNSRSNSLREEGDNEDNVKSMDLEAEHGFDGPITRARAKEMYNKIYRLRNAKEIWDSLSINYEGTEDVRLRKVTNLTKHNKSFTKKDGELMDDMFGRLHVLLNNLEALGQTYSKAQINLKVLTKFIKKNSSTLKSEEISFRRKEKKSSSKALKVQMHEFDGSNNFDGSKDNGVDLMSRNFKQMMKKKGKFQHSSRR

SEQ ID NO: 190572 - protein, 291 aa, Glycine max
  Coding DNA Sequence Number=SeqID_73794
  Gene Ontology: Cellular component=integral to membrane; Biological process=maltose metabolic process
  Homolog annotation: Hit_ID=Q0GR04; Match level="QueryCoverage=81%, HitCoverage=56%, E-value=6e-99, Identity=71%"; Hit description =Maltose transporter
MQGMLTSLLGNLSLLSYFAKKREKEAMVVQTLGVVSTYVVLVQLALAETMPLPYFLATSVVVISGLVLNFLNYFGILNAGIWRFWEDFITIGGLSVLPQIMWSTFVPYVPNSILPGATSFVIAVLAVTLARTGKLSEKGVKFVGGISGWTATLLFMWMPVSQMWTNYLNPENMKGLSAFSMLLAMLGNGLMLPRALLIRDFMWFTGSVWATLFYGYGNIACLYYLNIISKEFFLSATVGLISFIGYSLNPIALINTLSHVSVAMPRLCYVIFEPCPHRLMYNISISPVVMQ

SEQ ID NO: 190573 - protein, 162 aa, Glycine max
  Coding DNA Sequence Number=SeqID_73795
  Gene Ontology: Mol. function=sequence-specific DNA binding; Cellular component=intracellular; Biological process=regulation of transcription, DNA-dependent
  Homolog annotation: Hit_ID=Q00ZC0; Match level="QueryCoverage=65%, HitCoverage=16%, E-value=3e-23, Identity=48%"; Hit description=[K] KOG1657 CCAAT-binding factor
  Pfam annotation: Domain name=CBFD_NFYB_HMF; Domain location=41-105; Score=69.5; E_value=1.1e-17; Accession=PF00808.13; Description =Histone-like transcription factor (CBFNF-Y) and archaeal histone
  Pfam annotation: Domain name=Histone; Domain location=38-107; Score =23.3; E_value=0.00071; Accession=PF00125.14; Description=Core histone H2AH2BH3H4
  Pfam module annotation: Pfam domain module=CBFD_NFYB_HMF::Histone; Domain location=41-105::38-107
MRVVSNRVPQNHQDREEEKLRSFWEKQLLNIQIAEAFKSQQKLPLARIRRMMKSEPGVQMISSEIPMLMSKACEIFIQELTFRAWMHAEKNNKSIVQPCDVAKVIMQTDTMNFLTEIIPNNLGDFSVFDAKEENIANIAEENEVSLSFTAGFMGNPMMKMDS

SEQ ID NO: 190574 - protein, 276 aa, Glycine max
  Coding DNA Sequence Number=SeqID_73796
  Gene Ontology: Mol. function=DNA topoisomerase (ATP-hydrolyzing) activity; Cellular component=chromosome; Biological process=DNA topological change
  Homolog annotation: Hit_ID=P30181; Match level="QueryCoverage=69%, HitCoverage=22%, E-value=1e-37, Identity=42%"; Hit description=DNA topoisomerase 1
  Pfam annotation: Domain name=Topoisom_I_N; Domain location=160-276; Score=11.0; E_value=8.9e-11; Accession=PF02919.5; Description =Eukaryotic DNA topoisomerase I, DNA b
MAVKTSDEPNLAHDFDDDDDDGPVIYKRYSSSKKNQLHSDVRKSSSHSHDGQISNAPSAKPSPVKPSVGISNASNSLINTSSMKLPVANPKSPSLGDKQKMSIDVKEKSKSIDYCAKDYCEDSEDDEDNKPFIQHLLRSSGSSEYSKATKLLPSAGDGQNKRTTLVHNAVIFPPYQPHGVKMLYKGKPAEQEEPCEIQTDYMPKDRFKENFWNDWRKLLGRNHVIQNLKDCDFIPIYDWYQSEKEKKKGMTAEVGNFRVEQPKSEFSDTVISYKEM

SEQ ID NO: 190575 - protein, 207 aa, Glycine max
  Coding DNA Sequence Number=SeqID_73797
MKKKGRLHMLQCFSLSLKYHCKEDILRLESIYGATEFVPFDAMKDLASKSEDEDSINWLLMQSYPPRALDRILQEDWSRDVGKGPRVLMSLKWHLQSPFLLLHSATINLQEAKDSNNEEDPRPTSSTWRKNPSRNPSPPNLKSIICEHRPSKRKVYPLGATVWRSKEVVYDEMPFSTPLDLHQLLSLMAIFNVVLPWNCAKSGRSSK

SEQ ID NO: 190576 - protein, 164 aa, Glycine max
  Coding DNA Sequence Number=SeqID_73798
MASYGAHYSGLESEENPPSNGVHHIIRRCFQTINHNPFVVDSPSNHVCVWKRDFVVSEHNFSFIIDHPNSIFTFTHHIKPIIKEVNFDDEASVVSEDMVMEVNDGPPPSREYVHLIKEALLKTRKAFVEALHDHTHTEGEVKRWKLFEDYFIRKHIEAPSRYLL

SEQ ID NO: 190577 - protein, 137 aa, Glycine max
  Coding DNA Sequence Number=SeqID_73799
  Gene Ontology: Mol. function=protein disulfide isomerase activity; Cellular component=endoplasmic reticulum; Biological process=cell redox homeostasis
  Homolog annotation: Hit_ID=P29828; Match level="QueryCoverage=71%, HitCoverage=21%, E-value=1e-34, Identity=67%"; Hit description =Protein disulfide-isomerase precursor
MAGIHDISRHVQNRKGMDVQEYKGPREVDGIVDYLKKQSGPASTKIKFADEPTSFVGENKVVIEFDNFSALAEKLHSDYDFGHPLNVKLLPRGESSVSGPIVRLSKPFTGLFVDFQVIIYIVYHYYYIVPYNCVLLS

SEQ ID NO: 190578 - protein, 184 aa, Glycine max
  Coding DNA Sequence Number=SeqID_73800
  Pfam annotation: Domain name=zf-CCHC; Domain location=8-25; Score =17.7; E_value=0.0012; Accession=PF00098.13; Description=Zinc knuckle
MQEKTSSIKCFKCLGRGHITSQCLTKNTMIMRSQDIYSSQDEATTSPSSSESEEAKGEESSEEIYPQEEGQPLIVKEECKEVSVSSKRLAKKERNFEIKTNFKEISPLRQPPHFLLCKKTLVSIATPLGLELIPQVKELLDEGLVRKSLNPYALLVPKIGVEERIPVIEAVPESNKHENAVTRK

SEQ ID NO: 190579 - protein, 241 aa, Glycine max
  Coding DNA Sequence Number=SeqID_73801
EENVGNITEESQVVLPYTDGFMENHIDMMNMSYDLEAGNQLIPQPNMMQPPFMPSDQLPYNFQPNTQLELIKIKYALDSVQFRQNTSHRKVFSSKCWGILHEAFEPLTLSKAILLRAWLRHIYKGVNVDHYSFNSQSEYEELGTGDWSNQNLWEWADWEAMCAGARSNKGGAGSSCPLKVIGSVLQPGPKVVFVAFFLFSQEAWRDPSLRKSFKLNCHPVQQPVSNNMCPEEFPIFNSSYP

SEQ ID NO: 190580 - protein, 421 aa, Glycine max
  Coding DNA Sequence Number=SeqID_73802
MGDFSWRPLVKQVEPDDRVVPSSAVEPPIVERGQPTDKVDHNDNEFLEGSSLASLVVQASIVAPPPSSLPTQEVFVSPPTMVTVPVLLATTIIAPPFPIVAPFLSMLSMGYRSEKGTLVGFVSSFDKNHIQLVGVQNATDSVKVEVDKWRDIAQTFWRLERPKVANTIVTFAEAIRSNQHMSSKIGDALAKLLHTKLDGDKMFERCKDKFANVVVDLQARSKELESKMEESELGALEEMVNNKELEEELLASFFTKEHDLGLFNPLKDMKDDEIFDEEEIVAAEEYADKEKANMAIVKGLVNHLGDASFWRELTKGVPWVSVGALTKVGPSVSCIPRLDLGFNKLWTKEVFILAFEEARLTKGGPWVCELFGDVRLTQADLGFDAPLEKQNSLRVDLAFDDPLEMRNSPRLDLGFDEPLEK

SEQ ID NO: 190581 - protein, 74 aa, Glycine max
  Coding DNA Sequence Number=SeqID_73803
  Homolog annotation: Hit_ID=O22058; Match level="QueryCoverage=52%, HitCoverage=6%, E-value=2e-09, Identity=74%"; Hit description =Plastid RNA polymerase sigma-subunit precursor
MGKGGAMIVVAKRTGTVAPFLRWVARQQTMAQPYHQARYVGVLQGVGRFDSSRGYKFSTYVQYWIRKSILRVVA

SEQ ID NO: 190582 - protein, 141 aa, Glycine max
  Coding DNA Sequence Number=SeqID_73804
  Subcellular localization annotation: CTP_CleavageSite=77; ConfidenceScore=5.24e-01
MKKRTEWSTDGPIILHAKGGKCIFRSILSSLPRKSFLPLLSSAKASFLGGLLLREASPPSSSPRGFSLPFAFEMNLRVEETGKNGGRLVTVSLPEDPLGVLPEVSEEDLPEDFRKKGSFGSNETTSGRTGLPESSRNTSSG

SEQ ID NO: 190583 - protein, 115 aa, Glycine max
  Coding DNA Sequence Number=SeqID_73805
MGINDVYIQVKLSRVWQGNEEIEIMRGVLVKEKFKQTVKWRNCPSAILLSEEDFFQKISGKPLSGNFPEEPSSGRSICDFRNYSETTSGRTSSGMFPEEASSGRFPFSSGNLFFL

SEQ ID NO: 190584 - protein, 38 aa, Glycine max
  Coding DNA Sequence Number=SeqID_73806
MEMERSEGIMFQDITTLLLSVVAGIMFQDITTFCFTGW

SEQ ID NO: 190585 - protein, 120 aa, Glycine max
  Coding DNA Sequence Number=SeqID_73807
MAGVGSSSYKGNDSILFCFHCKSKTTTFINGWQLRSGGLALLCQNCGIQILYWELQLPDKVLTNVGLIHPNILAKSNMGAARTQAPTTTNYDVGSATWADLRKAPLQSAMEVTSLGHRPS

SEQ ID NO: 190586 - protein, 104 aa, Glycine max
  Coding DNA Sequence Number=SeqID_73808
MKLAHFETLSFSRTSLLRCCHSLVDHRHRVTMSLEPAMVEALCLDDNHYWTCKHMHEVGRECRADVDTLTESDVDYMQRLTVEVTGHKAHGPVPQPGSVVIARV

SEQ ID NO: 190587 - protein, 411 aa, Glycine max
  Coding DNA Sequence Number=SeqID_73809
  Gene Ontology: Mol. function=drug transporter activity; Cellular component=membrane; Biological process=multidrug transport
  Homolog annotation: Hit_ID=Q10A00; Match level="QueryCoverage=96%, HitCoverage=95%, E-value=2e-65, Identity=35%"; Hit description=MATE efflux family protein, expressed
  Pfam annotation: Domain name=MatE; Domain location=190-353; Score =134.5; E_value=2.9e-37; Accession=PF01554.9; Description=MatE
  Pfam annotation: Domain name=MatE; Domain location=37-189; Score =85.2; E_value=2e-22; Accession=PF01554.9; Description=MatE
  Pfam module annotation: Pfam domain module=MatE::MatE; Domain location=190-353::37-189
  Subcellular localization annotation: CTP_CleavageSite=52; ConfidenceScore=5.23e-01
MEETLLPKENKRVTLTNSKSSSGFVQELKNVSLMAAPMVVVSVSQFLLQVVSLMMAGHLGELSLAGVALATSFADVTGFSILMGMAGALETQCGQSFGAEQFHKLGNYVFCAILSLILSSVPISIIWIFMDKLLILLGQDHAISLIAGNYCIWLIPALFGYAVLQALKTKIALGSNALRSIKEFFFLAIPSALMICFEWWSFELVVILAGLLPNPKLETSVLSICLNICTLHYFIPYGTGAAVSTRVSNELGARRPQAAREAVFAVIVLAFTDAVVFSSVLFCFRHVLGFAFSNEMEVVHYVAKIVPVLCLSFMVDGFLGVLCGIVRGSGWQKIGAITNLVAYYAVGIPVSLLFGFGLNFNGKGLWIGILTGSTLQTIILALLTAFTNWEKQVLNSVLYLLFYVLTYSKNQ

SEQ ID NO: 190588 - protein, 74 aa, Glycine max
  Coding DNA Sequence Number=SeqID_73810
  Subcellular localization annotation: CTP_CleavageSite=41; ConfidenceScore=5.16e-01
MVSEMSKQDGTPPSLSSDLACCCNMVVLRRKRLCQGRRRISAGKGRTWRSRNYIGKGKGRRWSMRRFLGLLSSK

SEQ ID NO: 190589 - protein, 72 aa, Glycine max
  Coding DNA Sequence Number=SeqID_73811
MKAEKFDRDWKKIEAFVGSKTVIQVAIFVPLLLNYNFHLRIALFGALLLCSALRLQFPFSAIGLKANSSSSI

SEQ ID NO: 190590 - protein, 372 aa, Glycine max
  Coding DNA Sequence Number=SeqID_73812
  Gene Ontology: Mol. function=protein serine/threonine kinase activity; Cellular component=integral to membrane; Biological process=protein amino acid phosphorylation
  Homolog annotation: Hit_ID=Q2R0X3; Match level="QueryCoverage=91%, HitCoverage=38%, E-value=1e-53, Identity=33%"; Hit description =Leucine Rich Repeat family protein
  Pfam annotation: Domain name=Pkinase; Domain location=111-334; Score=- 12.5; E_value=8.1e-08; Accession=PF00069.15; Description=Protein kinase domain
  Pfam annotation: Domain name=Pkinase_Tyr; Domain location=111-359; Score=-83.7; E_value=2.4e-07; Accession=PF07714.7; Description =Protein tyrosine kinase
  Pfam module annotation: Pfam domain module=Pkinase::Pkinase_Tyr; Domain location=111-334::111-359
MAKIQGPKEGKPILIFTMKSGPYLGPWAQKSTLSVSFNLLDGEVPTKGVFQNASGFVVTSTLIFVEVFQNYIYHHALSKRKRSKKSYLDSPTIDRLPKVSYQSLHNGTHRFSSTNLFGFRNFSSVYKGTLELEDKGVAIKYMKNGSLEQWLHPGTLSAKHLRTLNLDQRLNIMIDVAFALEYLHHECVQSIIHCDLKPSNVLLDDGMIARVSDLGVARIISTINGTSSTQTSIVGMKGTTGYAPLEYGMGSKVSMNGDMYSFEILMLEMLTGRRPTDEIFKNGENLHHFVENSFPNNLLQILHPSLIPKQGKAIIEEENTCILAPTIGKCLVSVFKIGLACSAESPKERMNTVDVTRELSKIRKVFYPGKIN

SEQ ID NO: 190591 - protein, 118 aa, Glycine max
  Coding DNA Sequence Number=SeqID_73813
MALAKELAALKLSYKELMANCTILGRGKARYSKKLEKVKEKITKLKQRHNRHEKRSKECFGANGCKESNVTVDTKQENLPERDDGSEKGGFATRAQPGWLCKTLRGGLRTIEVKRVAL

SEQ ID NO: 190592 - protein, 74 aa, Glycine max
  Coding DNA Sequence Number=SeqID_73814
MACTHIPPSKLPHVWHLLSMSGFTRDSPQISASPHQFDLAPYASEPYNAQWNAPGLLRDKHTLRFESYSRRNGG

SEQ ID NO: 190593 - protein, 107 aa, Glycine max
  Coding DNA Sequence Number=SeqID_73815
MVVQLLVLAQRKMLSSGFDDTPQSKSKATARWIVAKRLEVLRIQQASYYLKVKNETISVKCRNLPFGGRATRDSRVRLPRKEYARSRHQRLFEENVGKTGKDVVYEF

SEQ ID NO: 190594 - protein, 264 aa, Glycine max
  Coding DNA Sequence Number=SeqID_73816
  Gene Ontology: Mol. function=RNA-directed DNA polymerase activity; Biological process=RNA-dependent DNA replication
  Homolog annotation: Hit_ID=Q1RYI2; Match level="QueryCoverage=25%, HitCoverage=10%, E-value=2e-12, Identity=46%"; Hit description =Ribonuclease H
MVARHVMSDSFMMKVAWESSTRMDSLWVRVVKAKYGCGNDLKPMINKDRHGSNLWRGIKAVWDSFDENCDWTILGSNGVLALVANRELEDVVKKVDDVFSNGVGCDTNYLHNSRVDIVSWKLGSDGSFSLKSAYGFNAKVDPKGRWRVPFFLEPNIWSSAGFALAEQKQQGFWWQYIWSNETLLAQLSHMNMPWNANKKLQDLLPDVSVRSQGVFTWIITEGGNIIVNCDGVVSHSTRKVVCGGVLRNSTATFLGAFSECGAAR

SEQ ID NO: 190595 - protein, 479 aa, Glycine max
  Coding DNA Sequence Number=SeqID_73817
  Gene Ontology: Mol. function=transferase activity; Biological process= paclitaxel biosynthetic process
  Homolog annotation: Hit_ID=Q94CD1; Match level="QueryCoverage=99%, HitCoverage=97%, E-value=4e-42, Identity=26%"; Hit description =Putative N-hydroxycinnamoyl/benzoyltransferase
  Pfam annotation: Domain name=Transferase; Domain location=13-478; Score=178.4; E_value=1.8e-50; Accession=PF02458.6; Description =Transferase family
MAAPHDNDPRNIVSISRIVSVHPKLVQPQRVLTLSNLDRQCPNLMHLVFFYNNLPHQTLKDLSLNSVFSNLKSGLEETLTLWYPSAGRLGTNQSDGKLNLWCNNQGAVLAEAETCVKISQLGNLSEYNEFFEKLVYKPDFDKNFSNMPLIVAQVTKFGCGGYSIGIGTSHSLFDGPATYDFLYAWASNSEIVKGRSRSDDELPKPVHERGIILSGSLQATRGTINFPSDSSSNVKQVRAMAIDHLYQLIMQTASGQNGFPMQIGGPSNPKKCVLKTYHLSGDMIEDLKRKHFPMQRGSLPFSTFEVLAAHLWKARTKALGVKKEKLVCFQFAVDIRNKMTPPLPKSFSGNAYVLASIMMSVAELEQTSHEFIVDKIREAKNSVNHNYVKAYVGALDGPQQGSSLPPLKELTLVSDWTRMPFHNIEFFRGKATYASPLATPMPQVAYFMQSPSDHKGVDVRIGFEAENISAFSECFLSMA

SEQ ID NO: 190596 - protein, 59 aa, Glycine max
  Coding DNA Sequence Number=SeqID_73818
MVGSMETPIKGFNHVQYVSKMSLDDEFLQFTPRTTLQAMKEAYRKNDMKEDFTFVILLL

SEQ ID NO: 190597 - protein, 370 aa, Glycine max
  Coding DNA Sequence Number=SeqID_73819
  Gene Ontology: Mol. function=nucleic acid binding; Cellular component= chromatin; Biological process=chromatin assembly or disassembly
  Homolog annotation: Hit_ID=Q9S775; Match level="QueryCoverage=78%, HitCoverage=20%, E-value=7e-35, Identity=31%"; Hit description=CHD3 -type chromatin remodeling factor PICKLE
MTGLKGAKIWKEEHDLVLLHAVLKHGYGRWHDIVDDKDLKIQEVITQELNIPFTKLPVHGQVCSQVYNSANMTNVESSCNPSAETDKSDIADDGANMTNLQSSCNQSKESGVSNIAAEGAHGSGDSGNQAQFRDMQRRHIEFIKKRFLLLEKGLNAEYQKEYFSDLKVNEVENDEPKADIQMIGQLPRIEAIGSEEISISAYDCDPDRLQLVCLYNKMCKTVEENTMNLIQELSARELTEVNVIKNFHQLEIISADVNRILNQQNKCSAETQVLNSNKSNTLSQTEVVGSGLLSSSQDKCKAEDVVMVCEPKKESDQLTSSSVEVGFVDIVEGARERENLQEGDGNEPSRLSRVYDSARLGLFTIKDEVA

SEQ ID NO: 190598 - protein, 90 aa, Glycine max
  Coding DNA Sequence Number=SeqID_73820
MKKKKIAIYGSRFDEEMSEIGRFGGLGMEERRKEEGAAQGFLENVIFIEQDAWRRQPTGNRLHEYCNRLQAICSSVIDYSIHVIDYQNIK

SEQ ID NO: 190599 - protein, 86 aa, Glycine max
  Coding DNA Sequence Number=SeqID_73821
MTKLKTEGWNRLRRGRRRERWRRGAIPVPGRWRVGFTCRRSRGTKTASLTLVSLEKMAARNDGGGGRRRRTVDRTRSDADLKTEVS

SEQ ID NO: 190600 - protein, 214 aa, Glycine max
  Coding DNA Sequence Number=SeqID_73822
  Gene Ontology: Mol. function=DNA binding
  Homolog annotation: Hit_ID=Q1T4X2; Match level="QueryCoverage=90%, HitCoverage=32%, E-value=5e-30, Identity=41%"; Hit description =Pentatricopeptide repeat
MWALRRASIPLRTRGFNVRASCVKLAGTSSVEEEDVINESHGITYGGFLSPNMRFHSVHNASLNFTVGKRALSSSSTKEEDDLEDGFSELEMPAGSGYESEDLLTSDDGDLSDDGQKEDVEEPPHNEVDEAAKEKGNPRRGRVESKLFNEIMNAQGISLHSVLEKWLEKGNELTREEVSLAMLYLRKRKLFGRALLICIEKQAFIVFSVSYTNL

SEQ ID NO: 190601 - protein, 426 aa, Glycine max
  Coding DNA Sequence Number=SeqID_73823
  Gene Ontology: Mol. function=DNA binding; Cellular component =mitochondrion; Biological process=protein amino acid phosphorylation
  Homolog annotation: Hit_ID=Q1T4X2; Match level="QueryCoverage=97%, HitCoverage=64%, E-value=0.0, Identity=73%"; Hit description =Pentatricopeptide repeat
  Pfam annotation: Domain name=PPR; Domain location=130-164; Score =25.3; E_value=0.00022; Accession=PF01535.11; Description=PPR repeat
  Pfam annotation: Domain name=PPR; Domain location=165-199; Score=6.5; E_value=1.3; Accession=PF01535.11; Description=PPR repeat
  Pfam annotation: Domain name=PPR; Domain location=266-300; Score =15.7; E_value=0.1; Accession=PF01535.11; Description=PPR repeat
  Pfam annotation: Domain name=PPR; Domain location=301-335; Score=6.9; E_value=1.1; Accession=PF01535.11; Description=PPR repeat
  Pfam annotation: Domain name=PPR; Domain location=337-370; Score =10.9; E_value=0.39; Accession=PF01535.11; Description=PPR repeat
  Pfam annotation: Domain name=PPR; Domain location=61-95; Score=23.5; E_value=0.00077; Accession=PF01535.11; Description=PPR repeat
  Pfam module annotation: Pfam domain module=PPR::PPR::PPR::PPR::PPR::PP R; Domain location=130-164::165-199::266-300::301-335::337-370::61-95
MILVLHIDQLQMLSEWLESKKEFEFIERDYASRLDLIAKLRGLHKAEVYIETIPESCSREIMYRTLLANCVSQNNVKKAEEVFSKMKDLDFPITVFTCNQLLFLYKRNDRKKIADVLLLMENENINPSSHTYSILIDTKGQSKDIDGMDQIVDRMKAQGIEPDINTQAVLIRHYISSGLQDKAETLLKEMEGENLKQNRWLCRILLPLYANLGKVDEVGRIWKVCETNPRYDECLGAIEAWGKLNKIDEAEKVFEIMVKKWKLSSKTCSILLKVYANNKMLMKGKDLIKRMGDGGCRIGPLTWDAIVKLYVQAGEVEKADSVLQKAAQQSQMKPIFSTYLTILEQYANRGDIHNSEKIFLRMKQADYPSKAKMYQVLMNAYINAKVPAYGIRDRLRADSIYPNRNLANQLVQVDGFRKNPVSDLLD

SEQ ID NO: 190602 - protein, 41 aa, Glycine max
  Coding DNA Sequence Number=SeqID_73824
MECKKLWQIKSEDVEANLEQIQESPAGGGQWQLSEAKMWPK

SEQ ID NO: 190603 - protein, 149 aa, Glycine max
  Coding DNA Sequence Number=SeqID_73825
  Subcellular localization annotation: CTP_CleavageSite=49; ConfidenceScore=5.40e-01
MMAHHSASPFPHFRFSLSPLKTLSFSRNPQNLSRKNNDLKLINHLIVVKFKHQVCNPIPSILTVGNCKNMSEIRGIPFAPYSAHLLTFGFCEIIFKEKEKRIARRQYIWRLQSILRLVDIWELYQSSRRKNLRNLREPLKMPLLLSEDT

SEQ ID NO: 190604 - protein, 291 aa, Glycine max
  Coding DNA Sequence Number=SeqID_73826
  Gene Ontology: Mol. function=nucleic acid binding; Cellular component= chromatin; Biological process=chromatin assembly or disassembly
  Homolog annotation: Hit_ID=Q9S775; Match level="QueryCoverage=84%, HitCoverage=17%, E-value=1e-118, Identity=82%"; Hit description=CHD3- type chromatin remodeling factor PICKLE
  Pfam annotation: Domain name=Helicase_C; Domain location=119-198; Score=92.6; E_value=1.2e-24; Accession=PF00271.21; Description =Helicase conserved C-terminal domain
MKELPPKKELILRVELCSKQKEYYKAILTRNYQILTHQGGAHISLINVVMELRKLCCHPYMLQGVQPDLKDEKESYKQFLESSGKLQLLDKMMVKLKEQGHRVLIYSQFQHMLDLLEDYCVYKHWQYERIDGKVGGAERQVRIDRFNAKNSSRFCFILSTRAGGLGINLTTADTVIIYDSDWNPHADLQAMARAHRLGQTNKVMIYRLITRGTIEERMIQITKKKMVLEHLVVGSLKAQNINQASICSRSLKFQEISVLLNTTSAIVNSGIGFESKLTSKCNCVVPVPWPP

SEQ ID NO: 190605 - protein, 203 aa, Glycine max
  Coding DNA Sequence Number=SeqID_73827
  Gene Ontology: Mol. function=DNA-directed DNA polymerase activity; Biological process=DNA replication
  Homolog annotation: Hit_ID=Q10QM0; Match level="QueryCoverage=76%, HitCoverage=37%, E-value=3e-39, Identity=51%"; Hit description=PHP domain C-terminal region family protein, expressed
  Pfam annotation: Domain name=PHP; Domain location=80-203; Score=27.9; E_value=1.7e-05; Accession=PF02811.9; Description=PHP domain
  Subcellular localization annotation: CTP_CleavageSite=49; ConfidenceScore=5.50e-01
MGDGCVIEGTTGNSNSNNNNNNKKKNKKKKNRGGSKKKMTHKQDHPSVSSSSSSSSAAPRVVDDFGVQKLLGRGGEKLLFELHSHSKFSDGFFSPSKVVERAHINAMKVLALTNHETMSGIPEAVESACKYGIKIIPGVEISTIFSPRGDSEVEEPVHILAYYSCIGPSRFEELDKFLSNIRDGCFLHAQNICLKTEQAQVAS

SEQ ID NO: 190606 - protein, 199 aa, Glycine max
  Coding DNA Sequence Number=SeqID_73828
MAEVDEVEERMKADMEAMKEQMTTMMEAMMSMKKIMENKHVFPPYGLPPNYTPPNENVNNSTPILIESQQPQSDHAHVSQPMGETHEIPHQNLANFEPHLGYAIEGQAVSDIPLQNTLEGPQYHPQPHPLHSTAGKNPHAMAEMGKLDHLEERLRAIEGGRDYAFANLEKLFLVPNIVTPPKFKCRTLTVQGTTCPRTI

SEQ ID NO: 190607 - protein, 139 aa, Glycine max
  Coding DNA Sequence Number=SeqID_73829
MVLVEFSLTRGICGLCLIKIRLNYHEESGFSISRDTIKTHEHYSLYTYSYSHLPLHTRHLFAEIAYQITQDLEIEATLRRNKAERRRKLLQDITVASILKEETHFSDLLSPDSPSSRESATQLPEVITMAEEHDQRITL

SEQ ID NO: 190608 - protein, 96 aa, Glycine max
  Coding DNA Sequence Number=SeqID_73830
  Gene Ontology: Mol. function=DNA-directed DNA polymerase activity; Biological process=DNA replication
  Homolog annotation: Hit_ID=Q9ZQI9; Match level="QueryCoverage=86%, HitCoverage=19%, E-value=8e-24, Identity=59%"; Hit description =Expressed protein
IGGSDYHGTGGHNESELGSVNLPVIVLHDFLKVARPIWCNAIREILECYAEEPSDSNLATITRFGRTCSFKGGSPLSCGQDLIDHLSSQEMEKCRV

SEQ ID NO: 190609 - protein, 361 aa, Glycine max
  Coding DNA Sequence Number=SeqID_73831
  Gene Ontology: Mol. function=nucleic acid binding; Cellular component= chromatin; Biological process=chromatin assembly or disassembly
  Homolog annotation: Hit_ID=Q9S775; Match level="QueryCoverage=93%, HitCoverage=23%, E-value=1e-124, Identity=68%"; Hit description=CHD3- type chromatin remodeling factor PICKLE
  Pfam annotation: Domain name=Chromo; Domain location=26-78; Score =33.6; E_value=6.9e-07; Accession=PF00385.14; Description='chromo' (CHRromatin Organisation MOdifier
  Pfam annotation: Domain name=DEAD; Domain location=137-310; Score= -34.8; E_value=0.0048; Accession=PF00270.19; Description=DEADDEAH box helicase
  Pfam annotation: Domain name=ResIII; Domain location=119-304; Score =7.1; E_value=1.2e-05; Accession=PF04851.6; Description=Type III restriction enzyme, res subunit
  Pfam annotation: Domain name=SNF2_N; Domain location=125-360; Score =206.4; E_value=6.6e-59; Accession=PF00176.13; Description=SNF2 family N-terminal domain
  Pfam module annotation: Pfam domain module=Chromo::DEAD::ResIII::SNF2_ N; Domain location=26-78::137-310::119-304::125-360
MKTVTGRVYIVDIYIRLPNWSSDGNSLAECIENSTKRGHDDKKEYLVKWKELPYDECYWELKSDISAFQTEIERFNTFKSRSRKLLSSKKKRSVEDDAELNKQQKEFLQYEHSLQFLSGGALHSYQLEGLNFLRFSWYKQTHVILADEMGLGKTIQSIAFLASLFEENVSPHLVVAPLSTLRNWEREFATWAPQMNVVMYFGSAKARAFIREYEFYFPKNQKRIKKKKSRQIVNESKQERIKFDVLLTSYEIINSDTSSLKHIKWECMIVDEGHRLKNKDSKLFSSLKQYSSKHRVLLTGTPLQNNLDELFMLMHFLDAGKFGSLEEFQEEFKDINREEQILRLHKMLAPHLLRSIHLSYS

SEQ ID NO: 190610 - protein, 566 aa, Glycine max
  Coding DNA Sequence Number=SeqID_73832
  Gene Ontology: Mol. function=microtubule binding; Cellular component =cortical microtubule, transverse to long axis; Biological process =cytoskeleton organization and biogenesis
  Homolog annotation: Hit_ID=Q6Z746; Match level="QueryCoverage=96%, HitCoverage=95%, E-value=1e-144, Identity=53%"; Hit description =Putative myosin II heavy chain
  Pfam annotation: Domain name=Myosin_HC-like; Domain location=177-530; Score=594.4; E_value=1.1e-175; Accession=PF07058.2; Description =Myosin II heavy chain-like
MASTHIGNAGDADAKALKGRPKKPSDDFISLFHGSDPKDRELGDALAEIKSLRNSERLKEKGVEELTDELIKVDEKLKAAEALLESKNLEIKKINEEKRAALAAQFAAEATLRRVHAAQKDDEMPPIEAIIAPLEAELKLARMEDDNRALGRLTKSKEAALLEAERTVQIALAKASLVDDLQNKNQELMKQIEICQENKILDKMLRQKVAEVEKLTQTVRELEEAVLAGGAAANAVRDYQRKVQEMNREVARAKVTANRVATVVANEWKDANDKVMPVFLAQVLEPTQKYCIAFYPGEMQQLRDKLAIAERTAKAEAQMKEKYQLRFKVLEERVKTSNGNSKFTVSDGRNIATGPSRRQSFGGAESLSASSSNGYQSRKTSISRPGSLRSNSANVLLKHAKLSSRSFDGGSRNLERERPTSDANGLDNMPRNSNIQTITSETITTHEESANGTPVKKSKSENEDYVSGMLYDMLQKEVISLRKACHEKDLTLKDKDDAIEMLAKKVDTLSKAMEVEARKMRREVASMEKEVAAMRISKEHDHRARRASAPRGAIGVLGTEWISIHH

SEQ ID NO: 190611 - protein, 472 aa, Glycine max
  Coding DNA Sequence Number=SeqID_73833
  Gene Ontology: Mol. function=DNA topoisomerase (ATP-hydrolyzing) activity; Cellular component=chromosome; Biological process=DNA topological change
  Homolog annotation: Hit_ID=Q1T4X4; Match level="QueryCoverage=91%, HitCoverage=68%, E-value=1e-171, Identity=64%"; Hit description=DNA topoisomerase II
  Pfam annotation: Domain name=DNA_gyraseB; Domain location=258-422; Score=230.3; E_value=4.4e-66; Accession=PF00204.15; Description=DNA gyrase B
  Pfam annotation: Domain name=HATPase_c; Domain location=108-238; Score=88.4; E_value=2.2e-23; Accession=PF02518.16; Description =Histidine kinase-, DNA gyrase B-, and HSP90-like ATPase
  Pfam module annotation: Pfam domain module=DNA_gyraseB::HATPase_c; Domain location=258-422::108-238
  Subcellular localization annotation: CTP_CleavageSite=62; ConfidenceScore=5.92e-01
MAHVLLLRPPLLRVMSFRFITSFSFHSRLSSFPSSTLSKTRTSFPLRKFWAPCSVPNAVTPRAFMSSISTTEAFHNSESPTAYSSDQIQVLEGLDPVRKRPGMYIGSTGPRGLHHLVYEILDNAVDEAQAGFASKIDVVLLADDSVSITDNGRGVLHAGGKFGGANSGYSVSGGLHGVGLSVVNALSELLEITVWRDGMEYMQTYSRGKPVSILKCLVLPDERKDLRGTRVRFWPDKEVFTTAIQFDHNTIAGRIRELAFLNPKKALHDVLSFRKETDGITVDIAFQWSEDAYSDTILGYANSIRTIDGGTHIDAMKASITRTLNSLGKKSKVIKEKDITLSGEHVREGLTCVVSVKVPNPEFEGQTKTRLGNPEVRKVVDQSIQEYLTEYLELHPDVLDSVLSKALNAFKAALAAKRARELVRQKSVLRSSSLPGKLADCSSTDPEECEIFIVEGDSAGGSAKQGRDRRFQ

SEQ ID NO: 190612 - protein, 103 aa, Glycine max
  Coding DNA Sequence Number=SeqID_73834
  Subcellular localization annotation: CTP_CleavageSite=81; ConfidenceScore=5.32e-01
MTSNLEPFGASKCLHAQIQPVPVSSTSNPSAVIKGVVCISNTACSYRITYLFYPHSTNPHNFKQMLNAFKTIRECSRLSTQLAQVGSPTSYDHVRHTILVKPS

SEQ ID NO: 190613 - protein, 142 aa, Glycine max
  Coding DNA Sequence Number=SeqID_73835
MDMTPTDGSTSNNSISLFNSPSRCFAKLNMQGGWFKTETERHPNYKKMQINKAGWATLILKITRKNSKKLVISYVLPTTPFLYTRDERGVAVGALGPYMGICTALEAEMLAVFLAIETLLEKKLELGVEKLCMNLEKSLRPH

SEQ ID NO: 190614 - protein, 626 aa, Glycine max
  Coding DNA Sequence Number=SeqID_73836
  Gene Ontology: Mol. function=DNA topoisomerase (ATP-hydrolyzing) activity; Cellular component=chromosome; Biological process=DNA topological change
  Homolog annotation: Hit_ID=O24307; Match level="QueryCoverage=100%, HitCoverage=69%, E-value=0.0, Identity=58%"; Hit description =Topoisomerase I
  Pfam annotation: Domain name=Topoisom_I_N; Domain location=350-562; Score=543.6; E_value=2e-160; Accession=PF02919.5; Description =Eukaryotic DNA topoisomerase I, DNA b
MAVETSDKPNLPHDFEDDDDGPVIYKRYSSSKKNQSHSEVRKSSSHSHDGQSYRQISNAPSSSGQTSCLQKGNTVPSAKPSPVKPSVGISKASKSLVNTSSTKLPVANSKSPSLGDRQKMSVDIKGEPKTIEHHAKNFVEDSEDDEDNKPLSFRLKNSNHDNKVTSVIAKKSSEDSDDDVPLAKKLYRNSNLGTTSSNHDDSNQKKPISKIQKEQKNGSGMSNKLDRPSPLPAKRPLDNSNSLHPSVKKSKVLDPVASIKSKAVSVKHELKVEDDDDDDDIPISQRIKKSAMSGDKSSSMKKVLTKVTKVNKPGSKPFKKQIKKTVKKSGSGSEYSKSSKILPSSGDGQKKWTTLVHNGVIFPPPYQPHGVKMLYKGRPVDLTPEQEEVATMYAVMRDTEYMQKDKFKENFWNDWRKLLGRNHVIQNLKDCDFTPIYDWYQSEKDKKKQMTTEEKKALKEEKMKLEEKYMWAIVDGVKEKVGNFRVEPPGLFRGRGEHPKMGKLKKRIHPGDITINIAKDAPIPECPIPGERWKEIRHDNTVTWLAYWSDPINPKLFKYVFLAASSSLKGQSDKEKYEKARTLKDYIGNIRSAYTKDFTSKDITKQQIAVATYLIDKLALRAGNEK

SEQ ID NO: 190615 - protein, 285 aa, Glycine max
  Coding DNA Sequence Number=SeqID_73837
  Gene Ontology: Mol. function=DNA topoisomerase (ATP-hydrolyzing) activity; Cellular component=chromosome; Biological process=DNA topological change
  Homolog annotation: Hit_ID=O24307; Match level="QueryCoverage=88%, HitCoverage=28%, E-value=1e-117, Identity=84%"; Hit description =Topoisomerase I
  Pfam annotation: Domain name=Topoisom_I; Domain location=1-173; Score= 266.1; E_value=7e-77; Accession=PF01028.11; Description=Eukaryotic DNA topoisomerase I, catal
DDDEADTVGCCTLKVENVTREPPNKLKFNFLGKDSIKYENTVEVELPVYNAILKFQKDKKPGDDLFDKLDTSKLNAHLKELMPGLTAKVFRTFNASITLDVMLNKETKDGDVGEKIVVYQHANKQVAIICNHQRSVSKSHTAQMSKLTEKIDELQAVLKELKTDLDRARKGKPPSKSSDGKRKKNLSPEMLEKKISQTNAKIEKMQRDMKTKEDLKTVALGTSKINYLDPRITVAWCKRHEVPIEKVLASFFVQIKLLIVLFYQFLAGAEGWVDLLGPCSLPFFF

SEQ ID NO: 190616 - protein, 48 aa, Glycine max
  Coding DNA Sequence Number=SeqID_73838
MLASGQVYMEVLNKVIKDTLRMANTHNILEFNRCDARFLVQETINPGE

SEQ ID NO: 190617 - protein, 133 aa, Glycine max
  Coding DNA Sequence Number=SeqID_73839
  Subcellular localization annotation: CTP_CleavageSite=43; ConfidenceScore=5.10e-01
MDNNPWELLDIDDSNLPSFVRLTNQSSSNSTTLILGPAGAVQVAMMYRQSKEPLPAQEFIMCPHQVTIREFNKNPWLCALDFVRSKDVDDTPHGTLSGFFDYTFDHVPLTIVIIKLYPQRFWRHESDAQGNRL

SEQ ID NO: 190618 - protein, 78 aa, Glycine max
  Coding DNA Sequence Number=SeqID_73840
MALGREPNQDILCHITIYPPNLAKTVPETMMTPVMEPSLAGSIIMVVVLTEVEVEHEEVAVAVALAVESERESEIQES

SEQ ID NO: 190619 - protein, 513 aa, Glycine max
  Coding DNA Sequence Number=SeqID_73841
  Gene Ontology: Mol. function=oxidoreductase activity; Cellular component=membrane; Biological process=electron transport
  Homolog annotation: Hit_ID=Q1SYG3; Match level="QueryCoverage=92%, HitCoverage=93%, E-value=1e-151, Identity=55%"; Hit description=E -class P450, group I
  Pfam annotation: Domain name=p450; Domain location=34-510; Score =271.8; E_value=1.4e-78; Accession=PF00067.12; Description=Cytochrome P450
MKTSGMAQQGWDGKIVKDNLILKAICNVLFSPFPPGPPKCSFRLLRQYLTDPKTILQKLHAKYGSIFAVHFGYSHADIFIANRFLAHQALIQHGTVFADRPKANPTNKIISSNQHDILFSFYGPKWRLLRRNLTSRILHPSQVKSYAHARKWVLDMLLQNLKSDSDASNPIRVIDHFQYGMFCLLVLMCFGDKLDEKQIREIEDSQRDMLVSFARYSVLNLWPSITRILFWKRWKEFLQKRRDQEAVLIPHINARKKAKEERFGNSSSEFVLSYVDTLLDLQMLEDEVGIKLDDGKICTLCSEFLNAGSDTTSTALEWIMANLVKNPEIQERVVEEIRVVMVRREKDNQVKEEDLHKLPYLKAVILEGLRRHPPLHFVAPHRVTKDVVLDGYLVPTYASVNFLVAEIGRDPTAWDDPMAFKPERFMNNGEQNGGTTFDIMGSKEIKMMPFGAGRRMCPGYALAILHLEYFVANFVWNFEWKAVDGDDVDLSEKLKFTTVMKNPLKVHILPRQQ

SEQ ID NO: 190620 - protein, 431 aa, Glycine max
  Coding DNA Sequence Number=SeqID_73842
  Gene Ontology: Mol. function=serine esterase activity; Cellular component=integral to membrane; Biological process=medium-chain fatty acid metabolic process
  Homolog annotation: Hit_ID=Q680G4; Match level="QueryCoverage=84%, HitCoverage=85%, E-value=1e-133, Identity=64%"; Hit description =Putative LEA protein
  Pfam annotation: Domain name=Abhydrolase_1; Domain location=152-397; Score=28.9; E_value=1.8e-05; Accession=PF00561.10; Description =alphabeta hydrolase fold
  Subcellular localization annotation: CTP_CleavageSite=30; ConfidenceScore=5.57e-01
MARSVVGSLPLFSRPYNNNVLFTPLHLSFSARHVTSSAVTMPSFEVLGGARDRFLPVLPHLSRPYHAFPLLAANRHIETIFASFFRSVPDVRLRRECLRTQDGGAVALDWVSGDDRRLPPDSPLLILLPGLTGGSGDAYVRHMLVRARSKGCRVVVFNSRGCGDSPVTTPQRLRRNLSKENLTICDTDLQFYSASFLGDMREVVSHVTGRYPNANVYAIGWSLGANILVRYLGQESHNCPLSGAVSLCNPFNLVVADEDFRKGFNIIYDKALSKALRKIFNKHVLLFEDIGGEYNIPLAANAKSVREFDDALTRVSFGFKSVDEYYSNSSSSDSIKHVRTPLLCIQAANDPIAPNRGIPREDIEENPNCLLIVTPKGGHLGWVAGDEAPLGAPWTDPLVMDFIQYLESEAVKTPETNSNPGSKETLYHLEV

SEQ ID NO: 190621 - protein, 296 aa, Glycine max
  Coding DNA Sequence Number=SeqID_73843
  Gene Ontology: Mol. function=nucleic acid binding; Biological process= DNA integration
MVLVSPPLNANNYHTWSRGMIRALWSKNKLEFVDGTLPMPKKEDANYKAWLRCNIMVVSWITRSLSPHISQKLKILWDELDMLSPTPDCSCTIKCTYDLIKSIQKKQEIEQVICFLKGLGEVYGTAKSNILMMDPLPSINKAYALVLQQEGQLQGNGTSDSKGIGGHKGEEVATLVEEEVMESWAEEMKMLEEKEDTNIQANNAHIAINLATQLTNATQSMGEQSQFEIDNSLQGSQGGTVTSSGVQFKPEQLQQLLAMLQQSYTKSSHSVSQISSGNVDESSSQQQNRLSDDWAC

SEQ ID NO: 190622 - protein, 190 aa, Glycine max
  Coding DNA Sequence Number=SeqID_73844
  Gene Ontology: Mol. function=DNA binding; Cellular component =mitochondrion; Biological process=DNA integration
  Homolog annotation: Hit_ID=Q1SDN3; Match level="QueryCoverage=69%, HitCoverage=12%, E-value=2e-35, Identity=46%"; Hit description =Polynucleotidyl transferase, Ribonuclease H fold
MTRPDILFVVPHLSQFMQSPRQPHFDVAARVLRYIKGCLAQGLFFPADFDLQFKAFSDSDWATCPTTPEYCALASTTCELQWLTSLLQSLYVPHITPTLLYCDSQSVRHIASNPSFHERTKHIDIDCHIVREKLPRVKLYVDKEIRRKKGDALVTYVKESSVALAIQILDGTPLHPGGKIPMSVNQAKYE

SEQ ID NO: 190623 - protein, 48 aa, Glycine max
  Coding DNA Sequence Number=SeqID_73845
MVDFRDPNDGKAYEDGEIVRFGARFEVKHHRVVLLCFHTHGKKQVGCG

SEQ ID NO: 190624 - protein, 169 aa, Glycine max
  Coding DNA Sequence Number=SeqID_73846
MGNSHLLGNRGPQLIPCRLQLGRSAAIDVSRRVDEGINEVWTLLYTIKESWWNFFYKYSTNCMLSLTKYVDSDGNLCMVKLSLDETDVYSNWGDFSFTIQRTGTSSFLQMHPNMVWADFQSIMSMKTNNAVDACGVSTQTVLYLYRRGKRGGLVVTECKRNRGDKEANA

SEQ ID NO: 190625 - protein, 269 aa, Glycine max
  Coding DNA Sequence Number=SeqID_73847
NTAQIIGYQPVGMARLVVHVDPAIGKVYGPHKKKLRTYLGIVARDKVNVTFVNRKEVPAAQKNLIWEDIQALAQGKEEGDDIVCEKYDINQGKWNQFWQSRRDPSWEDSFAEQSAQGNFVNHGHQDVLTATIGQPEHSDRVRVARASVTIRQYFGPASASSRTIKRSCVDPSGQDPDTGALDMCVLYVDDNPPRLVALGRVYEGLTIVHNVPLGNDQVKVGVGEVRDTVARAPNKHEPEGPTKPIDRLKPDDDPLYQMTLMIPQLFLKP

SEQ ID NO: 190626 - protein, 75 aa, Glycine max
  Coding DNA Sequence Number=SeqID_73848
MAQGSWEMIAGQCFCSPRTTTLTTAMEFDFHDVVATSVLTLLKSTSYSSSLLLIPLSTMIMARRLNLQQAKLSLS

SEQ ID NO: 190627 - protein, 201 aa, Glycine max
  Coding DNA Sequence Number=SeqID_73849
  Homolog annotation: Hit_ID=Q9LF51; Match level="QueryCoverage=52%, HitCoverage=29%, E-value=2e-12, Identity=40%"; Hit description =Glutamine-rich protein
MEEAKALHQQQQQQQQQQQLLLQQQQQQQHQQHYLLLQQLQKQQQQQQQAAAISRFPSNIDAHLRPIRPLNLQQNPNPSPNPAPNPNPNPLINLHQNPNSNHLPPPQQPSQQQQQQKIIRPGNQMELQMAYQDAWRVCHPDFKRPFSSLEDACERMGEEVISRNTWPFPKCGLSAVWFRSGTMFMALQSLYCSLFRIIFWT

SEQ ID NO: 190628 - protein, 81 aa, Glycine max
  Coding DNA Sequence Number=SeqID_73850
MVSLLLRISNLSARAIWFIESVLSGKMDAFRLSLPFRCSNIRGGAISPRRRDPMSHGAAAADPKAWNKEKESRRKGAIKER

SEQ ID NO: 190629 - protein, 304 aa, Glycine max
  Coding DNA Sequence Number=SeqID_73851
  Gene Ontology: Mol. function=methyltransferase activity; Cellular component=chloroplast; Biological process=metabolic process
  Homolog annotation: Hit_ID=Q56GA2; Match level="QueryCoverage=95%, HitCoverage=80%, E-value=1e-144, Identity=87%"; Hit description =Gamma-tocopherol methyltransferase
  Pfam annotation: Domain name=CMAS; Domain location=6-236; Score= -156.3; E_value=0.00016; Accession=PF02353.10; Description =Cyclopropane-fatty-acyl-phospholipid synthase
  Pfam annotation: Domain name=Methyltransf_11; Domain location=79-185; Score=79.3; E_value=1.2e-20; Accession=PF08241.2; Description =Methyltransferase domain
  Pfam annotation: Domain name=Methyltransf_12; Domain location=79-183; Score=34.1; E_value=4.8e-07; Accession=PF08242.2; Description =Methyltransferase domain
  Pfam module annotation: Pfam domain module=CMAS::Methyltransf _11::Methyltransf_12; Domain location=6-236::79-185::79-183
MAGKEEKEGKLQKGIAEFYDESSGLWENIWGDHMHHGFYDPDSTVSLSDHRLAQIRMIQESLRFASVSEERSKWPKSIVDVGCGIGGSSRYLAKKFGATSVGITLSPVQAQRANALAAAQGLDDKVSFEVADALKQPFPDGKFDLVWSMESGEHMPDKAKLSTWCNRQFVGELARVAAPGATIIIVTWCHRELGPDEQSLHPWEQDLLKKICDAYYLPAWCSASDYVKLLQSLSLQDIKSEDWSRFVAPFWPAVIRSALTWNGLTSLLRSGLKAIKGALAMPLMIKGYKKNLIKFAIITCRKPE

SEQ ID NO: 190630 - protein, 375 aa, Glycine max
  Coding DNA Sequence Number=SeqID_73852
  Gene Ontology: Mol. function=methyltransferase activity; Cellular component=chloroplast; Biological process=metabolic process
  Homolog annotation: Hit_ID=Q56GA2; Match level="QueryCoverage=99%, HitCoverage=100%, E-value=1e-180, Identity=85%"; Hit description =Gamma-tocopherol methyltransferase
  Pfam annotation: Domain name=CMAS; Domain location=127-307; Score= -168.2; E_value=0.0012; Accession=PF02353.10; Description =Cyclopropane-fatty-acyl-phospholipid synthase
  Pfam annotation: Domain name=MTS; Domain location=115-258; Score= -88.3; E_value=0.036; Accession=PF05175.4; Description=Methyltransfera se small domain
  Pfam annotation: Domain name=Methyltransf_11; Domain location=158 -256; Score=99.9; E_value=7.3e-27; Accession=PF08241.2; Description =Methyltransferase domain
  Pfam annotation: Domain name=Methyltransf_12; Domain location=158 -254; Score=52.2; E_value=1.8e-12; Accession=PF08242.2; Description =Methyltransferase domain
  Pfam module annotation: Pfam domain module=CMAS::MTS::Methyltransf _11::Methyltransf_12; Domain location=127-307::115-258::158-256::158 -254
  Subcellular localization annotation: CTP_CleavageSite=40; ConfidenceScore=5.18e-01
MATVVRIPTISCIHIHTFRSQSPRTFARIRVGPRSWAPIRASAASSERGEIVLEQKPKKDDKKKLQKGIAEFYDESSGLWENIWGDHMHHGFYDSDSTVSLSDHRAAQIRMIQESLRFASVSGIFIFYKPTHASRVASTVFVTCSQNEERSKWPKSIVDVGCGIGGSSRYLAKKFGATSVGITLSPVQAQRANALAAAQGLADKVSFQVADALQQPFSDGQFDLVWSMESGEHMPDKAKFVGELARVAAPGATIIIVTWCHRDLGPDEQSLHPWEQDLLKKICDAYYLPAWCSTSDYVKLLQSLSLQDIKSEDWSRFVAPFWPAVIRSAFTWKGLTSLLSSGQKTIKGALAMPLMIEGYKKDLIKFAIITCRKPE

SEQ ID NO: 190631 - protein, 211 aa, Glycine max
  Coding DNA Sequence Number=SeqID_73853
  Gene Ontology: Mol. function=electron carrier activity; Biological process=electron transport
  Homolog annotation: Hit_ID=Q9LTQ7; Match level="QueryCoverage=95%, HitCoverage=52%, E-value=1e-30, Identity=38%"; Hit description =Arabidopsis thaliana genomic DNA, chromosome 3, P1 clone: MQC12
  Pfam annotation: Domain name=MATH; Domain location=1-108; Score=9.3; E_value=0.013; Accession=PF00917.16; Description=MATH domain
MKKKRLILYPSGNIKSNGNGYVSLYLAIADTEKLSSGWEVDVNFKLFVFNQKNNNYLTIQDADGTVRKFQEMKTEWGFEQLISLETLLDSSNGYHVEDSCLFGAEVFVISRSGKWESLSMVKEPPHGTFTWKIGKFSTLEETYYHSKSFTVGERDWNLRVYPRGIESERGKGLSVYLQLTDCERFPAKRTVYAKFKLGILDQLNNKYHERT

SEQ ID NO: 190632 - protein, 96 aa, Glycine max
  Coding DNA Sequence Number=SeqID_73854
MEAMKDQMTTMMEAMMSMRKVREVNMAAVAATSAATEVDPTHPAGLNQSKHSFPPYGLPPNYTPPNAIHASDENVDNSTPIPIKSQQPQSGHAQVP

SEQ ID NO: 190633 - protein, 120 aa, Glycine max
  Coding DNA Sequence Number=SeqID_73855
  Gene Ontology: Biological process=response to DNA damage stimulus
  Homolog annotation: Hit_ID=Q1SYF5; Match level="QueryCoverage=99%, HitCoverage=48%, E-value=1e-54, Identity=90%"; Hit description =Proteinase inhibitor I25, cystatin
MVIGKPTFVSVQDLEMGFEKIVKIAHSSGVYKQERIGEKLKAERKQLVQGMNFYLKVVTSIPGIDNHDANALSQAIGSVQAIAKASKEQILENTDLSTDKAEMVSRFLRDPKFYLRPKIN

SEQ ID NO: 190634 - protein, 40 aa, Glycine max
  Coding DNA Sequence Number=SeqID_73856
MKVAATAAPDGYGHRNQSERGGDTSWIASTQCRFNQNECI

SEQ ID NO: 190635 - protein, 229 aa, Glycine max
  Coding DNA Sequence Number=SeqID_73857
  Gene Ontology: Mol. function=drug transporter activity; Cellular component=membrane; Biological process=multidrug transport
  Homolog annotation: Hit_ID=Q1SHJ6; Match level="QueryCoverage=96%, HitCoverage=46%, E-value=1e-96, Identity=76%"; Hit description=Multi antimicrobial extrusion protein MatE
  Pfam annotation: Domain name=MatE; Domain location=5-165; Score =107.3; E_value=4.5e-29; Accession=PF01554.9; Description=MatE
MVTYLSYSLKWWACEILVLLAGLFPNPKLETSVLSICLTISTLHFTIPYGFGAAASTRVSNELGAGNPQAVHVAVSATMFLAVTEGFIVSATLFGCRHILGYAYSDDRMVVHYVAVMIPLLCLSIFTDSLQGVLSGVARGSGWQHLGAYVNLGAFYLVGIPVGILLGFVAHFRAKGLWIGIVTGSIVQSILLSLITALTNWKKQAIMARERVFDAKPPDVNGSYHMTSA

SEQ ID NO: 190636 - protein, 190 aa, Glycine max
  Coding DNA Sequence Number=SeqID_73858
  Gene Ontology: Mol. function=nucleic acid binding; Cellular component= intracellular
  Homolog annotation: Hit_ID=Q1SHK0; Match level="QueryCoverage=51%, HitCoverage=33%, E-value=1e-32, Identity=70%"; Hit description=Zinc finger, U1-type
MIKRRFFKLDHGDREASDPSSSSSDSELEAVAETSEEESEEDAIAEVKPNDDEAGSNSSVLLALASAWDRIALADYGIMQSSIFEQQILVLIYNGYASEDSSANDVDVNSAGLLFSEDDAGAINERQMLINRELLSKGDTEKSNVLAEKKSLPTDLPSHVLKCKSVFKCRLCPRIICLSEETLRDHLQSK

SEQ ID NO: 190637 - protein, 135 aa, Glycine max
  Coding DNA Sequence Number=SeqID_73859
  Gene Ontology: Mol. function=drug transporter activity; Cellular component=membrane; Biological process=multidrug transport
  Homolog annotation: Hit_ID=Q1SHJ6; Match level="QueryCoverage=77%, HitCoverage=21%, E-value=2e-39, Identity=75%"; Hit description=Multi antimicrobial extrusion protein MatE
MTAAGTAKRKNSPTPTKAFLEKEMRVFSQAEEYLTKDKSIITLNQTQRLKEIAAPTCPNPSLKTRVQHVTTWKHKAIAEVRIMGEIKLWVWKNRVRGLRIAEPNRAGLDDAEKNSLDNDCHHQKGGECKYMNTGF

SEQ ID NO: 190638 - protein, 59 aa, Glycine max
  Coding DNA Sequence Number=SeqID_73860
MTVHEAEGPTSCYYFMHIREGSCIVAWVTEKDNAKLCLVVMIQKRTKVEAEPKKDKIDI

SEQ ID NO: 190639 - protein, 62 aa, Glycine max
  Coding DNA Sequence Number=SeqID_73861
MKGRGLNRLREPSAERRTKVKLSKEDKGPNFQVMSFSIGKCTASLELDRAGLGYRTAGHGVR

SEQ ID NO: 190640 - protein, 74 aa, Glycine max
  Coding DNA Sequence Number=SeqID_73862
  Homolog annotation: Hit_ID=Q1SHK0; Match level="QueryCoverage=56%, HitCoverage=14%, E-value=2e-07, Identity=61%"; Hit description=Zinc finger, U1-type
RHARSEKLLSEGRLKAILNSDGEIENQEISEIQTKDSEDDAEKNHKGKKQHKKRLRKKSKFFRHYHLPSCAKPA

SEQ ID NO: 190641 - protein, 310 aa, Glycine max
  Coding DNA Sequence Number=SeqID_73863
  Gene Ontology: Mol. function=DNA ligase (ATP) activity; Biological process=DNA recombination
  Homolog annotation: Hit_ID=Q1SHK1; Match level="QueryCoverage=99%, HitCoverage=24%, E-value=2e-71, Identity=47%"; Hit description=ATP -dependent DNA ligase; DNA repair metallo-beta-lactamase; RNA- metabolising metallo-beta-lactamase
MRKYFTWLVDETANKQDFLRGFHCVPCEKGEVGFKAEKVVSDAREPGQDMDKEVNALEKTEGDIGIGPDVALLDLISISGSNVVEAVSNFYKRETEFHEQVISCQNPVSTPKGCSLNTDSLAKPCLNTNNTGKNINIFSSQDSKLNNLRHTVPSPISPAKRKRSSDSKQKKKKPKVKARSEPSGSKQATITRFFSKLIPEMPGGAHSYNSEPKLDQSSKVEDLLPTDDRQLYKDEIDQFMQIINGNESLKKYAITIIEKTKGDINKALDIYYGNSEYLGENKISVESKIDRPVVKKHASKELRIKLDIFY

SEQ ID NO: 190642 - protein, 54 aa, Glycine max
  Coding DNA Sequence Number=SeqID_73864
MQLEKRKSLLWAYLRAVVSSVARGMKRDWTALGQVLRAMRNSWVESRVSKSMEE

SEQ ID NO: 190643 - protein, 202 aa, Glycine max
  Coding DNA Sequence Number=SeqID_73865
  Subcellular localization annotation: CTP_CleavageSite=39; ConfidenceScore=5.41e-01
MFHSRELFLQTLASMVVFLVLLSQGSAPTQPPTTTGTASCAATSQCSCHHQSPPPTSSNSQTLKPLFSPSLSHTLGPQTHLCVGGIRWVHLIQGPSLTSQLPRSVITARSRDPNRSYFGVLEKQQRWGKGWQHRLCGAGREVGQGLVGLFGGFWRSSNGVELDMYVKETSIADPDSIFLSWGKPETKSIQVKSVFPAKSRGA

SEQ ID NO: 190644 - protein, 99 aa, Glycine max
  Coding DNA Sequence Number=SeqID_73866
  Homolog annotation: Hit_ID=Q1SHK1; Match level="QueryCoverage=87%, HitCoverage=4%, E-value=1e-14, Identity=52%"; Hit description=ATP -dependent DNA ligase; DNA repair metallo-beta-lactamase; RNA- metabolising metallo-beta-lactamase
MEAGGLLLKHLYIVWNLRIGAMLRTIFPALAHAIDMNSCPTLHQEGTAKNIKDKLQMKLHARLWVLSGLQCLIGFNTNSLLQVLSMAVVEAYNILPNLD

SEQ ID NO: 190645 - protein, 37 aa, Glycine max
  Coding DNA Sequence Number=SeqID_73867
MDGSLRKNSFKSHIAQGGFRVTFQVCLHNFWQCHETS

SEQ ID NO: 190646 - protein, 56 aa, Glycine max
  Coding DNA Sequence Number=SeqID_73868
MVGIIIVDKYFSALPQNLRQHFLQHMLGRDSGSRGIVHFLWHVSILKQRSIKVYVV

SEQ ID NO: 190647 - protein, 65 aa, Glycine max
  Coding DNA Sequence Number=SeqID_73869
MDKSLKVEEDKWRKKERREQNFEREKRENEPLNPKFTLRLMRTLGSSPISLPQSSWRLLFNVLGE

SEQ ID NO: 190648 - protein, 59 aa, Glycine max
  Coding DNA Sequence Number=SeqID_73870
MFSKTLWNSMRERDNATKKIHSQERGVSDTERKQETRDTSGCESGGRQPMRINRADDGV

SEQ ID NO: 190649 - protein, 406 aa, Glycine max
  Coding DNA Sequence Number=SeqID_73871
MASVVVLQCQVKLTSHEDSCKLAIHACRSDDFPFLRMLTDKIGQVSLNDVSKKLLNFDSNIFRHFKDRFFKVMSIDVVAILSLPSASDPLAALDVLWVTSPGATHEAGRTYGWDCCCCCWRKGQPAEVEGPYKPSCPLIVQDVPSAPLAIEAPIGDTITPTTPAPSPPPILVVQEVALGVAEVSVLVVLAGFVVMSSSIIVVSLLSVSLVTSSALMVSTMMEDNDGRRHRQMEEATPCRCRGRTVVILKKVDDTKSSQVVLTYEASPLMVMRSKYDFHLFEGLPNSLVVVRVVELGPLMLVVIVTTSERTKCCALVYMALVMGDMYWRPWVTYTGVIVVCLCVHCARVYMSLYVGGVATYPSAGGRRVTRGMRVPRKEYARSRHQRLFEENVGKTGKDAIYELLSE

SEQ ID NO: 190650 - protein, 77 aa, Glycine max
  Coding DNA Sequence Number=SeqID_73872
MCGQQRPSAMATSHAGRHPDISTATTSPHTPEAKGGRITVIGIGSPAVAEGRTLLRGREISRRNSPKIKHPLHLKGR

SEQ ID NO: 190651 - protein, 136 aa, Glycine max
  Coding DNA Sequence Number=SeqID_73873
MKQKKNEIASLKLKLVENNIVRDSLWWWGLLGEDFLTDQSPNDAKGRDNERPRSDEKRRRTDLEAVRIWDKRGEATVVTTRGGGSAAVERNHSHFGVGVDLGIGWFVSRDREEKEAERGKKHDQCTARCKREKVGE

SEQ ID NO: 190652 - protein, 759 aa, Glycine max
  Coding DNA Sequence Number=SeqID_73874
  Gene Ontology: Mol. function=RNA-directed DNA polymerase activity; Cellular component=chromatin; Biological process=chromatin assembly or disassembly
  Pfam annotation: Domain name=RnaseH; Domain location=255-376; Score= -23.4; E_value=0.0088; Accession=PF00075.14; Description=RNase H
  Pfam annotation: Domain name=rve; Domain location=417-592; Score=6.4; E_value=0.0018; Accession=PF00665.16; Description=Integrase core domain
  Pfam module annotation: Pfam domain module=RVT_1::RnaseH::rve; Domain location=15-201::255-376::417-592
MDLMLQRGLIQPSTSPFSSPVLLVKKNDDSWRFCVDYQALNAVMVKDRFPIPTIDKLLDELGGACCFSKLDLLQGYHQIRMHDADIHKTAFRTHHGHYEFKVMPFGLCNAPSSFQATMNLLFGPYLCHFIIVFFDDILVYSTSFDEHLRHHETTFQAQVEYLGHVVSNKGVEPIASKIDAINQWPLPQSTRALRSFLGLAGFYRRFIRNYATMAAPLVNITTLPSFQWSEEAQLAFDHLKDALSTAPVLALPDFTTPFTLETDASGVGMGAVLSQKGHPIAFFSKPFTPKLLHSSTYMRELCAITTAVRKWRQYLLGRHFTIITDHRSLKELLTQVIQTPEQHMYMARLMGYDYDIQYRSGSHNQAADALSRIQLRQAIVADPSKHPGFSVTQNLIMHKGCIWIPRDLPIINTFCMNTTLPPLVVTPDWSGLRDDVAHFVASCVDCQLTKYEAKKSARLLCPLPVPQRPWEDLSMDSHMAHMVASLFLNIVIKLHGFPRSIVSDRDPLFISHFWQDLFRLSGTVLRISSAYHPQTDGQTEVLNRVIEQKPFTFPEYLLGTSRIDAVEEFLVDRDTTFQSIRKKLLKAQEVMKKYADRGRREVTYESTARGSQGSSGKLAKRYFGPFRVIERIGVAAYRLELPEGAKIHPVFHCSLLKPFQGTPTQLDLTSLPSQFVDGIPVVLLLLSSVIEKPITLGKCLFSGRECPLMKHLGRIGQHYAKLTTLRTRWIFRGHGMIGIRRKHQWQGCRRKERPRIREG

SEQ ID NO: 190653 - protein, 175 aa, Glycine max
  Coding DNA Sequence Number=SeqID_73875
  Homolog annotation: Hit_ID=Q39880; Match level="QueryCoverage=22%, HitCoverage=8%, E-value=6e-12, Identity=84%"; Hit description =Mitotic cyclin b1-type
MEKMKKWKRERWEKCRTSNNSQYLQNLQKHLIKHPVGKGKLGSARHGENLEVLFLIMEMLVVLILQRGENRHEQRRGTERWSSGFFVIYVLDSRQCFWGQHFKNRIKVFLRLPDWNNNNNPSILVVRISRKTWVVKEETKGCCRILGIFYLARFRLMLLASLKAMVLCSLRVKNL

SEQ ID NO: 190654 - protein, 138 aa, Glycine max
  Coding DNA Sequence Number=SeqID_73876
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q9SZR1; Match level="QueryCoverage=81%, HitCoverage=10%, E-value=2e-23, Identity=57%"; Hit description =Putative calcium-transporting ATPase 10, plasma membrane-type (EC 3.6.3.8) (Ca(2+)-ATPase isoform 10)
MESMKILRCFCGAGRRASVILTRCISVAAALLFRLAGERELVISTAVSPPTPVGDYDIGLEQLVSMSTDQNISALHQYGGASLQHIRGLSNLIKSNPDKGISGDDAHLLKRKNAFGTNTYPRKKEEVSGGFYGKLDKI

SEQ ID NO: 190655 - protein, 91 aa, Glycine max
  Coding DNA Sequence Number=SeqID_73877
MERATARGVADLDYVLHRDEPAELTNSSTSKEIALYERWERSNCLSIMFIKTHISTSIRGSISECQKVKDFKKALASTLMSKLSSMRLIGV

SEQ ID NO: 190656 - protein, 90 aa, Glycine max
  Coding DNA Sequence Number=SeqID_73878
MHYEIPFKVARSKGFKMMIEAVGDYNQQLNPPTQEMNKPHDDQIKQTQHGETIEDEQVVEPSLTEKILVEEIIGWNLELGPWERLGLLNT

SEQ ID NO: 190657 - protein, 201 aa, Glycine max
  Coding DNA Sequence Number=SeqID_73879
MARTKKTGQMTSEATKEIADKIDVLTASIGRPEHPGRVHAARASVTIKHYFGPASRGSYTSSSMASKDLEQLAQKIRDQLEESITQKSQMQSQRLALPPEAEVGPSIACAITKEICIDPSGQDPERETWTNVGFYEGSTTNHNVPLGNDQVKLGVEEVQDADARVPIPTQEDKQVVEAPLKPVDTSDPDVDPLYLMTLTIP

SEQ ID NO: 190658 - protein, 230 aa, Glycine max
  Coding DNA Sequence Number=SeqID_73880
  Subcellular localization annotation: CTP_CleavageSite=40; ConfidenceScore=5.35e-01
MAKNKLITTVGLAAKLANARKLVGNVAKTKSKVDTGPSKRSKATPTVQGETALVVPQNNPNLFECVKDEVEILKNPPTNKSTISSTQYKPIQKEPHSKRAKTMLIGIYWENVDIKDVDDFLGNGQWKDVCHEFETECSHSMNVTFNLRMLVEKMAPTYEQVHKNVEIEGLKRTKEEYENLKAFVTNDSCLKEMEKVKKFELDATESTKKNIEIQAPMEWSNVDAVADNGS

SEQ ID NO: 190659 - protein, 74 aa, Glycine max
  Coding DNA Sequence Number=SeqID_73881
METFCANIVWWRIEETFSSYSWSPNSYQLPSTTAYRSMWKELIINEDGRTPCSWDAFANSGSFFSLITFANYCH

SEQ ID NO: 190660 - protein, 68 aa, Glycine max
  Coding DNA Sequence Number=SeqID_73882
LRVTHGREFPQQRRRSTMREQMSVKGRDRGSERALSWWTLSESEASPHENEGAVAVSSKREGMRVRGS

SEQ ID NO: 190661 - protein, 153 aa, Glycine max
  Coding DNA Sequence Number=SeqID_73883
MKKLDDLLELPKADEVISELMKTKMELDKLVYVQYPADKQENAMSNEELLDINCSSLTWGAVGDAIEASEPSRLIRQHTKLTIEAPIEEEKEEEKHDENTKPIKQKIKEKEEVECTCSSLGERNCLINFQVGISSRHKACELVVQRVEEIIGG

SEQ ID NO: 190662 - protein, 155 aa, Glycine max
  Coding DNA Sequence Number=SeqID_73884
MDFFPDESFECIQAFQNSNLIPFMSLKLPVYSELVKAFYSNLEIQESTLISEVYGIKMVIDQSLFYDLTQLSSDGVPFEGALDVDWKFDFSVHDACRLVCTNQADMTGRLLAGSLALESRILHYLIIRILLLRSSNLAQVSEEDLIVMWAFHTGR

SEQ ID NO: 190663 - protein, 131 aa, Glycine max
  Coding DNA Sequence Number=SeqID_73885
MKEKIERFFLYRILEVDFEDSTPIKMFLYVWWSNGKQRRLVVATSGRGWRRIRFRVWGVTIGIIYLKWILLPSKLEKPAQDEKKERALSKGLKVQMAKSDNSDNSFEGSTDDEVALMSRMFKQMMKKKGKF

SEQ ID NO: 190664 - protein, 68 aa, Glycine max
  Coding DNA Sequence Number=SeqID_73886
MVTWDDSNNEKTTSSDDKQDNICLIANIDEIVEISLVGKGERFKLVQGQWLLMTHDNGKVYVPQTKAN

SEQ ID NO: 190665 - protein, 88 aa, Glycine max
  Coding DNA Sequence Number=SeqID_73887
  Gene Ontology: Mol. function=zinc ion binding
MATRVIVEALKRTEFKWVSRQEVRDAARAYISDTSLVDFVLRSLGNHVEGNYLDISDVYPYNEGLVMSNKVKDKYKKGSTNEGHALFV

SEQ ID NO: 190666 - protein, 66 aa, Glycine max
  Coding DNA Sequence Number=SeqID_73888
MCSTKQIKLSKYATWAGVDQGSFLWDPFGFCQLGAITMLDQLNLIGGYIYVTVEVLTRNVICEVEN

SEQ ID NO: 190667 - protein, 503 aa, Glycine max
  Coding DNA Sequence Number=SeqID_73889
  Gene Ontology: Mol. function=binding; Cellular component=ubiquitin ligase complex; Biological process=protein ubiquitination
  Homolog annotation: Hit_ID=Q1SXA3; Match level="QueryCoverage=99%, HitCoverage=100%, E-value=1e-125, Identity=54%"; Hit description=IMP dehydrogenase/GMP reductase
  Pfam annotation: Domain name=Arm; Domain location=150-193; Score=4.9; E_value=2.9; Accession=PF00514.13; Description=Armadillobeta-catenin -like repeat
  Pfam annotation: Domain name=Arm; Domain location=195-238; Score=2.7; E_value=5.6; Accession=PF00514.13; Description=Armadillobeta-catenin -like repeat
  Pfam annotation: Domain name=Arm; Domain location=239-283; Score=5.0; E_value=2.9; Accession=PF00514.13; Description=Armadillobeta-catenin -like repeat
  Pfam annotation: Domain name=Arm; Domain location=284-322; Score=2.8; E_value=5.4; Accession=PF00514.13; Description=Armadillobeta-catenin -like repeat
  Pfam annotation: Domain name=Arm; Domain location=326-365; Score=5.7; E_value=2.4; Accession=PF00514.13; Description=Armadillobeta-catenin -like repeat
  Pfam module annotation: Pfam domain module=Arm::Arm::Arm::Arm::Arm; Domain location=150-193::195-238::239-283::284-322::326-365
MANYHRNNVENVVLGRHHHHSHRSKSASVAGHTFRLWNAASFRRIIFDAVSCGASSRYAARSNISDEKQHLQQKQQHHKTTSMKNNAKSEKLSDLLSIAEAETDVETKKKEEKLEDLKRLVKELQQHEEDSTKNKKSEAAAKVRLLAKEELEVRGTLAMLGAIPPLVAMLDETEQNDVNSLVSSLYALLNLGIGNDANKAAIVKVGSVEKMLKLIESPDGLDSSVSEAIVANFLGLSALDSNKPIIGSSASIYFLVRTLQSLDDESSPQAKQDALRALYNLSIFPGNVAFILETDLVVFLVNSIGDMEVTERTLATLSNIVSTREGRKAISAVPDSIPILVDVLNWTDSPECQEKASYILMVMAHKSYGDKQAMIEAGIASSLLELSLLGSTLAQKRASRILEILRVDKGKQVSGSYGLGAAVSAPICGSLSGKPDGGGGRECFEEDEEMMSEEKKAVKQLVQQSLQNNMRKIVKRANLPHDIVPSDHFKSLTLSSTSKSLPF

SEQ ID NO: 190668 - protein, 141 aa, Glycine max
  Coding DNA Sequence Number=SeqID_73890
  Gene Ontology: Mol. function=binding; Cellular component=microtubule
  Homolog annotation: Hit_ID=Q9T041; Match level="QueryCoverage=59%, HitCoverage=10%, E-value=4e-11, Identity=59%"; Hit description =Microtubule-associated protein TORTIFOLIA1
MTSQTIACSSPPSLPHHRLHPLVLLPHHLEQRLHEQPTVPIVTNNGFKYCTMRAPTMLWQALRTVGSVSLRRRTTWAMILVRLAVAVMKCATQTMLSRVYTSIRGSAKTQTWGSEAMWWSGGMMSLYQDHVTANKYERETL

SEQ ID NO: 190669 - protein, 297 aa, Glycine max
  Coding DNA Sequence Number=SeqID_73891
  Gene Ontology: Mol. function=DNA binding; Cellular component=nuclear origin of replication recognition complex; Biological process=DNA replication
  Homolog annotation: Hit_ID=Q852Q8; Match level="QueryCoverage=66%, HitCoverage=27%, E-value=1e-51, Identity=50%"; Hit description =Origin recognition complex3
  Pfam annotation: Domain name=ORC3_N; Domain location=2-127; Score= -76.4; E_value=1.3e-06; Accession=PF07034.2; Description=Origin recognition complex (ORC) subunit 3
  Subcellular localization annotation: CTP_CleavageSite=35; ConfidenceScore=5.04e-01
MVEASPYDMKWFSFSSSFSTSEWVVKVPIIFIFGVATTVDASRNILPSHALERLCPSRFMLGTPVERMDAIVEAVLLKHCTTFSIGYKVAVFLRNYFINQDGTVTSFIRALKVACLLHFSMEPLSVIHGQTLAEDQKEGKSALSPETLLKYIDELPLCARNQTVDHPTQKSMSEGLSELVTVQKLWSTAVLCLYEAGKYSRVRLLDLFCEALSQDLYLSRVSDCHVGDEKDRDLSSTNDPRQQYSIMKSGGIIGKIVCKVRDIPTGMLYQLIESWEKLTADVSEWLPTEGQQAKCTH

SEQ ID NO: 190670 - protein, 107 aa, Glycine max
  Coding DNA Sequence Number=SeqID_73892
MERVHARVPRTIPIISKSIRPILQNLCEGNERVKRPHFEFQGRYPVNIDKDARMLNLQAIAFLDYLLRNFLKPVEGMPFHEIFCFKNVEKLQLPDIATASSYTTLTN

SEQ ID NO: 190671 - protein, 69 aa, Glycine max
  Coding DNA Sequence Number=SeqID_73893
MYKIIRVLGGGGGGGSKGKEKREPENRSLRLRMLLTEALNQRHSEKVPSDEDLESAINTRESEEREGPV

SEQ ID NO: 190672 - protein, 67 aa, Glycine max
  Coding DNA Sequence Number=SeqID_73894
MTYKEHKKHSLEVAELVLFDGTWEIESRQHNMIKWLEDKAMLPHYSIFVIEMNISPRSNEPYVWTML

SEQ ID NO: 190673 - protein, 204 aa, Glycine max
  Coding DNA Sequence Number=SeqID_73895
  Homolog annotation: Hit_ID=Q1SZY9; Match level="QueryCoverage=39%, HitCoverage=28%, E-value=2e-14, Identity=61%"; Hit description =Expansin 45, endoglucanase-like
MSTHALHVEATVRGAKIGGDDGPCCTGDAPPPVEVRVLLMALELEVGVADLATLEESLAKSYDGHAITPLRRSSYPHTLPTEENLVETVDYGGRRDDIAIFDKDSSVTSELDHVSRLAEKGDRAWVLVALDEGEQMLQHLPSERVIYSPSPACLPGPLHHELCFERKTYRESESDTYTISGSETVSESEIDSDDTMSDTTVVSH

SEQ ID NO: 190674 - protein, 222 aa, Glycine max
  Coding DNA Sequence Number=SeqID_73896
  Homolog annotation: Hit_ID=Q6ZIK5; Match level="QueryCoverage=54%, HitCoverage=33%, E-value=2e-44, Identity=64%"; Hit description =Putative growth-regulating factor 1
  Pfam annotation: Domain name=QLQ; Domain location=19-55; Score=75.6; E_value=1.5e-19; Accession=PF08880.1; Description=QLQ
  Pfam annotation: Domain name=WRC; Domain location=82-127; Score =100.8; E_value=3.9e-27; Accession=PF08879.1; Description=WRC
  Pfam module annotation: Pfam domain module=QLQ::WRC; Domain location =19-55::82-127
MNISGGGGTVMGFSSNGRSPFTVSQWQELEHQALIFKYMVAGLPVPPDLVLPIQKSFDSTLSHAFFHHPTLSYCSFYGKKVDPEPGRCRRTDGKKWRCSKEAYPDSKYCERHMHRGRNRSRKPVESQTMTHSSSTVTSLTVTGGGDSNGTVNFQNLPTNAFGNLQGTDSGTDRTNYHLDSIPYAIPMLGDALTCGIGTRFKRPSSMKIVYKLCLVEYFVTKL

SEQ ID NO: 190675 - protein, 108 aa, Glycine max
  Coding DNA Sequence Number=SeqID_73897
MELCCVVKALSLMVLSVRVFSFPKAIASDALATTNSQKIYCLAANTGSKCWGQMSYRMSRHHASEHADYMCPYEQIKQVNNTRELFTQFGATSPTSGGYQAREEIHSQ

SEQ ID NO: 190676 - protein, 293 aa, Glycine max
  Coding DNA Sequence Number=SeqID_73898
MMEAMMSMRKMMEVNTATTVVASTATERDLIHPSGFNQDSHPIIDVVGQGGETVANQMGLIMSRSRNIGNSTSIFIVNQQPQPDHTHAHVSQPLEDTHEAPQDHTLTDFRVYPGYTTKGLVFSSVLMPNAVMGPQLRAIERVGNYRFVDMSELCLVPNVVIPSKFKVPDFDKYKGTTCPKNHLKMYYKKIDLANQVVSPMTEREMITMIMNTLLMFYYEKMVGYMPSSFTDLVTIDERIEAGLRKGKFNYVVSVNPGNGGLGRSDERNKEGETHVVAAMLAWPNFPLAPYNPM

SEQ ID NO: 190677 - protein, 63 aa, Glycine max
  Coding DNA Sequence Number=SeqID_73899
MSVKNLVGHLGVHDKTIHTLVSQVTLTRLNGALKHGVFTPKAYTLKSSSGLLPLDSGPTHKTF

SEQ ID NO: 190678 - protein, 144 aa, Glycine max
  Coding DNA Sequence Number=SeqID_73900
MGVNGQGDSTQPVIMQSGWKTLVASHREWRDQRGNHHRGWCAALATASVGPGNTRPPQGRRGADDNRGFAVVQTKNEKKMKITKVMGPLTTPVKDAQVRSYHGIGTNGGSGMNRDTTASLELAKEKEKKNKNASKEKHSNNQTK

SEQ ID NO: 190679 - protein, 77 aa, Glycine max
  Coding DNA Sequence Number=SeqID_73901
  Homolog annotation: Hit_ID=Q1T3I7; Match level="QueryCoverage=47%, HitCoverage=8%, E-value=2e-12, Identity=86%"; Hit description =Protein kinase
MFLNKVNANKEAAAYSRTWRGHMQNLLGYACSVYCVYKMIKDFDSLNLSPDKAYEVGFCVLTSELQEFGEFTKRGML

SEQ ID NO: 190680 - protein, 257 aa, Glycine max
  Coding DNA Sequence Number=SeqID_73902
  Gene Ontology: Mol. function=kinase activity; Cellular component =integral to membrane; Biological process=positive regulation of I -kappaB kinase/NF-kappaB cascade
  Homolog annotation: Hit_ID=Q1T3I7; Match level="QueryCoverage=86%, HitCoverage=35%, E-value=1e-46, Identity=54%"; Hit description =Protein kinase
SLQSVVFKQDGSVDPVTRTISIFLQFFDIGINAALLSQYISLLFIGMLVVISVRGFLTNLMKSSAMIISSPISCVQFFFAVSRVGSGSSSNVVLFLSEIMGMYFVSSILLIRKSLATEYRKKVVNKRKSENMMTFLLLTKVWACQFVALVLIDANLACINCYYFIKLPWFIRIIITEVLGGDIQFDFYHRWFDAIFVASAFLSLLLLSAHYTSRQIDKHPIDLNSLLEHLMLLELITSERVDIVIVNINRCALCKIF

SEQ ID NO: 190681 - protein, 476 aa, Glycine max
  Coding DNA Sequence Number=SeqID_73903
  Gene Ontology: Mol. function=transferase activity, transferring glycosyl groups; Cellular component=integral to membrane; Biological process=metabolic process
  Homolog annotation: Hit_ID=Q8S996; Match level="QueryCoverage=98%, HitCoverage=82%, E-value=1e-128, Identity=50%"; Hit description =Glucosyltransferase-13
  Pfam annotation: Domain name=UDPGT; Domain location=6-470; Score= -67.0; E_value=3e-07; Accession=PF00201.9; Description=UDP -glucoronosyl and UDP-glucosyl transferase
MRTHLVVVSVPVISHQIAISEFCKRLLQLHPTIRITFIIPVLESLPNASKSIIVSLSALDIETITLPPVNLPQEITVPALKLPLAMSLSLPSIHDALKSITSTSHVVAIVADYFAYELLPFAKELKILSYVFFPTAATIISLCLHSSTLHETISCEYKELQEPIKIPGCIPIHGRDLPTSLQDRSSENYKHFLLRSKALRLADGILVNSFVELEARAFKAMMEESKSNPSVYMVGPIVKNVCDTTHNNNTNNNINGSHCLAWLDEQTPNSVVFVSFGSGGTISQHQMNELALGLEQSSQKFVWVVREPNDLPSANYFGGSSLGQDPLSFLPNEFMERTKGQGLVIPFWAPQVEILGHKAIGAFLTQCGWFSTLESVVNGVPIIVWPLFAEQRMIATILVDDLKVAIRPKANESGIVERCEVAKVVKSLLVGNEGMRIRNRMEVMQDAGASAIKNNGFSTTTLSQLATKWKNMGGCK

SEQ ID NO: 190682 - protein, 424 aa, Glycine max
  Coding DNA Sequence Number=SeqID_73904
MTLSETQCSPKHMDKESIDQGHNMVSRNFDGKETIFDQTHLGLQVNLERQDTRINTKSTLGIPTISTQICQEVNSTGSSLRDSVPKHRQYIKSKPPEAMGTSVSSRIVETKTNHDISVKQENSLSSGIHSVGCQEIDTASNISKDKILDRTNNGENQQRPKRKQMEDDLDINVEATFQRDLTVKAVNCQLPNDKKVKHIDLSDTVVEASAVSCQKMPWNEVNGKFEDRESYSRELRTSFGGIHGCYDSGAWESFNGSSASLVNDLGSCSLGEDKRCKEPCDEKIIHEDFGAMERTFFPVDTRKKNDLGMVLNSESLNEPREYVDQVQVGIPNLELGLGGETKPSHKGMLPFFVGAVHKKNNQEKIPEILTYEREDENVAASLSLSLSFPSSNKEHVKPVPKAEPLPGGHNVNSPYLLFRRFTDK

SEQ ID NO: 190683 - protein, 877 aa, Glycine max
  Coding DNA Sequence Number=SeqID_73905
  Gene Ontology: Mol. function=zinc ion binding
  Homolog annotation: Hit_ID=Q2QSD0; Match level="QueryCoverage=70%, HitCoverage=48%, E-value=2e-40, Identity=25%"; Hit description=PHD -finger family protein, expressed
  Pfam annotation: Domain name=C1_3; Domain location=254-284; Score =5.9; E_value=0.1; Accession=PF07649.3; Description=C1-like domain
  Pfam annotation: Domain name=PHD; Domain location=255-304; Score =25.0; E_value=0.00018; Accession=PF00628.19; Description=PHD-finger
  Pfam module annotation: Pfam domain module=C1_3::PHD; Domain location= 254-284::255-304
VSLKSGKKFVKHSMIRNADMRLESGTCNVCSAACSSCMHLNQALMGSKAEEFSDENCRLGEANQYCNESDRSSLGSRACERLKHGVSETSHRPSVSSTQDSLSENAENSQALSEKYQDSKCLESLDDSTSCISRTKGSGNGPSVDMSSLSECCMENVDSSLTKERVPIIVPGEKSLADKENLNNGTAKVSIEICQKSEADTENNFDVAEDVDLKFSAHDGLHEKVEELVKSPGRAEPQSEDESDESDVVEHDVKVCDICGDAGREDLLAICSRCSDGAEHTYCMREMLEKVPEGDWLCEECKCAEETANQKLAAKRQALGSSTGSPKASSPKRIVPLLRESSFKSMDKGKMKSGQQIPMCNHLGGNDTELARSLSTVPRGQNARSTLLKSNSFNNFNSKPRVKLVDEVIPQKQKGGVEHISKNMETPAGMISKSMSFKSSNLGRSIAVESKVKMMSSKPGTARDLKASRHTKDSASFDRKFLSKIDRPVICSTMVSSVVSTSKGDQKLTPHGETAKPSTVNNNREFKVNQDGKLYSSSKSINNTSSKSPEPQVSSDRTSTSVDETQQDRLPRSQDTANQVDKTKDSSSDHVTSGVTNASKSSFCRKCKDFGHATECCTVSGTQEFGAESSVIATSSSKDEMHEGNRLKAAIQAALLRRPEIHKRKEAPDQTNEFPTSSTGLKREVTSQKQVLVSSTLKNGISAEESNMKQEIIENSTFETSKCPSANDLKQLEFCRTDVCSQLRKSDSAGPTSGKPVVRDDFPNNAMEISSILSKMSVIPEYECIWQGVFVVHRNGMPPDLYTGIQAHLSACASPKVHEVVKKFLPEVSLNEVSRLSVWPSQFHQGGAKEDNIALYFFARDIERQEYEYHSSIESRL

SEQ ID NO: 190684 - protein, 203 aa, Glycine max
  Coding DNA Sequence Number=SeqID_73906
  Gene Ontology: Mol. function=RNA binding; Cellular component=plastid chromosome
  Homolog annotation: Hit_ID=Q2VY14; Match level="QueryCoverage=77%, HitCoverage=26%, E-value=2e-62, Identity=74%"; Hit description =CONSTANS interacting protein 5
MASEDQGHGSCILEFKKEILTLKADFACKSLNEGEEVPLRSPEAIEAFKMLSPNYRKKKREEMGLTKEEFYTKQFEIKGDISEPLMTTWAGPLVVRLVPPHDWPPRGWCVDQEELTFIREAHKVQARRVMLEEVESGVRIDTDGVGLDRYRVFLKQYKEWVEANKDSLEEESYKVLILHHTNAELSAASDWIGKKEDERRRKT

SEQ ID NO: 190685 - protein, 146 aa, Glycine max
  Coding DNA Sequence Number=SeqID_73907
  Homolog annotation: Hit_ID=Q1T2S9; Match level="QueryCoverage=59%, HitCoverage=28%, E-value=6e-13, Identity=43%"; Hit description =Cyclin-like F-box; F-box protein interaction domain; Galactose oxidase, central
MACQRPGRVVNCLSLRTNSWSFTEKKQLTAAYDDNEVGHVTREFLNGAFHWLEYCKGLGCQIIVAFDVREKELSEVPRPRDLPVESEDNFIYDLITMGECLCLCFVRCQNRTRVYEMWTMKEYKVQASWTRAVWWISGGRTVLELN

SEQ ID NO: 190686 - protein, 124 aa, Glycine max
  Coding DNA Sequence Number=SeqID_73908
  Gene Ontology: Mol. function=transferase activity, transferring hexosyl groups; Cellular component=integral to membrane; Biological process=metabolic process
  Homolog annotation: Hit_ID=Q1SEE9; Match level="QueryCoverage=93%, HitCoverage=24%, E-value=1e-40, Identity=69%"; Hit description=UDP -glucuronosyl/UDP-glucosyltransferase
MEEETTTQGRGWVVPYWAYQIQILAHGAIGGFICHGGWNSTIEGVVQGIPLIAWQLFAGQKMNAVLLTEGLKVALRANVNQNGIVEREEIGRVIKKQMVGEEGEGIRQRMKKLKGVAADACIEG

SEQ ID NO: 190687 - protein, 78 aa, Glycine max
  Coding DNA Sequence Number=SeqID_73909
  Homolog annotation: Hit_ID=P31582; Match level="QueryCoverage=41%, HitCoverage=16%, E-value=3e-08, Identity=84%"; Hit description=Ras -related protein RHA1
  Subcellular localization annotation: CTP_CleavageSite=56; ConfidenceScore=5.33e-01
MQFQLSLSSLCQNLATSIARKVDHHDINTHRRSFSASTTTFTWQNQESTIGATFFSQALAVNGAIVKFEIWDTSGQER

SEQ ID NO: 190688 - protein, 420 aa, Glycine max
  Coding DNA Sequence Number=SeqID_73910
  Gene Ontology: Mol. function=transferase activity, transferring glycosyl groups; Cellular component=integral to membrane; Biological process=metabolic process
  Homolog annotation: Hit_ID=Q8S996; Match level="QueryCoverage=99%, HitCoverage=79%, E-value=1e-132, Identity=55%"; Hit description =Glucosyltransferase-13
  Pfam annotation: Domain name=UDPGT; Domain location=5-410; Score= -116.6; E_value=9.5e-05; Accession=PF00201.9; Description=UDP -glucoronosyl and UDP-glucosyl transferase
  Subcellular localization annotation: CTP_CleavageSite=84; ConfidenceScore=5.02e-01
MEKITHIAVVPGPGFSHLIPILEFSKRLVKLHPLLHVTAFIPTLGSLSSVSKSFLKTLSPSITPTFLPPVDPIDIPQGLETAIRMQLTVTYSLPSLHNALKSLTSRTPLVALVVDNFAYEALDFAKEFNMLSYIYFPKSAFTLSMYFHLPKLDEDTSCEFKDLPEPIQMPGCVPIHGLDLHHQIQDRSSQGYELFLQRVKRFCTVDGIFINSFIEMEKEPIRALAKEWNGYPPVYPIGPIIQTGIESDGPIELDCIKWLDKQQPKSVLYVSFGSAPSSSASSAYLSGQNENPLEFLPYGFLERTKGQGLVILSWAPQIEILSHSSIGGFMSHCGWNSTLESVLQGVPLIAWPLFAEQRMNAVMLSDDLKVALRLKGNGNGVVEKEEVAEVIKSLMEIESGKMRKIMKRLKEAAINAIKED

SEQ ID NO: 190689 - protein, 51 aa, Glycine max
  Coding DNA Sequence Number=SeqID_73911
MARSRDLYGRELKGILTLIPKVVISLLMVSRGINETLGLIRILVMDLKRAN

SEQ ID NO: 190690 - protein, 136 aa, Glycine max
  Coding DNA Sequence Number=SeqID_73912
  Gene Ontology: Mol. function=hydrolase activity; Cellular component =mitochondrion
  Homolog annotation: Hit_ID=Q1RVU0; Match level="QueryCoverage=79%, HitCoverage=62%, E-value=2e-36, Identity=67%"; Hit description=NUDIX hydrolase
  Pfam annotation: Domain name=NUDIX; Domain location=3-125; Score =25.1; E_value=0.00026; Accession=PF00293.18; Description=NUDIX domain
MSLTSAVFEISFSDLIDFALLLKGGWENDETVEEAAVREAIEEAGVRGDLMDFLGYYEFRSKTLQDECSPEGLCKAAMFALFVKEELESWPEQSTRKRSWVAVSEALANCRHAWMRDALHCFCKWHEECKGGSSLN

SEQ ID NO: 190691 - protein, 168 aa, Glycine max
  Coding DNA Sequence Number=SeqID_73913
MTLRSLSQGPARPGPGNLRDHLHQRLLLLLHQLPYLQHPCFGSASAHHEHGGVCFLGGLARSLTFFFWGGEASATQKSQPEPEATQEDDPDPDIQEIDPTAQEDTVEDSLEMTPQALPVTTPVLELSSLQASTVATPVLELSEDEDDATAMDYAPSAPHDDPSAPQDP

SEQ ID NO: 190692 - protein, 43 aa, Glycine max
  Coding DNA Sequence Number=SeqID_73914
MATPMSTACYLDKDETVQLIDIKKYRDFKQIPKNLTLVQLKES

SEQ ID NO: 190693 - protein, 77 aa, Glycine max
  Coding DNA Sequence Number=SeqID_73915
MATAYFPMNFFTNLIFDESWEVVKGIGIPICGHSFNSSIWVMQWLYMKDTFNLNQLSPVLNEEVLCMTVVMDLLTAK

SEQ ID NO: 190694 - protein, 41 aa, Glycine max
  Coding DNA Sequence Number=SeqID_73916
MKRCSSYKKAGHNVCRCPNGDVGGHSYYASTYNTFYEEFME

SEQ ID NO: 190695 - protein, 83 aa, Glycine max
  Coding DNA Sequence Number=SeqID_73917
SGDMRGYLMVIHNFGQPGANEPVDAWKLTLSSKPFVVLTRESGDMRGYLMVIHNFRQPGANEPVDERGLTSSSAPFVDLTREV

SEQ ID NO: 190696 - protein, 122 aa, Glycine max
  Coding DNA Sequence Number=SeqID_73918
  Gene Ontology: Mol. function=galactosyltransferase activity; Cellular component=membrane; Biological process=protein amino acid glycosylation
  Homolog annotation: Hit_ID=Q1SXJ8; Match level="QueryCoverage=98%, HitCoverage=100%, E-value=6e-32, Identity=54%"; Hit description=LGC1, related
MADSTIKILSIVLFLCFVSQGYSQCFLSDLSVSQIQTGVKMQGKPEWNVTITNNCSCVQKNVILSCNGFQSVEQIDPSLLKISPNGCLVNDGQPIYTDAIKFKYVWNQSFPLNPISSEIACS

SEQ ID NO: 190697 - protein, 104 aa, Glycine max
  Coding DNA Sequence Number=SeqID_73919
  Homolog annotation: Hit_ID=Q1RTL8; Match level="QueryCoverage=61%, HitCoverage=9%, E-value=1e-17, Identity=62%"; Hit description=IMP dehydrogenase/GMP reductase
MARLATTFLPSAPMVYAVISDPGIVDNPDIPSYQPHAYGRCDPPALISLQMNAIEMEANCYHKTASDPTAPAVPCKGATVRGFWSAARTIAFCGSRRWQRGVCR

SEQ ID NO: 190698 - protein, 138 aa, Glycine max
  Coding DNA Sequence Number=SeqID_73920
  Subcellular localization annotation: CTP_CleavageSite=24; ConfidenceScore=5.25e-01
MGLFAFPRIYFLMIRSLTALDSSRSSAGRRFCRRSDSRTCKRQDLDNLSVRWILLSYHFFIDYLKYEVSRKKATRNGNKEGEKETSSTLYEDEIWRPCLKGINPVWLLGLRVFAFVVLLVLFILIATEDGGSIFFFYT

SEQ ID NO: 190699 - protein, 127 aa, Glycine max
  Coding DNA Sequence Number=SeqID_73921
  Gene Ontology: Mol. function=electron carrier activity; Biological process=electron transport
MMSTRSKEVGGVALPQVLQPFALPAGGNDIENRSARMDGANFGSFLAWKSINVKSWIWKQQAMHPELNDNSYFRKKWVCCDHHADALEVAHTIEKCLNKIKMKRKDNQRLQRAEVHAAISVARGCNC

SEQ ID NO: 190700 - protein, 995 aa, Glycine max
  Coding DNA Sequence Number=SeqID_73922
  Gene Ontology: Mol. function=DNA binding; Cellular component =intracellular; Biological process=DNA integration
  Homolog annotation: Hit_ID=Q1T010; Match level="QueryCoverage=89%, HitCoverage=96%, E-value=1e-107, Identity=42%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=397-564; Score =48.3; E_value=2.6e-11; Accession=PF00665.16; Description=Integrase core domain
  Pfam module annotation: Pfam domain module=RVT_2::rve; Domain location=605-760::397-564
MKVILGYQEVLEIVEKGYSPLEEDATKEQKVAYNENKKNDCKALCLIYQSVDNAHFEKIIGAKTSSKAWKILEKGNEGTKQLKKVRLQTICKQFKLMQMEENERVAEFFNHVFTLTNAVKSYGEKVTDLTIVEKVICTLNPKFDNIVVAIEESRNLEILKVEELEGSLEAHEQRFLERSDGKAPDQALQAQTYKKKEELVAEEEDIKEGIVIGVQGNQNNGKQGNEANMPKEADSKDDVLLLMMSDMKGSRGSEIWYLDSGCSNHMTSHREWLIHFEKSRKSQIRFADNRIIQAEGIGDILIRRKNDNQAMIKDVLYVPAMKNNLISIGQLIEKGFSMNLHQGILELYGPKHRKVLKTPFSANRTFQVKIGTLKPQCLSAESEMNDSWIWHMRYGHRNFKDLSMLHTKNLVNGLPRTKNPQAVCERFLVSKQPRSTFGSYVPSRATKSEVFDTFKVFKILVEKQSRRSLKILRTDGGGEFTSGEFENFCRDNGIIHEIIAPYTPQHNGVAERRNITIMNIVRSMMKGTNLPLSFWAEAVEDNYLYTKSMSNSDSVLLVLEEVWSGRKPSVQHLKVFGTLCYTHVPDQKRRKLDDKSEAMIFIGYHPTGSYKLYNPKKKKVIYSRDVQFDELKYLKDRDNQKEQATISVQVPMENSVRHLERLYHGIYVKTIKDGGVLLICLYVDDLLITRSNPAEIENLKDSLKSEFEMSDLGLLSYFLDIEFAETKDGIVLHQKKYVKEVLKRFNMDQCNKVDTPMEGNLKLDTGDHEASVDATLFRQLVGCLRFVYHSRPEISYGVGLVSRFMKKGELYLVAYSDLDWCGDKVERRSTSAEYISACSVACQALWILSFISELNLKTDDFVELHTDNKDQVNKGRIRLKYCGTDLQLADIMTKALKANRLKLLRNMLETGAFGSLGGYIIVVMQLDGDKGRERLLGAADLAIIEGHSFEDHDDDLGEAPKILNGIAAEGDGIADLEGLDDAFEREVQRQTERSP

SEQ ID NO: 190701 - protein, 59 aa, Glycine max
  Coding DNA Sequence Number=SeqID_73923
MLLEKSFFLLITAKPHLSVGIKTLKGRKSFQKALEGVRKKELAPPFKLWAMEWMIILED

SEQ ID NO: 190702 - protein, 413 aa, Glycine max
  Coding DNA Sequence Number=SeqID_73924
  Homolog annotation: Hit_ID=Q64EX4; Match level="QueryCoverage=98%, HitCoverage=94%, E-value=1e-117, Identity=48%"; Hit description =MtN19-like protein
  Pfam annotation: Domain name=SURNod19; Domain location=32-413; Score =517.8; E_value=1.2e-152; Accession=PF07712.3; Description=Stress up -regulated Nod 19
MTLQIFVIANFLIPNGLCTVIVILSGTTYSIFLDSENHIKSATFVSKSFEVGPGKIVSKSFYDIEFPKGHIGVKSFDAELVDEDGNSVPLYETYLHHWFAIKYNENITMSRYIEKSHDISKGINYTRNDGACRGFLLPHYWGLGGESRGTSSNLPDPFAVEFGNPTNIPHGFKEKWLFDIMAIDTRGAYSRKGCIECRCNLLNLPKDFYNVTKDINEQPLSLNYKGGLFCCKDNLQCKLRKGFHGPTRKLSLRYKIKWVDWDEHQVPLKFYILDTTDRVRTNGSTTIHDCQAEYTIPRIGHSDSPHVKKANIPMKKGGYLIYGTSHMHTGVVNATLYGQDGRVLCTSTPKYGTGKEAGNERGYLVGMSGCYPKPGSIKIKDGEILTLETRYQNKFRTGAMGFFYIHLAEQLPN

SEQ ID NO: 190703 - protein, 146 aa, Glycine max
  Coding DNA Sequence Number=SeqID_73925
  Homolog annotation: Hit_ID=O82047; Match level="QueryCoverage=96%, HitCoverage=53%, E-value=1e-35, Identity=55%"; Hit description=PRIB5 protein
MMSRNAIRLEVAPKDGNWGFNISERKAMLLAGTVDKNVERVYKEELQLPKWEEDPNLHTRPRYKQIVKDLADKYHTENLLLVTHGEGVGVALSSFKKDVEVYEVDYCGYVQLRRPIFKKDQSFTAGEFEVLTHNGQTGINFMSNKA

SEQ ID NO: 190704 - protein, 311 aa, Glycine max
  Coding DNA Sequence Number=SeqID_73926
  Gene Ontology: Mol. function=DNA binding; Cellular component=nucleus; Biological process=regulation of transcription, DNA-dependent
  Homolog annotation: Hit_ID=Q8H0H3; Match level="QueryCoverage=96%, HitCoverage=92%, E-value=2e-70, Identity=51%"; Hit description =Hypothetical protein B25
  Pfam annotation: Domain name=Myb_DNA-binding; Domain location=13-60; Score=37.8; E_value=3.7e-08; Accession=PF00249.21; Description=Myb -like DNA-binding domain
  Pfam annotation: Domain name=Myb_DNA-binding; Domain location=67-112; Score=43.8; E_value=6e-10; Accession=PF00249.21; Description=Myb-like DNA-binding domain
  Pfam module annotation: Pfam domain module=Myb_DNA-binding::Myb_DNA -binding; Domain location=13-60::67-112
MHGKKEQEEYIRKGQWEAEEDEVLLNHVKKYGPRDWSSIRSKGLLQRTGKSCRLRWVNKLRPNLKNGCKFSLEEERVVIELQAQFGNRWAKIASYLPGRTDNDVKNFWSSRQKRLARILQTSATTFRSQKNKTKVPSFLDVPTLEAPKFSSSSEGEPSSKPQTCTLPYIDNSEVIQMVSLPDLIKSELPSSDTIHVEQEFTLFENYKSTEQIAFPQIPELQNGLTFSMENQDLVPTIEEPCFIEDLCPFDVSEFGIGPQHPFGFPFFEPPGSCRFGTRDAIDNFKISDSFFDDLPVDMFDHMDPPASPSNL

SEQ ID NO: 190705 - protein, 135 aa, Glycine max
  Coding DNA Sequence Number=SeqID_73927
  Gene Ontology: Mol. function=RNA-directed DNA polymerase activity; Biological process=RNA-dependent DNA replication
  Homolog annotation: Hit_ID=Q1RVK7; Match level="QueryCoverage=42%, HitCoverage=8%, E-value=3e-12, Identity=55%"; Hit description=RNA -directed DNA polymerase
MAFEHLCQPWRKCLVVKILGKSIGFLPMHEKMRSRWKLEGNFNLIVIKNRYFMVTFGMEVDRDKEVNGIGEDVWRLVNEAFMFGYLDASILDILLVLIPKVDHPSHQKEFSLISLCNVSYKIITKVSDKVATIFK

SEQ ID NO: 190706 - protein, 458 aa, Glycine max
  Coding DNA Sequence Number=SeqID_73928
  Gene Ontology: Mol. function=phosphoribosylformylglycinamidine synthase activity; Cellular component=cytoplasm; Biological process =purine nucleotide biosynthetic process
  Homolog annotation: Hit_ID=Q8PGR7; Match level="QueryCoverage=57%, HitCoverage=19%, E-value=1e-114, Identity=76%"; Hit description =Phosphoribosylformylglycinamidine synthase
  Pfam annotation: Domain name=Hep_Hag; Domain location=401-428; Score =29.8; E_value=9.7e-06; Accession=PF05658.4; Description=Hep_Hag
LDLNEDVAAPFISTGARTRVAVLREQGVNGQIEMANAFERAGFRAFDVHMSDLIEGRVALQDFTGLVACGGFSYGDVLGAGRGWATSILERSALRDAFAAFFAREDSFALGVCNGCQMMSQLKGIIPGAEHWPQFRRNASEQFEARTALLEVVESPSILLRGMAGSRLQVAVAHGEGQAVFDNAVDQAAARVSLRYIDGNGNVASQYPLNPNGSPDGITGLTSSDGRVTIMMPHPERTPRALNMSWAPAEWQGDSPWMRMFRNARLPLTLEPRFRSIHFAVTGDVGPESPAVALLCPKPVQSGAVPMNRIYRKVWNKALGQLVVASELASSDSSSGGVVDQRRDATQATPALLAVALGLVLGLGVSGTAAAQSVQIGGSATCVAFSGKLLEKCLIEGSASAKGSNAVAIGSNSSATAANSVALGAGSKATRANSVSVGDTGKERQITNVAASTQATDA

SEQ ID NO: 190707 - protein, 107 aa, Glycine max
  Coding DNA Sequence Number=SeqID_73929
MEKLKPTIKEVSVNNPMNWREFRILFRLRIWWSWWKRKLEIFFFFDLLIFHFLHLQRTLQSSSTNHKKKQRKRECRTEDPGAFGTEKLLEETVFQVHAMCIVVNISL

SEQ ID NO: 190708 - protein, 83 aa, Glycine max
  Coding DNA Sequence Number=SeqID_73930
MQLLRERASIHGNISHTHLKNFVRLWNDDYVNGRWFIYASNDVTSKREIGCDINKDICTQKHKSKTKETSLDSGRQREETRLS

SEQ ID NO: 190709 - protein, 181 aa, Glycine max
  Coding DNA Sequence Number=SeqID_73931
  Homolog annotation: Hit_ID=Q1RTL8; Match level="QueryCoverage=50%, HitCoverage=12%, E-value=1e-29, Identity=65%"; Hit description=IMP dehydrogenase/GMP reductase
MFSDSPKLQFFFSLRWPEDFSKVVDDGLKLSKRIYFGKDRVVSLSKHLSPMARLTTAFLPSAPMVYAVISDPGIVDNPDIPSYQPHVYGRCDPPALIPLHMNAIEMEADVTTNPLQIPQPQSSPAKEPLEKDADEDRGGDEGHGEAVDSGEWPKRDLTATKEERKREVEALQLHRLMILCG

SEQ ID NO: 190710 - protein, 61 aa, Glycine max
  Coding DNA Sequence Number=SeqID_73932
MACDPVVRFRKWIEKNGWWNDMAESELINNLRQQSIGNEQAGLRILSDRSRNSFGPQHQYL

SEQ ID NO: 190711 - protein, 77 aa, Glycine max
  Coding DNA Sequence Number=SeqID_73933
MARTLVSMKNLLKFFIFAALVIVQFSHGVSFKDRCHEFCHNIPKANCDAYCKDNHYQKGECIPSYPAGDSLCCCSGD

SEQ ID NO: 190712 - protein, 178 aa, Glycine max
  Coding DNA Sequence Number=SeqID_73934
  Pfam annotation: Domain name=zf-CCHC; Domain location=161-178; Score =22.8; E_value=0.00017; Accession=PF00098.13; Description=Zinc knuckle
MSHHSSSVNGEGTNHKDPLSRILDELSSLKLWKEKLERKEKGKERSLSEELHDYYEGRHRSHLRPHSHRREKERKPQEANINLPYFHGKDNVEAYLNWEIRVEQQLKRKSTLKSYGSHFYPKKDQGLGILGAAPSKPKDDKGKTIEKQVPKASMQKKTSFIKCFKCLGRGHITSQCPT

SEQ ID NO: 190713 - protein, 229 aa, Glycine max
  Coding DNA Sequence Number=SeqID_73935
  Homolog annotation: Hit_ID=Q9SKM9; Match level="QueryCoverage=20%, HitCoverage=40%, E-value=8e-07, Identity=53%"; Hit description =Expressed protein
MRLNTVTGSTHLCFHIFEWHPLELLEAVVNIWMQHTGLCSQAFEHWDEISHMLLVEKLQGSRKQARERQGEILGLCKQAHGKARELQVIRKHVPDQLDPVLRINLIRKMLMDHLIRKLLQASLLRHQRRKGQWCLPRRSTLTMLPRRWTVVRGSSSRQHGSSSRWFVAARASLFVAEEEEEESNGEEEKGSARKKKNGSGEESNALREKKNQKLCEEEEKKLQRRGERE

SEQ ID NO: 190714 - protein, 61 aa, Glycine max
  Coding DNA Sequence Number=SeqID_73936
MTATSSTKKKKKCSEVKRMKRKEEAADDDRGIMDFSQLLLGAPAKLLGAPSNTLKTLVKEV

SEQ ID NO: 190715 - protein, 94 aa, Glycine max
  Coding DNA Sequence Number=SeqID_73937
  Gene Ontology: Mol. function=peptidase activity; Cellular component =vacuole; Biological process=defense response
  Homolog annotation: Hit_ID=Q39807; Match level="QueryCoverage=57%, HitCoverage=68%, E-value=8e-26, Identity=94%"; Hit description =Protease inhibitor
  Pfam annotation: Domain name=Defensin_2; Domain location=19-53; Score= 11.3; E_value=0.044; Accession=PF01097.9; Description=Arthropod defensin
  Pfam annotation: Domain name=Gamma-thionin; Domain location=10-54; Score=87.7; E_value=3.6e-23; Accession=PF00304.11; Description=Gamma- thionins family
  Pfam module annotation: Pfam domain module=Defensin_2::Gamma-thionin; Domain location=19-53::10-54
MGPTMVAEARTCESQSHRFKGPCLSDTNCGSVCRTEGFSGGHCRGFSRRCFCTKEYDNYYKSSDVIRCKDGSGKFTKAQLNDDMCDCVDGTNEP

SEQ ID NO: 190716 - protein, 179 aa, Glycine max
  Coding DNA Sequence Number=SeqID_73938
MKTRVEMEVVLLPQNINSVHEPMCVMAVAMSSSLAKLSCHELTDQYVCMVADAAIMAGSRDEVVAVTQPHISGKHWKGEEARGKNKLFPDLMGCNGYHLVPLAMVQFTREPGNLTAVAEALILLRSQELYRNKALEKNRVPIWLDFHTSNSWNSNGACGFFFAEGERLLGVEQHKCISA

SEQ ID NO: 190717 - protein, 458 aa, Glycine max
  Coding DNA Sequence Number=SeqID_73939
  Gene Ontology: Mol. function=phosphoric monoester hydrolase activity
  Homolog annotation: Hit_ID=Q6VEY3; Match level="QueryCoverage=35%, HitCoverage=36%, E-value=1e-63, Identity=71%"; Hit description=CTD -phosphatase-like protein
  Pfam annotation: Domain name=NIF; Domain location=285-452; Score =207.4; E_value=3.4e-59; Accession=PF03031.8; Description=NLI interacting factor-like phosphatase
MAGVGADEGRSICGYETCDVSDFYISDMIVTSLPFGGNSFDDDISETNCLSDYGSAEPSMFTASEQYMILPALEDDIKVGTSDIISYEEAVMVRESASLYSAIGQIRSCNQESNVKSDLDKSECFDPQSFIKNLPELSEIEVNGQPTLIPKQSPRRKSITLVLDLDGQKIGARSHLHQKQEEARLLLGLRSRLYNMRPKSWVQIAFWTKNLEGGTVHIVQKGVETYSHVVNTDIAYRNQAEEIMCVWTCASLNEDGTSGVGLAFEGVFQSGGRQLESMTASGGGQKSVTGSRKETLVHSTLEPCDDADFTFTVFFNLKEYTVYVKQRPYLHAFLERVSEMFEVVIFTASQSIYAKQLLDILDPDGRFISRRMYRESCLFSDGNYTKDLTILGVDLAKVAIIDNSPQVFRLQVNNGIPIKSWFDDPLDCALMSLLPFLETLADADDVRPIIAKRYGNKE

SEQ ID NO: 190718 - protein, 32 aa, Glycine max
  Coding DNA Sequence Number=SeqID_73940
MDNCKDLTEIGKEHLDHEPTIDPDSRAYGELS

SEQ ID NO: 190719 - protein, 130 aa, Glycine max
  Coding DNA Sequence Number=SeqID_73941
  Gene Ontology: Mol. function=RNA-directed DNA polymerase activity; Biological process=RNA-dependent DNA replication
MRSLGSNELSWEVKTLAFFHAQTVVQRKRSKIHGLFLPEGNWCTDDEILQQEVIFRACLVRQKSCPVTKEEVYKALMGMKSYKAALQPNGFQPAFYKMFWDKIGDDVRHFVKDVFESSIFDLQAAETMIV

SEQ ID NO: 190720 - protein, 89 aa, Glycine max
  Coding DNA Sequence Number=SeqID_73942
MKKRIKIHETKCGPPRGNNFPQQFREREVPRRLNPFFFTPPPIYSKIGEELATQLAQESKVAFSRSNSLLEEGSEGPSEPDFYSYHPFY

SEQ ID NO: 190721 - protein, 80 aa, Glycine max
  Coding DNA Sequence Number=SeqID_73943
MKKEHRVTELVKIPVSALNLWSSCAEAQCGSDLGQISKAEKQIQKIGKDDENEFTLKSRRCLISSDIIGHRSHRCDDQIM

SEQ ID NO: 190722 - protein, 153 aa, Glycine max
  Coding DNA Sequence Number=SeqID_73944
MIKNNREIKLVVIRASILSRRPLTHIITPPPLSPHRYRSRRHTLALMPLFLIICQALYFAFYMIIDEGSQPYISFGSCGPVIVLSGTQPLYNIAGKDSMIEPGGGSVISKQNSHFSGKDKTEPSNSSELRNKPTQGWLARTPLLKKLRVARET

SEQ ID NO: 190723 - protein, 244 aa, Glycine max
  Coding DNA Sequence Number=SeqID_73945
MTTLAQTWSVLSYYDLAPTSHTSDVNLDRARLIYGLVSRMDMDVGSFISQQISQIAQSSTSRLGFPALITALCDIQGVVSDTLIFESLSPAINLAYVKKNCWNPADPSITFPGPRRTRTRASASASEAPLPTQSPSQPSQRPRHPPASTSASMDTHGQMLRSLHVGQQLIMENMHRLSLHLQMDPPLTTPEAYRQRVAWPGDQPSTDRGEEPSRVAEDPAVDEDLIADLATADWGPWADLGGGS

SEQ ID NO: 190724 - protein, 249 aa, Glycine max
  Coding DNA Sequence Number=SeqID_73946
  Gene Ontology: Mol. function=transmembrane receptor activity; Cellular component=membrane; Biological process=signal transduction
  Homolog annotation: Hit_ID=Q9F5N1; Match level="QueryCoverage=99%, HitCoverage=35%, E-value=2e-69, Identity=53%"; Hit description =Methyl-accepting chemotaxis protein McpU
  Pfam annotation: Domain name=Cache_1; Domain location=134-213; Score =84.0; E_value=4.5e-22; Accession=PF02743.8; Description=Cache domain
MTRILVAASSLVVAAFAGFSYYIDSLQHRVTTEAVAENIDSSGKQAAQSIANWLNGRIMLTETVAKTLAKLPEDGAKLQFLENEVLTAQFMSTYFGNAETGTFTTFPKTPLPEGYDPRKRPWYLDAVKAGKTVLTEPYNDASTGGLIITAAIPVSVDGKLTGVTGSDFSLDSLVKMITSVDAGKDGYAFLVSKDGKILIHPDAKFVDKPLTDLFKVDTPVISSAISQTEINGKGKITSFIPVAGLPSVD

SEQ ID NO: 190725 - protein, 54 aa, Glycine max
  Coding DNA Sequence Number=SeqID_73947
MASGFHVLKLCNSSLASGNRLPMLCNRLPEKKTLEAYLLTTCSGYGTHCVVTRS

SEQ ID NO: 190726 - protein, 144 aa, Glycine max
  Coding DNA Sequence Number=SeqID_73948
MTLAANKDSVYDTVCEKYDISKEKWVQFCQTRRDPSWEDVRKKAQAIQKQNAAPHVLSRGGYEYLEQKLMAEKTKKKLEEATQFGSTEVLIDPPSPIRRHVKWKMARTKKSGQMTSKAAKEIAEKIIRFFGGAGVIGFLCPPWT

SEQ ID NO: 190727 - protein, 69 aa, Glycine max
  Coding DNA Sequence Number=SeqID_73949
MVQKAINEGKLKFEEKPMKVDIDPFHIQGESLVNFLLKKQKANKEVMLCPHCSLMFDRPMDKAFEASKI

SEQ ID NO: 190728 - protein, 138 aa, Glycine max
  Coding DNA Sequence Number=SeqID_73950
MRRDAILAMQHENVVRPSVFDRIREGPPLGFEKKMSIKDQEEKEMITDFFEYGDYAREDYFNDPSLSPKPLHLTAMVEDQIINKILVDGGVAFNILPSSMLHVFGRTVKDLSPHNIVVSNFVGKPSDFEGVICLDVSV

SEQ ID NO: 190729 - protein, 262 aa, Glycine max
  Coding DNA Sequence Number=SeqID_73951
  Gene Ontology: Mol. function=sequence-specific DNA binding; Cellular component=nucleus; Biological process=regulation of transcription, DNA-dependent
  Homolog annotation: Hit_ID=Q2HRQ1; Match level="QueryCoverage=77%, HitCoverage=84%, E-value=4e-21, Identity=35%"; Hit description =Transcription factor, MADS-box
  Pfam annotation: Domain name=SRF-TF; Domain location=9-62; Score =23.2; E_value=0.00088; Accession=PF00319.9; Description=SRF-type transcription factor (DNA-binding and dimerisation domain)
MVRPKLILKPIPNGRDRDLAFTKRKKALMTKMTEFSNVCGVKACMIMYDGNYGDAPPLTWPQDDPIEVHSIIKRLGRIWLTMIFPKSKKETLKIKYPTWHSSFNNLGVEELRNFIDRLDFKLEACKQQIEMSKHEHQNEANFSFMQSMVQSESAAPIPGQLNFMQETSQNQFSLVPMRPPNDGNQLDEIEDLTIQLDEIVNWGSQPGKSIVIAVVLVLKFMEMNTTKSPHFAITMDLCNQCNPITMILHCRILLLGQKMCSK

SEQ ID NO: 190730 - protein, 109 aa, Glycine max
  Coding DNA Sequence Number=SeqID_73952
  Gene Ontology: Mol. function=transferase activity; Cellular component= membrane; Biological process=metabolic process
  Homolog annotation: Hit_ID=Q8L6W3; Match level="QueryCoverage=92%, HitCoverage=19%, E-value=3e-43, Identity=73%"; Hit description =Neutral invertase
  Pfam annotation: Domain name=Invertase_neut; Domain location=1-109; Score=-284.8; E_value=0.011; Accession=PF04853.3; Description=Plant neutral invertase
MDCHNPRQGLMPTSFKVRTVPLDSDDSATKEVLDPNFGEASIGRVAPVDSIWERVDVQIGIKMMLKLCLADGFDMFPTLLVTNGSCMIDQRMGIHGHPLEIQMVVVLVN

SEQ ID NO: 190731 - protein, 408 aa, Glycine max
  Coding DNA Sequence Number=SeqID_73953
  Gene Ontology: Mol. function=transition metal ion binding; Cellular component=nucleus; Biological process=proteolysis
  Pfam annotation: Domain name=Transposase_21; Domain location=244-399; Score=10.9; E_value=1.5e-15; Accession=PF02992.5; Description =Transposase family tnp2
MDRSWMKACRISDEYDNEVEQFLQFAERYAPIIRGKYFFPCVKCGNGRRHSLNEIRPYLISSHTNPVDEDIEDRIEEMIHDLGQEGFRQAHAPLYEQLQVDSKKPLYLGCTSFTWLSVMLDLVNLKARLSWSDKSFTELLVVLKKMLPENNTLLKNQYEAKKILSPVGMKYQKIHACPNDCILYKNQFSDMRKCPTCGVSRYKAKDDEGSHHATTNNDRPTKVYWYLPIIPRFNQLYANAHDAENLTWYADGRKSDGLLWYPADSPQWKTVDRLFPDFGDDPRNSRLRLASDEMNPFAGLRQPRNDIDVYLTPLIEDLKTLWVDRVDVFDGNLQQTFKLRAMTQKKDASDKNIWKKMSIFFDLPCWSDLEVRHYIDVMHVEKNVYDSLIDTHLNIKGKTKDGLKSRDC

SEQ ID NO: 190732 - protein, 1120 aa, Glycine max
  Coding DNA Sequence Number=SeqID_73954
  Gene Ontology: Mol. function=G-protein coupled photoreceptor activity; Cellular component=membrane; Biological process=regulation of transcription, DNA-dependent
  Homolog annotation: Hit_ID=Q2HRN2; Match level="QueryCoverage=99%, HitCoverage=99%, E-value=0.0, Identity=76%"; Hit description =Phytochrome e
  Pfam annotation: Domain name=GAF; Domain location=219-389; Score =117.3; E_value=4.4e-32; Accession=PF01590.16; Description=GAF domain
  Pfam annotation: Domain name=HATPase_c; Domain location=991-1103; Score=60.2; E_value=6.7e-15; Accession=PF02518.16; Description =Histidine kinase-, DNA gyrase B-, and HSP90-like ATPase
  Pfam annotation: Domain name=HisKA; Domain location=879-943; Score =43.1; E_value=9.2e-10; Accession=PF00512.15; Description=His Kinase A (phosphoacceptor) domain
  Pfam annotation: Domain name=PAS; Domain location=606-722; Score =105.0; E_value=2.2e-28; Accession=PF00989.14; Description=PAS domain
  Pfam annotation: Domain name=PAS; Domain location=737-859; Score =97.7; E_value=3.6e-26; Accession=PF00989.14; Description=PAS domain
  Pfam annotation: Domain name=PAS_2; Domain location=73-186; Score =202.1; E_value=1.3e-57; Accession=PF08446.1; Description=PAS fold
  Pfam annotation: Domain name=PAS_4; Domain location=612-727; Score =12.0; E_value=0.013; Accession=PF08448.1; Description=PAS fold
  Pfam annotation: Domain name=Phytochrome; Domain location=400-579; Score=406.7; E_value=3.4e-119; Accession=PF00360.10; Description =Phytochrome region
  Pfam module annotation: Pfam domain module=GAF::HATPase _c::HisKA::PAS::PAS::PAS_2::PAS_4::Phytochrome; Domain location=219 -389::991-1103::879-943::606-722::737-859::73-186::612-727::400-579
MSFGSRGKLKDTSLSTSAESNMNSKRDKILAQYSADAEILAEFEQSGVSGKSFDYSRMVLDPPRLVSEQKMTAYLSKIQRGGLIQPFGCMLAIEESTFRIIGFSDNCFQLLGLERQIDSKQFMGLIGVDATTLFTPPSGASLAKAAASREISLLNPIWVYARTTQKPFYAILHRIDVGVVIDLEPARMSDPALSLAGAVQSQKLAVRAISRLQSLPGEDIGLLCDTVVEEVQKLTGYDRVMVYKFHEDDHGEVVSEIRRSDLEPYLGLHYPATDIPQASRFLFKQNRVRMICDCHAKPVKVIQSEELRQPLCLVNSTLRLPHGCHTQYMANMGSIASLVMAIVVNGKHATRLWGLLVCHHTSPRYVSFPVRYACEFLMQAFGLQLYMEIQLASQMAEKRILKTQTLLCDMLLRDAPLGIVNQSPSIMDLVKCDGAALYYEGNCWLLGTTPTEAQVKDIAEWLLSNHGDSTGLTTDSLADAGYPGAASLGDAVCGMATARINSKHFLFWFRSHTAKEVKWGGAKHHPEDKDDGGKMNPRSSFKAFLEVVKSKSLPWEVPEINAIHSLQLIIRDSFQDTENTGPKTLTYVQKSDTATGGMDELSSVALEMVRLIETATVPIFGVDLGGVINGWNTKIAELTGLQASEAMGKSLVNEIIHADSCDTFKSTLSRALQGQEDKNVELKIKHFGLDQQQEVAYLVVNACTSRDHTDAIVGVCFVGQDITCEKVVQDKFIQLEGDYKAIIQSLSPLIPPIFSSDENACCSEWNAAMERLTGWKRDEVIGKLLPGEIFGSFCRLKGQDTLTNFMILLYRGISGQDSEKIPFGFFDRNGEFIETYITANKRIDTGGNMLGCFCFLQIVMPDLNQPSEEHKPRGRESISESKELAYILQEMKKPLNGIRFTRKLLENTAVSENQKQFLDTSDACERQILAIIEDTNLGSINEGTLQLNMEEFVLGNILDAIVSQVMMLIREKNLQLFHEIPDEIKMLSLYGDQIRLQVVLSDFLLNVVSHTASPNGWVEIKISPGLTLQDGNEFIHLKFSMAHSGQGIPSNVLHDMFEGGNQWTTQEGLGLYMSRKILSRISGHVQYVREQNKCYFLIDLEIRKRKERKRNLHAETSMLS

SEQ ID NO: 190733 - protein, 74 aa, Glycine max
  Coding DNA Sequence Number=SeqID_73955
MIFFFKKHRLSSHGASIECGRKRTYRTAPASQGSSRCYPSCDKGARRHEEPGPCLASLTMVECGGVSCSILVPL

SEQ ID NO: 190734 - protein, 181 aa, Glycine max
  Coding DNA Sequence Number=SeqID_73956
  Homolog annotation: Hit_ID=Q1SL15; Match level="QueryCoverage=67%, HitCoverage=12%, E-value=3e-14, Identity=35%"; Hit description =Ovarian tumour, otubain
SVKVSVFVVAVVGSSSATYEMDGDQWMYDSMMSEEVDMDYQNEEECGVNESHVFDSRDDVLQWARSVAHENGFVAVIIRSDTNTGCRERISFVLIGRERSAEYRCRKKEFVRRDTGTRKCGCPFNLRGKPLMCGIHNHELAKSLVGYPYAGRLTKAEKTLIADMTKSMVKPRNILLTLKEH

SEQ ID NO: 190735 - protein, 108 aa, Glycine max
  Coding DNA Sequence Number=SeqID_73957
MGEVEEVQEKMKADMEAMKEQMATMMAMMSMRKIMEANAVVVAATSTVAKIQNEHAFPPYGLPPNVAYTPNENVNNSTPLPIESQQPRTIMHMSFKPWGRHMKFPTTI

SEQ ID NO: 190736 - protein, 902 aa, Glycine max
  Coding DNA Sequence Number=SeqID_73958
  Gene Ontology: Mol. function=binding; Cellular component =intracellular; Biological process=metabolic process
  Homolog annotation: Hit_ID=Q2QNV4; Match level="QueryCoverage=87%, HitCoverage=67%, E-value=1e-131, Identity=29%"; Hit description =Pentatricopeptide, putative, expressed
  Pfam annotation: Domain name=PPR; Domain location=167-201; Score =19.1; E_value=0.016; Accession=PF01535.11; Description=PPR repeat
  Pfam annotation: Domain name=PPR; Domain location=202-236; Score=1.8; E_value=4.6; Accession=PF01535.11; Description=PPR repeat
  Pfam annotation: Domain name=PPR; Domain location=268-302; Score =33.1; E_value=9.9e-07; Accession=PF01535.11; Description=PPR repeat
  Pfam annotation: Domain name=PPR; Domain location=303-337; Score =12.1; E_value=0.27; Accession=PF01535.11; Description=PPR repeat
  Pfam annotation: Domain name=PPR; Domain location=369-403; Score =40.3; E_value=6.5e-09; Accession=PF01535.11; Description=PPR repeat
  Pfam annotation: Domain name=PPR; Domain location=470-504; Score =13.2; E_value=0.2; Accession=PF01535.11; Description=PPR repeat
  Pfam annotation: Domain name=PPR; Domain location=571-605; Score =38.7; E_value=1.9e-08; Accession=PF01535.11; Description=PPR repeat
  Pfam annotation: Domain name=PPR; Domain location=672-706; Score =49.0; E_value=1.6e-11; Accession=PF01535.11; Description=PPR repeat
  Pfam annotation: Domain name=PPR; Domain location=707-741; Score =12.0; E_value=0.28; Accession=PF01535.11; Description=PPR repeat
  Pfam annotation: Domain name=PPR; Domain location=743-776; Score=4.8; E_value=2; Accession=PF01535.11; Description=PPR repeat
  Pfam annotation: Domain name=PPR; Domain location=809-843; Score=2.2; E_value=4.1; Accession=PF01535.11; Description=PPR repeat
  Pfam module annotation: Pfam domain module=PPR::PPR::PPR::PPR::PPR::PP R::PPR::PPR::PPR::PPR::PPR; Domain location=167-201::202-236::268 -302::303-337::369-403::470-504::571-605::672-706::707-741::743 -776::809-843
MKRHQWEKNAYLYGQRWRRFWVHVLNATPQSNSSMHGQTRQCNDHDSEARRAVAQGLKKKKNIKSVGNGSAGSKLMHTATTSICNNNNVMAKPETLDSLTTQLESLFRACSDASMVQQARQVHTQVIVGGMGDVCAPSSRVLGLYVLCGRFRDAGNLFFELELRYALPWNWMIRGLYMLGWFDFALLFYFKMLGSNVSPDKYTFPYVIKACGGLNNVPLCMVVHDTARSLGFHVDLFAGSALIKLYADNGYIRDARRVFDELPLRDTILWNVMLRGYVKSGDFDNAIGTFCEMRTSYSMVNSVTYTCILSICATRGNFCAGTQLHGLVIGSGFEFDPQVANTLVAMYSKCGNLLYARKLFNTMPQTDTVTWNGLIAGYVQNGFTDEAAPLFNAMISAGVKPDSVTFASFLPSILESGSLRHCKEVHSYIVRHRVPFDVYLKSALIDVYFKGGDVEMARKIFQQNILVDVAVCTAMISGYVLHGLNIDAINTFRWLIQEGMVTNSLTMASVLPACAAVAALKPGKELHCHILKKRLENIVNVGSAITDMYAKCGRLDLAYEFFRRMSDRDSVCWNSMISSFSQNGKPEIAIDLFRQMGMSGAKFDSVSLSSALSAAANLPALYYGKEMHGYVIRNAFSSDTFVASTLIDMYSKCGNLALAWCVFNLMDGKNEVSWNSIIAAYGNHGCPRECLDLYHEMLRAGIHPDHVTFLVIISACGHAGLVDEGIHYFHCMTREYGIGARMEHYACMVDLYGRAGRVHEAFDTIKSMPFTPDAGVWGTLLGACRLHGNVELAKLASRHLLELDPKNSGYYVLLSNVHADAGEWASVLKVRSLMKEKGVQKIPGYSWIDVNGGTHMFSAADGNHPESVEIYLILKSLLLELRKQGYVPQPYLPLHPQIMGKN

SEQ ID NO: 190737 - protein, 42 aa, Glycine max
  Coding DNA Sequence Number=SeqID_73959
MWVIQRASRINIEMILMDEKAHKIVAQIKNVDPGKWNDVKVG

SEQ ID NO: 190738 - protein, 76 aa, Glycine max
  Coding DNA Sequence Number=SeqID_73960
  Subcellular localization annotation: CTP_CleavageSite=34; ConfidenceScore=5.18e-01
MADHDDLLASEMAERSTPPTAVSNTANVLPPCTRGRRNQSRVWTVSIVIFAVCLRLNDTIKQTKGLKGIVGQQIGK

SEQ ID NO: 190739 - protein, 244 aa, Glycine max
  Coding DNA Sequence Number=SeqID_73961
MSLIGKHLQFLIDRESAEGRCLRDAVNYLNGYMVHYICHDKQVLRMFHAKEFITMAQELGAKIVAHKSSIENAKMIIAQPAPLVVLIEWIKKQKEDLRYEGTVNVVGTSGNSQRNFQMALADVTNTQPNSQHVPTRQRKTINNICRLHSNLYNDFVAASSTSTGLLNNEIHDHSFVPQHANDPLHHTNEASLDNNTENAETYDSVLDDENELSDYVDDSTHDISTGYVDLGDPYEACAYCQVAM

SEQ ID NO: 190740 - protein, 37 aa, Glycine max
  Coding DNA Sequence Number=SeqID_73962
MEDATKTDFQNPPCPPHFLDVVMDLGDCRGHQTSLHH

SEQ ID NO: 190741 - protein, 80 aa, Glycine max
  Coding DNA Sequence Number=SeqID_73963
MKTLLCLLILSLCLLILSFCLPEDAFFKRNKGTCNGGILPHYWGFGVESRETSSDILDPFVIEQGWKDIMYFNTKIWNRK

SEQ ID NO: 190742 - protein, 317 aa, Glycine max
  Coding DNA Sequence Number=SeqID_73964
MGKICKKSPNPYLAEKKLLEEKRKTREQQAEFTENSSLSLDPPSLVSRHVKWKMARTRRYRQMTSTATQEISDKIGLVSQLASTLDRHLVAQIVLVEEENKNLQEAWRRTVEEEQLRKEVEEENKNLQETWRMTVEEENKRSLELIKQQLKQAIKLELSQIASQHSPPLEPPDIQVVVAGVSTKGSCAEAYTIPLAKKPSDLHIDIMGLYVVHDQCTKLVALGKVYDSAFTIHNIPYADDVVRVSVVKVYHGDAYGSPLQLLFVHLYLKEISMGVYRKAHQIVKYLKLKRMNPSIEHRELMLAKIKFRIEALLIEHV

SEQ ID NO: 190743 - protein, 165 aa, Glycine max
  Coding DNA Sequence Number=SeqID_73965
  Homolog annotation: Hit_ID=Q9LTU4; Match level="QueryCoverage=35%, HitCoverage=4%, E-value=7e-12, Identity=59%"; Hit description =Helicase-like protein
MSIKYLFKYINKGYDRITTTFMPVQNEDGTTEQIVDKMKHYLDGFLVDDKEYIETLRGACYWGSGQFLRRLFVTMLISNSIERPNHRHIFGSIINVVNRQAGGMFFLYRYGGTRKTFMWKTLASALHSKGDIVLIVASSGIASLLLPNSNLTLTNAQEIKSFPNG

SEQ ID NO: 190744 - protein, 409 aa, Glycine max
  Coding DNA Sequence Number=SeqID_73966
  Gene Ontology: Mol. function=nucleic acid binding; Cellular component= lysosome; Biological process=regulation of transcription from RNA polymerase II promoter
  Homolog annotation: Hit_ID=Q6YZW2; Match level="QueryCoverage=99%, HitCoverage=87%, E-value=1e-142, Identity=62%"; Hit description =Putative oligouridylate binding protein
  Pfam annotation: Domain name=RRM_1; Domain location=106-177; Score =90.1; E_value=6.6e-24; Accession=PF00076.12; Description=RNA recognition motif. (a.k.a. RRM, R
  Pfam annotation: Domain name=RRM_1; Domain location=21-88; Score =59.2; E_value=1.3e-14; Accession=PF00076.12; Description=RNA recognition motif. (a.k.a. RRM, R
  Pfam annotation: Domain name=RRM_1; Domain location=228-306; Score =35.8; E_value=1.5e-07; Accession=PF00076.12; Description=RNA recognition motif. (a.k.a. RRM, R
  Pfam module annotation: Pfam domain module=RRM_1::RRM_1::RRM_1; Domain location=106-177::21-88::228-306
MEPVPSGNLPPGFDTSACRSVYVGNIHVNVTDKLLAEVFQSAGPLAGCKLIRKEKSSYGFVDYHDRASAALAIMTLHGRQLYGQALKVNWAYANSSREDTTGHFNIFVGDLSPEVTDATLFACFSVYPSCSDARVMWDHKTGRSKGYGFVSFRDHQDAQSAINDMTGKWLGNRQIRCNWATKGAGGSSNEEKNNDSQNAVMLTNGSSDGGQDNNNEDAPENNPSYTTVYVGNLPHDLYWTAFCSVFDVTQAELHCQFHALGAGVIEEVRVQRDKGFGFIRYNTHDEAALAIQMANGRLVRGKNMKCSWGSKPTPPGTASNPLPPPAQPYQILPTAGMNQGYSPAELLAYQRQLALSQAAVSGLSGQALLQMTGQHGLAPASMGINSGASQAMYDGYTGNSSRQQLMYYR

SEQ ID NO: 190745 - protein, 90 aa, Glycine max
  Coding DNA Sequence Number=SeqID_73967
PLEWPLELPPAEALALTEALGLRKPHFPPKEKARLLVRHKPRYRLCSIGSVTSEHWHYAGTNDGGAEGVGVEVEAGGAGAEEDGPSDPRA

SEQ ID NO: 190746 - protein, 102 aa, Glycine max
  Coding DNA Sequence Number=SeqID_73968
  Gene Ontology: Mol. function=protein serine/threonine kinase activity; Biological process=protein amino acid phosphorylation
  Homolog annotation: Hit_ID=Q1S3M6; Match level="QueryCoverage=60%, HitCoverage=7%, E-value=3e-21, Identity=74%"; Hit description =Protein kinase; UspA
AIEKGTFAEMLDPSVVDWPMEDAMKLAKMGLQCAELRRKDRPDLGKVILPELNRLRDLAEDNNLISVLDNSMDAPLAKQVSVHLDGGGPSFTQSREIRANNS

SEQ ID NO: 190747 - protein, 457 aa, Glycine max
  Coding DNA Sequence Number=SeqID_73969
  Gene Ontology: Mol. function=protein serine/threonine kinase activity; Cellular component=ubiquitin ligase complex; Biological process=protein amino acid phosphorylation
  Homolog annotation: Hit_ID=Q1PF03; Match level="QueryCoverage=90%, HitCoverage=54%, E-value=1e-151, Identity=64%"; Hit description =Protein kinase family protein
  Pfam annotation: Domain name=Pkinase; Domain location=161-377; Score =52.0; E_value=2e-12; Accession=PF00069.15; Description=Protein kinase domain
  Pfam annotation: Domain name=Pkinase_Tyr; Domain location=161-403; Score=37.2; E_value=9.5e-15; Accession=PF07714.7; Description =Protein tyrosine kinase
  Pfam module annotation: Pfam domain module=Pkinase::Pkinase_Tyr; Domain location=161-377::161-403
METGTPPEFSSLSFESDRHSSSTSQAVDDMEAEMRRLKLELKQTMELYNTACKEAFTAQQKAVELKKWKLEEERRLEEARLAEETALAVAEKERAKSKAAIEAAEAQKRIAQLEAQKRLTAEMKALRESEEKKKVLDALVNVDIRYRRYTIEEIEAATDFFAESLKIGEGGYGPVFKCLLDHTPVAVKVLRPDAQQGRSQFQREVEVLSCIRHPNMVLLLGACPEYGCLVYEYMANGSLDDCLFRQGSTPPLPWQLRFKIAAEIGTGLLFLHQTKPEPLVHRDLKPANILLDRNYVAKISDVGLARLVPPSVADSVTQYHMTSTAGTFCYIDPEYQQTAKSPMGLTHHVERAIENGIFTEMLDPSVLDWPVEDALKLAKMGLQCAELRRRDRPDLGKVILPELNRLRDLAEDNNLISVMGNSMDAHLEKQLSVHLDGGVHHLLGRGKLEQTIQSVFY

SEQ ID NO: 190748 - protein, 560 aa, Glycine max
  Coding DNA Sequence Number=SeqID_73970
  Gene Ontology: Mol. function=translation initiation factor activity; Cellular component=cytoplasm; Biological process=mRNA catabolic process, nonsense-mediated decay
  Homolog annotation: Hit_ID=Q2HSQ9; Match level="QueryCoverage=97%, HitCoverage=45%, E-value=0.0, Identity=81%"; Hit description =Initiation factor eIF-4 gamma, middle; Up-frameshift suppressor 2
  Pfam annotation: Domain name=MIF4G; Domain location=23-245; Score =18.8; E_value=0.0017; Accession=PF02854.9; Description=MIF4G domain
MFCIPHKIGKKDSGFLRTLDSSIKRNTAVIKKLKQINEEQREALMDELRSVNLSKFVSEAVAAICDAKLRSSDIQAAVQICSLLHQRYKDFAPSLVQGLLKVFSPGKPGDESDTDRNLKAMKKRSSLKLLLELFFVGVIEDGGIFINIIKDLTSGEQLKDRDAAQTSLTLLSSFARQGRIFLGLSVSGPEIHEEFFKGLNITADQKKVLRKACYSFYDAAAELLQSEHSSLRLMEHENSKILNAKGELSDENIASYEKLRKSYDHLYRNISSLAEALDMQPPVMPEDGHTTRVTSGEDGISSASGKDSSVVEPIWDDEDARTFYECLPDLRAFVPAVLLGETEPKSSEQSAKNQDQTTEILPESDKGQQTTHESGEVSTESSALPEAESTERVKDKEEKDKSKELDREKEKEKENDKKGENEKDKLRSVEGTNLDALLQRLPGCVSRDLIDQLTVEFCYLNSKSSRKKLVRALFNVPRTSLELLPYYSRMVATLSTCMKDVSSILLQMLEEEFNFLINKKDQMNIETKIRNIRFIGELCKFKISPPGLVFSCLKVQEINN

SEQ ID NO: 190749 - protein, 109 aa, Glycine max
  Coding DNA Sequence Number=SeqID_73971
MCATCAIDDGNGSNSDDDNGVDTSSVSSSVDGDNISSNDKNNGNDDNVNDDDNDGACESNNNVSDDNNNSDNIDKSDNNDHNSNCDISDSCGDNDNNCGNNNDIMNYYN

SEQ ID NO: 190750 - protein, 234 aa, Glycine max
  Coding DNA Sequence Number=SeqID_73972
  Gene Ontology: Mol. function=protein serine/threonine kinase activity; Cellular component=ubiquitin ligase complex; Biological process=protein amino acid phosphorylation
  Homolog annotation: Hit_ID=Q1PF03; Match level="QueryCoverage=99%, HitCoverage=31%, E-value=6e-55, Identity=48%"; Hit description =Protein kinase family protein
  Pfam annotation: Domain name=Usp; Domain location=14-169; Score=47.1; E_value=5.8e-11; Accession=PF00582.16; Description=Universal stress protein family
MWLPKHHSEKKDGVNGLVAVAIDKEKGSQNALKWAVDNLLTKSATVILIHVKLLAPILSPSPSLFTPRISALLGDDTSLVSKEPEGNNKNVFLPYRVFCTRKDIQCTDVLLEDSDISKALIEYASQAGIEHLVLGSSTKTSLLKRFKVSDTPGAVSKGAPDFCTVYVIAKGKIQTMRSASRPAPAIVPNLLSQASVRKDSDPNVLLAQSIKEQETRHSFDAALPRRSQDESETF

SEQ ID NO: 190751 - protein, 140 aa, Glycine max
  Coding DNA Sequence Number=SeqID_73973
  Homolog annotation: Hit_ID=Q1T344; Match level="QueryCoverage=72%, HitCoverage=36%, E-value=6e-15, Identity=37%"; Hit description=RNA polymerase, RBP11-like
MDEDQWMYDNTMFEEIDMNEENEEKPGVNEENGEESSCERNGKYRVRKKYLVRTITDNRKCGCPFKLQAKLVVGGEGWMMKLICGSHNHVLAKSLVGHPYVDRLTKDEKIIIVDMTKSMVKPRNILLTLKEHNANSYTTM

SEQ ID NO: 190752 - protein, 642 aa, Glycine max
  Coding DNA Sequence Number=SeqID_73974
  Gene Ontology: Mol. function=translation initiation factor activity; Cellular component=cytoplasm; Biological process=mRNA catabolic process, nonsense-mediated decay
  Homolog annotation: Hit_ID=Q2HSQ9; Match level="QueryCoverage=82%, HitCoverage=43%, E-value=0.0, Identity=74%"; Hit description =Initiation factor eIF-4 gamma, middle; Up-frameshift suppressor 2
  Pfam annotation: Domain name=MIF4G; Domain location=50-251; Score =175.1; E_value=1.8e-49; Accession=PF02854.9; Description=MIF4G domain
  Pfam annotation: Domain name=Upf2; Domain location=325-507; Score =203.1; E_value=6.5e-58; Accession=PF04050.5; Description=Up -frameshift suppressor 2
  Pfam module annotation: Pfam domain module=MIF4G::Upf2; Domain location=50-251::325-507
MANMLEILMRLKNVKNLDPRHSTLVENAYYLCKPPERSARVAKVRPPLHQYIRKLLFSDLDKSTIEHVLRQLRKLPWNECEPYLLKCFMKVYKGKYGQIHLIASLAAGLSRYHDEFAVAIVDEVLEEIRVGLELNDYGMQQRRIAYMRFLGELYNYEHVDSSVIFETLYLILIYGHGTQEQDVLDPPEDCFRIRLIITLLETCGHYFDRGSSKRKLDRFLIHFQRYILSKGALPLDIEFDLQDLFVDLRPNMVRHNSIEEVNAALVELEEHDRIVFADKASSEKHSDTEKSLSRTTSTTTVVGNGQSIDNGMEENGVQDDNDSETDSGSDTIDVEGHDDEELDEENHDDGCETEDDDDDDDDGPGPASDEEDEVHVRQKMTQVDPLEEANFDQELKAVVQARESMEQRRQELRGRPTLNMMIPMNVFEGSAKDHHGRGVGGESGDEPLDEDTGGNKEVQVRVLVKRGNKQQTKQMFIPRNSSLVQSTKQKEAAELQEKEDIKRLVLEYNDREEEELNGLGTQATNWMQSVGYKGGGRGSSLEGNSGRGSGSRHRHHNYSGSGIYYSRRNVGDAGRGYRVVYTPLWFPDLKLTCRIYLYGAKITMFGFGGVKLAKDCSIGDLAEDCTIVCHWECVKLFLVETP

SEQ ID NO: 190753 - protein, 58 aa, Glycine max
  Coding DNA Sequence Number=SeqID_73975
MTATVAAGSDNDDKGTNDGVLTARREEAKMKKECTNSGVGNYAGCTKQLPSYTLLFDI

SEQ ID NO: 190754 - protein, 343 aa, Glycine max
  Coding DNA Sequence Number=SeqID_73976
  Gene Ontology: Mol. function=DNA binding; Cellular component =membrane; Biological process=DNA integration
  Homolog annotation: Hit_ID=Q1SKN1; Match level="QueryCoverage=97%, HitCoverage=32%, E-value=1e-82, Identity=40%"; Hit description =Integrase, catalytic region
MNAEIQALEANHTWTLTDLPPNKTVIGFRLLLALAAINKWHLRQLDVNNAFLHGDLNEEVYMVIPQGMNPKKPGLVYRLQRSLYGLKQASRQWYVRLSFFLISHGYKQCASDYSLFLKHQHNYITALLVYVDDIVLSGNNFTEIQNISHLLDNAFKIKDLGDLRFFLGFEVARTSTGINLYQRKYALDILTDTGMLGSKLVSTPSDYTTILHQHSSSPLSAEDASSYRRLIGFNVCLGSSLISWKSKKQAPVSRSSSEVAMANLSSALHIASNPVFHERTKHIEIDFHIIQEKILVGLVKLLPITSANQLVDIYTKALMPGAFQFLYSKLGMSNIHSHLEGGS

SEQ ID NO: 190755 - protein, 324 aa, Glycine max
  Coding DNA Sequence Number=SeqID_73977
  Gene Ontology: Mol. function=protein binding; Cellular component =nucleus
  Homolog annotation: Hit_ID=Q5HZP1; Match level="QueryCoverage=51%, HitCoverage=59%, E-value=2e-15, Identity=32%"; Hit description =Ribonuclease H2 subunit B
MEKLDPVEQPTQSPWAWSGWYREGPCLIMREGNIPARAPLGDSVPLSLRSGTTDSRRTRCSYASADPGTDGNGLGQMISLRHPKSGNATQYLFVNGMLQELQWFKNLYGSWFLGDYITEDGRMYLSTPIDPVFIMLPIFEEARMKKGDDLGRFRQLDEILFIDGYPGYMQLMSVVENCMLVVSEVKEIGSSKFFRLDDSKVLRWLCYKVCQLKQTLPKLDKNYAVQSEKDTLIDAVSILGEYLKEKPWLQLLCDHLKLNILEVTGKAQVNAEESNPGLRNELQEQSNDKKATTAKKGRQAKKVKLETESHNIKDMFSRASRKKN

SEQ ID NO: 190756 - protein, 474 aa, Glycine max
  Coding DNA Sequence Number=SeqID_73978
  Homolog annotation: Hit_ID=Q9ZUH9; Match level="QueryCoverage=35%, HitCoverage=49%, E-value=9e-12, Identity=32%"; Hit description =Expressed protein
  Pfam annotation: Domain name=DUF593; Domain location=34-127; Score =131.0; E_value=3.2e-36; Accession=PF04576.6; Description=Protein of unknown function, DUF593
MVLVIASNSIINQGCSMAEKSIRCSVISRSKSDVTAMRDTLLAQQQLLEKLYAELDEEREASATATSEALDMILRLQGEIAVVKMEARHYKRVAEEKIGHAEASLEAFEELMYQKEMQIASLEFQVKAYRHKLMSLGCELQEDLLLLNRSDQRNGENGGQSSSVRRLQSMPAIQFLSSLRAAAKRGRSPSPVLDVIPKIIEESNTDKEVDQPGSGTLDSYLNQIKELNEQVRVISDCAEGEKSANLRSRRGRSCSILPHASAKMTCDQTHRLISTNLDEVSQGESTYNRGVANDSSRLLNVHDVYEVPQTSEDHEVSEHGEKRVENWSSDAENNRLTKPDSVSEGMVESPLKNDAEKKKGVFKVHGEIKTPCLKDMMMTIIGQKKGGMCVDCNSQAEFQKLNQRFERLERERISARQEIINEGNGEEQLRLLKDIQSQLQMIQSGMRSLKTKEVTPKDDVSLASLQEAMLHFWL

SEQ ID NO: 190757 - protein, 197 aa, Glycine max
  Coding DNA Sequence Number=SeqID_73979
  Homolog annotation: Hit_ID=Q1RZN4; Match level="QueryCoverage=33%, HitCoverage=28%, E-value=2e-14, Identity=53%"; Hit description=Zinc finger, SWIM-type
MFQSQGIPCRHILCVLKGKGLTKIPSSYIVNRWTKLANRKPIFDITNNVLDTFSKSENESKLISDVWGHTTKKLFFYDAHSKKENQESDLRPAVERRFQQHWFLVADDVAGSSSVAPRYNFRHRSLHRQAHAKRGSESRCIATYSRDGVSEYHRQRQRGRGGFSSISVGRPAVSVRLLAGARLLCFRLRFVSKPFDL

SEQ ID NO: 190758 - protein, 205 aa, Glycine max
  Coding DNA Sequence Number=SeqID_73980
  Gene Ontology: Mol. function=transcription factor activity; Cellular component=intracellular; Biological process=regulation of transcription, DNA-dependent
  Homolog annotation: Hit_ID=Q2KW76; Match level="QueryCoverage=93%, HitCoverage=81%, E-value=7e-89, Identity=85%"; Hit description=GntR -family transcriptional regulator
MLGIRLPRAVGGGRVLDTVHPRQLVELVAQHAEQHLVAAAFDDTVVEIVVAFLLVVADAGLEGFVFFVGVQHLAHFLDFRRRHAFGRQAAGHAFERFADFVEFGQFLRAERDHAGAGVRHAHQQSLALEPVQRLAQRAAADAVDARQFRFGNLAARGDLALDDGGLDLAEDLFRQGLAVVVRGARQRQHFAHCVNNRMVFWVKTR

SEQ ID NO: 190759 - protein, 218 aa, Glycine max
  Coding DNA Sequence Number=SeqID_73981
  Gene Ontology: Mol. function=oxygen transporter activity; Cellular component=flagellin-based flagellum; Biological process=flagellum organization and biogenesis
  Homolog annotation: Hit_ID=Q7WJA4; Match level="QueryCoverage=97%, HitCoverage=46%, E-value=4e-52, Identity=53%"; Hit description =Flagellar hook-associated protein 2
WSGQLELARLRVGGDAQVGQRADGAFAQHGLQRVGHGRLDRARGAVAGQRLVGGGLCVEGRQVLDGRLQRVVGLDEVLDGLVGDRRVGFELERDRLAGLGFLGQVQRDAVDGLGHVVRTALDRDAVDDHFGVFGLGVGHAGGGGAVGGGAEGQDVLERLVAGDGDVLDRGLDAGVLGRQHQVVVAVAVVDDGGAQAGLVVGVDGLDDAVERGVALQVD

SEQ ID NO: 190760 - protein, 85 aa, Glycine max
  Coding DNA Sequence Number=SeqID_73982
MRIKRSFKVVMGPRTRLVVSFKTRKGKQGSKGLSKELSQGKSIWLEAYKNKIASIISKYACELGSTNKNQAKAIVQAINGAKHTK

SEQ ID NO: 190761 - protein, 87 aa, Glycine max
  Coding DNA Sequence Number=SeqID_73983
SLSRLEGNIIFLLHIVATCPSRASEARLMGALSKGGKMRRVATNEGISTSHVDKSGAFAPTYPSSKRKSDLCSSFLSVNQAILLLEG

SEQ ID NO: 190762 - protein, 97 aa, Glycine max
  Coding DNA Sequence Number=SeqID_73984
MTYKLIIQHRQIYIGYWKTNIVVALPPIPFLAPPLAPLPPPTPVPPLTHAPFLGPALPRAPNPLPPYPLLRPEAHAAAILPRRGVEGTANFLDWRAI

SEQ ID NO: 190763 - protein, 159 aa, Glycine max
  Coding DNA Sequence Number=SeqID_73985
  Homolog annotation: Hit_ID=O80875; Match level="QueryCoverage=58%, HitCoverage=9%, E-value=4e-10, Identity=42%"; Hit description =Expressed protein
  Subcellular localization annotation: CTP_CleavageSite=54; ConfidenceScore=5.11e-01
MGSFVPFGGFFSTPSEFKSPLSCTNASSLSRCDSCNEKCEQEVADILKVGPATSASGYSSTSLPWLQKVNVDSDRRLDVAKVIDAANEVINNIDREELPKFFALKNDPDDEEAELLKIYFDPSLARVELEARDESYDVIIGDLPDQIDGGPCYKLYTKC

SEQ ID NO: 190764 - protein, 123 aa, Glycine max
  Coding DNA Sequence Number=SeqID_73986
MAKNAKKKLEEAVQSGTTNGVIDPPSPIRRHVKWKMARTKKTGQMTSEAAKEIAEEIDSLEEQASQGSFVPHGHQDVLTTAIGRAEHPGRVRAVGVGVTIKQYFGSAPRTSHSSSSLPPEDLQ

SEQ ID NO: 190765 - protein, 55 aa, Glycine max
  Coding DNA Sequence Number=SeqID_73987
MILQSLNPRLLLGGLSLRQKGSTECGYYIMHWMSTIILGSFRKNWEAVIVYFNLN

SEQ ID NO: 190766 - protein, 269 aa, Glycine max
  Coding DNA Sequence Number=SeqID_73988
  Homolog annotation: Hit_ID=Q1T3Y0; Match level="QueryCoverage=48%, HitCoverage=18%, E-value=1e-07, Identity=33%"; Hit description =Targeting for Xklp2
MGEFLVDTKVFEDKKERWSSFSPNKYLEEVEKCATPRSVAQKKAYFGAHSKKVVARKAELLAQEKQREKDSFGLEEHSGIDLSGVKHETSSVGEIHRTHVNEYEEEFAVSRDYQSSSVQIDEPENVCKKQVESPNNNIEAEDVKEISHVLYKETRKASEVEVKDVKLNHPKESKVKSVSKGSNAAKTKKKSMLPTSKASPISTPKASPNIIEQRTYSHYSRPMTSWQRVMVLKKLYKEAEEDVLTVAKKKKNKRRTEREESSMARVLIF

SEQ ID NO: 190767 - protein, 72 aa, Glycine max
  Coding DNA Sequence Number=SeqID_73989
MTLVQGHKSYTCTRSIPLYTTLVTEIKEIKEKQQKQDDIIQSIAAGNKQPLIPHLVLVAGSTLTDEEAARDL

SEQ ID NO: 190768 - protein, 149 aa, Glycine max
  Coding DNA Sequence Number=SeqID_73990
  Gene Ontology: Mol. function=metal ion binding; Cellular component =nucleus; Biological process=multicellular organismal development
  Homolog annotation: Hit_ID=Q9LDT3; Match level="QueryCoverage=85%, HitCoverage=59%, E-value=2e-37, Identity=60%"; Hit description=Axial regulator YABBY4
  Pfam annotation: Domain name=YABBY; Domain location=7-148; Score =144.7; E_value=2.5e-40; Accession=PF04690.4; Description=YABBY protein
MANRKREGIKLILEQQVSVPCSILSTVVTVRCGHCTSLLSVNMKKASLVPFHLLASLTHLEPKEGASEDGANKSLSSYNTSTMTNSDCEEENVTQISDFVHKPPEKRQRTPSAYNRFIKEEIKRLKAENPNMAHKEAFSTAAKNVRFLN

SEQ ID NO: 190769 - protein, 82 aa, Glycine max
  Coding DNA Sequence Number=SeqID_73991
MEEEQFFRHDVNGRPTRSTFHQDVAPLKFMRMWDILVMMRIPCHARSPSTRMLLVKRYLRKRFFQPTRNAIPWETRATLLKI

SEQ ID NO: 190770 - protein, 78 aa, Glycine max
  Coding DNA Sequence Number=SeqID_73992
  Homolog annotation: Hit_ID=Q10N71; Match level="QueryCoverage=73%, HitCoverage=74%, E-value=1e-11, Identity=51%"; Hit description =Uncharacterized plant-specific domain TIGR01589 family protein, expressed
MGEHHSSYPFKDEVQNLIERCILFHMSQDQCVRALAEHAGIKPLVTVTVWKELQKENKEFFRAYLQVTTPRPLFMSKI

SEQ ID NO: 190771 - protein, 230 aa, Glycine max
  Coding DNA Sequence Number=SeqID_73993
MDTPSATISYQDVTALASTWHLATGLSINRGYTNRSLEKPLKWKKLVRAPDAYNTKTFRNQIVWMGTLKASTSNYDGSDNTAHHDDACKMTEEQMITHVTQIHDAQKKKKAEKEEEALVVASMKEKDASVQAKDVDGTIVHGVINDLTNISIMDKTPKASNAAITIEVVHHVQELIVTRDHVQDMIGQAMESFVERQHQENEQFRLFVQNSITTEVSNLIDILMQNLQQA

SEQ ID NO: 190772 - protein, 218 aa, Glycine max
  Coding DNA Sequence Number=SeqID_73994
  Gene Ontology: Mol. function=nucleic acid binding; Biological process= DNA integration
  Homolog annotation: Hit_ID=Q1SDG1; Match level="QueryCoverage=48%, HitCoverage=8%, E-value=4e-18, Identity=38%"; Hit description =Integrase, catalytic region; Zinc finger, CCHC-type
  Pfam annotation: Domain name=zf-CCHC; Domain location=147-164; Score =19.5; E_value=0.00059; Accession=PF00098.13; Description=Zinc knuckle
LWDMVENGDYVPYDDQLNELSRGQWTEEQNLRFLINSKTQNVMLCALSEEECTKVHNFRSAKQMWDILAITYKGMSQVKKNKLNLLTHNYELFSMEKGKDIQTFEEQVLRSSSKALKVDDSSDGGSKWKNSSRKMPKEKKDKEKSSIIFYECKKPGHFKSDCPKLEKGQDKKKHYKTKEKKGLLSTWEDLDDTSPNEDDEEANICLMADTTSEESESD

SEQ ID NO: 190773 - protein, 154 aa, Glycine max
  Coding DNA Sequence Number=SeqID_73995
  Subcellular localization annotation: CTP_CleavageSite=40; ConfidenceScore=5.04e-01
MVVSLFLKWHLQSPFLLLHSTAMIFKKQRTPLMKKIKGLQAPHGATSLNKSVLLKNLPFDLPHSIYTNILRNLKGLCGLDDIYYATVINKLLWDQGMYHVFNKMDDDSKDNLVVKDAINKRKQKKLAKAITDEDREEGRRGGAICMGAQDNEET

SEQ ID NO: 190774 - protein, 103 aa, Glycine max
  Coding DNA Sequence Number=SeqID_73996
MQVGSATFIIRVIKHSGICSGDSKILQVASCFQDVKTSHVTSAFCSPCLHALTVVKQFTAAFCKLHIYKSFPGCQDISCDISFLLPLSPCSYCSEAVHCSIFY

SEQ ID NO: 190775 - protein, 239 aa, Glycine max
  Coding DNA Sequence Number=SeqID_73997
MIDEVVLVRGFWPEALMSISDWLYFDREKGTPEKISREVRSMYDALLPTDPIELAILYTQGWQVDLHDPDAKYERGSGTKHDFDYAARQAKLTAQLIASDKQLTKRSVERIACGDGHGTFVFARELMKHVGDPIKLMQIAITVAECSETPPNRSFFAGLITGADDRDCDLAKRLIRLALQSPNLKNDAIALIGSGRLQSDDIQLVISLLASADIQPWQCKGLGLAQLHGLLAYSATGRT

SEQ ID NO: 190776 - protein, 79 aa, Glycine max
  Coding DNA Sequence Number=SeqID_73998
MDINTLGSSGRRGSKSLRELASGDYPTFGARFWCRLYVLILFYYFLLFVLFEEKRTHPYNQHLLGTNDAKCTKAYGGSV

SEQ ID NO: 190777 - protein, 66 aa, Glycine max
  Coding DNA Sequence Number=SeqID_73999
  Gene Ontology: Cellular component=membrane
MALDRLLHMGINLAVQRLLVTEQLVQAACGDRLAQAELQLPIDELIGIAERAECMHPVDHLHGRGQ

SEQ ID NO: 190778 - protein, 341 aa, Glycine max
  Coding DNA Sequence Number=SeqID_74000
  Gene Ontology: Mol. function=protein binding
  Homolog annotation: Hit_ID=Q2SQI8; Match level="QueryCoverage=68%, HitCoverage=57%, E-value=1e-64, Identity=53%"; Hit description =Uncharacterized conserved protein
  Pfam annotation: Domain name=UPF0027; Domain location=113-341; Score =72.8; E_value=1.1e-18; Accession=PF01139.8; Description =Uncharacterized protein family UPF0027
MGVGIKDVILPGEMKEILNGVVLAEKQAQASVIRRREEANATCSQLNTAKLIEDNPVLMRLKVLEALEKVTEKIDKFAVFGGLDGVLKQLGRAAAPSRTFNKTMDTQQNYQWLHAEGTTPIKGWVNGVPLEAQAHEQLRNIAAIPFVGPWVAVMPDVHLGKGATVGSVIPTRGAIIPAAVGVDIGCGMAAVRTTLRANDLPDDLRQLRNSIERSIPVGNGRGGEHHRMPDSIHTRLVQSGLADGLEKIKDKHRRIRTDKLDRQLGTLGGGNHFIELCLDETDTVWVMLHSGSRGTGNLIGTYFIEKAREELARRVLGFHLPDKDLAFFMEGEPLFDDYVEA

SEQ ID NO: 190779 - protein, 134 aa, Glycine max
  Coding DNA Sequence Number=SeqID_74001
  Gene Ontology: Mol. function=transition metal ion binding; Cellular component=cytoplasm; Biological process=cytoskeleton organization and biogenesis
MGDRLEDMIRDLGQESFQQAHAPVYEGLQSDSKKPLYTGCKNSLTLLSAVLSLVNVKARYGWSDKSFTSLLEVVHNLLPKDNTLPKSYYKAEIYCVRWVWSIRRFMLAPMIAYCTDMNSKKCRNALPVGLHVTK

SEQ ID NO: 190780 - protein, 58 aa, Glycine max
  Coding DNA Sequence Number=SeqID_74002
MKREKHVSYSSHNSCKSLSEELRNYYEGRHRSHPSPHSHRREKERKPQEANINLSYFQ

SEQ ID NO: 190781 - protein, 385 aa, Glycine max
  Coding DNA Sequence Number=SeqID_74003
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-56, Identity=30%"; Hit description= UPI00006A17C9 related cluster
HVLKFRGLHALAFRGLHVLAFRGLHILKFRGLHALAFRGLQVLAFRRLHVLKFRGLHALAIRGLHAFAFRGLHVLTFIGLHVLALIGLHVLAFRGQHILVIRGLHILSFRRLHILTFIGLHVLTFRGLHALAFRGLHVLAIRGLHVLAIRGLHALAFRGLRVLTIRGQHILPFIGLHFLAYRGLHVLAFRGFHAISFRGLHVINFIGLHALTFRGLDFLSFRGLDVLAFRGLHALAFRGLHALTFIRLHALTFRGLCVLAFVGLHALTIRGLHVLTFRGLHVLTLRELQVLAFKGLHVLTFIGLHALTFRGLDIITFIGLDVLAFKGLHALAVRGLHVLPFRGLHALAFIGLHALTFRGLCVLAFVGLHALTFRGLHVLTFRGLH

SEQ ID NO: 190782 - protein, 319 aa, Glycine max
  Coding DNA Sequence Number=SeqID_74004
  Subcellular localization annotation: CTP_CleavageSite=32; ConfidenceScore=5.06e-01
MNTLSTPTVLSLFIAAVKFLDFQMIALSGPCRAKRVHPCWLSANMLLFFNPLNKAKRSCCAKPLFCIKEAKHVLCAKPKGHSAKAELSPTCCTKPRPSFVLKIMASKKRKAPTTPSQAWERYTDIVVPRKLLPERNVVIYHSEFDEFKEELERRKWDKELTSFDEGSIDVAIVKEFYASLYDPEDKSPKQVRVRGHLVKFDEDTLNTFLKTLVIIKDRDTLLAYSRFALLRPDPQELAAMLCIPGRGFELNVDGLPLKILRKNMTTLVQTWSFLSYSNLVPTSHTSDITLDRAKLIYGIIMKMDMNLGYLISHQISIIA

SEQ ID NO: 190783 - protein, 138 aa, Glycine max
  Coding DNA Sequence Number=SeqID_74005
  Gene Ontology: Mol. function=transition metal ion binding; Biological process=DNA integration
TKNLHHPEASIVERYIAEEAIEFCSEYIEKAKPIGLSKSRHNDRVGGKGSRGLHVITPSVEDLLQAHLKLADGPKRNVITWQGYNINKYSFFTKAQDDKSTMQNSEVTLRAECQHFATTPVCRPVVHVDPATGKADGP

SEQ ID NO: 190784 - protein, 347 aa, Glycine max
  Coding DNA Sequence Number=SeqID_74006
  Gene Ontology: Mol. function=alkylbase DNA N-glycosylase activity; Cellular component=intracellular; Biological process=base-excision repair
  Homolog annotation: Hit_ID=Q5KR01; Match level="QueryCoverage=76%, HitCoverage=100%, E-value=1e-101, Identity=69%"; Hit description=3 -methyl-adenine DNA glycosylase II
  Pfam annotation: Domain name=AlkA_N; Domain location=1-112; Score =143.0; E_value=7.8e-40; Accession=PF06029.2; Description=AlkA N -terminal domain
  Pfam annotation: Domain name=HhH-GPD; Domain location=118-228; Score =27.4; E_value=5.1e-05; Accession=PF00730.15; Description=HhH-GPD superfamily base excision DNA repair protein
  Pfam module annotation: Pfam domain module=AlkA_N::HhH-GPD; Domain location=1-112::118-228
MTLLSWRAPYDWQWMFAFLSARAVAGIETFHEDQYTRSFSLDGHRGLITVKPDERSQGFQVTLSHGLLPVADQCLARVAQLFDLACDPFEVTQTLGKLAQPRPGLRLPGALDAFEQAVRAVLGQLVSVAMAAKLTAKVAAVYGEALSEAPGYVIFPEPQKLAQADPLALKALGMPLRRAEALIHLGKAALSGELPLTAPADMATGMKQLQSLPGIGRWTANYYALRAFSRNDACAYCALCQPLATLALLCFVAYLVHRRLGAGRGIGVQGAYHWYRRPEIPIIAAFDGQPSPSIYIQASPAHRLRAKALSPAHFIVNYVNKLAMSILALFRKTAITKIKAICRWKSV

SEQ ID NO: 190785 - protein, 306 aa, Glycine max
  Coding DNA Sequence Number=SeqID_74007
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=5e-48, Identity=31%"; Hit description= UPI00006A17C9 related cluster
MHAFAIRRLHALAFRGLHALAFRGLHVLVIRGLHVLHFRGLHLFTFKGLHALAIRGLHALAFRGLHILTIIGLHVLYFRGLHALTFRGQHVLTIEGLHLLAIRGLHALAFIGLHILTIRRLHVLAFRGLHVLAYRGLHALAFRGLHVLTFIGLHVLAFIGLHVLTFRRLHALAFRGLHVLTFRGLQVLSYRGLYLFTFKGLHALAIRGLHALAFRGLHILTIIGLHVLYFRGLHALTFRGQHVLTIEGLHVLAIRGLHALAFRGMHALAIRGLHALAFIGLHVLTFRGLHAFAFRGLHVFAFRVLN

SEQ ID NO: 190786 - protein, 355 aa, Glycine max
  Coding DNA Sequence Number=SeqID_74008
  Homolog annotation: Hit_ID=Q25XR8; Match level="QueryCoverage=49%, HitCoverage=89%, E-value=8e-09, Identity=30%"; Hit description =Hypothetical protein precursor
  Subcellular localization annotation: CTP_CleavageSite=62; ConfidenceScore=5.79e-01
SPARRSSRAGRSPGAPTATRGPSTAPRASASRSRLPPRSGPPGRRRRSGACPPGRRGRRDHRSRHRGRDPSPHPPVPPSRRPPPGPRWRHGRRTRSTGTTPASPPPRQSPAGGRPAPPARPGCCATTTGVAPGRRVRPVPRAGEEGGSSSACPSVLGQEHLILDGQRAQVDREFDHAVSEDLGAPGPRSGQTQGRRCIGDAIRKLEGETPRARDPGDEALLAERGAALGGGERAVADQELGDREGAELLGEHGLRLEVDDQPGPFGRPALRIRHALGQTHVRHGRDEAARARRLVDPGDLREGGVGRVIRQRDLRHPPGACDERDGGHPDEHVLLHDASTSSIVAVSVAPTRTSI

SEQ ID NO: 190787 - protein, 185 aa, Glycine max
  Coding DNA Sequence Number=SeqID_74009
  Gene Ontology: Mol. function=methyltransferase activity; Biological process=methylation
  Homolog annotation: Hit_ID=Q82VU5; Match level="QueryCoverage=95%, HitCoverage=96%, E-value=2e-43, Identity=50%"; Hit description =Possible N6-adenine-specific methylase
  Pfam annotation: Domain name=Cons_hypoth95; Domain location=4-175; Score=204.7; E_value=2.2e-58; Accession=PF03602.5; Description =Conserved hypothetical protein 95
  Pfam annotation: Domain name=MTS; Domain location=1-171; Score=-73.4; E_value=0.0026; Accession=PF05175.4; Description=Methyltransferase small domain
  Pfam module annotation: Pfam domain module=Cons_hypoth95::MTS; Domain location=4-175::1-171
MNQVRLNAGVWRSRILKFPDAEGLRPTSDRVRQTLFNWLGQDMTGKCCLDLFAGTGALGFEALSRNARQVTMLELAKAPFQALLQNQRLLGATQADIRQADALQFLAQNRQQYDVIFCDPPYHKQWLDKLLPQLAGHLSENGMLYVEAEYALKSDPDWQVIKSGKAGQVFYHLLQPVPALINDTP

SEQ ID NO: 190788 - protein, 189 aa, Glycine max
  Coding DNA Sequence Number=SeqID_74010
  Homolog annotation: Hit_ID=Q47336; Match level="QueryCoverage=18%, HitCoverage=40%, E-value=3e-14, Identity=97%"; Hit description=LacZ -alpha peptide
AIGAGLFAITPAGERGMCCKAIKLGNARVFPVTTLNSMIVSSLQLLILAHPRLFWSIPLIGNKTRINPLFITIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 190789 - protein, 123 aa, Glycine max
  Coding DNA Sequence Number=SeqID_74011
VPTKRSLLELSSQGCTVGTNKLLAKQLESLTETLSKLPTQLQATQPSHSAVMQVEGCSICGGAHESGYCIPLDDAAKEVNYMGNQHRPGFNACGFVGYQQGVNFNQNQGQWRSLPGNQFNKDQ

SEQ ID NO: 190790 - protein, 171 aa, Glycine max
  Coding DNA Sequence Number=SeqID_74012
  Gene Ontology: Mol. function=chitin binding; Cellular component =extracellular region; Biological process=chitin metabolic process
  Homolog annotation: Hit_ID=UPI0000DBF0F4; Match level="QueryCoverage =95%, HitCoverage=82%, E-value=7e-17, Identity=42%"; Hit description =Choline-phosphate cytidylyltransferase B (EC 2.7.7.15) (Phosphorylcholine ...
  Homolog annotation: Hit description=transferase B) (CTP:phosphocholine cytidylyltransferase B) (CT B) (CCT B) (CCT-beta).
MHALTFRGLHVLAIRRLHALTFRGLYVLAIRGLHSLTYRGLHVLTFREVHTLAFRGLHVLAFRGLHALAFRGLDALAFRGLHVLAFRRLHALTFRELHALAFRGLDVLTFRGLDILTFRGLHALAFIGLDVLAFRGLDVLAFRGLHTLPFRGLHVLSFRGLHAFAFRPSPS

SEQ ID NO: 190791 - protein, 67 aa, Glycine max
  Coding DNA Sequence Number=SeqID_74013
  Subcellular localization annotation: CTP_CleavageSite=63; ConfidenceScore=5.50e-01
MQGYHMVTRTFHQPGANEPVDTQRLTSSSAPFVVLTREVLLSSSGNIESRRRARFFFARPGKSSAMV

SEQ ID NO: 190792 - protein, 58 aa, Glycine max
  Coding DNA Sequence Number=SeqID_74014
MSRNFTDCLTMGVKYLEVAQNDHNLSLRAIGHDRIWMAKGVRNDQNLSPHVIGLTASG

SEQ ID NO: 190793 - protein, 264 aa, Glycine max
  Coding DNA Sequence Number=SeqID_74015
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-43, Identity=35%"; Hit description= UPI00006A17C9 related cluster
  Subcellular localization annotation: CTP_CleavageSite=34; ConfidenceScore=5.68e-01
VRACSPLLVRTCSPLKVRACSPTKARTCSPLKVRACSPTKVRTCSPLMVRACSPLKVRTCGPLKVRACSPTKVRTCSHLMARACSPLKVKACSPLMVRMCSPLNARTCSPLKARTCSPLKVRACSPLLARTCSPLKVRACSPTKVRICSPLMARACSPLKVRTCGPLKVKACSPLMVKTCSPLKARMCSPLKVRACSPLLARTCSPLKVRACSPTKVRICSPLMARACSPLKARTCGPLKVSACSPTKVRTCTHQMARACSPLK

SEQ ID NO: 190794 - protein, 97 aa, Glycine max
  Coding DNA Sequence Number=SeqID_74016
MFQKSPLVIDYRICVIDYSAFTSNHHDHHQNIKVICFYTVMMMVVAVVTIVECDNGGGGCYGDEGEVVATTMMMVVAMVTMKPCDGDGYGCYGRSES

SEQ ID NO: 190795 - protein, 47 aa, Glycine max
  Coding DNA Sequence Number=SeqID_74017
MDGRCVHNLPNHGFQCYKRFMVVEAEPNLSIHSNVQWKLGNEVQILL

SEQ ID NO: 190796 - protein, 34 aa, Glycine max
  Coding DNA Sequence Number=SeqID_74018
MAQPLILRTYQMKMRLVGSKAMIVILTPLPGPKE

SEQ ID NO: 190797 - protein, 270 aa, Glycine max
  Coding DNA Sequence Number=SeqID_74019
  Gene Ontology: Mol. function=DNA binding; Biological process =regulation of transcription
  Homolog annotation: Hit_ID=UPI00005DC297; Match level="QueryCoverage =92%, HitCoverage=97%, E-value=9e-60, Identity=51%"; Hit description =transcription factor
  Pfam annotation: Domain name=Myb_DNA-binding; Domain location=23-74; Score=43.4; E_value=7.5e-10; Accession=PF00249.21; Description=Myb -like DNA-binding domain
MEGGGREGYNGVIMTMTRDPKPRLRWTADLHDRFVDAVTKLGGPDKATPKSVLRLMGLKGLTLYHLKSHLQKYRLGQQAQKQNEEVHKENSRCSYVNFSNRSLAPNTSYRGDDEGGEIPIAEALRCQIEVQKRLEEQLKVQKKLQMRIEAQGKYLQSVLEKAQRSLSLDGPGSLEASRAELTEFNSALSNFMENMNKDSKQNIIEVNNFYSKSHGSAFYNQEVGREQNRDQKPKVEGGSIQFDLNIKGSNDLVSAGGAEMDANMVSSYRV

SEQ ID NO: 190798 - protein, 88 aa, Glycine max
  Coding DNA Sequence Number=SeqID_74020
  Gene Ontology: Mol. function=transcriptional repressor activity; Biological process=regulation of nitrogen utilization
  Homolog annotation: Hit_ID=P52581; Match level="QueryCoverage=99%, HitCoverage=34%, E-value=1e-34, Identity=68%"; Hit description =Isoflavone reductase homolog
VYMDEDDVATYTVKTIDDPRTLNKMVYLRPPENILTQRQLIEKWEKLIGKQLEKSSMNEQDFLASMEGCLTNFEIGEGGEEAPELYPE

SEQ ID NO: 190799 - protein, 272 aa, Glycine max
  Coding DNA Sequence Number=SeqID_74021
  Gene Ontology: Mol. function=4 iron, 4 sulfur cluster binding; Cellular component=integral to membrane; Biological process=electron transport
  Homolog annotation: Hit_ID=Q19KB4; Match level="QueryCoverage=57%, HitCoverage=37%, E-value=9e-86, Identity=98%"; Hit description=PSI P700 apoprotein A2
  Pfam annotation: Domain name=PsaA_PsaB; Domain location=1-272; Score=- 19.6; E_value=5.4e-06; Accession=PF00223.9; Description=Photosystem I psaApsaB protein
DPLHVRPIAHAIWDPHFGQPAVEAFTRGGALGPVNIAYSGHLVHVAIPGSRGEYVRWNNLLSILPHPEGLGPFFTGQWNLYAQNPDSNSHIFGTPQGAGTAILTLLGGFHPQTQRAFAHGAIFFIRDYNPEQNEDNVLARMLDHKEAIISHLSWASLFLGFHTLGLYVHNDVMLAFGTPEKQILIEPIFAQWIQSAHGKTSYGFDILLSSTNSPAFNAGRSIWLPGWLNAVNENSNSLFLTIGPGDFLVHHAIALGLHTTTLILVKGALDAR

SEQ ID NO: 190800 - protein, 51 aa, Glycine max
  Coding DNA Sequence Number=SeqID_74022
FTLVVRRYSSPTTHEILLCWAGTIKFDSAWKHRGSVGWDIDRSNDVPLERN

SEQ ID NO: 190801 - protein, 57 aa, Glycine max
  Coding DNA Sequence Number=SeqID_74023
MDNKDGKKRTNSEAEKRYNDLIKEKTRALKATMKKWDALLAESSSSENNNEDSKEKK

SEQ ID NO: 190802 - protein, 36 aa, Glycine max
  Coding DNA Sequence Number=SeqID_74024
MYCLLSKTGPDGRRETRGTGTRGIARKPRQDFGISK

SEQ ID NO: 190803 - protein, 79 aa, Glycine max
  Coding DNA Sequence Number=SeqID_74025
  Subcellular localization annotation: CTP_CleavageSite=52; ConfidenceScore=5.07e-01
MDLVASSTPFNSYRADSTQGSRKERASRQLRQQKLELRNTEEKRIQLNLSLRAVQRRESKVNGQWRISPSPGFILNRPR

SEQ ID NO: 190804 - protein, 147 aa, Glycine max
  Coding DNA Sequence Number=SeqID_74026
  Gene Ontology: Mol. function=transcription factor activity; Biological process=regulation of transcription, DNA-dependent
  Homolog annotation: Hit_ID=Q5PJW0; Match level="QueryCoverage=100%, HitCoverage=66%, E-value=4e-46, Identity=62%"; Hit description =Transcriptional repressor for envCD
  Pfam annotation: Domain name=TetR_C_2; Domain location=84-147; Score =4.4; E_value=1.2e-07; Accession=PF08361.2; Description=MAATS-type transcriptional repressor, C-term
  Pfam annotation: Domain name=TetR_N; Domain location=16-62; Score =79.2; E_value=1.3e-20; Accession=PF00440.13; Description=Bacterial regulatory proteins, tetR family
  Pfam module annotation: Pfam domain module=TetR_C_2::TetR_N; Domain location=84-147::16-62
MARKTKEDALRTRQLLIESAIQQFAQRGVTNTTLTDIADAAGVTRGAVYWHFSSKAELFNEMWQQQPPLRELLPHQQWELDNQNPLTGLRKKFITGLQYIAENSRQQALLQILYHKCEFTSDMLPESEIRKRIGFNYAIIRDVLQCC

SEQ ID NO: 190805 - protein, 161 aa, Glycine max
  Coding DNA Sequence Number=SeqID_74027
  Gene Ontology: Mol. function=protein transporter activity; Cellular component=integral to membrane; Biological process=protein secretion
  Homolog annotation: Hit_ID=Q5PJW6; Match level="QueryCoverage=87%, HitCoverage=36%, E-value=6e-33, Identity=53%"; Hit description =Transmembrane protein affecting septum formation and cell membrane permeability
  Subcellular localization annotation: CTP_CleavageSite=62; ConfidenceScore=5.07e-01
MTSHARVSLLSSLIISAVLLTGCDNSGNQQAQPQAPQVSVHVVHSEPLSVTTELPGRTSAFRVAEVRPQVSGIILKRNFVEGSDIKAGESLYQIDPATYQAAWNSAKGDEAKAEAAAAIAHLTVKRYVPLLGTQYISQQEYDQAVATARQADADVVAAKAA

SEQ ID NO: 190806 - protein, 119 aa, Glycine max
  Coding DNA Sequence Number=SeqID_74028
  Subcellular localization annotation: CTP_CleavageSite=20; ConfidenceScore=5.31e-01
MLVRMLRTLLFAAARVKSCPSMHSSCVIASLSGCARTVGPPPISGGGPGTRQRTLNYLKVWIWSPLKVRTRSPLKARACSPLKFRTCRLSKARECSPMMARTCNPLKVRACPPLKMGNM

SEQ ID NO: 190807 - protein, 137 aa, Glycine max
  Coding DNA Sequence Number=SeqID_74029
  Subcellular localization annotation: CTP_CleavageSite=15; ConfidenceScore=5.18e-01
MPISPLRKVSVGLCRSDIGVAPTRRPTNPEKSNRALGFPALVTGLCQSYRAPVPPARIMPARHPVDPKKANRVLELLALITGLSRSSSPTNRAFIKKYCAPRQAQGETPQQPGDGRQWAISAPPPPLEFTSAYPQKG

SEQ ID NO: 190808 - protein, 57 aa, Glycine max
  Coding DNA Sequence Number=SeqID_74030
MRTKTTKLMDGATGGTAAILGGRHHRLELLELRLKCEEDEGLLAVRKNESIYTAVPL

SEQ ID NO: 190809 - protein, 182 aa, Glycine max
  Coding DNA Sequence Number=SeqID_74031
  Gene Ontology: Mol. function=zinc ion binding
  Homolog annotation: Hit_ID=Q1S818; Match level="QueryCoverage=50%, HitCoverage=94%, E-value=1e-16, Identity=45%"; Hit description=Zinc finger, GRF-type
  Pfam annotation: Domain name=zf-GRF; Domain location=85-127; Score =39.9; E_value=8.5e-09; Accession=PF06839.3; Description=GRF zinc finger
MKETLKPQKASFHKITNPKALCGFVLLVIEAANQCCSSVPHQRRCLVVLVKLLVLSLKPTVWVSSVNLIMERSSLSYTSKARSRVVCLCNVEAPLVTSWTEDNPGRHFYGCGLCRKRCNYFEWHDPVTNIRQKRIIVALMKKVDELKLREKDLQTKISDMKMKGNFLGIGLVFSWGNVIYWW

SEQ ID NO: 190810 - protein, 147 aa, Glycine max
  Coding DNA Sequence Number=SeqID_74032
  Subcellular localization annotation: CTP_CleavageSite=41; ConfidenceScore=5.36e-01
MAEPSKKRKGSSSAAAAAAHRRHGPSEAPTALIHPSLSSPRSSTLFSSDDQRLWMALFLLRCMGIPMIIDQSLFFSLTHLPSQGAPFEGTIVDDWKFDYSSHDARRMVCNDQAEMTGRLLAGSTGLTWFGTECIRHYGPMHLSLYLN

SEQ ID NO: 190811 - protein, 80 aa, Glycine max
  Coding DNA Sequence Number=SeqID_74033
MEEVDKEILETFRKVEVEVEEPSSSSPTLVPPTVQPPPTLVLKPLPANLKYAYLEDKEKFPVIISASLATKQEEKLLLVL

SEQ ID NO: 190812 - protein, 115 aa, Glycine max
  Coding DNA Sequence Number=SeqID_74034
MAAQLIHDRVVMECLEGVWETLEGNERCRFRGTIRLTATSLPAQVIEVSSSEEDLEEDPEELPLEPAMDALDLPMNDEDPLPDVDSLEDIMSASEADSTEESGPGGTANSDDSSS

SEQ ID NO: 190813 - protein, 105 aa, Glycine max
  Coding DNA Sequence Number=SeqID_74035
  Homolog annotation: Hit_ID=Q1SHW6; Match level="QueryCoverage=47%, HitCoverage=7%, E-value=1e-15, Identity=82%"; Hit description=AAA ATPase; DEAD/DEAH box helicase, N-terminal
MEEKKDEEDNIFNEGETEVTMAHAKKLVQSGVLPSDIGIITPYAAQAQALYFSSFMKDSNMHQSWTQTAKEASMVLAYTATTCDLGLFLAMLLASRRMVPPMSQS

SEQ ID NO: 190814 - protein, 103 aa, Glycine max
  Coding DNA Sequence Number=SeqID_74036
MSYTGSLSAPFHLTKRTASVYPLREKGALGQKSPTCAKRSIHALRARAKQGHLFKPEIRFCEESLDWDSELCMSKVSRERKVQVPESFERFCCVKICRDQSLK

SEQ ID NO: 190815 - protein, 482 aa, Glycine max
  Coding DNA Sequence Number=SeqID_74037
  Gene Ontology: Mol. function=hydrolase activity
  Homolog annotation: Hit_ID=Q2HRX8; Match level="QueryCoverage=80%, HitCoverage=58%, E-value=4e-41, Identity=29%"; Hit description=IMP dehydrogenase/GMP reductase
  Pfam annotation: Domain name=DUF1723; Domain location=132-181; Score =58.1; E_value=2.9e-14; Accession=PF08330.1; Description=Protein of unknown function (DUF1723)
MVRTRGLGRALGTGRGRDMSQDAHQPEVPQHRPIASMTGIVDAVDAEGVATDGSEGSPAVDEGFLGGLRDPLVLIGFAEHVAHSIWSGEERPKQKLVSHGRKVDKFGRPAPEIEGMIAATGLSPLIRCSVITTDLGLISSFVKRWHRETRTLHLPIGEMTITLDDVASLLHLPITSALHTFEPLVTSDMVMLLTELLESRCRARRWVVAAHAYLLHLVGCTLFANKSATHVHVMHLEAFRDLAQAGGFSWGATTLVHLYDHLNEASQTPTRQMAGYMTLFQICEYFPMVHQCVVDDAYVEASPRASRWLTSKAHMTGIKGAPYRVRIEALTVTDAYWMPYAEHRGVKGFDLISFYTGQLIWGQIVVYVRPEWVLRQFGYIQTVPLPPVRDSLTGPDIDDRWLHFSDHLVPAGEICVVFDLPMHSVVDCQGCQVIVEDLELVINLKMVTEGTELYDIMARCLRIARGNAADGSLRSRQRRRIE

SEQ ID NO: 190816 - protein, 109 aa, Glycine max
  Coding DNA Sequence Number=SeqID_74038
  Gene Ontology: Mol. function=glutathione transferase activity
  Homolog annotation: Hit_ID=Q9FQE5; Match level="QueryCoverage=82%, HitCoverage=41%, E-value=4e-27, Identity=70%"; Hit description =Glutathione S-transferase GST 13
  Pfam annotation: Domain name=GST_C; Domain location=16-106; Score =23.0; E_value=0.0011; Accession=PF00043.15; Description=Glutathione S-transferase, C-terminal domain
MTCYDDDDDDDDGGGGDSLILPTIWNACWSDENRREKAVEEALEALKILQEALKDKKFFGGDNIGLVDIAANFIGYWVPILQDIARLELLTIEKFPSYINRVKSLSITL

SEQ ID NO: 190817 - protein, 300 aa, Glycine max
  Coding DNA Sequence Number=SeqID_74039
  Gene Ontology: Mol. function=nucleic acid binding; Cellular component= ribonucleoprotein complex; Biological process=RNA processing
  Homolog annotation: Hit_ID=Q6K6X2; Match level="QueryCoverage=95%, HitCoverage=64%, E-value=8e-52, Identity=38%"; Hit description =Putative RNA recognition motif (RRM)-containing protein
  Pfam annotation: Domain name=RRM_3; Domain location=185-288; Score =107.5; E_value=3.8e-29; Accession=PF08777.1; Description=RNA binding motif
MKLEHNCYASYKQVNSVRLPRHVGDKKFFCGTALDEFSLDEEKEKVLKQSLVYAGAELELKPKKDFDAQREKELEEHENFRPPVGSGHQNNTNTEANYPKGLLIAFKLKSISDEVPSSQNNIDKQANGSNFVSKTDQQNPSEIAAKDSDQKISENVENYKENNGVSFGKETQGEEKSKETDGKNSAAAHKDNKDVVSREDLKCVFEKFGTVKYIDFKIGEKSGYIWFEEPEAAQKARAAAVLSEKEGLVVKNYIATLDPVTGEAEREYWTLLRGNQEKIRGCTKYRGRYVDALNHVFSLT

SEQ ID NO: 190818 - protein, 95 aa, Glycine max
  Coding DNA Sequence Number=SeqID_74040
MAPILKYYLGILTKECLHVFKLHIIFKLMEACLCGFYGVEVFTLRKINYGGFQKPPQLDSPQAISGGFRKPLVLRTFCRDFFCRGFKPTLTVEVF

SEQ ID NO: 190819 - protein, 161 aa, Glycine max
  Coding DNA Sequence Number=SeqID_74041
  Gene Ontology: Mol. function=peptidyl-prolyl cis-trans isomerase activity; Cellular component=chloroplast thylakoid membrane; Biological process=protein folding
  Homolog annotation: Hit_ID=Q9LYR5; Match level="QueryCoverage=75%, HitCoverage=48%, E-value=2e-44, Identity=70%"; Hit description =Peptidyl-prolyl cis-trans isomerase
  Subcellular localization annotation: CTP_CleavageSite=29; ConfidenceScore=5.38e-01
MASIMSLSLSYVSLPKSQFSISGRTASCCCAPLFQRRKILFSSIGIFAGTLCNIPLTGISLAAEFADMPALRGKDYGKTKMRYPDYTETESGLQYKDLRPGNGPKPKMGETVVVDWDGYTRGYYGRIFEAQNKTKGGSFEGDDKNFVKFKIGYNEVRDLVI

SEQ ID NO: 190820 - protein, 469 aa, Glycine max
  Coding DNA Sequence Number=SeqID_74042
  Gene Ontology: Mol. function=receptor activity; Biological process =metabolic process
  Homolog annotation: Hit_ID=Q1SHK5; Match level="QueryCoverage=87%, HitCoverage=89%, E-value=4e-74, Identity=80%"; Hit description=SAM (And some other nucleotide) binding motif
  Pfam annotation: Domain name=Methyltransf_11; Domain location=274 -377; Score=-2.8; E_value=0.1; Accession=PF08241.2; Description =Methyltransferase domain
MAGIRLQPEDSDVSQQSRAVALSATDLVSDDDRSVAADSWSIKSEYGSTLDDDQRHADAAEALSNANLRPPSDYSSDKDEPDSEAVTSMLGFQSYWDSAYADELTNFREHGHTGEVWFGVDVMEVVASWTKALCVEISQGHIPNGVDEVKAEADKLGDKVLSTWSVLDIGTGNGLLLQELAKQGNESKPVLLNGGAMADFHGGFSKKRHRIAVAWRVWDGGVMAAAIAMAVVAVMAGRDDLRQRRTGTSGGDELRQRRICHERRPAARSSRGEDEAAVAKKKASRRRRRRRFSDLTGTDYSERAISLAQSLANRDGFSNVKFLVDDVLETKLEQEFRLVMDKGTLDAIGLHPDGPVKRMMYWDSVSRLVASGGILVITSCNNTKDELVQEVESFNQRKIATAQELGAVKDEEPLPCCNRGIPSKMKMLSFVMIKVSGRMDLKLFLTVVSNSKYLFAIYVKFHYLSFLGE

SEQ ID NO: 190821 - protein, 59 aa, Glycine max
  Coding DNA Sequence Number=SeqID_74043
LLKIILKLIDQNFELILKYHRQNIEVYLFTEDKRMHANNCSVEILLILIFDACVKWPRE

SEQ ID NO: 190822 - protein, 227 aa, Glycine max
  Coding DNA Sequence Number=SeqID_74044
MTTMNLSYDFLCGFLVQRRGHHCSNRNQRDAVSENVKGGERVWQNDVRGVVLQTFSLRGFVCKHIPEGVFFLRDPASTNSRLRYPAITNNDFFMHGVPPLPLVRYPMPTIHVDPPVALARLMQKKRSWLGSASCSGGISAEKEEEQVLKKCILYFSSFTNSNVNAYFSKPKHVLPIHFKKKKKELLDLPIALAGLVQKKKKKGAGFMQRGSNNSKCYGMMDDGAQDG

SEQ ID NO: 190823 - protein, 116 aa, Glycine max
  Coding DNA Sequence Number=SeqID_74045
MNDLDYDDVSPRACHWIAMKASLRSISTSTYMQRLDGLRIPDVCWMPYGEHRPIQKFDLISCYSEIDDQWMHYSDHLALAGQIYVVPGRCALEYMVLPHFSFIHDSGIAIRSADNK

SEQ ID NO: 190824 - protein, 101 aa, Glycine max
  Coding DNA Sequence Number=SeqID_74046
  Gene Ontology: Mol. function=transferase activity, transferring glycosyl groups; Cellular component=chloroplast; Biological process =glucan biosynthetic process
  Homolog annotation: Hit_ID=Q75T80; Match level="QueryCoverage=85%, HitCoverage=13%, E-value=1e-28, Identity=79%"; Hit description =Starch synthase I precursor
MELMSLNGTRHLINILLPTILLSGKAECKISLQKELGLLVRPDCPMIGFIGRLDYQKGIDLIRLAMPELMEADVQFDTVHNFNPYIEESKAESTEYVVHEL

SEQ ID NO: 190825 - protein, 68 aa, Glycine max
  Coding DNA Sequence Number=SeqID_74047
  Subcellular localization annotation: CTP_CleavageSite=27; ConfidenceScore=5.07e-01
MTSAEQPVKKRKLYKPLPEPPPSSPPESKATPSSPQSVPTPSTPPLSQEDILTKRRNKDEIRIRIKEI

SEQ ID NO: 190826 - protein, 85 aa, Glycine max
  Coding DNA Sequence Number=SeqID_74048
MVADPLSESIMSGITCGGDCSRQCQILCQIPLRWKSHANLLCFGANLPPSSSRFKLMGYTVEGEGRIEGRKDEGEGSIEDKKEDE

SEQ ID NO: 190827 - protein, 152 aa, Glycine max
  Coding DNA Sequence Number=SeqID_74049
  Homolog annotation: Hit_ID=UPI00001632AD; Match level="QueryCoverage =21%, HitCoverage=7%, E-value=7e-07, Identity=78%"; Hit description =protein binding / ubiquitin-protein ligase/ zinc ion binding
MSDTKKTLVVCYTFHGHTLPSVGTNMVPLQQSPFVWLRLEFQHLTGEYETLVLQIDVLLLDHVTQIVKKMPKKELDEELWRLLATLGEQTEITKGNHGVVIREDKNPTNPSSDASASRFLISCILPFYISSLLFVYVVRDNIIDLVKDEDIK

SEQ ID NO: 190828 - protein, 512 aa, Glycine max
  Coding DNA Sequence Number=SeqID_74050
  Gene Ontology: Mol. function=glucuronate isomerase activity; Biological process=glucuronate catabolic process
  Homolog annotation: Hit_ID=P0A8G3; Match level="QueryCoverage=88%, HitCoverage=96%, E-value=0.0, Identity=91%"; Hit description=Uronate isomerase
  Pfam annotation: Domain name=UxaC; Domain location=61-512; Score =1293.7; E_value=0; Accession=PF02614.5; Description=Glucuronate isomerase
MYDYLWGHSSLRAKPVMARPAAGFVPVRGMNLLAFIDLTHEKRFAYEHTLSDAPVMRKTIMTPFMTEDFLLDTEFARRLYHDYAKDQPIFDYHCHLPPQQVAENYRFKNLYDIWLKGDHYKWRAMRTNGVAERLCTGDATDREKFDAWAATVPHTIGNPLFHWTHLELRRPFGITGTLLSPATADEIWDRCNALLAQDNFSARGIMKQMNVKMVGTTDDPIDALEHHAAIAKDSAFDIKVLPSWRPDKAFNIEQATFKDYMAKLAEVSDTDIRRFADLQTALTKRLDHFAAHGCKVSDHALDVVLFAESNEAELDSILARRLSSESLSEHEVAQFKTAVLVFLGAEYARRGWVQQYHIGALRNNNQRQFKLLGADVGFDSINDRPLAEELSKLLSKQNEQNLLPKTILYCLNPRDNEVLGTMVGNFQGEGMPGKMQFGSGWWFNDQKDGMERQMTQLAQLGLLSRFVGMLTDSRSFLSYTRHEYFRRILCQMIGRWVHAGEAPADIQLLGDM

SEQ ID NO: 190829 - protein, 91 aa, Glycine max
  Coding DNA Sequence Number=SeqID_74051
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=63%, HitCoverage=10%, E-value=1e-25, Identity=96%"; Hit description=NADH -plastoquinone oxidoreductase subunit 2
MVLLAIWSSGGEIELQEIVNGLINTQMYNSPGILIALLFITVGIGFKLSPAPSHQWTPDVYEGVRCYIVGSHPSETTSIIGASVNKRITLR

SEQ ID NO: 190830 - protein, 129 aa, Glycine max
  Coding DNA Sequence Number=SeqID_74052
  Homolog annotation: Hit_ID=Q1SKD7; Match level="QueryCoverage=98%, HitCoverage=32%, E-value=1e-13, Identity=31%"; Hit description =Ankyrin
MPPRKLSAKRSRRDVAAEGTSAAPEFDSHRFKSAEHQQRFEAIKGWSFHRERRVQLRDDEYADFQEKIARRRWTSLVTPMAKFDPDIVLEFYANAWPMEEGVRDMRSWVRGQWIPFNADALSQFLGDPL

SEQ ID NO: 190831 - protein, 92 aa, Glycine max
  Coding DNA Sequence Number=SeqID_74053
  Subcellular localization annotation: CTP_CleavageSite=21; ConfidenceScore=5.08e-01
MVFDGYGVSKDMIFISANQVVTSLKEYCRNMPFCERARRGSRMRFPKKERCAESPPTFICGKRRKNRRSTKAGLLLLRTLHRRGNQTYVVLS

SEQ ID NO: 190832 - protein, 231 aa, Glycine max
  Coding DNA Sequence Number=SeqID_74054
  Gene Ontology: Mol. function=transcription factor activity; Cellular component=intracellular; Biological process=regulation of transcription, DNA-dependent
  Homolog annotation: Hit_ID=Q1MAI1; Match level="QueryCoverage=96%, HitCoverage=89%, E-value=2e-75, Identity=67%"; Hit description =Putative GntR family transcriptional regulator
  Pfam annotation: Domain name=FCD; Domain location=71-197; Score =109.0; E_value=1.4e-29; Accession=PF07729.2; Description=FCD domain
  Pfam annotation: Domain name=GntR; Domain location=1-49; Score=27.3; E_value=5.5e-05; Accession=PF00392.11; Description=Bacterial regulatory proteins, gntR f
  Pfam module annotation: Pfam domain module=FCD::GntR; Domain location= 71-197::1-49
MDLAKDRRLPTERAFAETFNVGRRAVRRALEVLEAEGLIWRRQGAGTFVGEKPDDWSAQVTELVAGTDFMEIMEVRLRIEPQLAQLAAMRAKPDEVERMRALVEKTGQSTDADAKELWDGSLHRQIAQSAGNKLFLSIFDVINRVRQDDAWQSIRELARRSGANGRASFEQHMAIVDAIADRDPARAGEAMRQHLLMHQERLIRATSLGFLEEGAGEGNAAKVDNSLTEAS

SEQ ID NO: 190833 - protein, 224 aa, Glycine max
  Coding DNA Sequence Number=SeqID_74055
  Gene Ontology: Mol. function=chlorophyll binding; Cellular component =integral to membrane; Biological process=photosynthetic electron transport
  Homolog annotation: Hit_ID=P56777; Match level="QueryCoverage=99%, HitCoverage=54%, E-value=2e-96, Identity=66%"; Hit description =Photosystem II P680 chlorophyll A apoprotein
  Pfam annotation: Domain name=PSII; Domain location=1-224; Score =157.6; E_value=3.2e-44; Accession=PF00421.9; Description=Photosystem II protein
MALYELAVFDPSDPGLDPMWRQGMFVIPFMTRLGITNSWGGWNITGGTITNPGIWSYEGVACFGFGAFHVTGLYGPGIWVSDPYGLTGRIQSVNPAWGVEGFDPFVPGGVASHHIAAGTLGILAGLFHLSVRPPQRLYKGLRMGNIETVLSSSIAAVFFAAFVVAGTMWYGSATTPIELFGPTRYQWDQGYFQQEIYRRVGAGLAENQSLSEAWSKIPRKISFL

SEQ ID NO: 190834 - protein, 225 aa, Glycine max
  Coding DNA Sequence Number=SeqID_74056
  Gene Ontology: Mol. function=protein binding; Cellular component =integral to membrane; Biological process=defense response to fungus
  Homolog annotation: Hit_ID=Q1SWI7; Match level="QueryCoverage=99%, HitCoverage=87%, E-value=1e-37, Identity=31%"; Hit description =Leucine-rich repeat
  Pfam annotation: Domain name=LRR_1; Domain location=117-139; Score =10.0; E_value=3.9; Accession=PF00560.23; Description=Leucine Rich Repeat
  Pfam annotation: Domain name=LRR_1; Domain location=141-163; Score =11.6; E_value=1.9; Accession=PF00560.23; Description=Leucine Rich Repeat
  Pfam annotation: Domain name=LRR_1; Domain location=16-38; Score =17.1; E_value=0.062; Accession=PF00560.23; Description=Leucine Rich Repeat
  Pfam annotation: Domain name=LRR_1; Domain location=165-188; Score =7.7; E_value=10; Accession=PF00560.23; Description=Leucine Rich Repeat
  Pfam annotation: Domain name=LRR_1; Domain location=190-213; Score =3.4; E_value=65; Accession=PF00560.23; Description=Leucine Rich Repeat
  Pfam annotation: Domain name=LRR_1; Domain location=40-62; Score =19.1; E_value=0.016; Accession=PF00560.23; Description=Leucine Rich Repeat
  Pfam annotation: Domain name=LRR_1; Domain location=93-115; Score =0.5; E_value=2.3e+02; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=117-139::141-163::16-38::165- 188::190-213::40-62::93-115
NQLEGTIPTSLGNLTSLVKLQLSRNQLEGTIPTSLGNLTSLVRLDLSYNQLEGTIPTSLANLCNLMEIDFSYLKLNQQVNELLEILAPCISHGLTALAVQSSRLSGNLTDHIGAFKNIDTLLFSNNSIGGALPRSFGKLSSLTYLDLSINKFSGNPFESLRSLSKMSSLQIDGNNFQGVVKEDDLANLTSLMEFHASGNNFTLKVGPKWLPNFQLSYLDVTSWQL

SEQ ID NO: 190835 - protein, 198 aa, Glycine max
  Coding DNA Sequence Number=SeqID_74057
MSIVIPILPPNTHRSYNKTLSFAICHPQIHVEHKPNEEQLEANELIILLNENLDGEVKYHILNKGYEINFVFVTIYAKCCNIDGDEGGGKDGTEVAAKDDKDVKDSVVEGVEGFNFNYVDVDNDSNAKRRKIGRCSNWCLAKPGPCAQRVSSAKRNISPLNDQSSLTRAKRINGAKRTFEDRKSFLKPEMKKKRVLGG

SEQ ID NO: 190836 - protein, 55 aa, Glycine max
  Coding DNA Sequence Number=SeqID_74058
  Gene Ontology: Mol. function=sequence-specific DNA binding; Cellular component=cytoplasm; Biological process=positive regulation of transcription
  Homolog annotation: Hit_ID=Q152U7; Match level="QueryCoverage=98%, HitCoverage=39%, E-value=7e-17, Identity=81%"; Hit description =Multiprotein bridging factor 1c
  Pfam annotation: Domain name=HTH_3; Domain location=1-54; Score=34.9; E_value=2.8e-07; Accession=PF01381.12; Description=Helix-turn-helix
MQARMDKKLTQSQLAQLINKKPQVIQEYESGKAILNQHIIGKLGKVLGAKLRDKK

SEQ ID NO: 190837 - protein, 344 aa, Glycine max
  Coding DNA Sequence Number=SeqID_74059
  Gene Ontology: Mol. function=nucleic acid binding
  Pfam annotation: Domain name=SWIM; Domain location=128-164; Score =38.3; E_value=2.6e-08; Accession=PF04434.8; Description=SWIM zinc finger
  Pfam annotation: Domain name=zf-CCHC; Domain location=242-259; Score =9.8; E_value=0.024; Accession=PF00098.13; Description=Zinc knuckle
  Pfam module annotation: Pfam domain module=SWIM::zf-CCHC; Domain location=128-164::242-259
MQERIQGWLGLDGCFLKGYCGSHLLAAVGQDANNVFFVIAYAVGLLPVMQEVMLGVKHRNKPILSLCEDIRTYIMRKMTSAKLKMATRLGPLVPMQQSRLEKEKLESNKWTANWVGDPDGTRFEVCHHETRIDVDLQNQSCTCRMWQLTGLPCRHVIVAIRYNNHRLEDYNDGMLTIVSYNATYENYIRPTRSQQYWKTTPFDRLTPPHIKKRLGRPKKCRRKDQNEGQASNSRLKRSYKEVTCTRCGLNGHNSRGCINSGVPPRPKKWKPIVEEGNNLNATTTTLETIFIPPPMPTAFRPPPLRLLAPIRIIMSDGVSHNKNQPNYMSFIPTPGMPSHQDSNN

SEQ ID NO: 190838 - protein, 36 aa, Glycine max
  Coding DNA Sequence Number=SeqID_74060
MEKSSERSSSFDLRLGRMKGQKGVEGRLKECVFVAR

SEQ ID NO: 190839 - protein, 430 aa, Glycine max
  Coding DNA Sequence Number=SeqID_74061
  Homolog annotation: Hit_ID=Q1BX29; Match level="QueryCoverage=45%, HitCoverage=88%, E-value=4e-17, Identity=34%"; Hit description =Hypothetical protein precursor
  Pfam annotation: Domain name=DUF1275; Domain location=1-204; Score =56.5; E_value=8.9e-14; Accession=PF06912.2; Description=Protein of unknown function (DUF1275)
MIAGYCDTVTFVAADALFSAHVTGNFIVFAYQFVKGSDIHAWVKLLTFPVFILAVMAGGKIAGKVINHYTLLFWEGTLLFLAGIIVAVLSYYGTFSEVMMYTVAMMTVFAMGLQNAFGKLYAKETHGPTTMMTGNVTQASLDFGTLLSSGFQHPEAWASLKKQLVTILGFLIGCFLGAYAGKQFGLETLILPGLAMIICYFYHRKNYIKAQIQENPALLRKQISSSPNIAQKTALLLRLSNYYISKKGELKADLDSAAILNRQAKALNMKSGDPMSAGKLIFLDAKLDKERGSKNIALSKMKEALAYFETHQFKEQTGEAYNELSYMYDNKPEYFDTKIRLKEKALELFKNSGSKLNQAGVLKDLGELYYIKENPDKALGLLRQSLSVYQSVKFRELQSVYNLISQVEIQKADYGEALRYGLLAEKTAES

SEQ ID NO: 190840 - protein, 225 aa, Glycine max
  Coding DNA Sequence Number=SeqID_74062
  Gene Ontology: Mol. function=hydrolase activity
  Homolog annotation: Hit_ID=Q2X918; Match level="QueryCoverage=99%, HitCoverage=31%, E-value=2e-72, Identity=58%"; Hit description=Twin -arginine translocation pathway signal precursor
MLGGGIAIQSRMAYQGEYFADRYGSGAAESTPPVKKMLEMGVPVGGGSDATRVSSYNPWVSMYWLTAGKTVGGLQLYHETKLDRSTALELYTKGSAWFSQEQQKKGDIRVGMFADLAVLDQDYFTVDDEDIKNIEAEMTIVDGKIVYAKGTFSSYAPPSIPVLPDWSPTNLYNGYYPAGGHFQKEIEKNAKQDLKAPLTSQIHSCAGSCDIHHHNHNQARMSNVP

SEQ ID NO: 190841 - protein, 106 aa, Glycine max
  Coding DNA Sequence Number=SeqID_74063
MEGLVDLAVIDAFLAFHHGKEILVVAILAMHDTFDQRCEKSGARIVCCTPALYVWLLKPWNEKPRRPERKNTTKTSFEGLYRAAIVSSSSEEVKGIITGQRHDLEG

SEQ ID NO: 190842 - protein, 67 aa, Glycine max
  Coding DNA Sequence Number=SeqID_74064
MWECVDEMNMMVGSSRTSSVAHKVGHHKKKTKIDHYMVEFPDEMQQYILNIVDATDNYCVESHLNHI

SEQ ID NO: 190843 - protein, 421 aa, Glycine max
  Coding DNA Sequence Number=SeqID_74065
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q10MX4; Match level="QueryCoverage=81%, HitCoverage=78%, E-value=1e-104, Identity=51%"; Hit description =Expressed protein
  Pfam annotation: Domain name=DUF231; Domain location=251-421; Score =229.1; E_value=9.5e-66; Accession=PF03005.6; Description=Arabidopsis proteins of unknown function
MKHPRGKLPLPIIVITTCVLAFVAILYVERLSFLSSKSIFKFKPCPRKTTKPKTSDKKTDEEVVVVNASSWIDDRFDFDPEECNVANGKWVFNHSIKPLYSDISCPYIDRQFSCVKNGRNDSDYRHWEWQPEDCTLPRFNPELALRKLQGKRVLFVGDSLQRNQWESFVCLVEWVIPHKHKSMQLGRVHSVFTAKAYNATIEFYWAPYLVESNSDIDIIDIKKRIIKVDAIAERAKNWTGVDILVFNTYVWWMSGVRIKTIWGSFANGQEGYEEFDTPVAYKLALKTWANWIDSTINPNKTRVFFTTMSPTHTSQDWGNMEGVKCFNETKPVRKKKHWGTGSDKRIMSVVAKVVKKMKIPVTFINITQISEYRIDGHSSVYTETGGKLLTEEERANPQNADCIHWCLPGVPDTWNQILLAM

SEQ ID NO: 190844 - protein, 39 aa, Glycine max
  Coding DNA Sequence Number=SeqID_74066
MSTNFTLALYILAAVQKRQELAEQIKDISKNMEVSFKNK

SEQ ID NO: 190845 - protein, 192 aa, Glycine max
  Coding DNA Sequence Number=SeqID_74067
  Subcellular localization annotation: CTP_CleavageSite=56; ConfidenceScore=5.10e-01
MPERQHGMYYTPPTFTQEPPQMPPMYSYPHDFQLGYSFAGIFGSSPSSTGTPSFTQSGQVSTPNAPLTGLWNVPGDIPDMDDLLGVDLRHDFSAEADQAGGCGKRLGGCDKKRLGGRGVGGQAPGCPALAVAPVAGAPPVEPDPWALRKAPASGALPAVPRVTCTVEAPVWGALCNKKTDPPRNNFKIASFW

SEQ ID NO: 190846 - protein, 68 aa, Glycine max
  Coding DNA Sequence Number=SeqID_74068
  Subcellular localization annotation: CTP_CleavageSite=56; ConfidenceScore=5.25e-01
MSPPPLEPHNHSQTHLKLSGRLPLQARFSAGLHTTKSLKLSGTWTFLSLENPRHAKASRKGPNSLSKI

SEQ ID NO: 190847 - protein, 95 aa, Glycine max
  Coding DNA Sequence Number=SeqID_74069
  Gene Ontology: Mol. function=nucleic acid binding
ILVIDYTVIFLKSHDFSKVFSNLFIGNQLQDSGEDIEHRVCVKHLYSNFRKRHPGTHLKELMWQAARVVTIAPWKRVMQKLKKTDKSAWKTLEDL

SEQ ID NO: 190848 - protein, 70 aa, Glycine max
  Coding DNA Sequence Number=SeqID_74070
  Homolog annotation: Hit_ID=Q9SJI9; Match level="QueryCoverage=96%, HitCoverage=22%, E-value=4e-11, Identity=74%"; Hit description =Expressed protein
  Subcellular localization annotation: CTP_CleavageSite=37; ConfidenceScore=5.10e-01
MEDTAPTSGDPNGKIFQLTISTPLSSFISTAVNVLLNGVTVSEVTWLEDFQPPDDFVIRKGQYRGPVIRT

SEQ ID NO: 190849 - protein, 701 aa, Glycine max
  Coding DNA Sequence Number=SeqID_74071
  Pfam annotation: Domain name=DUF688; Domain location=1-695; Score =132.9; E_value=8.7e-37; Accession=PF05097.3; Description=Protein of unknown function (DUF688)
MEEKQLDFNQPLLSVRRISSTAASENDYKRKPDKPVPKRPPLPFYKSELKSGPVTNPGTVPFVWEKTPGRPKNESKQQTQAVERPSVAPKLPPGRVLKVEQQDSDKVPKGASVTQSRTGSSVSDSPRTASLDNKVTKHEIPQVIEEKASSVSNDEDENYLDALDTLSRTESFFMSCSVSGLSEWDGPDVQPSGNFSTDQQTRDFMIGRFLPAAKAMASETPQIQHNSRKSLVTQEQLKQARKVESGANSRPLNPKWQKVLPHYAQDIGREESEDESDDHDGYENYAPKVCGLFPRFCLLNPVPGLRMEGRIPSSTVHGVQGKSITSHRRTAKEHGRTATYGKKSVNSQSGYTEERDFLSTAEKSKHDIDPHRRACSKSLASERTEFESSCESPVIEKTLYVDSVHKVKTSISCSSDTNLRGDDFDTLRKDTDLDKNLSIDFSIEDSKHLGIVDEKAVSEPEISASLDSSLLVCSDNSNDNMQMEMKNHSNKICPEKQELTKPDYQGSNLDHDLVAISSPEMVAWEKIESESKGFSSKESSNGLIKNPIAWRNRKFASDLKFDSMCQQATKLVDQECTIRSSEDPRTLASSKVVGDRKINLESQLQMKLGHGKTSNASSLKLPLALPSPKAPSESWLKRTLPTVSSKNISLRLNLATHYHAPTQTPKTALPDPKWERIVKSSEVNHGHLQFAQELLPPIPEA

SEQ ID NO: 190850 - protein, 143 aa, Glycine max
  Coding DNA Sequence Number=SeqID_74072
MQGLHPDASVADTGGSTSNLELDSVNSFDTSEHMFLMTRKSQRLSLESLFMFTHHRKSKKLSNKLEPRKILGKYPEKPPLPFIRGSNFPASSTSLVAPNFPTFESETCLFLRRPWLLFSVHRGVHSSSAVMDIGKGKVENGRE

SEQ ID NO: 190851 - protein, 547 aa, Glycine max
  Coding DNA Sequence Number=SeqID_74073
  Gene Ontology: Mol. function=transporter activity; Cellular component= membrane; Biological process=transport
  Homolog annotation: Hit_ID=UPI000034F4F5; Match level="QueryCoverage =98%, HitCoverage=99%, E-value=0.0, Identity=55%"; Hit description =permease
  Pfam annotation: Domain name=Xan_ur_permease; Domain location=46-465; Score=87.0; E_value=5.9e-23; Accession=PF00860.11; Description =Permease family
MAESSDHSGGGNSQSQVIQVPEPQPHPVMEQLPDVEYCINSPPPWPHALLLGFQHYILTLGMTVLIPTTIVPEMGGGHAEKAKVIQNLLFVSGLSTLLQTWFGTRLPTVVVGSYSYIIPAMSIIHAKRYTKYTDPYEKNLSKYAFIHCGPVVLLGDVHSLLLYVVDEQRFTHTIRGIQGALIISSIFHVCMGFLGIWRFAVRFLSPLSVVPFVTFTGLGLYHLGFPMYLNRFISTKRLIYERYGLLFSIASAWLLAQLLTSSTAYNNKPESTQNSCRTDRSGLISASEWFHIPFIPFPWGFPTFNFGEALAMIAASFVTLFESTGTFFAAARYGSGTPVPPHIICRGTGWVGVASMVNGFLGSVTGCTASVENAGLLALTKVGSRRVIQISAGFMVFFSIAGKFGAVLASIPLPIMAAMNCLFFGYVSSAGLDFLQFCNLNSFRIKFVLGLSFFLGISIPQYFVEYFYVKHHHGWFNDILNVFFMSHTTVAVLVAFILDITLSRDDDEVRKDIGLQWWEKFRVYSADGRNADFYKLPCRLNEFFPAL

SEQ ID NO: 190852 - protein, 411 aa, Glycine max
  Coding DNA Sequence Number=SeqID_74074
  Gene Ontology: Mol. function=phosphatidylcholine-sterol O -acyltransferase activity; Cellular component=integral to membrane; Biological process=lipid metabolic process
  Homolog annotation: Hit_ID=Q10PI5; Match level="QueryCoverage=93%, HitCoverage=96%, E-value=1e-147, Identity=64%"; Hit description =Haemolysin-III related family protein, expressed
  Pfam annotation: Domain name=HlyIII; Domain location=88-396; Score =234.1; E_value=3e-67; Accession=PF03006.10; Description=Haemolysin -III related
MIRCTHIAEMTPGAYDGLIATPEKINDFVDCEDERASSKFRKGVRLWRKLKYQLVEYNSLPPYMRDNEFILGYYRAEWPLKQIFLSIFSIHNETLNVWTHLIGFFLFLFLTIYTAKRAPMIVDFNSVQHLSEMIGKADLNKIRLELLKCLPSLPNMPEILKLNDLSTSLYSLDFSSLSGWALVELLTNCLPEQFSLNGLKDDMNMVSPLMQPITRWPFYAFLGGAMFCLLASSTCHLLTCHSQRLSYIMLRIDYAGIAALIATSFYPPVYYSFMCNPFFCYLYLGFITLMGIATIVFSLLPFFQKSEFRKYRASLFFLMGFSGVAPIIHKLILHKHQPEALQTTGYEILMGVLYGLGAAIYVTRIPERWMPGKFDIAGHSHQLFHILVVAGAYTHYHDGLIYLRWRDSQGC

SEQ ID NO: 190853 - protein, 480 aa, Glycine max
  Coding DNA Sequence Number=SeqID_74075
  Gene Ontology: Mol. function=serine carboxypeptidase activity; Cellular component=lysosome; Biological process=proteolysis
  Homolog annotation: Hit_ID=Q1SGX6; Match level="QueryCoverage=99%, HitCoverage=99%, E-value=1e-133, Identity=49%"; Hit description =Peptidase S10, serine carboxypeptidase
  Pfam annotation: Domain name=Peptidase_S10; Domain location=32-477; Score=398.2; E_value=1.2e-116; Accession=PF00450.12; Description =Serine carboxypeptidase
MASPGSHIVVLAFVLLISSKLAECHNIVRFLPGFQGPLPFLLETGPIIVVALDISYVEVGETEAEEHAELFYYFIESENDPKGNPLLLWLTGGPGCSAFSGLVFEIGPLTFKNEEYNGSLPNLTLKPQSWTKVSSIIFVDLPAGTGFSYPKTERAVQQSSSKLVRHAHQFIRKWLIDHPEFLSNEVYIAGDSYCGIPVPVIVQEISNGNEGGMQPWIYIQSLQKNCRGEYRNIDPRNALCLRDMQSYEEAAEAPVRNPGPTGIPAVIDPSGINSYGQHFVPRNVHIRGIETGHVLAPLCDESDLRNDMEVTWRRSSLAHKTSAFFSPRLTLPPLYCRSHAYVLCSYWANDDNVRKALHVRKGSIGKWTRCNDDLKSKFNADIPSSFQYHVNLSRKGYRSLIYSGDHDMVVPFLATQAWIRSLNYSIVSDWRQWYYDGQVAGTYSNRMTFATVKGGGHTAPEYKPEECLAMFSRWISNMPL

SEQ ID NO: 190854 - protein, 209 aa, Glycine max
  Coding DNA Sequence Number=SeqID_74076
MDISSSQYNSAGESGWTRYLDHSSLSESYFQRRGGIEDYGGKGATLEEEEEDLSMISDASSGPPHYHEDDDQNYCVNWYPSTSHYTKESENNKNKKVKEYGNNQQPSSPLDDTASSPVLNCPKASQNAIKKASFSGNGAVENAVDFPPCFSGTRIKRKSKFQKHFSFFERSLGGKQASEEPVWNNIREYKKLKRVSDSIFLDAISDRHV

SEQ ID NO: 190855 - protein, 87 aa, Glycine max
  Coding DNA Sequence Number=SeqID_74077
MECWEGGTSLGDRGELGGEGGSGVPGVAPAAGAPPVAPSPKALADASASGALPAAPSCAAPTPHVACTAEAHIWEALCNKKTDPQAN

SEQ ID NO: 190856 - protein, 99 aa, Glycine max
  Coding DNA Sequence Number=SeqID_74078
  Gene Ontology: Biological process=response to abscisic acid stimulus
  Homolog annotation: Hit_ID=O82464; Match level="QueryCoverage=97%, HitCoverage=98%, E-value=5e-23, Identity=55%"; Hit description=Late embryogenic abundant protein
  Pfam annotation: Domain name=LEA_5; Domain location=1-99; Score =125.6; E_value=1.3e-34; Accession=PF00477.8; Description=Small hydrophilic plant seed protein
MESQQANREELDEKARQGETVVPGGTGRSRGGQTRKQQLGSEGYHEMGTKGGQTRKEQMGREGYQEMGRKGGLSTMDKSGGERAEEEGIEIDESKFKIT

SEQ ID NO: 190857 - protein, 114 aa, Glycine max
  Coding DNA Sequence Number=SeqID_74079
  Subcellular localization annotation: CTP_CleavageSite=49; ConfidenceScore=5.15e-01
MPPLLPAGKLVPPLTTAGTRIPPLATAALSLNRQYERRDRLSRRERGCTADSCGGTRRDGAMPPFLLAGHANVAVPPLPPAEHLDGTRASVHMHAESFLCRLGMLNHFYAVYAG

SEQ ID NO: 190858 - protein, 76 aa, Glycine max
  Coding DNA Sequence Number=SeqID_74080
MKMNKRRPKRVLRTRKSSLKEQPERGVLSHLLENETENGGKTETMLSREAIEDSAELEDAYLGYTEKDADYRSFQW

SEQ ID NO: 190859 - protein, 90 aa, Glycine max
  Coding DNA Sequence Number=SeqID_74081
  Subcellular localization annotation: CTP_CleavageSite=52; ConfidenceScore=5.16e-01
MTWMPPLLPAGKLVPPLTTAGTRIPPLATAGLSLNRQYERRDRLSRRERGCTADSCGGTRRDGAMPPFLLAGHANVAVPPLPPAEHLDGT

SEQ ID NO: 190860 - protein, 554 aa, Glycine max
  Coding DNA Sequence Number=SeqID_74082
  Gene Ontology: Mol. function=DNA binding; Cellular component =mitochondrion; Biological process=DNA integration
  Homolog annotation: Hit_ID=Q1RSZ9; Match level="QueryCoverage=98%, HitCoverage=69%, E-value=1e-139, Identity=74%"; Hit description =Polynucleotidyl transferase, Ribonuclease H fold
MAPWALPPCPWPSDSWARPNFGQQRQRVQPGILGPRPPQAYITTPTPTDIEAAMHTLGLTPPDVNWYMDTGATSHMTYAQGNLTSYFNMSNKRGIIVGNGHSIPIHGYGHTTLSSPCPPLSLNNVLHAHQLVKNLVSVRKFTIDNSVTVEFDPFGFSMKDIPTGMPLMRCESWGELYPITKPTNPATSPYTFAALAPSLWHDRLGHPGAPVLNSLGKNKLIECNQIKDSSNGKNQQVGMDYGETFSPVIKSKTIRTVLNLALSKDWPIHQLDVKNAFLHGELKETVYMHQPLGFRDPDRPNHAPRAWYKRFVDYVRTLGFFHSTSDHSLFIYHQGISMAYLLLYVDDIILIASSDELRRSIISFLSSEFAMKDLGQLSYFQGIAVTRHVGGLFLSQKKYAAEIIDRAGMSSCKPSFTPVDTKPKLSATTNTPFEDPSLYRSLARALQYLTFTRPDIAYAVQHVCLFVHDPREEHMYALKRILRYIQSTLDFGLHLYPSSTSTLLFYTDADWDGCPDTRRSTSGYCVFLGDNLISWSAKRQATLTTTKSRFNIDF

SEQ ID NO: 190861 - protein, 167 aa, Glycine max
  Coding DNA Sequence Number=SeqID_74083
  Gene Ontology: Mol. function=protein kinase activity; Cellular component=integral to membrane; Biological process=protein amino acid phosphorylation
  Homolog annotation: Hit_ID=Q9FIZ3; Match level="QueryCoverage=94%, HitCoverage=58%, E-value=3e-18, Identity=35%"; Hit description =Receptor-like protein kinase
  Pfam annotation: Domain name=LRR_1; Domain location=32-54; Score=2.9; E_value=80; Accession=PF00560.23; Description=Leucine Rich Repeat
  Pfam annotation: Domain name=LRR_1; Domain location=56-78; Score =18.2; E_value=0.029; Accession=PF00560.23; Description=Leucine Rich Repeat
  Pfam annotation: Domain name=LRR_1; Domain location=8-30; Score=1.8; E_value=1.3e+02; Accession=PF00560.23; Description=Leucine Rich Repeat
  Pfam module annotation: Pfam domain module=LRR_1::LRR_1::LRR_1; Domain location=32-54::56-78::8-30
MTKNSYLHVISFDVQMNNINGHIPEEIEGCEELQNFAASNNILEGDLPSPMGSLISLKILNLANNSLSGSIPTALSHLSNLTYLNLVAFQVTSGSKVQSFNNFSWPETCSLTSFPWSYSTAPQSNSWNFLITALKENFLPSWTNCRTSQILCSTTTALLDNHVTLEL

SEQ ID NO: 190862 - protein, 460 aa, Glycine max
  Coding DNA Sequence Number=SeqID_74084
  Subcellular localization annotation: CTP_CleavageSite=67; ConfidenceScore=5.65e-01
MASNISEASMRLASQGNPKENLPCMHASSTPSTRPTSCLSLPALSAPVLLSSKRLFVFCWWLSKSVSLSHPASVEYDEFHRELKRHYWHKALTRQIDGHIDMVLVKEFYANLYDLEDKSPRQVRVRGKLIKFDDESLNTFLEALVILEPGEHVTTYSRFYRTCTDPQELAAKLYIPGREFVLNVEGAPWKLLKKDLTTLAQTCSVLSYSNLAPTFHTSDLNMDRARLGFPTLITALCIARGVVLDSLTFESLSPTINLTYIKKNCWNLDDPSVTFPGTCKARAQGSEGLSSSAPLAPTPSTSTLPSPPVHTGTSTSSSDVTVPILQSLHHGLCLVMQSIHDLAQHRPIIGMEDFMARVAWPGVQPSPLGVGEASAGHEPLSKVTPEVTLEATPWTSPVTISVVEVSEEEDGAADIDYAANMTTTQSTWDPWPTATQETPQPAQDTSFSPQDEPTAPQEEL

SEQ ID NO: 190863 - protein, 378 aa, Glycine max
  Coding DNA Sequence Number=SeqID_74085
  Gene Ontology: Mol. function=ATP binding; Cellular component=integral to membrane; Biological process=photosynthesis
  Homolog annotation: Hit_ID=Q9SLU2; Match level="QueryCoverage=100%, HitCoverage=90%, E-value=3e-85, Identity=44%"; Hit description=CF9 protein
MDLPLLRKSLQFSRRNKKYLLLIALFGASGYGAYRAYNSPYVAQKRCRIAKLLRAFVSVAELISNSADTVTVISNDLNRFLASESDEIPNSLKQLAKIAKSNEFSMSLARVSEAVTLGILLGYKSQPGNDKKDTKITAEASGFSDRVLERFFSKAGTGFVSVVVGSFARNLVLGFYDAEPVGARFQSDVPGWVNVICDERCGKLIGDCVQTFVSTAVAVFLDKTMDVNTYDEMFAGLSNPKHQENVKGILVSMCNGAMETFVRTSHQVLTNGTARPNTGLSVAPVVVPVSEDGCLKPEVFQLKIGSLINGVQDVGWLEQIKSVLSVPANRRFVLDVTGRVTFETVRSFVAFLVWRISDGFKRSVSKVHEEVMGKGLEV

SEQ ID NO: 190864 - protein, 451 aa, Glycine max
  Coding DNA Sequence Number=SeqID_74086
  Gene Ontology: Mol. function=ubiquitin-protein ligase activity; Cellular component=ubiquitin ligase complex; Biological process =protein ubiquitination
  Homolog annotation: Hit_ID=Q70KS2; Match level="QueryCoverage=41%, HitCoverage=72%, E-value=2e-37, Identity=47%"; Hit description=BSD protein
  Pfam annotation: Domain name=BSD; Domain location=174-240; Score =69.8; E_value=9e-18; Accession=PF03909.7; Description=BSD domain
MSWLARSFASSLRLDDDENDIVLDPPTTSSREPPQQQHEARENAFGSEEAEEEEDDDEETQERGGVKEDLDEIKETLTRQFWGMASFLAPPPSDSHSPSDPSSFVSDQSNHRAVSPNEVPQLDDAAISNHSNSVSVGSDSDGDCGLAQRAVGITEEVLVFAMNIAMHPETWLDFPIDEEDDTDDFDMSGAQQEHAAVVERLTPRLAALRIELCPCHMSESYFWKVYFVLLHSRLNKEDAGILSTPQVMAARAMWMQELHKQTKPEFEISGRSVSYSRDNAAQHNDFSPDLLDDTYSDDMPSQTYGYRTTSLSMLSDCETDKHMVESSGTHFTDKSVIEKNSIIKTENKDLKCGQPSQIIIQDYDDDDGDEWPEEDSDLGGYGGTTHPMVNEEDISFSDLEDDDYGIKPVSSSTGPVNPHSAPRTMKRLPDVWKNTSTGVWSILLYIMNGGE

SEQ ID NO: 190865 - protein, 123 aa, Glycine max
  Coding DNA Sequence Number=SeqID_74087
  Gene Ontology: Cellular component=integral to membrane; Biological process=vesicle-mediated transport
  Homolog annotation: Hit_ID=Q9FFF8; Match level="QueryCoverage=94%, HitCoverage=10%, E-value=2e-30, Identity=58%"; Hit description =Arabidopsis thaliana genomic DNA, chromosome 5, P1 clone:MOP10
MLYFGTDDIEIDEPIPKASTSSPDAKNKQKDKLQDREKLFEGGTNNDDIKPRLRTPEEIMATYRKTGDAASVAAQARNKLMERQEKLERISQRTAELQSGAENFASLANELVKTMERRKWWQI

SEQ ID NO: 190866 - protein, 164 aa, Glycine max
  Coding DNA Sequence Number=SeqID_74088
  Homolog annotation: Hit_ID=UPI0000660AB6; Match level="QueryCoverage =83%, HitCoverage=32%, E-value=3e-09, Identity=30%"; Hit description =UPI0000660AB6 related cluster
MVKKHSNLIGKTVVEEQDASDIEMDMRFWHDVFDLYFVCGKESRGRQDDDLVFFVRKLGSHGSGSNNKTESVDPYFVRRWAPKLSDLVDETSIDVDWRRSFYLNLIAHTSFSVTVAICSHQDLLNHRAGEDTPLSPIYKEVETTPAYPDICFAIDDFDSTFDAV

SEQ ID NO: 190867 - protein, 80 aa, Glycine max
  Coding DNA Sequence Number=SeqID_74089
  Gene Ontology: Mol. function=growth factor activity; Cellular component=extracellular region; Biological process=cell proliferation
  Homolog annotation: Hit_ID=Q7PCB1; Match level="QueryCoverage=98%, HitCoverage=97%, E-value=1e-13, Identity=54%"; Hit description =Putative phytosulfokine peptide precursor
  Pfam annotation: Domain name=PSK; Domain location=9-80; Score=73.1; E_ value=8.8e-19; Accession=PF06404.3; Description=Phytosulfokine precursor protein (PSK
MSKLATFLYLLICFGLTYASRPNVEFDAIISPHRDVSAYKTALAVLDDESCEGIDGSEECLMRRTLVAHVDYIYTQKHKP

SEQ ID NO: 190868 - protein, 118 aa, Glycine max
  Coding DNA Sequence Number=SeqID_74090
KGRDLSNRNRCWGWRFTHLKQIANQTGDSLLLCALQLLSLHPPSKTTSASCTPRPAISETPQSELRFQQQWRSRQCKWRDALPREVASTTGGLAFHVSHGSEIAIANGDLHEKCMQFT

SEQ ID NO: 190869 - protein, 59 aa, Glycine max
  Coding DNA Sequence Number=SeqID_74091
MVDEMILKARTAIFTISRTNYCPNDHQRVKTMFKIRNTNDHQRVKTMFKIRNITSLFLW

SEQ ID NO: 190870 - protein, 208 aa, Glycine max
  Coding DNA Sequence Number=SeqID_74092
MYSYRLMAALVLTEKDHCYCVVLNAHDGAAFPSEKVSNDCSTSDSSSLQVHTISAKKKDTKLTLFSGFVSYQMVRDAYDAGRSRFGSLLSVVHSSGKTDRIYMKGPGGRGEVEVAVSGVADQSHEDSGPFSPVISKKGFGLGVIVRKAASAASVAARHAYAAASASSPTFDELIPLKCSLMSISLPWEYIAYDLLFKVRFCIDQLGLK

SEQ ID NO: 190871 - protein, 144 aa, Glycine max
  Coding DNA Sequence Number=SeqID_74093
  Homolog annotation: Hit_ID=Q9T062; Match level="QueryCoverage=66%, HitCoverage=32%, E-value=9e-07, Identity=37%"; Hit description=BZIP transcription factor-like protein
  Pfam annotation: Domain name=bZIP_1; Domain location=55-117; Score =34.7; E_value=3.2e-07; Accession=PF00170.11; Description=bZIP transcription factor
  Pfam annotation: Domain name=bZIP_2; Domain location=55-109; Score =39.1; E_value=1.5e-08; Accession=PF07716.5; Description=Basic region leucine zipper
  Pfam module annotation: Pfam domain module=bZIP_1::bZIP_2; Domain location=55-117::55-109
MFFHQDEAVQYPCTPVHETMLTESEIEDLFSLINHSTDPASPGSGSQGSNRVVYSPEERKLRRMQSNRESARRSRYRKKQHIENLTSQLNRLRIQNRLLKNQLASTMHQNLLLSLHNDHLKSESVALMATLSDLCGILGTMLSH

SEQ ID NO: 190872 - protein, 343 aa, Glycine max
  Coding DNA Sequence Number=SeqID_74094
  Gene Ontology: Cellular component=integral to membrane; Biological process=vesicle-mediated transport
  Homolog annotation: Hit_ID=Q9FFF8; Match level="QueryCoverage=96%, HitCoverage=28%, E-value=7e-42, Identity=35%"; Hit description =Arabidopsis thaliana genomic DNA, chromosome 5, P1 clone:MOP10
MTSLSVLFLIDGVPSSSSPITSLVWKQEAYFLSGVNSLKQSETDSGNSLEEILFVLSRDGKINIVDSDSGKIICSRPLQVKESTAISIISLEILIDFCTPEGSISASEASNDKLQEEPVKNTADASPDEEEEPLSTRVNSSEAGLPSSESSHSGDLLLDPLVLLCCENSLRLFSAKSLIQGHKKPIKKVKHSKSCYWTTFFKKDDKVYGLLSLLQTGTFEIRSLPDLELVAESSLLSILRWNYKVNMDKTMCSDDHGQIVLANSSELAFMSLLAGENEFSNPEHLPCLHDKVLAAAADAAFRFSSNQKKKQTVVPGILGGIVKGFKGGKTTPTDVTKIPTSNF

SEQ ID NO: 190873 - protein, 67 aa, Glycine max
  Coding DNA Sequence Number=SeqID_74095
MGQSRSNVGPKFGKEDGDEEELRKTSTLSLLTITWDMVEVALVVAQQVEHPSVQKGQLVKEGKWQVD

SEQ ID NO: 190874 - protein, 86 aa, Glycine max
  Coding DNA Sequence Number=SeqID_74096
MIENMCALQSTGTWDLLPFPPGKSTDGCHLLYTIKFAPMVPLINSSLFWYQMIYTSVQMYMEQPQGFVAQGESSTMASKVAQSKDD

SEQ ID NO: 190875 - protein, 577 aa, Glycine max
  Coding DNA Sequence Number=SeqID_74097
  Gene Ontology: Cellular component=integral to membrane; Biological process=vesicle-mediated transport
  Homolog annotation: Hit_ID=Q9FFF8; Match level="QueryCoverage=95%, HitCoverage=49%, E-value=1e-140, Identity=48%"; Hit description =Arabidopsis thaliana genomic DNA, chromosome 5, P1 clone:MOP10
  Pfam annotation: Domain name=WD40; Domain location=231-269; Score =19.2; E_value=0.015; Accession=PF00400.22; Description=WD domain, G -beta repeat
  Pfam annotation: Domain name=WD40; Domain location=30-68; Score=3.6; E_value=14; Accession=PF00400.22; Description=WD domain, G-beta repeat
  Pfam annotation: Domain name=WD40; Domain location=517-555; Score =7.2; E_value=5.2; Accession=PF00400.22; Description=WD domain, G -beta repeat
  Pfam module annotation: Pfam domain module=WD40::WD40::WD40; Domain location=231-269::30-68::517-555
MFAKRLLHKAVLHHSNHKLQHGGLQGNELDPRIVIHYGIPSTASVLAFDPIQRLLAIGTLDGRLKVIGGDNIEGLLVSPKQLPYKYLEFLQNQGHLVGVLNDNDIQVWNLESRSLVCSLQWEFDITAFSVISGSHFIYVGDQHGLFSVIKFEAEEGQLLKSSYNLSAKFLREAAGFSEPSEQPIIGVLLQPSSFGNRQDITRIVFLGGGKDLQLKDEDGNSSSESGANPPADIVEQNLGDKEITALCWASSTGSILAVGYLDGDILLWNLSSAAPSKGQQTSKNVVKLQLSTEERRLPVIVLQWSNSHKSQSDSAGQLFVYGGDEIGSEEVLTGFQVLTLEWSSGMESVKCTNRADLTLNGSFADLILLPSPGTMGLSSKDELFVLTNPGQLHLYDNDSLSTLTSQPKRTPSVSAVEFPVLVPIADPCLTVAILIRLPSKSNSSKILTEVASAMRTGSRPGSAPSNWPLTGGVPSLSSTAKGAVVERVYFVGYSNGSVLVCDATHAVLSYICYIEGEVNGIKVAGSDAQVTKLDFCSVSLLLAVGNECGLVRIYDLKGHSGGRNFHFVTETKSEGDP

SEQ ID NO: 190876 - protein, 128 aa, Glycine max
  Coding DNA Sequence Number=SeqID_74098
MVHDAPEGGLEVVSGAEAGGVEKVDGAWAGDIIEGEAEDKDDRAGEDVVLEVEPQVVEVKEEKVKVVDDSLSETDWLSEPHPLSEVVSSLREWETLGEDKSEICMPNVQPARPTKTLSILALSAPMLA

SEQ ID NO: 190877 - protein, 107 aa, Glycine max
  Coding DNA Sequence Number=SeqID_74099
  Gene Ontology: Mol. function=oxidoreductase activity, acting on the CH-CH group of donors; Cellular component=glyoxysome; Biological process=fatty acid metabolic process
  Homolog annotation: Hit_ID=Q96329; Match level="QueryCoverage=57%, HitCoverage=14%, E-value=2e-24, Identity=79%"; Hit description=Acyl -coenzyme A oxidase 4, peroxisomal
MKMPSYFNFPALDVSVAFPQATPASTFPPCASDYFHFNDLLKPEEQAVRNRVRECMEKEIAPIMTEACFSFLLIVLKEAEIGQNSAEIPFVWITVLNVLLGGKLFFF

SEQ ID NO: 190878 - protein, 71 aa, Glycine max
  Coding DNA Sequence Number=SeqID_74100
MAKTESFGAKQSERCSVRKQRDDRNSGRWDWFRCNLSAHAWFGGRCSIMVWGCWYLGFGFLDSHLVRGLIN

SEQ ID NO: 190879 - protein, 346 aa, Glycine max
  Coding DNA Sequence Number=SeqID_74101
  Gene Ontology: Mol. function=oxidoreductase activity, acting on the CH-CH group of donors; Cellular component=glyoxysome; Biological process=fatty acid metabolic process
  Homolog annotation: Hit_ID=Q96329; Match level="QueryCoverage=93%, HitCoverage=75%, E-value=1e-145, Identity=76%"; Hit description=Acyl- coenzyme A oxidase 4, peroxisomal
  Pfam annotation: Domain name=Acyl-CoA_dh_1; Domain location=191-338; Score=47.4; E_value=4.7e-11; Accession=PF00441.14; Description=Acyl -CoA dehydrogenase, C-terminal doma
  Pfam annotation: Domain name=Acyl-CoA_dh_M; Domain location=91-143; Score=87.7; E_value=3.5e-23; Accession=PF02770.9; Description=Acyl -CoA dehydrogenase, middle domain
  Pfam annotation: Domain name=Acyl-CoA_dh_N; Domain location=4-87; Score=-3.1; E_value=0.00069; Accession=PF02771.7; Description=Acyl -CoA dehydrogenase, N-terminal domain
  Pfam module annotation: Pfam domain module=Acyl-CoA_dh_1::Acyl-CoA_dh_ M::Acyl-CoA_dh_N; Domain location=191-338::91-143::4-87
YWEKAEFPFHVIPKFAALRIAGGTIKGYGCPDLSIAGSAVAAAEVARVDASCSTFFLVHSSLAMLTIALCGSEAQKQKYLPSLAQMKTIACWALTEPDYGSDASALKTTATKVEGGWILDGQKRWIGNSTFADLLVIFARNMTTNQINGYIVKKDAPGLTVTKMENKIGLRIVQNGDIVMGKVFVPDDDRLEGVNSFQDTNKVLAVSRVMVAWQPIGLSMGIYDMCHRYLKERKQFGAPLAAFQISQQKLVQMLGNIQAMILVGWRLCKLYESGKMTPGHASLGKSWITLRARETAALGRELLGGNGILADFLVAKVLMPNFIFEIYFVEPSIGSRFKWGNFRMDF

SEQ ID NO: 190880 - protein, 74 aa, Glycine max
  Coding DNA Sequence Number=SeqID_74102
  Gene Ontology: Mol. function=RNA-directed DNA polymerase activity; Biological process=RNA-dependent DNA replication
MPLRGWIASCLLGQHDESGKRERAVYYLSKKFTAYGMNYSLLERTCCALVWGAYRLRQYMLSYTTWLVLVILYD

SEQ ID NO: 190881 - protein, 159 aa, Glycine max
  Coding DNA Sequence Number=SeqID_74103
MEAMLSMKKIMESNAAVVTPTSVATQVDPTHPSGLNQLNPPISDMVGQGGEAFGNTGGPYVVKSKNSFPSYDLPPNYAPPNAVPVLDENANNSTPIPIEGQQPQSDHAHAFCGVPLPNTLWGPQYHPQPQPLHSVAGRVPPARVKREKLDHIEERLRAI

SEQ ID NO: 190882 - protein, 90 aa, Glycine max
  Coding DNA Sequence Number=SeqID_74104
GPRRTGAGGGEGRAEVDGADVDGALDLLALDFWVPGKVTEGSSSGEIFPQELPWQTLSIKNCSNLPFGGRATRDSRDACSTKGIRAESPP

SEQ ID NO: 190883 - protein, 38 aa, Glycine max
  Coding DNA Sequence Number=SeqID_74105
MESLCRKQPKDLDELQARVVGYIQMELFTFCNQMRCTE

SEQ ID NO: 190884 - protein, 170 aa, Glycine max
  Coding DNA Sequence Number=SeqID_74106
  Gene Ontology: Mol. function=RNA-directed DNA polymerase activity; Biological process=RNA-dependent DNA replication
  Homolog annotation: Hit_ID=Q8H6Q8; Match level="QueryCoverage=75%, HitCoverage=43%, E-value=3e-31, Identity=51%"; Hit description=CTV.20
QHFIGDPSLWKDRFAELLSNLKCRTLADFRWYRDTFLTRVYTREDSQQPLWKEKFLASLPRSLGDKVRDKIRSQSSNGDIPFENLSYSQLISYVQKVALKIFQDDKIQRQLAKEKAQTRKDLGSFCEQFGLPTCPKQKKKQRKKSRIINQPIEGDFQKEDTLKNPQLVRK

SEQ ID NO: 190885 - protein, 259 aa, Glycine max
  Coding DNA Sequence Number=SeqID_74107
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=1e-41, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVLAFRGLHVLAFRGLHGLTFRGLHVLTLRGLHALAFTGLHAVTFRGLHVLAFRGLHVLAFKGLLALPIRGLDALTFRGLHILAFRGLHMLAFRGLHVLAFRGLHVLAFRGLHVLPSKDYTSSRLHVLTIRGLHVLAFRGLHALAFRGLHVLAIRGVHALTFIGLHVLSFRGLHVLSFRGLDALTFKGLHVLAFRGLHALTIRGLHVLAYRGLHVLTFRGLHALAFRGLHVLAFRGHHTLTFRGLHVLAFRGVARPHL

SEQ ID NO: 190886 - protein, 965 aa, Glycine max
  Coding DNA Sequence Number=SeqID_74108
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=90%, HitCoverage=76%, E-value=1e-144, Identity=50%"; Hit description =Chromo
  Pfam annotation: Domain name=rve; Domain location=534-690; Score =104.4; E_value=3.4e-28; Accession=PF00665.16; Description=Integrase core domain
  Pfam annotation: Domain name=zf-H2C2; Domain location=475-516; Score =20.6; E_value=0.00066; Accession=PF09337.1; Description=His(2) -Cys(2) zinc finger
  Pfam module annotation: Pfam domain module=RVT_1::rve::zf-H2C2; Domain location=252-421::534-690::475-516
MKSNLPPLLPTPPGPPIRSSNVKRITPVEMRLRKEKGLCYFCDEKFSFNHKYPNRQFLLLQMEDDNEDLMSTIVPQGTQEDEITESEDHHLSFNALKGGRGVGTIRFIAYIEKLPVTVLIDGGSSDNFLQPRVAKFLKLPVEPATQFRVMVGNGNYMSTEGLVKQLKGKFTTLQGDCELVPEQAQLHCIRRMVATNSIAEVYSQQLMEPDVAPNGSQPVKVKPYRYPHSQKEEIERLVSGLLDEGIIQPSKSPFSSPIILVKKKDGSWGVCTDYRALNAITIKDSFPIPTVDELIDELFGASFFSKLDLRSGYHQFFLNLDDRHKIAFRTHHGHYEWLVMPFGLTNAPATFQSLMNDIFAGILRKFVLVFFDDILVYSANCKDHLYHLVVVLSILKQHQLFARLSKCCFGVQQMDYLGHTLSGSGVAMDGTKLEAIQKWPEPHNLKQLRAFLGLTGKIVLPHDVGLLNQIMEEFHSSMIGGHVVVNRTTTRIGAQFYWNGMRSDISTFVRECAICQQAKVDHVFPAGLLQPLPIPQQIWEDIAMDFIVQLPPTQGFTTIFTVVDRLSKFGYFIPLKFEFNSKVVAEVFVTNIVKIHGLPKTIVSDSERIFISTFWQQLFKVQGTTLAMSSSYHPQSDGQIENLNKTIEMYLRCFIFEHPKRWVTMLPWAQFWYSTSFHQSLGMTPFQVVFGRPPPTVMHYEVDPKDPDPLKDLLQLCDQLLSKLKGNLLKAQQYMKMQADKKRRDLQFQVGDLVLVKLQSYRQHSVALRKHQKLGLCYFGPFPVIEIIGTVAYKVQLPESTKIHHVFHIALLKPFNGKSSSPYLPFPLTSSELGPTLCLWKVLDVQVVKCLEATEAKDATWEDLQDIYESYPQFNLEDKVVFDEEGNVTCIKKEGDLVILLPVVATYPSAGGRRVTRGMRVPRKEYARSRHQRLFEENVGKTGKDAIYDLLSERFGSCIYARGRY

SEQ ID NO: 190887 - protein, 103 aa, Glycine max
  Coding DNA Sequence Number=SeqID_74109
  Gene Ontology: Mol. function=oxidoreductase activity; Biological process=ethylene biosynthetic process
  Homolog annotation: Hit_ID=Q8W3Y3; Match level="QueryCoverage=54%, HitCoverage=27%, E-value=2e-16, Identity=56%"; Hit description=1 -aminocyclopropane-1-carboxylic acid oxidase
  Pfam annotation: Domain name=2OG-FeII_Oxy; Domain location=28-98; Score=3.4; E_value=0.055; Accession=PF03171.10; Description=2OG -Fe(II) oxygenase superfamily
MVQEGDEGFWFEVRETSRAAAGLVVLESWPMERVANYPPCPNLVLVKKGLRPHTNAGGIILLFQDDKVITNGKYKSVEHHVIAQTDGTKCLLPHSLCVIAQTD

SEQ ID NO: 190888 - protein, 69 aa, Glycine max
  Coding DNA Sequence Number=SeqID_74110
MDEDQWMYDSIMSEEVYMDDQNEQECGVNEQHVDCSDAFNTSQVFGTRDDVLQWARLVAHENRFVAIIM

SEQ ID NO: 190889 - protein, 333 aa, Glycine max
  Coding DNA Sequence Number=SeqID_74111
  Homolog annotation: Hit_ID=Q8PPZ9; Match level="QueryCoverage=36%, HitCoverage=82%, E-value=8e-35, Identity=60%"; Hit description=3 -dehydroquinate dehydratase
QVRLFQQVDQLLDFAEIHGGLFALDVSVAAHLCAVARRAIGIEGIDGVAVVVAQLHPGTLGQDQLLLGIAAIAAAATVGGRTGRSPSWWSDVSSRCLRPCGRTPWPHRRDRPTPERRQARAAARSRAGRMHAQQRRVHRVAVAVGAEAADHAHGLVTEVAVLAERFAGMRIGQVDLDERHRHRRQRIAQGHRGMGEGGGVDQDESGSVVARGLHAVHQYVLGIGLQALDRVPGGRGLGRQRLVDVGQRGVAVDLRLAGAEQVEVGAVQDQQLRHGIRKTGKGGSLAEPADAVQFGEVCCVSIVCLKPAEALAALRGAADQGALNAVRAGDACT

SEQ ID NO: 190890 - protein, 724 aa, Glycine max
  Coding DNA Sequence Number=SeqID_74112
  Gene Ontology: Biological process=multicellular organismal development
  Homolog annotation: Hit_ID=Q208P4; Match level="QueryCoverage=97%, HitCoverage=99%, E-value=0.0, Identity=76%"; Hit description=RAMOSUS4
REKGLELEISYRRMGDGSIVGHLPEEILLNVFSAVSDTRTRNALSLVSWSFYHLERKTRTSLTLRGNARDLHLIPTSFKHVTHLDLSFLSPWGHALFCSSSATVGHQSLLAQHLRAAFPRVTSLAIYARDPYTLRLLLLSAWPELSAVKLVRWHQRPPTSANEADFAELFKKCRSLASLDLSSFYHWTEDIPKVLAANPISAATLRRLNLLTTSLPEGFKAHEIESITASCPNLEHFLVVCTFHPRYIGFVSDDTLVAIPSNCPKLSLLHLADTSSFLNRREDEGFDGEDASVSRAALLTLFSGLPLLEELVLDVCKNVRESSFALEVLGSKCPNLRVLKLGQFQGICLAFGSRLDGIALCHGLQSLSVGNCADLDDMGLIEIARGCSRLVRFELQGCRLVTERGLRTMACLLARTLIDVKVSCCVNLDTAATLRALEPIRERIERLHVDCVWNGLKESDGLGHGFLNFDLNGLDEPGDGGELMDYFGGGECENATKRKRQRCEYEMGVHDSFLQSNGNGFCGKSWDKLQYLSLWIKVGDLLTPLPVAGLEDCPVLEEIRIKVEGDSRGQPKPAESEFGLSILACYPQLLKMQLDCGDTKGYALTAPSGQMDLSLWERFLLNGIGSLSLGELHYWPPQDEDVNQRSVSLPAAGLLQECYTLRKLFIHGTAHEHFMNFFLKIPNLRDVQLREDYYPAPENDMSTEMRVGSCSRFEDALNRRRICD

SEQ ID NO: 190891 - protein, 815 aa, Glycine max
  Coding DNA Sequence Number=SeqID_74113
  Gene Ontology: Mol. function=protein serine/threonine kinase activity; Cellular component=membrane; Biological process=protein amino acid phosphorylation
  Homolog annotation: Hit_ID=Q6ER39; Match level="QueryCoverage=99%, HitCoverage=100%, E-value=0.0, Identity=60%"; Hit description=CTR1 -like kinase kinase kinase-like
  Pfam annotation: Domain name=Pkinase; Domain location=559-807; Score =229.4; E_value=7.7e-66; Accession=PF00069.15; Description=Protein kinase domain
  Pfam annotation: Domain name=Pkinase_Tyr; Domain location=559-807; Score=243.6; E_value=4.2e-70; Accession=PF07714.7; Description =Protein tyrosine kinase
  Pfam module annotation: Pfam domain module=Pkinase::Pkinase_Tyr; Domain location=559-807::559-807
MEETREDAGPAERRPSNMSWWPSDFVEKFESVSLSSQDETLNNKESPRHSNRDVMSPQKASQILWRTGMLSEPIPNGFYSVILEKRLKKLFDSIPTLEELQALGGEGFRADVIVVDAEKDRRLSMLKQLIVALVRGLNSNPPAMIKKIAGLVSDFYKRSNVESPAKAALEESSHMFENRGVQMLGQIRHGSCRPRAILFKVLADTVGLESRLMMGFPNDGAAECVDSYKHMSVIVVLNSVELLVDLMRFPGQLLPRSTKSILMTHISAAGESDSAENDSCDSPLEPNSPLYGVSESVEKEENLQFHRRFEVSSNVSGLPLRNMMLRSNTSLDRNWSFSHSEPNIATAFGRRSRRKVIAEQRTASSSPEHPSLRAHGRSKLSGDRTSFRDFADDQSTLRSSYKSDGASSSEARRIRRRSISITPEIGDDIARAVRAMNKTLKQKRLPREQGGDSSLSHSPIDRTSSLDLQKNVSNFHLDGHHERSPLYLLHRDPVTSQKAMSLPSSPHDYRVQASERSEASEYTTNDELESTWNKILESPMFSNRPLLPYEEWNIDFTELNVGTRVGIGFFGEVFRGIWNGTDVAIKVFLEQDLTAENMEDFCNEISILSRLRHPNVILFLGACTKPPRLSMVTEYMEMGSLFYLIHVSGQKKKLSWRRRLKMLRDICRGLMHIHRMKIIHRDVKSANCLVDKHWIVKICDFGLSRIITESPMRDSSSAGTPEWMAPELIRNEPFSEKCDIFSLGVIMWELCTLNRPWEGVPPERVVYTVANEGARLDIPEGPLGRLISECWAEPHERPSCEEILSRLVDIEYSMC

SEQ ID NO: 190892 - protein, 54 aa, Glycine max
  Coding DNA Sequence Number=SeqID_74114
MEQLQIKERSSPSYANIDLDKRMFKIQLKVSHDTNVVTFTMFDRDAQQFLNTIT

SEQ ID NO: 190893 - protein, 76 aa, Glycine max
  Coding DNA Sequence Number=SeqID_74115
MEDTPVSPASPSRRRRTLAKPADWLSEEVKNSTLPSLEVLDWAIEVIRPEIRAPMFISKQETRPKISLARGGQVEV

SEQ ID NO: 190894 - protein, 116 aa, Glycine max
  Coding DNA Sequence Number=SeqID_74116
  Homolog annotation: Hit_ID=Q94F64; Match level="QueryCoverage=94%, HitCoverage=23%, E-value=2e-20, Identity=41%"; Hit description=CDPK adapter protein 1
MGGTVDDTLSSCKVEKQKFKIQPVSPFSTGEGLPYAFEEWPNASDVWGWKVGRRANKAGYFHDRYLYLSTSLHTSCCYSWCFQSKPDVERYIQSNFPNMKIEEFFGLFSWKVPTTE

SEQ ID NO: 190895 - protein, 92 aa, Glycine max
  Coding DNA Sequence Number=SeqID_74117
MSVKNLVEHLGVHDKTNHTLGDQSRSLCFARTLQSYGINIDFKKHSNRVYLPPRSTLRRVRQGLSLLSQAKGPSGEGRRPKWRKIKLPSGEE

SEQ ID NO: 190896 - protein, 74 aa, Glycine max
  Coding DNA Sequence Number=SeqID_74118
MGVIKYLTMDELKILNIPSETLKLFNHSIFPHKGHPIRKISMQQGQTYILVARFPDPNYGVKTVNFIINSPHLS

SEQ ID NO: 190897 - protein, 243 aa, Glycine max
  Coding DNA Sequence Number=SeqID_74119
  Homolog annotation: Hit_ID=Q8H6Q8; Match level="QueryCoverage=47%, HitCoverage=3%, E-value=6e-09, Identity=31%"; Hit description=CTV.20
MASESDDDSETDLQKQIQKAKQTKTVCNQKPSQPLTQQESTPQPSNNYISKNKFFNVLQMEPEYWDKNPFKATAKVFPPGFHYRPTATNKTRKFYEFILIDTNSVSIKHFKDPKDPNLNTHSTIQILKRHAFVKWWSQFDTSKAAPEQVKNWFQSNPEFLRPADPETSLFLNQKSQLAAFLASSKSKESLAQNLKEVLQLLQQEEEEEPPKKEAESSENNDDQEDYPFYQNEDDCFGTSLDDD

SEQ ID NO: 190898 - protein, 46 aa, Glycine max
  Coding DNA Sequence Number=SeqID_74120
MSAFIYSCTSSTLPITLALAQVRIWGCDMNPHGTRANDLGSSRIKP

SEQ ID NO: 190899 - protein, 48 aa, Glycine max
  Coding DNA Sequence Number=SeqID_74121
MELRQISPSSSFVVFFVQKEHMCRRCCESMCADGCTDHRERLRGEDSH

SEQ ID NO: 190900 - protein, 282 aa, Glycine max
  Coding DNA Sequence Number=SeqID_74122
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=Q8LD27; Match level="QueryCoverage=99%, HitCoverage=100%, E-value=1e-103, Identity=69%"; Hit description =Proteasome subunit beta type 6 precursor
  Pfam annotation: Domain name=Proteasome; Domain location=11-242; Score=160.8; E_value=3.4e-45; Accession=PF00227.16; Description =Proteasome A-type and B-type
  Subcellular localization annotation: CTP_CleavageSite=59; ConfidenceScore=5.07e-01
MDQKVDFSAPHSMGTTIIGVTYNGGVVLGADSRTSTGVYVANRASDKITQLTDNVYVCRSGSRMRPLAVWSVIINVPLDFLHHMLVIFKIFPSLKVILSMSVESMDDDLVKAADSQIVSDYVRYFLHQHTIQLGQPATVKVAANLVRLLAYNNKNFLQTGLIVGGWDKYEGGQIYGVPLGGTIVQQPFAIGGSGSSYLYGFFDQAWKEGMTKDEAEDLVKKAVSLAIARDGASGGVVRTVIINSEGVTRNFYPGDQLPLWHEEMEAHNSLLDILGVPEPMSM

SEQ ID NO: 190901 - protein, 128 aa, Glycine max
  Coding DNA Sequence Number=SeqID_74123
PAGSDTLDYAKGYLTDKARDVKERAKDYGSYAQGGDGGGTLVDLHVQVLLFILNLVCIVLCCSGTGIRKGVKFVAKSGFRSSIFQCHLTVAVAEMMRDCCLNLKSDAILTSSFSEMIHELDTIPFPSF

SEQ ID NO: 190902 - protein, 288 aa, Glycine max
  Coding DNA Sequence Number=SeqID_74124
  Subcellular localization annotation: CTP_CleavageSite=44; ConfidenceScore=5.30e-01
MATSPTTTTTTTVRSSSVPSLPPPSPKSPPEYPDLYGKRRETARVHMLEREITFLEEELKSVEGLQAASRCCKEIADYVMANADPLLPSDHDSYAFFSFKQNQEEPSVMWLLEVALLFVEKYDKKEIKHQSPANNFFSTLAPFSLEYLLVKRKRLMTNERDPFPFCEDYVACPVLTSLGSVAAVAAVKVAVAAVFHPSNAAPYQSGAVVALAPNQIAVKRVAVLEIVVLSHVVAILGAQLVHLAPLAAVANAPALALAQAVQRTQDTGNVFSFGTPISSHSWPRSFGI

SEQ ID NO: 190903 - protein, 155 aa, Glycine max
  Coding DNA Sequence Number=SeqID_74125
MREGEESEAEDEVKTAEGKPATASCSTNPFSKVGEVSIEILRQRALSSVAWCCREQAKSTMGIPQTARDRCGVELSDLQAPLADLNRDHFLDSYPPSLVFRVGGVGFGWAHTGLVVVGVGGGWWWNDGGIGGGICVEGGDLVGSVVVMVDVEEGE

SEQ ID NO: 190904 - protein, 822 aa, Glycine max
  Coding DNA Sequence Number=SeqID_74126
  Gene Ontology: Mol. function=RNA-directed DNA polymerase activity; Cellular component=chromatin; Biological process=one-carbon compound metabolic process
  Pfam annotation: Domain name=RVP_2; Domain location=403-517; Score= -35.3; E_value=0.00056; Accession=PF08284.2; Description=Retroviral aspartyl protease
  Pfam module annotation: Pfam domain module=RVP_2::RVT_1::Retrotrans _gag; Domain location=403-517::579-748::108-198
MGERIEALETQMGNVTTTLHDLALQMQQHAQQMQQQSVILTELSKQISQKGVSPEGETSVGDSTQNESRLAGKKVKLSVFEGEDPVAWITRAEIYFDVQNTPDEMRVKLSRLSMEGSTIHWFNLLRETKDDLSWEILKRALIARYGGRRLENPFEELSTLRQTGTVEEFVEAFELLSSQVGRLPEEQYLGYFMSGLKQPIRRRVRTLNPQNRMQVMRMAKDVEEELKEEDDEGDRYYGKNRMSRSEPNGLLSKSRNGSNPIHKDFTRSNSGGYAPSQKTGSTGSNTNPTSSMNSTGRKGENDRRTLSSERWKGVRGVQSDEIAERRAKGLCFKCGGKYHPTLHKCPERAMRVLILGEGEELNEEGEIVSLEATETEGEGEGEETEAECNLIGVMGSMGEYNTMKICGKIASIDVMVLIDSGASHNFISPEITTALGLLVTPMAAKNIKLGDGHKVLSKGICEGVQIDLGPQVFHVDALVLELGGLDVVLGVSWLSTLGKVVMDWKDLSMQFMHEGRMVNLQAQGRIQEKQSCLHSFLEDKHRRGGEGWWWTQYPYHQKKEIGKQVTELLAAGVIRTSMSTFSSPVILVKKKDGSWRMCVDYRALNKATVPDKYPIPIVDELLDELYGATIFSKIDLKAGYHQIRVHKDDMHKTAFRTHNGHYEYLVMPFGLMNALATFQATMNDIFRPYLRSFVLVFFDDILVYSKSETEHLEHLKLVLSVLESHCFVANEAKCKFGCKQVDYLGHVISGDGVAVDPDKIKCVLEWPEPKNVKGVRGFLGLTGYYRKFIKDYGKIAKPLTELTKKNNFVWGKEALVAFKLLK

SEQ ID NO: 190905 - protein, 751 aa, Glycine max
  Coding DNA Sequence Number=SeqID_74127
  Gene Ontology: Mol. function=identical protein binding; Cellular component=cytoplasm; Biological process=negative regulation of enzyme activity
  Homolog annotation: Hit_ID=Q9ZUF6; Match level="QueryCoverage=97%, HitCoverage=96%, E-value=0.0, Identity=63%"; Hit description =Subtilisin-like serine protease, putative
  Pfam annotation: Domain name=PA; Domain location=354-452; Score =100.1; E_value=6.6e-27; Accession=PF02225.12; Description=PA domain
  Pfam annotation: Domain name=Peptidase_S8; Domain location=106-580; Score=45.6; E_value=1.6e-10; Accession=PF00082.12; Description =Subtilase family
  Pfam annotation: Domain name=Subtilisin_N; Domain location=22-96; Score=64.8; E_value=2.7e-16; Accession=PF05922.7; Description =Subtilisin N-terminal Region
  Pfam module annotation: Pfam domain module=PA::Peptidase _S8::Subtilisin_N; Domain location=354-452::106-580::22-96
MDSSISLFFLLLQLTMLSATKKTYIVHMKQRHDSSVHPTQRDWYAATLDSSPDSLLYAYTASYNGFAAILDPQEAHVLRASDSVLGVYEDTRYTLHTTRTPEFLGLQAHSAFWQDLHQASHDVVIGVLDTGVWPESQSFDDSQMPQIPTRWRGNCESAPDFDPSLCNNKLIGARSFSKGYRMASANARKNREPASPRDLDGHGTHTASTAAGSAVSNATLLGYATGTARGMAPQARVAAYKVCWTGGCFASDILAGMDQAIQDGVDVLSLSLGGSSSSVPYYFDNIAIGAFAALERGIFVACSAGNTGPRSGSVANVAPWIMTVGAGTLDRDFPAYATLGNGKRFAGVSLYSGEGMGDEPVGLVYFSDRSNSSGSICMPGSLDPDSVRGKVVVCDRGLNSRVEKGAVVRDAGGVGMILANTAASGEGLVADSHLVAAVAVGESAGDEIREYASLDPNPTAVLSFGGTVLNVRPSPVVAAFSSRGPNGVTAQILKPDVIGPGVNILAGWSGAVGPSGSQDTRKTGFNIMSGTSMSCPHISGLAALLKAAHPDWSPSAIKSALMTTAYTYDNTESPLRDATGEESLSTPWAYGAGHVNPQKALSPGLLYDASTQDYIYFLCSLNYTLDHLRLLVKHPDANCSKKFADPGDLNYPSFSVVFGSNKVVRYTRTLTNVGEPGSAYDVAVSAPSTVDITVNPNKLEFGEVGERQTYTVTFVSNRSVNDSATSGFGSIMWSNEQHQVRSPVAFTWTYF

SEQ ID NO: 190906 - protein, 171 aa, Glycine max
  Coding DNA Sequence Number=SeqID_74128
MKKRKELGHDFPPISPPPKSRRLEWERDLLCSTTMMMMMMMEEEENAMVDQPCVDPTPASVTDTEERAIVLYEPTATTPFLKSPSSPEFSVVIKADLIPGLKDYLLSWGIAKQDDPVEDEMRREKSSEMSTNDCLAVVPWVALHSPMACEEIVPETGQPLEVEEGDMMEMD

SEQ ID NO: 190907 - protein, 46 aa, Glycine max
  Coding DNA Sequence Number=SeqID_74129
FNLVYKMGALVGVKKLSMDTFWGFRKFTMEMEISNILSKLHHTKIT

SEQ ID NO: 190908 - protein, 115 aa, Glycine max
  Coding DNA Sequence Number=SeqID_74130
MMILETMFLRCSCSAYWGFPSSLQKSYFDIKREKNAPAENCSNLLEVTEKRKERGKTVAATGNLLRRWRMATHSGHRLWCRGGGERLWSDTCFETHPVKERKTPLQYICEMPFRG

SEQ ID NO: 190909 - protein, 213 aa, Glycine max
  Coding DNA Sequence Number=SeqID_74131
  Gene Ontology: Mol. function=DNA binding
  Homolog annotation: Hit_ID=Q1SBB3; Match level="QueryCoverage=93%, HitCoverage=30%, E-value=2e-24, Identity=41%"; Hit description =Homeodomain-like
MISSRKLFGLAYWQKFSRTKLVKGDHYFDSVNDVLSKVIAEPNLLKLEVVETKVGGSNGEDAETGSNKDGQPDNHHHHYLKHQASTNNGDHIIGKPCNLSELKSLHGNSVGKVDVDDDDIAYNKGNMHISKTKHRKGKHNKDATTQKEVNANPDHANNTTENHENQKTCVPDGNQPKRINLVKEQDQVKAETSHTVKNSSGGLGSENWDSQSS

SEQ ID NO: 190910 - protein, 349 aa, Glycine max
  Coding DNA Sequence Number=SeqID_74132
MTWHPNDGTDTCKSEAMWSLFSSPSSEGFFFSAEKLRSRVMEQHDLRRRHSPPLTSDPKPLPELARSASASSSFTVDNNSKGLSHHHSAAPAPPMYLKTIHLEVAGNIFLGQSTRWTDQQHSLYIRSLEASFVNELHHSMRLRCRSLRNSTDEAYKCRILQNLHNMPKQSLALQDDRQKRINLQRVAPMLESTADSHVLAGSQFELTSVDGSCSLREPITCKHGLLCDEEIQIHARGSSTFTDRSPRSLEKQCICRSFHLDLACSTTGSNPGNSLSLSLVAKVTDQNFKDEEARSSSMPLVKRLKTATADGSSSDQVVPFGKLHIPDVSTSSNAQAQKIKDMNCYENPQ

SEQ ID NO: 190911 - protein, 434 aa, Glycine max
  Coding DNA Sequence Number=SeqID_74133
MDIEEDVEIPLILGRPFMLTANCVVDIGKGNLQMGIDDQKITFDLFDAEKHSLDWNICSKMDEVENEMPLEKGKKPPPNLMSPMIRPDLFPRVPGKDMSRTFTLGTSFQRGMQPDGLIDVALVKKFYANLYDPEDKSPRKIRVKEKLIKFDGETLNAFLETPMVMEPGERYTAYSSALEAPEEGFDHSGALTRGLATHGHLGLYNEKGVKEREGGVVPNSLTFKSLSPAINLAYIRKNYWNPDDPTITFSGTRKARAQGPTDVSAPSSAPPALAPSAPLAPLPIVPAPFGTSTHSSDQIMSILQSLHHGLCLVMQSIHDLAQHQPIISMEDFMAQVVWPGVQPSSLGEGEAPTAQESQPEADADVEETPEDTPAATPTEATKEGDGAVNADYVADMVASQSTWDPWPTLAQDTSLPAQDAPSSPHDDPTPTQED

SEQ ID NO: 190912 - protein, 85 aa, Glycine max
  Coding DNA Sequence Number=SeqID_74134
MKTLKTIVDGKIDQAAPQWIEVKSHVQSEGYECCYHVIHWMWNIVSGGLKNDWVMWFADGTPLDKETITTIYNKWAAYFVKVKDS

SEQ ID NO: 190913 - protein, 248 aa, Glycine max
  Coding DNA Sequence Number=SeqID_74135
  Homolog annotation: Hit_ID=Q9FLU4; Match level="QueryCoverage=63%, HitCoverage=67%, E-value=1e-21, Identity=35%"; Hit description =Arabidopsis thaliana genomic DNA, chromosome 5, TAC clone:K18P6
  Pfam annotation: Domain name=DUF599; Domain location=1-171; Score =241.6; E_value=1.7e-69; Accession=PF04654.3; Description=Protein of unknown function, DUF599
MDNDKKNILAVQSLRNTIMGATLMATTSILLCSGLAAIVSSTYSVKKPLEDTVYGGHGEFMISLKYVTLLSIFLFSFFCHSLSIRFINQVNILINTPQDPIMSLVTPEYVNEILEKGFLLNTVGNRLFYAALPLLLWIFGPVLVFLCSLTMVPVLYNLDFVVTGANKGKMQLNENRDFKQVCSTTSTLVARVYAYAKKSLMPFGRKNEKDALIIHVLSYVNVNGHIVDPLYKYLIKSSKGGLFEDNIK

SEQ ID NO: 190914 - protein, 77 aa, Glycine max
  Coding DNA Sequence Number=SeqID_74136
MAMDLNFSSTTPLRLPGLFQALPLGLPLMIAADDPITASPKLSVLSSRRIPCLANSLEYPRIVVTETPCDERRDAFV

SEQ ID NO: 190915 - protein, 150 aa, Glycine max
  Coding DNA Sequence Number=SeqID_74137
  Homolog annotation: Hit_ID=Q1S0F5; Match level="QueryCoverage=49%, HitCoverage=15%, E-value=6e-07, Identity=40%"; Hit description=IMP dehydrogenase/GMP reductase
EGRIRTLSSCEGCPNVPLMGTRGCINYNPVLAIRQLGYPMRGVPSDESITPFITRGFSDHNARVLQGVRKAWDAAVQTQGLDWLPNLKTVRDSEVKASEESDEVQALKAELERARVVEEGAAIVSSSSEEVKGIITGQRHDLEGRAKGLP

SEQ ID NO: 190916 - protein, 96 aa, Glycine max
  Coding DNA Sequence Number=SeqID_74138
MEKAPRIDPLYNPNSSSLGLFSRKKSVIEAYPFQPRDQPIKQTKIVGMVYPADGLSSVSDVLVFVGEYLSGVQVSGPCPSISGGILRFRFRNDRFL

SEQ ID NO: 190917 - protein, 310 aa, Glycine max
  Coding DNA Sequence Number=SeqID_74139
  Gene Ontology: Mol. function=transporter activity; Cellular component= integral to membrane; Biological process=transport
  Homolog annotation: Hit_ID=Q8ZNA4; Match level="QueryCoverage=89%, HitCoverage=89%, E-value=1e-119, Identity=75%"; Hit description =Putative transport
  Pfam annotation: Domain name=Form_Nir_trans; Domain location=29-283; Score=-83.1; E_value=7.1e-05; Accession=PF01226.8; Description =Formatenitrite transporter
MKPSPSNNTHDNDVDSEEKEQGTDIEVDEDALPSRGAAIHEEIRQDGEKELERDGMALLWSAIAAGLSMGASLMAKGIFQVHLAGVPGAYLLENLGYTFGFVIVIMARQQLFTENTVTAVLPVMHKPTGGNFMLVLRLWSVVLIGNLIGTALGALAFNHMPIFDDATRQAFTAISEKVMEHTPGEMFANAVISGWIIATMVWMFPYAGGAKIVVIVMMTWLVALGDLAHIVVGSVEVLYLVFAGTLPWQEFLWPFALPTLLGNITGGTLIFALISHAQIRNDMSEAAKAKARAEQKRKEKQEKQKDQEKA

SEQ ID NO: 190918 - protein, 213 aa, Glycine max
  Coding DNA Sequence Number=SeqID_74140
  Gene Ontology: Mol. function=nucleoside-triphosphatase activity; Cellular component=outer membrane-bounded periplasmic space; Biological process=cytochrome complex assembly
  Homolog annotation: Hit_ID=Q9Z651; Match level="QueryCoverage=83%, HitCoverage=85%, E-value=5e-66, Identity=69%"; Hit description =Cytochrome c biogenesis ATP-binding export protein ccmA
  Pfam annotation: Domain name=ABC_tran; Domain location=62-212; Score =103.6; E_value=5.7e-28; Accession=PF00005.17; Description=ABC transporter
MNTPFGGRGSLRADFGPWFECGIIPASFIAMNLPSMLEVINLACVRDERTLFHGLSFQVQAGDVVQIEGPNGAGKTSLLRLLAGLSRPEQGEVRWQQQSIRRQREIWQQNLLYLGHHPGVKSVLSPRENLHFWHGDRSEDTLYDALEQVNLLGYEEVPVAQLSAGQQRRVALARLWLSPAPVWILDEPLTAIDKHGVEKLMARFADHADNGGV

SEQ ID NO: 190919 - protein, 150 aa, Glycine max
  Coding DNA Sequence Number=SeqID_74141
  Homolog annotation: Hit_ID=O24097; Match level="QueryCoverage=70%, HitCoverage=26%, E-value=7e-36, Identity=62%"; Hit description=MtN19 protein precursor
  Pfam annotation: Domain name=SURNod19; Domain location=3-150; Score= -141.4; E_value=3.7e-06; Accession=PF07712.3; Description=Stress up -regulated Nod 19
MDMRRNGCSTSWSLIHVVHKIRKLALNAEYTIPATGGGGDSPHVQKANIPMENGGYLIYGTAHMHSGVVNATLYGQDGRTLCTSTPKYGTGKEAGNEKGYLIGMSVCYPQPGSIKIHDGEILTLESRYKNEFRTGAMGHFYIYLAEELPQ

SEQ ID NO: 190920 - protein, 59 aa, Glycine max
  Coding DNA Sequence Number=SeqID_74142
MKVSTFCRKSKDLSEESYGGAIISSTPPHSFVVRPLPPSPPSPTLSSAPPHRLCFPCLE

SEQ ID NO: 190921 - protein, 54 aa, Glycine max
  Coding DNA Sequence Number=SeqID_74143
  Gene Ontology: Mol. function=protein dimerization activity; Cellular component=nucleus; Biological process=regulation of transcription, DNA-dependent
  Homolog annotation: Hit_ID=Q0GPH5; Match level="QueryCoverage=72%, HitCoverage=13%, E-value=7e-12, Identity=85%"; Hit description=BZIP transcription factor bZIP62
MAMTTTTESDLDYELRYLSLAVTDTFTAFQNLLPERIYAYPIEGENIRRKIVLW

SEQ ID NO: 190922 - protein, 396 aa, Glycine max
  Coding DNA Sequence Number=SeqID_74144
  Gene Ontology: Mol. function=DNA binding; Biological process =regulation of transcription
  Homolog annotation: Hit_ID=Q1SV84; Match level="QueryCoverage=86%, HitCoverage=98%, E-value=1e-101, Identity=56%"; Hit description=No apical meristem (NAM) protein
  Pfam annotation: Domain name=NAM; Domain location=69-197; Score =317.7; E_value=2e-92; Accession=PF02365.6; Description=No apical meristem (NAM) protein
MEGIMFISWRKGISQIIVSFPSEPYNLYKASKPDSRRVCFSMQKEKEAIVKEGTTEIEMEGTRAKEETLPPGFRFHPTDEELVTCYLVNKISDSNFTGRAITDVDLNKCEPWELPGKAKMGEKEWYFFSLRDRKYPTGVRTNRATNAGYWKTTGKDKEIFNSETSELIGMKKTLVFYKGRAPRGEKSNWVMHEYRIHSKSSYRTNRQDEWVVCRVFKKSGNAKKYPSSNHARAVNPYSLEIEPNILPPLMMQLGDPGAHFLYGRNYMNSAELAELARVLRGGGSTSSVNLPIQSHLSYPTSSSTGGGFTISGLNLNLGGGGATATTQPILRPMQPSPAPVHTMAQVLDANSSMMTTSSLGAENVGYGAEMSNLNLHGNRYMGVDHCMDLDNYWPSY

SEQ ID NO: 190923 - protein, 144 aa, Glycine max
  Coding DNA Sequence Number=SeqID_74145
  Subcellular localization annotation: CTP_CleavageSite=56; ConfidenceScore=5.04e-01
MATCTMVSMRSGLKREPPPKSSNLLLTTMTNNDTLCQLQPILQRWSVTTRLVATISLTIKSCLWGFYGGWIFELQWGSFNGDFPPWRCSGRQRKGGERRHHPLRNKPWKKELHHQDEPWIRSLERMLQWRKRKRERKREGGARN

SEQ ID NO: 190924 - protein, 509 aa, Glycine max
  Coding DNA Sequence Number=SeqID_74146
  Gene Ontology: Mol. function=protein kinase activity; Cellular component=intracellular; Biological process=protein amino acid phosphorylation
  Homolog annotation: Hit_ID=Q69WY1; Match level="QueryCoverage=99%, HitCoverage=99%, E-value=1e-104, Identity=32%"; Hit description =Selenium-binding protein-like
  Pfam annotation: Domain name=PPR; Domain location=127-161; Score =22.6; E_value=0.0014; Accession=PF01535.11; Description=PPR repeat
  Pfam annotation: Domain name=PPR; Domain location=198-232; Score =14.8; E_value=0.13; Accession=PF01535.11; Description=PPR repeat
  Pfam annotation: Domain name=PPR; Domain location=24-58; Score=48.9; E_value=1.7e-11; Accession=PF01535.11; Description=PPR repeat
  Pfam annotation: Domain name=PPR; Domain location=270-304; Score=4.1; E_value=2.4; Accession=PF01535.11; Description=PPR repeat
  Pfam annotation: Domain name=PPR; Domain location=336-370; Score=6.6; E_value=1.2; Accession=PF01535.11; Description=PPR repeat
  Pfam annotation: Domain name=PPR; Domain location=59-93; Score=1.9; E_ value=4.5; Accession=PF01535.11; Description=PPR repeat
  Pfam module annotation: Pfam domain module=PPR::PPR::PPR::PPR::PPR::PP R; Domain location=127-161::198-232::24-58::270-304::336-370::59-93
MYSKCGMVGEAGQMFNTLPVRNVISWNAMIAGYSNERNGEEALNLFREMQEKGEVPDRYTYSSSLKACSCAGAVGEGMQIHAALIKHGFPYLAQSAVAGALVDIYVKCRRMAEARRVFDRIEVKSMMSRSTVILGYAQEDNLTEAMDLFRELRESRYRMDGFVLSSLMGVFADFALVEQGKQMHAYTIKVPYGLLEMSVANSVLDMYMQCGLTDEADALFREMLPRNVVSWTVMITGYGKHACSHSGLIKEGKKYFSSLCSHQKIKPQVEHHDCVVDLLGRGGRLKEAKNLIEKMPLKPNVGIWQTLLSVCRMHGDVEMGKQVGEILLRREGNNPANYVMVSNMYAHAGYWKESEKIRETLKRKGLKKEAGRSWVEMDKEIHIFYNGDGMHPLIEEIHEVLKEMEKRVKEEMGYVHSINFSLHDVEEESKMESLRVHSEKLAIGLVLVRRGLKLKGERVIRIFKNLRVCGDCHAFIKGLSKVLKIAFVVRDANRFHRFENGLCSCGDYW

SEQ ID NO: 190925 - protein, 596 aa, Glycine max
  Coding DNA Sequence Number=SeqID_74147
  Gene Ontology: Mol. function=transferase activity; Cellular component= intracellular; Biological process=protein kinase C activation
  Homolog annotation: Hit_ID=Q1SV87; Match level="QueryCoverage=83%, HitCoverage=93%, E-value=0.0, Identity=73%"; Hit description =Pentatricopeptide repeat
  Pfam annotation: Domain name=PPR; Domain location=142-176; Score =17.1; E_value=0.063; Accession=PF01535.11; Description=PPR repeat
  Pfam annotation: Domain name=PPR; Domain location=204-238; Score =49.8; E_value=8.9e-12; Accession=PF01535.11; Description=PPR repeat
  Pfam annotation: Domain name=PPR; Domain location=305-339; Score =39.5; E_value=1.2e-08; Accession=PF01535.11; Description=PPR repeat
  Pfam annotation: Domain name=PPR; Domain location=340-374; Score =11.0; E_value=0.38; Accession=PF01535.11; Description=PPR repeat
  Pfam annotation: Domain name=PPR; Domain location=376-410; Score=8.4; E_value=0.75; Accession=PF01535.11; Description=PPR repeat
  Pfam annotation: Domain name=PPR; Domain location=442-476; Score=1.6; E_value=4.8; Accession=PF01535.11; Description=PPR repeat
  Pfam annotation: Domain name=PPR; Domain location=71-105; Score=9.5; E_value=0.56; Accession=PF01535.11; Description=PPR repeat
  Pfam module annotation: Pfam domain module=PPR::PPR::PPR::PPR::PPR::PP R::PPR; Domain location=142-176::204-238::305-339::340-374::376 -410::442-476::71-105
MGVRELENRFVTTLRNCPKIAELKKIHAHIVKLSLSQSNFLVTKMLDLCDNLSHVDYATMIFQQLENPNVFSYNAIIRTYTHNHKHPLAITVFNQMLTTKSASPDKFTFPFVIKSCAGLLCRRLGQQVHAHVCKFGPKTHAITENALIDMYTKCGDMSGAYQVYEEMTERDAVSWNSLISGHVRLGQMKSAREVFDEMPCRTIVSWTTMINGYARGGCYADALGIFREMQVVGIEPDEISVISVLPACAQLGALEVGKWIHKYSEKSGFLKNAGVFNALVEMYAKCGCIDEAWGLFNQMIEKDVISWSTMIGGLANHGKGYAAIRVFEDMQKAGVTPNGVTFVGVLSACAHAGLWNEGLRYFDVMRVDYHLEPQIEHYGCLVDLLGRSGQVEQALDTILKMPMQPDSRTWNSLLSSCRIHHNLEIAVVAMEQLLKLEPEESGNYVLLANIYAKLDKWEGVSNVRKLIRSKRIKKTPGCSLIEVNNLVQEFVSGDDSKPFSQELRYGTFGFLETSVFKAVDKCTLIQKIAFSAWSWMRGYLESFNCSTNQCLACPGISVLLREVIVVWLGKFDTSYQILTLCCSKGVELGMMGWCYW

SEQ ID NO: 190926 - protein, 143 aa, Glycine max
  Coding DNA Sequence Number=SeqID_74148
  Gene Ontology: Mol. function=DNA binding; Cellular component=oxygen evolving complex; Biological process=DNA integration
  Homolog annotation: Hit_ID=Q1SS72; Match level="QueryCoverage=94%, HitCoverage=9%, E-value=7e-39, Identity=60%"; Hit description =Integrase, catalytic region
MAVNKPVDNGMLGSKPVSTLIDYDVRLYQQSGTPLDDTKASSYHRLIGHLIYLTNTRPDITYAIQHLSQFVAHPSSAHQQAAYRILRYLKVTPGSGLFLSTSSIFQLKAFSDFDWARCIDTKRSITSYSVYLGSSFISWKSKK

SEQ ID NO: 190927 - protein, 97 aa, Glycine max
  Coding DNA Sequence Number=SeqID_74149
MKESCFKWHCGVVTLRIVSATSSLVVGEVAKVKDDKTFFGHDLGGIGFPGWGGDGGDLGGGAGGGGGGDLEVDLVLVLVVALVGQRLIGHHTSYLIN

SEQ ID NO: 190928 - protein, 75 aa, Glycine max
  Coding DNA Sequence Number=SeqID_74150
MAVSKLRNDAKATWKIPLQLKGSSRCGVSTENNGGEEMTFFQSYLDYKAQNAQVTNVLENGNVAHTPDILSQIPT

SEQ ID NO: 190929 - protein, 118 aa, Glycine max
  Coding DNA Sequence Number=SeqID_74151
MLISMNLKRDPNRVICPQVPAFFIMKNHKCTDKVYTISMQLCSMKHGHHQCTELGRLKILSLPLPSPWMLIIFKPISFPLQGCPTGSLHPPSISGGGSWRSPMIVGGGEGGSRVWREK

SEQ ID NO: 190930 - protein, 711 aa, Glycine max
  Coding DNA Sequence Number=SeqID_74152
  Gene Ontology: Mol. function=DNA topoisomerase (ATP-hydrolyzing) activity; Cellular component=chromosome; Biological process=DNA topological change
  Homolog annotation: Hit_ID=Q1SV94; Match level="QueryCoverage=99%, HitCoverage=99%, E-value=0.0, Identity=77%"; Hit description =Spectrin repeat
  Pfam annotation: Domain name=DUF630; Domain location=1-60; Score =117.2; E_value=4.5e-32; Accession=PF04783.3; Description=Protein of unknown function (DUF630)
  Pfam annotation: Domain name=DUF632; Domain location=253-582; Score =402.6; E_value=5.5e-118; Accession=PF04782.3; Description=Protein of unknown function (DUF632)
  Pfam annotation: Domain name=Extensin_2; Domain location=38-343; Score=-136.5; E_value=0.057; Accession=PF04554.4; Description =Extensin-like region
  Pfam module annotation: Pfam domain module=DUF630::DUF632::Extensin _2; Domain location=1-60::253-582::38-343
MGCAQSRIDNEESVSRCKDRKNLIKDAVVARNAFAAGHSGYAVALKNTGAALSDYAHGETHDPHPPPLDPPSSSADPPPPPPPPIDDSLPPPPPPLPEFSPAPAPLSRSVTMPAGVMHHYRHRSPVPLSIAEEDEEQDATPKLARKTAGSPPPEMKTPPPPPPESKGMAWDYFFMVENMPGRSLSAEDDNDDDDDDDNHIHNHNHNDDGERKMENVVEDEVEPKTPDKVQEHENVSIHEEHDDGISEAKKYIEHSKTAPAEFRRAIKVVPSVTLMQILNVLDDHFLKASEGAQEVTKMLEATRLHYHSNFADNRGHIDHSARVMRVITWNRSFRGVSNGDAAKDDIDSEEYETHATVLDKLLAWEKKLYEEVKQGELMKFEYQRKVAILNKQKKRGASAESLEKTKAAVSHLHTRYIVDMQSMDSTVSEVNHIRDAQLYPKLVALVIEMANMWENMCLHHDSQLKIVTDLKSLDISQAPKETTKHHYDRTVQLEKVILEWHLQFEKLVTQQKHYIKALNSWLKLNLIPIESNLKEKISSPPKAQNPPIQALLHAWHDYVDKLPDELAKSAISSFAAVIKTILLQQEEEMKLKERCEETRKEYLKKKQAFEEWYQKHLMRRGPDEAEHERGEEVNTNNPVSERQFVVESLQKRLEEEIESHQKHCIQVREKSLQSLKTRLPELFRALSDYAHACAEAYEKLKLITQSRGGGA

SEQ ID NO: 190931 - protein, 124 aa, Glycine max
  Coding DNA Sequence Number=SeqID_74153
  Gene Ontology: Mol. function=oxygen transporter activity; Biological process=oxygen transport
  Homolog annotation: Hit_ID=Q6QDC2; Match level="QueryCoverage=96%, HitCoverage=97%, E-value=2e-29, Identity=50%"; Hit description=2-on -2 hemoglobin
MQSLQHKASEWSGVSTADAFTIDEAFKPWLPSLPISTTGCIYDDEEEWFRSIFANSQNQYEFLVQRMGGPTLYSQFSNKRMVTSYGSSIGHYTAYFLVAGVEQQDQNLHTPCKDAALKQHAPPM

SEQ ID NO: 190932 - protein, 42 aa, Glycine max
  Coding DNA Sequence Number=SeqID_74154
MASNGGSRRPPVALGGGKMRKRQTKFEVDPTVYESRIAILLN

SEQ ID NO: 190933 - protein, 54 aa, Glycine max
  Coding DNA Sequence Number=SeqID_74155
MVMKHKSGDAWRMTTTRRVGSRTLVVDEGGIRQHDNTVRGLRSLRGKGGGVGIW

SEQ ID NO: 190934 - protein, 173 aa, Glycine max
  Coding DNA Sequence Number=SeqID_74156
MVGRFAYSIASPSLAIAGGDVCVGQYGLAETSLCFKIGGLSTYNQIIQKMLSNLREAGKHKGPAIQEVQDEVISKPPTKVSYKVNFDTKIKKNIGTGLGMVIRDHKGQIIAAATKFMDMELCPIEAEAFSLRWASILVWELCVHGAIYETNCLDSVKHGITKRTRWEETYFTA

SEQ ID NO: 190935 - protein, 522 aa, Glycine max
  Coding DNA Sequence Number=SeqID_74157
  Gene Ontology: Mol. function=nucleic acid binding
  Homolog annotation: Hit_ID=Q1SZC2; Match level="QueryCoverage=33%, HitCoverage=90%, E-value=9e-51, Identity=57%"; Hit description=Bromo adjacent region
  Pfam annotation: Domain name=BAH; Domain location=38-164; Score=26.8; E_value=7.9e-05; Accession=PF01426.8; Description=BAH domain
MVEAGEEEVIEFKWGTRKGLGGKKKDVQFYESFTYDGVEYSLFDSVFLYKEGEPEHYIGKILKIWENSDKSKKVKILWYFRPSEILNFLEGSETLENELFLASGEGEGLVNVNPLEAISGKCNIVCISKDIRNPYPSDEEVQMAEFVFYRFFDVGMRKILDKIVVDKIAGIEVKNIFNNLDSQKVVGLVKPDLDNKEVSGNFMASNEVVALSSQKKSQPLIEKPDGKCFDTLVRENAASKSLLGEKPTCSIGVKEASKSANALHTISNKKTVPQAKVEEKRGCKDSLVKQKSFAKLSHGLIAGLEMKEITKMDDGSGKGSIEKNILMSRGDSKRDDRKDVGVPIGQIKKGLEEENASKKGKRGGFGKVSSLKKNNNGQNRRLITYDDDNNDDLKTIAPCSSKEKYKVQRAMDSCDVEELPSKKLKIDKKLAKLTSDKLRKESSMISPNVEHKLDFRPMEVTRRPNDFLFSWHFLYLTTSPYDQMNKIELSRQGQPLRLAFGPTMLLVPSLNNDLVGLDLYYN

SEQ ID NO: 190936 - protein, 207 aa, Glycine max
  Coding DNA Sequence Number=SeqID_74158
  Gene Ontology: Mol. function=microtubule motor activity; Cellular component=microtubule associated complex; Biological process =microtubule-based movement
  Homolog annotation: Hit_ID=Q1SGR1; Match level="QueryCoverage=55%, HitCoverage=17%, E-value=4e-48, Identity=72%"; Hit description =Kinesin, motor region; Prefoldin
  Pfam annotation: Domain name=AT_hook; Domain location=66-78; Score =14.9; E_value=0.061; Accession=PF02178.9; Description=AT hook motif
  Pfam annotation: Domain name=Kinesin; Domain location=104-206; Score=- 121.8; E_value=1.2e-06; Accession=PF00225.13; Description=Kinesin motor domain
  Pfam module annotation: Pfam domain module=AT_hook::Kinesin; Domain location=66-78::104-206
MRMLRWMCGKTRQDKIRNEAIRERVGVAPIVEKMVENRLRWFGHVERRPVDSVVRRVDQMERRQIIRGRGRPKKTIREVIKKDLALNDLDRSMELKGNIRVFCRVRPLLADESCSTEGQKHSFTFDKVFTPEASQEEVFVEISQLVPSALDGYKVCIFACGQTGSGKTYTMMGRPGHLEEKGLIPRSLEQIFQTKQSQQPQGWKYEM

SEQ ID NO: 190937 - protein, 71 aa, Glycine max
  Coding DNA Sequence Number=SeqID_74159
MESSNEKMMGKRKVSRRNNEETRSYFTWILKMECALNDVLRDQRNLSNKGDEGWRKSALNVARSVVYKLQC

SEQ ID NO: 190938 - protein, 71 aa, Glycine max
  Coding DNA Sequence Number=SeqID_74160
MVSPQGRNMWTVDDLVPYVEKITILSEEQEIIIEPVAHGPSSERRFHHKSFTCFSQVLKLGVLADEGRLLK

SEQ ID NO: 190939 - protein, 123 aa, Glycine max
  Coding DNA Sequence Number=SeqID_74161
MKRTRKVTRLRSLATKQHGARRLVVNVDLNTGKADGPHKKKLRTYLEIVVRDKVDVTYETWKEVPAAQKDLIWEDIHFKSDLTKKWALAAEQDDVDDIACEKYDISKDKWAQFCETRRDPSWE

SEQ ID NO: 190940 - protein, 176 aa, Glycine max
  Coding DNA Sequence Number=SeqID_74162
MSTTSSTASTENTIQLPTFYHTQWAPNYPEIVHLRYNGAIYEVRVRQRRDKVYLADGLQSFWKDLKIYESTSINFFACDNHSVFYIHFIPPLERQTCGRQRKTIWTLQLTQEMPDHPEPLKLPHCTEVPLRACGNHMTVLRRHGPPLQWKVETLNPAIGGKGVVQPWYDFIQEMDF

SEQ ID NO: 190941 - protein, 84 aa, Glycine max
  Coding DNA Sequence Number=SeqID_74163
MENYKKSMNFILAIYHYSILCSFLMEKTDTELTYFIVVLHPAKKESYTMVESERLSYIRNNQKKLRVYKYSSLQTSLDTGQLKA

SEQ ID NO: 190942 - protein, 43 aa, Glycine max
  Coding DNA Sequence Number=SeqID_74164
MENPSQGASVTLPRRFLEQIHEGFPPFFTVLHPFFIRSSFFNR

SEQ ID NO: 190943 - protein, 81 aa, Glycine max
  Coding DNA Sequence Number=SeqID_74165
MVTKGWSFVGASMENEEERKSNVRERERELLNFLWLIPHVSLRPSRPVFESRQYIYQNAQNKAPSVVQRLVLLNFKSHAKR

SEQ ID NO: 190944 - protein, 155 aa, Glycine max
  Coding DNA Sequence Number=SeqID_74166
MVCIDQADMTGRLLSGCPIDWAHLIRYRMHKALRSSEPLPYPQLVTLFLQHFEIPLNSEPFVQVKRSFAIGVGAVTSFDYHKDMDGQWLKKDVQPPQDERTPSPLPQRDDSSALMHEVFSELRGPHTYVGERFDSLDGCIDVIDARFAGMDTHIT

SEQ ID NO: 190945 - protein, 50 aa, Glycine max
  Coding DNA Sequence Number=SeqID_74167
MVAIIPARIPQPPFSQGYNSNATCAYHGGVLGHSIEHCMTLKHKMSPRTH

SEQ ID NO: 190946 - protein, 107 aa, Glycine max
  Coding DNA Sequence Number=SeqID_74168
MGIFVGHLELLKANCRTIRKGGSSALSPSRPIRKLLEEATSSLGQACYFRLKPPARLGELGGKLLHFSINGHWGERRRGSTPLVFKFHLKLVRKIIKKENIKVEALP

SEQ ID NO: 190947 - protein, 99 aa, Glycine max
  Coding DNA Sequence Number=SeqID_74169
MVGAGLKKDLRVSRVVPGGSLNAFLFLLIGVISQRLAMESIDSLPIGWTVGAMIYFTGEVSAQLVELRSCNWVVAITEDRNMPLKDSTETKTGCQERRG

SEQ ID NO: 190948 - protein, 47 aa, Glycine max
  Coding DNA Sequence Number=SeqID_74170
FCIKKESGRAPELKQRAKREINSLSESSISCQAQRSIGAKPKSTYSR

SEQ ID NO: 190949 - protein, 99 aa, Glycine max
  Coding DNA Sequence Number=SeqID_74171
MASNFQQFSARNDAIVLKGVHDMPTNSSSSVENKKLEGKLDALVNLNNYDLSSNRYNPGWRNLPNLRWANPPQQQQPIPPFQNVAGPSRPYVPPPIQQQ

SEQ ID NO: 190950 - protein, 95 aa, Glycine max
  Coding DNA Sequence Number=SeqID_74172
  Subcellular localization annotation: CTP_CleavageSite=40; ConfidenceScore=5.43e-01
MATDPTSPPQSDGQSEATSKRSRTTTRLRTLTLRTVDQPRPAVYVDPATGRASGPMREKFHSYLGVVAREKVPIIHNNWKDVPETLKDIVWNDIL

SEQ ID NO: 190951 - protein, 130 aa, Glycine max
  Coding DNA Sequence Number=SeqID_74173
MVEAVRRSTLYTNSVSLMCFLGTVISYDFWMSLIADLMLPNSSPPTILPPLDIHWVWFCHTLNPVSYREYCETRFSKLIGKAGIFDEENREYALMRCREIWSSRYSLELFETRRVRIRRIWILWLLLGAI

SEQ ID NO: 190952 - protein, 1153 aa, Glycine max
  Coding DNA Sequence Number=SeqID_74174
  Gene Ontology: Mol. function=zinc ion binding; Cellular component =membrane; Biological process=defense response
  Homolog annotation: Hit_ID=Q9FHX1; Match level="QueryCoverage=94%, HitCoverage=98%, E-value=0.0, Identity=64%"; Hit description=TMV resistance protein-like
  Pfam annotation: Domain name=DZC; Domain location=1094-1129; Score =89.0; E_value=1.4e-23; Accession=PF08381.1; Description=Disease resistancezinc fingerchromo
  Pfam annotation: Domain name=FYVE; Domain location=656-724; Score =48.0; E_value=3.2e-11; Accession=PF01363.12; Description=FYVE zinc finger
  Pfam annotation: Domain name=RCC1; Domain location=330-379; Score =12.3; E_value=0.033; Accession=PF00415.9; Description=Regulator of chromosome condensation (RCC1)
  Pfam annotation: Domain name=RCC1; Domain location=382-434; Score =24.0; E_value=0.00052; Accession=PF00415.9; Description=Regulator of chromosome condensation (RCC1)
  Pfam annotation: Domain name=RCC1; Domain location=437-486; Score =22.0; E_value=0.0021; Accession=PF00415.9; Description=Regulator of chromosome condensation (RCC1)
  Pfam annotation: Domain name=RCC1; Domain location=500-549; Score =9.5; E_value=0.066; Accession=PF00415.9; Description=Regulator of chromosome condensation (RCC1)
  Pfam annotation: Domain name=RCC1; Domain location=552-601; Score =27.4; E_value=4.9e-05; Accession=PF00415.9; Description=Regulator of chromosome condensation (RCC1)
  Pfam annotation: Domain name=RCC1; Domain location=606-653; Score =19.9; E_value=0.005; Accession=PF00415.9; Description=Regulator of chromosome condensation (RCC1)
  Pfam module annotation: Pfam domain module=DZC::FYVE::RCC1::RCC1::RCC1 ::RCC1::RCC1::RCC1; Domain location=1094-1129::656-724::330-379::382 -434::437-486::500-549::552-601::606-653
MADLVSYRNADRDIDQVYFSPFWNVMIVIRGGNRAGLSVFEWNGLMGREALIALKKGAQLLKYGRKGKPKFCPFRLSNDELSLIWISSSGERNLKLSSVSRIIPGQRTAVFQRYLCPEKDYLSFSLIYNNGKRSLDLICKDKVEAEVWIAGLKALISSGQGGRSKIDGWSDGGLYLDDSRDLTSNSPSESSASVSRDISSPDVSVSLANTSPQSFYFESTLNIERSHAPSNPSNMQVKGSSSDVFRVSVSSAPSTSSHGSAPDDYDALGDVYIWGEVICENVVKVGAEKSASYFSPRTDILLPRPLESNVVLDVLQIACGVKHAALVTRQGELFTWGEESGGRLGHGVGKNVIQPRLVEAMASTTVDFVACGEFHTCAVTMAGELYTWGDGTHNAGLLGHGTDVSHWIPKRIAGPLEGLQVALVTCGPWHTALITSTGQLFTFGDGTFGVLGHGDRENVSYPREVESLSGLRTIAVACGVWHTAAVVEVIVTQSSASVSSDKLFTWGDGDKNRLGHGDKDARLEPTCVSLLIDSNFHRIACGHSLTVGLTTSGEVFTMGSSVYGQLGNPQSDGKVPCLVKDKLAGESVEEIACGAYHVAVLTSKNEVYTWGKGANGRLGHGDVEDRKTPTLVEALKDRHVKYIACGSNYSAAICLHKWVSGAEQSQCSACRQAFGFTRKRHNCYNCGLVHCHSCSSRKALRASLAPNPGKPYRVCDSCFVKLIKVAESGNNNRRNAMPRLSGENKDRLEKSELRLTKTAVPSNMDLIKQLDSKAAAKQGKKADTFSLVRTSQPQSLLQLKDVVLSTAIDLKRTAPRPVLTPSGVSSRSVSPFSRRPSPPRSATPIPTTSGLSFSKSITDSLKKTNELLNQEVLKLRGQVETLRQRCELQELELQRSTKKTQEAMALAAEESAKSKAAKEVIKSLTAQLKDLAERLPPGAYDAENIRPAYLPNGLEPNGIHYPELNGERHTRAESISGSSLASIGLESSLLNRTEGTLPGSYGANLYLQNRGSVTSNGTDDYPNVKLPNGSSMIQPSSSTVSDMVDGRDSGDFQDDESGLRSRNTIVPANSNQVEAEWIEQYEPGVYITLVALGDGTRDLKRVRFSRRRFGEHQAETWWSENRDRVYERYNVRSTDKSSGQAARRTEGAGSPVL

SEQ ID NO: 190953 - protein, 248 aa, Glycine max
  Coding DNA Sequence Number=SeqID_74175
  Gene Ontology: Mol. function=nucleic acid binding
  Homolog annotation: Hit_ID=Q8H0P8; Match level="QueryCoverage=79%, HitCoverage=83%, E-value=1e-61, Identity=58%"; Hit description=RNA -binding protein
MSPSGLTSGGNEMHNYIARNDDHTGHRILKDTKTLGSAYDRYLQSAGQLTSFNSGEASAISSVGLGRGVGGLPHHSLTDPAVTGHPGGGHDLSRNGRNVNYASQLPVDAASMPGPETLPLPPDASSTLYVEGLPSGSTRRERGGDPLILCFVDFANPACAATALSALQGYKVDELNPESSHLRLQFSRFPGPRSGPGLRGKSVDVDYDEDDDDGDDNDESNKMVTTIVTMIMVMMVGEDGDPIINPNS

SEQ ID NO: 190954 - protein, 195 aa, Glycine max
  Coding DNA Sequence Number=SeqID_74176
MALRRCNSGLHNPLSAILAHITASAIWAMALCMAITTWRFTVGMADVVFAVRRDPLTVDVTVNSTRQQATCDAIGESPSKQKGLQGNTTVELPSKPHYKPPEVGAILLLVQFLNAEENPSLHVNTVTTNGGVHGSDAGGGADDSRGGGVREGKEEGEWCCSEKGLKSDCSQFMAKHKGLKSTLLPWLLPQLADVS

SEQ ID NO: 190955 - protein, 250 aa, Glycine max
  Coding DNA Sequence Number=SeqID_74177
  Gene Ontology: Mol. function=nucleic acid binding
  Homolog annotation: Hit_ID=Q8H0P8; Match level="QueryCoverage=81%, HitCoverage=78%, E-value=2e-46, Identity=51%"; Hit description=RNA -binding protein
MSPSGLTSGGNEMHNYIARNDDHTGHRMLKDTKTIGSAYDRYLQSAGLTSFNSGEASAVGGVGLGRGAGGLPHHSLTDPAVMGHPGGGHDHARNGRNVNYGGQLPLDAASMPGPETVPLPPDASNIFRPFVGYREVRLVSKESKHRGGDPLILCFVDFANPACAATALSALQAVLVIITGNVFLFSAGYKVDELNPESSHLRLQFSRFPGPRSGPGPRGKRIMAEAQYSNAIGYSRVVYRRFWILSYKCF

SEQ ID NO: 190956 - protein, 161 aa, Glycine max
  Coding DNA Sequence Number=SeqID_74178
  Gene Ontology: Mol. function=ubiquitin-protein ligase activity; Cellular component=ubiquitin ligase complex; Biological process =protein ubiquitination
  Homolog annotation: Hit_ID=Q2HVY1; Match level="QueryCoverage=90%, HitCoverage=36%, E-value=2e-59, Identity=75%"; Hit description=U box
  Pfam annotation: Domain name=U-box; Domain location=5-80; Score=52.1; E_value=1.8e-12; Accession=PF04564.6; Description=U-box domain
MDEIEILAHFLCPISLQLMRDLVTVCTGITYDRENIERWLFSCKNNTCPVTKQCLLDHGLTPNHTLRRLIQSWCTLNASLGVERIPTPKSPIGKTEIVKLLTEAKGFPEKQLKCLTRLRSVAFEGQRNKTCLESVGVIEFLATTMNISAPILWGKDLVHMG

SEQ ID NO: 190957 - protein, 93 aa, Glycine max
  Coding DNA Sequence Number=SeqID_74179
MLGAPGPLRLPNCAMIHVNACGQHMTILRRFGPPLQWNVVVVDGGVGRKYVVQPWYQFLADNDFSHSDEVSFYYRSIDKIWEIVIRRRKNWDY

SEQ ID NO: 190958 - protein, 92 aa, Glycine max
  Coding DNA Sequence Number=SeqID_74180
MRKFGDDKSWIQLINFSYLHLNIRPYEEKSMILPLCMSNNRDFFMLKFTRNADDEYQTILYNQRDGSFRTLLWCNFKIFTKTLVISNALSDV

SEQ ID NO: 190959 - protein, 370 aa, Glycine max
  Coding DNA Sequence Number=SeqID_74181
  Homolog annotation: Hit_ID=Q1RUD8; Match level="QueryCoverage=58%, HitCoverage=42%, E-value=8e-26, Identity=35%"; Hit description=IMP dehydrogenase/GMP reductase
MDVLALLIFGVVLFPNVDGLVDLAAIDAFLAYHHSKESPMAAVLADLFDTFDRRCEKSSARIICCLPALCVWLVSHLFQQDTRHPCPLQSHRSCTEKRRIDWDQFLTGIGGRTINWFPRWKEGKEGVLFSCGGYPNIPLIGTRGCINYNPALAIRQLGYPMRGAPMEESMSPFLVKDFGAQNFKAIQRIHKAWETPLRKDQELRGIRNGTIGGYHEWLKVHIRGLDWLAKLKVVSEESFEAPEEDEEVQAFKSELGKAKLAKEKFKLAATHIRKECAGLREENATTARALEQETKRARKEEYGRNKFRGALWGSNNELKLRREERDQSQAHSMVLKEELVACSRSKRSLSQRLCETETNMLAIIAKYKKS

SEQ ID NO: 190960 - protein, 128 aa, Glycine max
  Coding DNA Sequence Number=SeqID_74182
MMRILLIGQGSKKSKVVFQWGLLSWEPNLDIWGKTNLGVKVSVSGLTPILLHKARVTMMISKQRAKLVMATARWALKHPVYGIVILWLGIYTNRPNVSKLCSFISSMNSSILISVIPENKLLSSVPCF

SEQ ID NO: 190961 - protein, 39 aa, Glycine max
  Coding DNA Sequence Number=SeqID_74183
MAGVVRDGKPMLHSRVMGHATLPPFSCYSCQNVRPPSAR

SEQ ID NO: 190962 - protein, 147 aa, Glycine max
  Coding DNA Sequence Number=SeqID_74184
  Homolog annotation: Hit_ID=Q1SMF0; Match level="QueryCoverage=88%, HitCoverage=32%, E-value=7e-14, Identity=29%"; Hit description =Tetratricopeptide-like helical
MNVKNEEDVDVKVDCSDSFNTSKLFGSRDEVLQWARSLAHDIGFVAVIMRSYTNIGVRGKVSFLLIACERSGEYRPKKYNLVRTCTGRLTKDEKIVVADMTKSMVKQKNILLTLKEHNDNSYTTIKQIYNARHAYRSSIRGSNTELQ

SEQ ID NO: 190963 - protein, 180 aa, Glycine max
  Coding DNA Sequence Number=SeqID_74185
  Gene Ontology: Mol. function=nucleic acid binding; Biological process= DNA integration
MEEMRATKNILNIEIKKDGVQKKLFPFNTTQSKSEKEYMAHVTYGSVVGSLMYARVCTKQDLAQAVSVVSRFGCKEIYDWVHIHDWNLFCQLEGNSRVHGSGKSSKGKDLTESLSAIYLVKDQFHHERTKHIDIRYHLIHFEKRVEVHKVDTSENLIEMFTMPVPRSKFMQYLNLLNIDY

SEQ ID NO: 190964 - protein, 112 aa, Glycine max
  Coding DNA Sequence Number=SeqID_74186
  Homolog annotation: Hit_ID=Q1SPB9; Match level="QueryCoverage=81%, HitCoverage=15%, E-value=1e-10, Identity=41%"; Hit description =Transposase
MTKHQRSTERDPSYYVKDDSNYGYRAIVVLLGMGEDSWSLVRNHLLKELVKWSNEYVNLFVGIDRFKELKRSLLVDGLSMITMDKWMDITDMGYVIASRYNVILLSLSCNKV

SEQ ID NO: 190965 - protein, 129 aa, Glycine max
  Coding DNA Sequence Number=SeqID_74187
MQGYFKGSLRKDKELKGSSNGIISRYHKWLKARMQELDCLPKLKTSSEEEAETPEESEEVQALKVELERAQTVKEKFKMTTIKPKHWNGKQRGSERKNEVETSFEGLRGAATASLSFGGPRETSRESKA

SEQ ID NO: 190966 - protein, 88 aa, Glycine max
  Coding DNA Sequence Number=SeqID_74188
MYSYIHTKVSVLQVEREARERVIASLHREAMMWMDRFAFTLNGSQKLPRLLNKAKVIANMYSAPEEVHRLLNYCPLMIDLMAHIIRNR

SEQ ID NO: 190967 - protein, 131 aa, Glycine max
  Coding DNA Sequence Number=SeqID_74189
VDSRGSHLQPRENEPVDAQRLTSSSAPSVVLTRESGDMRGYLMVTRTFRQPGANRPVDTQRLTSSYAPFVVLTREVRCHAGLPYGYPQVTCGVTLWLPAPFAIQGQRVRNIQARRRARFFSAGQGRSSAMA

SEQ ID NO: 190968 - protein, 35 aa, Glycine max
  Coding DNA Sequence Number=SeqID_74190
MTFVDNWAVGKEKEQWGLDMRVRLIKEEKSITGRL

SEQ ID NO: 190969 - protein, 80 aa, Glycine max
  Coding DNA Sequence Number=SeqID_74191
MMIWEQRAKFVMATTRWVLKHPIYGIVILRLGIYTSRPNVSKLCSFIGSMNPSILISDDVPKGKPYKVPEFQQTLSTITK

SEQ ID NO: 190970 - protein, 377 aa, Glycine max
  Coding DNA Sequence Number=SeqID_74192
  Gene Ontology: Mol. function=3-oxoacyl-[acyl-carrier-protein] synthase activity; Cellular component=mitochondrion; Biological process=fatty acid biosynthetic process
  Homolog annotation: Hit_ID=P0A953; Match level="QueryCoverage=76%, HitCoverage=71%, E-value=1e-141, Identity=86%"; Hit description=3 -oxoacyl-[acyl-carrier-protein] synthase 1
  Pfam annotation: Domain name=Ketoacyl-synt_C; Domain location=141 -249; Score=156.6; E_value=6.6e-44; Accession=PF02801.12; Description= Beta-ketoacyl synthase, C-terminal do
  Pfam annotation: Domain name=ketoacyl-synt; Domain location=3-133; Score=-1.1; E_value=1.4e-07; Accession=PF00109.16; Description=Beta -ketoacyl synthase, N-terminal domain
  Pfam module annotation: Pfam domain module=Ketoacyl-synt_C::ketoacyl -synt; Domain location=141-249::3-133
VFGADAMRGPRGLKGVGPYVVTKAMASGVSACLATPFKIHGVNYSISSACATSAHCIGNAVEQIQLGKQDVVFAGGGEELSWEMACEFDAMGALSTKYNETPEKASRTYDASRDGFVIAGGGGMVVVEELEHALARGAHIYAEIVGYGATSDGADMVAPSGEGAVRCMKMAMQGLDTPIDYLNTHGTSTPVGDVKELGAIREVFGDNTPYISATKAMTGHSLGAAGVQEAIYTLLMLEHSFIAPSINVEQLDDAAKGMNIVTQPTEKALTTVMSNSFGFGGTNATLTLRKYQALPAALPASRRRGQFRRASTPQSRVSSPAVAMRRRKGVTAAAAADRLPAPATAADAVPAAPAADRAGYDRADASAAGGWRNSLAG

SEQ ID NO: 190971 - protein, 60 aa, Glycine max
  Coding DNA Sequence Number=SeqID_74193
MDELINKTQLSPKIIPTSSRRLSGSTKESHFSYSTTVILLPRTKVRDHHRYQPHDTKIVR

SEQ ID NO: 190972 - protein, 91 aa, Glycine max
  Coding DNA Sequence Number=SeqID_74194
MNCVFVHASSTHEFGAMRSDCLVQFSILYPFSESYELRFRSCILHQRVLSHASRLTGEDPLVQSSMLAFYSEPHELRFRSCILHPRVWSHA

SEQ ID NO: 190973 - protein, 209 aa, Glycine max
  Coding DNA Sequence Number=SeqID_74195
  Gene Ontology: Mol. function=kinase activity; Cellular component =intracellular; Biological process=regulation of transcription, DNA -dependent
  Homolog annotation: Hit_ID=Q11UG9; Match level="QueryCoverage=75%, HitCoverage=91%, E-value=1e-29, Identity=44%"; Hit description =Cyclic nucleotide binding regulatory protein
  Pfam annotation: Domain name=cNMP_binding; Domain location=52-142; Score=44.7; E_value=3.2e-10; Accession=PF00027.19; Description =Cyclic nucleotide-binding domain
MISNLRGTVKAVIQAKLIIKGEEKPAYTGDLHSMKDHELHQLTDLLFKSGKEEKYGPKSVIIEEGTVSRKFYYLKKGILRGWTNYDGKEVTFQFLFENHIFCCSESFFYHQPSSYTVETIEACSLLSVEKTDIDTLSEDITFVNLFNKYLISRVNDYQQLLISQIREKPEMRYKKLLEENPEIILRIPQHLIASYLGMTPVSLSRIRNR

SEQ ID NO: 190974 - protein, 156 aa, Glycine max
  Coding DNA Sequence Number=SeqID_74196
MHKVLLLLVFLNLVNIPVIRNDDPVSLYKTGDDPAWAPKNYNDKNWSRVRGDTSDKIFWSRTRLDLRQVEPELTPLGLQIESFGAFEVYWDGVFIGNNGQLPQNGKPEIPGSESSYYRVPDSLISPGSHIVALRTSQSLLPHFNFKRGKWLMAALL

SEQ ID NO: 190975 - protein, 133 aa, Glycine max
  Coding DNA Sequence Number=SeqID_74197
MKNGEKRRKIFTDLLMETSRKRYPRGLRTLWNSLPSPIYRKRGEEVAAQLAQVSWVAFSLSNQASRRPSMITVESPTVATYPSAGGRRETRGMRVPRKEYAWSRHQRLFEENVGKSGKDVIYELLSERFESCI

SEQ ID NO: 190976 - protein, 92 aa, Glycine max
  Coding DNA Sequence Number=SeqID_74198
RKDVDVRKHNLPPPIPEDHMRLGIFGLKHNLPTPSPPPQRDSSSSLLNDVLTELSCHHQNDGECDCICCIKVLMMPKIEAIQSLLQVQDKIK

SEQ ID NO: 190977 - protein, 192 aa, Glycine max
  Coding DNA Sequence Number=SeqID_74199
  Gene Ontology: Mol. function=sequence-specific DNA binding; Cellular component=nucleus; Biological process=regulation of transcription, DNA-dependent
  Homolog annotation: Hit_ID=Q9SHB5; Match level="QueryCoverage=83%, HitCoverage=52%, E-value=2e-17, Identity=37%"; Hit description=WRKY transcription factor 55
  Pfam annotation: Domain name=WRKY; Domain location=141-180; Score =12.8; E_value=2e-05; Accession=PF03106.6; Description=WRKY DNA -binding domain
MLSLSIDQITEAFSGAKEKMLLFSRQNQTSDESPPTLVHETTTQQSQMDASLMQEWLRSSHALTMDQLFQMHQFHAARSTLQQIGEMGGKDGEDSERNKGSEGEVQGIHASPSRPRKREANQEKRKVMVPAPQFGNTEVPPEDGYTWRKYGQKEILGSKYPRKVGNTPEVYNSSPQSHVMNNKWLRHFSGMQ

SEQ ID NO: 190978 - protein, 201 aa, Glycine max
  Coding DNA Sequence Number=SeqID_74200
  Gene Ontology: Cellular component=integral to membrane
  Homolog annotation: Hit_ID=Q6D905; Match level="QueryCoverage=82%, HitCoverage=80%, E-value=3e-19, Identity=35%"; Hit description =Putative membrane protein
MALPPALAWLDIHWLGNAVGEWSLVELTQEGFLVASVAAFVRLALRRADDRAFAVLAAAVFACMLLREMDEALDLIAHGFWKYPVGVLIIGSLAWASRDWRRAMQALVRFLVSRPGTVMTIGLVLLLFYSRLIGMTSLWTGLLGDQYIRVFKNTIEETTELLGYTFILAASVGYVAHRVREPLTARKRTVHEDAGMQQRPL

SEQ ID NO: 190979 - protein, 74 aa, Glycine max
  Coding DNA Sequence Number=SeqID_74201
MFGTGWCAVVGRAGFASTVVLAAAAVAVLLSISHFIPSMASIIEFICSFKANMSAFIYSCTSSRSPIILDLDLV

SEQ ID NO: 190980 - protein, 121 aa, Glycine max
  Coding DNA Sequence Number=SeqID_74202
MTATPIRGITEVLTRTVYHPTTHHQPCMKTWVTLLPSSSKGSLLGILMGSTRILESMLRETPTPTPRFPLRGWRPRTTSTQRHGRASKPPNAANVFVRGRASPGSGRKGETRSHRREIEGC

SEQ ID NO: 190981 - protein, 109 aa, Glycine max
  Coding DNA Sequence Number=SeqID_74203
MCMDSLSHSPFRDLGNRSLNQKVISRVGCRVQNAMSTLEPSGHWQMVVILPKENLVVWFCSLHNRPDNYLKGIISSALKGLDDTPQPKSKAGARWIVVKYFNDVRPLEA

SEQ ID NO: 190982 - protein, 168 aa, Glycine max
  Coding DNA Sequence Number=SeqID_74204
  Gene Ontology: Mol. function=transcription factor activity; Biological process=regulation of transcription, DNA-dependent
  Homolog annotation: Hit_ID=Q9I461; Match level="QueryCoverage=94%, HitCoverage=96%, E-value=3e-52, Identity=59%"; Hit description =Probable transcriptional regulator
  Pfam annotation: Domain name=TetR_N; Domain location=12-54; Score =19.9; E_value=0.0017; Accession=PF00440.13; Description=Bacterial regulatory proteins, tetR family
MGRQRSIDRDKVLDIAEEIVATQGAAGLTIDAVAKAMGISKGGVHAYETLFTAIAGDDPSPQTAVRAHMLATHSSDQTASAKAAGLMATLIQTPEHLASTREWYRSRIAGLDLTTEEGKRARLAFLATEGAFMLRYFGLMDIDQAEWETMFTDMQALILTEDAYRTDS

SEQ ID NO: 190983 - protein, 85 aa, Glycine max
  Coding DNA Sequence Number=SeqID_74205
  Gene Ontology: Mol. function=tetracycline:hydrogen antiporter activity; Cellular component=integral to membrane; Biological process=tetracycline transport
  Homolog annotation: Hit_ID=Q2AAU2; Match level="QueryCoverage=94%, HitCoverage=16%, E-value=1e-37, Identity=100%"; Hit description =Multidrug efflux pump SmfY
MVASALFLIVIDMTVLYTALPRLTQALDASASQKLWIVNAYPLVVAGLLPGAGMLSDRIGHKRLFLAGLPVFAVASLCAAFYGIL

SEQ ID NO: 190984 - protein, 244 aa, Glycine max
  Coding DNA Sequence Number=SeqID_74206
  Gene Ontology: Mol. function=sugar porter activity; Cellular component=periplasmic space; Biological process=transport
  Homolog annotation: Hit_ID=Q2NVD6; Match level="QueryCoverage=99%, HitCoverage=72%, E-value=1e-107, Identity=80%"; Hit description =Sugar ABC transporter periplasmic component
MDFEANIDIVTNANEAKIPVVVTNARLNTDAMTSEVVSNDELGGYLEAKAVLDKLDCKNHKVNVVIIEGPKGGSGEIQRGKGNDKAIAECGAGQVTVLERKTANWSRAEAQPLMENWLQKHRGKINGVIGQNDEMALGAIEAIKGAGLNVKDFAIAGVDGVSDAIHAVQAGEMVSILQDAKGQMQGSIDVALRAVKGESYQPQSDIWKQYAKDLKWEGGTQKHYYIPWTVVTAENAQSLLDARK

SEQ ID NO: 190985 - protein, 121 aa, Glycine max
  Coding DNA Sequence Number=SeqID_74207
MSKNEMKLPGVVIMVMLVIGFAEADFNSTFVQIESNRVSSKPRLTCGPKCELSCLPYVLAFILYPICVAACMKQCRQTPIDTIYSCLSGCDAVKSLPDNNEGRGRAAYVVDSCLQQCEDKK

SEQ ID NO: 190986 - protein, 121 aa, Glycine max
  Coding DNA Sequence Number=SeqID_74208
MSKNEMKLTGVVIMVMLVIGFAEADFNSAFVQIESNRVSSKPRLTCGPKCELSCLPYVLAFILYPICVAACMKQCRQTPIDTIYSCLSGCDAVKSLPDNNEGRGRAAYVVDSCLQQCEDKK

SEQ ID NO: 190987 - protein, 229 aa, Glycine max
  Coding DNA Sequence Number=SeqID_74209
  Gene Ontology: Mol. function=DNA binding; Cellular component=nucleus; Biological process=regulation of transcription, DNA-dependent
  Homolog annotation: Hit_ID=Q8S8I2; Match level="QueryCoverage=72%, HitCoverage=70%, E-value=2e-35, Identity=46%"; Hit description =Protein ULTRAPETALA2
DPPKQKRSQGNEKKTEDDNITQGPSKRRKQFRVGDDGKILFDEEELKMILDFKRGEDYIEVLCGATNKKYGDYVGRLKINNEGQYFITCECCLECPLVSVTLEAFEKHALREGSGRWKRNIWVHCEDEDKVPLWKTPLIKYYLHQANVANRKDSAMRKQNFHRDEFLRCTRCGKERRFHLQSRPDIKNYHDALKHKCWICSLWPYQNWYLVLQNTFYAGKRYWGLTMCQ

SEQ ID NO: 190988 - protein, 146 aa, Glycine max
  Coding DNA Sequence Number=SeqID_74210
MLMCNDQYSCVGPIELLCTIIRTPDAILNLLQSTITPTHDAIMYYNGKWNIPRQGEFLGYSFSGTNPIRFGIPSGCGMEKLKDLIKQVAPTGVPPNGIHISQLVRRLFFRQPGHSKYSENLIEYDITELKNDEDVLKVLAQSNYWK

SEQ ID NO: 190989 - protein, 104 aa, Glycine max
  Coding DNA Sequence Number=SeqID_74211
  Gene Ontology: Mol. function=DNA photolyase activity; Cellular component=mitochondrion; Biological process=DNA repair
  Homolog annotation: Hit_ID=Q1RUS6; Match level="QueryCoverage=85%, HitCoverage=22%, E-value=5e-23, Identity=54%"; Hit description =Deoxyribodipyrimidine photolyase, class 1
MYNFLKSPKKHVIQRLGELCQHRLELPNSHDEIEAARLEVAAEVGDRVDKEGGAIGANLVEAENGEDGEGVIVGNSEALIVEEAEVVMKPDKGGTTALEGSRGQ

SEQ ID NO: 190990 - protein, 255 aa, Glycine max
  Coding DNA Sequence Number=SeqID_74212
  Gene Ontology: Mol. function=transposase activity; Cellular component= intracellular; Biological process=transposition, DNA-mediated
  Homolog annotation: Hit_ID=Q2NWF7; Match level="QueryCoverage=99%, HitCoverage=76%, E-value=3e-84, Identity=65%"; Hit description =Transposase
  Pfam annotation: Domain name=Transposase_20; Domain location=138-222; Score=81.8; E_value=2.2e-21; Accession=PF02371.7; Description =Transposase IS116IS110IS902 family
  Pfam annotation: Domain name=Transposase_9; Domain location=15-111; Score=46.4; E_value=9.7e-11; Accession=PF01548.8; Description =Transposase
  Pfam module annotation: Pfam domain module=Transposase_20::Transposase _9; Domain location=138-222::15-111
MEATGAYSEPLATFLHDEGYDVSVENPARIRRFGQAELSRNKTDKDDARMIARYCKLHGPSLWQPAPLNERRLKALVKRLTNLQEMRQMEENRLEVSDAVVQPSIRVVIAALDAQIDETKRAINDHIDNDPGLKKNRELLESIPGIAGVLSSTMLAYLGDMSRFSSSKALVAWVGLNPMRQESGEWKGKSRISKMGNSAMRKALYMPAIVAMKWNPAVSALKKRLDAGKKTGKVVVCAAMKKLLQLAYGVLKSGR

SEQ ID NO: 190991 - protein, 221 aa, Glycine max
  Coding DNA Sequence Number=SeqID_74213
MDIIGEHVIMDSRTINNVDNATAEPETTVASTNILHVAPNVGSVASTLHEGGLVAVVAVNIGPSQKTKSSASSSSSAKGKGPVGTTKANKGTKTPTNATPLRVVRKTRFKSRVTEKTEEMLGFMVPLVEKMLNMNGALELTICPFLFVCKKRWKIPKSSKGRAGFVRRAPRWNKLVVPSGTSDKIGTIQRRLAWPLRKDDTHKSRNGPNFFSISNFSDYSS

SEQ ID NO: 190992 - protein, 162 aa, Glycine max
  Coding DNA Sequence Number=SeqID_74214
MDFSVVFHHRGYPKDKFKLWWKHSHMDFEQGLKLISDDIQAMELENYALSTNEEVHIYVDHIPIPITDVGIINPLLWINNGMAVVDDGVQINVHVVGDDHVGDEINVEEVLHGQRWLVLKLYMVDTVTLKVVMKMKILYVFKLRRIVCRLAWTMRMSRILLM

SEQ ID NO: 190993 - protein, 446 aa, Glycine max
  Coding DNA Sequence Number=SeqID_74215
  Gene Ontology: Mol. function=helicase activity; Cellular component =mitochondrion; Biological process=protein amino acid phosphorylation
  Homolog annotation: Hit_ID=Q1PFC5; Match level="QueryCoverage=94%, HitCoverage=93%, E-value=1e-140, Identity=57%"; Hit description =Pentatricopeptide repeat-containing protein
  Pfam annotation: Domain name=PPR; Domain location=164-198; Score =24.6; E_value=0.00034; Accession=PF01535.11; Description=PPR repeat
  Pfam annotation: Domain name=PPR; Domain location=199-233; Score =32.7; E_value=1.3e-06; Accession=PF01535.11; Description=PPR repeat
  Pfam annotation: Domain name=PPR; Domain location=236-270; Score=1.6; E_value=4.8; Accession=PF01535.11; Description=PPR repeat
  Pfam annotation: Domain name=PPR; Domain location=282-316; Score =57.6; E_value=4.2e-14; Accession=PF01535.11; Description=PPR repeat
  Pfam annotation: Domain name=PPR; Domain location=317-351; Score =24.4; E_value=0.00041; Accession=PF01535.11; Description=PPR repeat
  Pfam annotation: Domain name=PPR; Domain location=353-387; Score =27.8; E_value=3.9e-05; Accession=PF01535.11; Description=PPR repeat
  Pfam module annotation: Pfam domain module=PPR::PPR::PPR::PPR::PPR::PP R; Domain location=164-198::199-233::236-270::282-316::317-351::353 -387
MIRTNSLRHFHKHLASQTLVLVIKDLPFDAHPPPPSPSPPPWTNDAVTEVLRLISRYTLQSPRSIGRQHTFRHRTPLRQRNLNLEHHKLRSNTLLLGPAAHLDPRKAHHLGPLKALEFFRWVEARFNFPHSEPTCRELACLLGRANALKPLWHFLKHSPHVTTATVTCLIKLLGEQALADEALLTFHRMKQFHCKPDTHSYNTLIHALCRVGKFTKARSLLQQMELPGFRCPPDTFTYTILISSYCRHGILTGCRKARRRRIYEAGRLFRLMLFRKLVPDVVTYNALIDGCCKTLRVERALELFDDMKRRGLVPNRVTYGCFIRYYCVVNEIDKGVEMLREMQRLGHGVPGSSSYTPIIHALCEAGRVVEAWWFLVELVEGGSVPREYTYGLVCDRLRAAGEGGLLEDHDGVHKRIKDGIWNRYRQMMKVKPVMARKGYPEMEEPV

SEQ ID NO: 190994 - protein, 142 aa, Glycine max
  Coding DNA Sequence Number=SeqID_74216
  Gene Ontology: Mol. function=nucleic acid binding
MGCKTIGRPIEVKSKDDYNTACKTTFKQACRPFIGVDGCHLKYLFGGQLLVAIGRDPNEQNLPIVFMLLRVEAETKDTWRWFLTLLFEDIGSPTLVPWVIMSYVKHLYQNFKNFFGGGTMMRDLKIGASKAAYEVAWVEKME

SEQ ID NO: 190995 - protein, 233 aa, Glycine max
  Coding DNA Sequence Number=SeqID_74217
  Gene Ontology: Mol. function=RNA-directed DNA polymerase activity; Cellular component=chromatin; Biological process=chromatin assembly or disassembly
  Pfam annotation: Domain name=RVP_2; Domain location=118-232; Score= -59.3; E_value=0.042; Accession=PF08284.2; Description=Retroviral aspartyl protease
MAARFGTKIVPFGSVGEEDSSEAHSTLNGKLESILECLSMLSLPPSPPTLVPQPVMHHPHLKLEVSRFDGQDPFGWIFKIFQFFDYQGVPKPERLTVESRRHYTLSPFQATATYVTIVMNSGAVLSLNALVGMPTSETMRLFGTINNHQVLIFVDSGSTHNFIQSRIAKFLALQSTLTPPVKVLVGNDTTMDYDTSCPQIPVLIQGHRFMVDFFALPHSGTDVVLGVQWLCEL

SEQ ID NO: 190996 - protein, 138 aa, Glycine max
  Coding DNA Sequence Number=SeqID_74218
  Homolog annotation: Hit_ID=Q1SPB9; Match level="QueryCoverage=77%, HitCoverage=24%, E-value=1e-09, Identity=40%"; Hit description =Transposase
MLRSMSVYIKLAKTLLVVDVSKELLTVFHVHGLFKPQVTIIKEMETISKRCEELDVCGKVTLKSKLWEIAYPDLKSMCPPPKKVNTKDAQNKPMIKHQRSTKCDPYYWEYVDALHFVQNSNSSVVHHLLTRTFQEGLC

SEQ ID NO: 190997 - protein, 43 aa, Glycine max
  Coding DNA Sequence Number=SeqID_74219
MRSDIYVFGIVLLELITGHRACDDTHGPEKHLDDWVCWYCRKE

SEQ ID NO: 190998 - protein, 194 aa, Glycine max
  Coding DNA Sequence Number=SeqID_74220
  Gene Ontology: Mol. function=nucleic acid binding; Biological process= DNA integration
RTTKLEETLTQFMQVTMSNHKSTESALNNLEVQAEDEDSVVHKKKIADKKGTDCKRNKVRGVEVPYLVVPSKKEKDHHLARFLDIFRKLEITMPFGEALQQMPLYSKFLKDMLTRKHKYINQENIIVEGNCSAVLQKILPPKHKDPGSVTIPCPIREVNVGKSLIDLGANDATLHVQKIGRVGNNGHSNDFTIS

SEQ ID NO: 190999 - protein, 121 aa, Glycine max
  Coding DNA Sequence Number=SeqID_74221
  Homolog annotation: Hit_ID=Q1SYE9; Match level="QueryCoverage=32%, HitCoverage=5%, E-value=5e-07, Identity=57%"; Hit description =Esterase/lipase/thioesterase; Phospholipid/glycerol acyltransferase
  Subcellular localization annotation: CTP_CleavageSite=45; ConfidenceScore=5.59e-01
MAAAGACLFSAALFRREPPSPAGKPSSHRISSTTPRLAVSVDRVPASTAAVESGEGNGAVVREKRMEEKEEKENRRMNGWKEYLEQSKELIEPDGGPPRWFSPLECASRLDYSPLLLFLPV

SEQ ID NO: 191000 - protein, 170 aa, Glycine max
  Coding DNA Sequence Number=SeqID_74222
MAHRQIMVILRLLSSRGGEPDDMRRQIMVIPLTFSPSRPDRVQWRAEKNYGHSAPFHPGSIMFDGTQRQIMVILCLLSSRGGGPDDMRRQIMVIPLTFFAIQTQSCPMTHGDKLWSFCALCHSGAASRVINAQRQIIVILRPLSFRSSKSSDKRTETNYGHSAPFVIQGQ

SEQ ID NO: 191001 - protein, 171 aa, Glycine max
  Coding DNA Sequence Number=SeqID_74223
MPFRGLINARKRTTLSVFSGKRDELAKRACCAKRVHQYSLYMSSRKRKSIGARPTTQYDTRRFHSFEAWTRYTDNVLGRHILVERKVELERRNFHKRLTNFAGSSIDLALVKEFYANLYSPEGPSPKQVKIQGHLIKIDADSLNTFLETPVVLAEGESLPAYCRYCLQDAH

SEQ ID NO: 191002 - protein, 299 aa, Glycine max
  Coding DNA Sequence Number=SeqID_74224
  Homolog annotation: Hit_ID=Q1T493; Match level="QueryCoverage=92%, HitCoverage=50%, E-value=1e-33, Identity=29%"; Hit description =Nucleic acid-binding, OB-fold, subgroup
  Pfam annotation: Domain name=Rep_fac-A_C; Domain location=155-288; Score=-57.9; E_value=0.012; Accession=PF08646.1; Description =Replication factor-A C terminal domain
EVVFRQVSGKGRRVVFKLKDLSQQLLSCTLWDDYCLQFLKFLDDYEGDDPIIVLLSHCRIKEAQGSYPASINNSFKASKLIINQPVMELQEFNERYFLLVELGIEARSGFKSHGEGSTQLSGSIQLSSKESFFGKTEAKTIADINTISEEIVCVTVGTITRIVLDNHSWCYIACIQCHKKSDAEMGPFTCACGKYNKEAVLRYRLEVMINQGNESTKFLLWDRECSELIGQSADAVNKLKIEDGDVDLNASPQSLDKLLGHELAFKIKVQPKFRNSAVLKCSADSSLINVVMDMLADAE

SEQ ID NO: 191003 - protein, 128 aa, Glycine max
  Coding DNA Sequence Number=SeqID_74225
  Gene Ontology: Mol. function=DNA binding; Biological process=DNA integration
  Homolog annotation: Hit_ID=Q1SKC8; Match level="QueryCoverage=78%, HitCoverage=31%, E-value=9e-20, Identity=39%"; Hit description =Integrase, catalytic region
MKFLNLDSTTSGEKRKVQLQELEEMHLNAYESSKLYKERTKRKLKSRWSDPFTVKDVKPYGDIEIKDQSKDRNWLVNGQRLKIYLGGEVPQHTIVIKLKDPKSDTKHQASDVKETFTRRQSSFLTLTF

SEQ ID NO: 191004 - protein, 101 aa, Glycine max
  Coding DNA Sequence Number=SeqID_74226
  Gene Ontology: Mol. function=DNA binding; Biological process=DNA integration
  Homolog annotation: Hit_ID=Q1S3H4; Match level="QueryCoverage=85%, HitCoverage=19%, E-value=2e-17, Identity=52%"; Hit description =Integrase, catalytic region
MAISFKDVDYPWSADIAKFKAMEQLLQGMKFHERKRFFQEATRKNKLAYFGIAITHHEEATLTEKEQLQRSFKKDYIGLHSSKMLITMHDHAAAVNEPEHI

SEQ ID NO: 191005 - protein, 181 aa, Glycine max
  Coding DNA Sequence Number=SeqID_74227
  Subcellular localization annotation: CTP_CleavageSite=39; ConfidenceScore=5.21e-01
ARRARARPAELPSTSTAPPPARTSAAPSTPSSADFQHLEAMLVAPPDFIPFVEQFNEWVAWPGTQPPLHREDEGLTAQVPQQREDESSETSTSYPLIRRKRVVETQEVAATSEKSLDATSEPSEPMADMASIQQAADPSTHEDQTTSVLSPNTSPPTTPVLRLIDEEDGQIQDNQDKSQEF

SEQ ID NO: 191006 - protein, 98 aa, Glycine max
  Coding DNA Sequence Number=SeqID_74228
GCIDLVGCPWWGKIKWLKSLNISEGMLRIFNSSMVFELNVCTCSSLLGGLLVLGGVSLGLGTPLWPRLITIGGSYGARQGGLDTYCVVSLSEVLWGYA

SEQ ID NO: 191007 - protein, 228 aa, Glycine max
  Coding DNA Sequence Number=SeqID_74229
  Gene Ontology: Mol. function=cation transporter activity; Cellular component=integral to membrane; Biological process=calcium ion transport
  Homolog annotation: Hit_ID=Q8L783; Match level="QueryCoverage=89%, HitCoverage=46%, E-value=2e-72, Identity=69%"; Hit description =H+/Ca2+ antiporter, putative
  Pfam annotation: Domain name=Na_Ca_ex; Domain location=47-196; Score =79.5; E_value=1e-20; Accession=PF01699.14; Description=Sodiumcalcium exchanger protein
MAGMIYRSIRVVLLSSKLNLLMPFGPLAILVQILTGHHGWIFGLSLLGIMPMAERLDYVTKKLTLYTGHTVGVGGIFNASFGNATELIISLCALKSGMIRAVQLSLLGSIFFNMLLVLGCAFFRGGIVSNKKEQVFNKEIASVNSGLLLMAVMGILLPAALHYTQAEVHVGESELSLSRFSSCIMLVAYVACLFFQFKSQRSLYVPVNELKLIYTLNCKQVRSMQSHI

SEQ ID NO: 191008 - protein, 127 aa, Glycine max
  Coding DNA Sequence Number=SeqID_74230
  Gene Ontology: Cellular component=integral to membrane
  Homolog annotation: Hit_ID=Q9SEW5; Match level="QueryCoverage=57%, HitCoverage=28%, E-value=7e-33, Identity=90%"; Hit description=Amino acid transporter c
MDGKNSLQITRSGIGAYDDDGHAKRTGNLQSAVAHIITAVIGSGVLSLAWSTSQLGWIGGPFSLLCCAIVTYISSFLLSDCYRTPDPVTGKRNYSYMDAVRVYLGSNTLNSFSCASTIILAKHRYIL

SEQ ID NO: 191009 - protein, 322 aa, Glycine max
  Coding DNA Sequence Number=SeqID_74231
MGEVDELQEWMKADMEAMKEQITTMMETMMSMKKMMGVNTATVTATSAIVEVEPTPPSGLNQINHPTSNMVGQGGKELGSTGSPHFVQIQNKHAFPPYGLPPNYTPPNENVNNSTPILIESQQPQSDHAHVSQPMGETHEIPHHNLADFKPCLGYAIEGQPVRGVPLPNTLEGPQFRPQPQPLHFTTGKIPPGMTEKGKLDHLEERLRAIEGGRDYAFASLEELFLVPNVIIPPKFKVPDFDKYKGTTCPKNHLKMYCRKMGAYAKDEKMLMHFFQESLTGVAITWYTNLEPSRVHSWKDLMVAFVRQYQYNSDMAPDRMQL

SEQ ID NO: 191010 - protein, 125 aa, Glycine max
  Coding DNA Sequence Number=SeqID_74232
  Gene Ontology: Mol. function=protein binding; Biological process =defense response to fungus
  Homolog annotation: Hit_ID=Q6JN46; Match level="QueryCoverage=71%, HitCoverage=9%, E-value=8e-16, Identity=49%"; Hit description=EIX receptor 2
  Pfam annotation: Domain name=LRRNT_2; Domain location=38-80; Score =54.7; E_value=3e-13; Accession=PF08263.3; Description=Leucine rich repeat N-terminal domain
MSCYSLKLFYALLLLLLHAAGSILGFNSLPNSTEIKCIESERQALLNFKHGLKDDSGMLSTWRDDGNNGDCCKWKGIQCNNQTGHVEMLHLRGHGRQYLSGAINISSLIALENIEHLDLSYNDFE

SEQ ID NO: 191011 - protein, 331 aa, Glycine max
  Coding DNA Sequence Number=SeqID_74233
  Homolog annotation: Hit_ID=Q7N1U2; Match level="QueryCoverage=35%, HitCoverage=81%, E-value=2e-53, Identity=85%"; Hit description =Similar to unknown protein YfjG of Escherichia coli
  Pfam annotation: Domain name=SmpA_OmlA; Domain location=47-129; Score= 109.0; E_value=1.4e-29; Accession=PF04355.4; Description=SmpA  OmlA family
MAPLDKRARLQELARLLGGMTLLTRKISKVRRGGDPKPPQRPETGQALEVVYRPDINQGNYLTSTDVAKIQKGMTQQQVAYTLGTPMLQDPFGTQTWFYVFRQQPGHEDITQQTLTLTFDSAGVLTDIQNKPALTNALFFCLFCPLPAQLFRIGEQGPVDLHPVAVVQRIAQLGRAAVDADFVALEIDILAQLQQARSLDRLLDAAALGQFHLAQLFEHLAERQLNQFVGELEVQVQLHLAGLFAQRRELPTAHQLAERAIDQLHIDALVIQQRIARGEGLADTGLGDVHRGGHFVGGSVKHPAAGATWQKIGIRVNIVNQLIHLLGAERH

SEQ ID NO: 191012 - protein, 49 aa, Glycine max
  Coding DNA Sequence Number=SeqID_74234
MVALGGGRGSCCIGATSGIKAACAFSEIHSSSLKKSLKELIHGPLKLIN

SEQ ID NO: 191013 - protein, 164 aa, Glycine max
  Coding DNA Sequence Number=SeqID_74235
  Gene Ontology: Mol. function=nucleic acid binding; Biological process= DNA integration
  Homolog annotation: Hit_ID=Q1RXN8; Match level="QueryCoverage=75%, HitCoverage=10%, E-value=4e-26, Identity=40%"; Hit description =Peptidase S8 and S53, subtilisin, kexin, sedolisin; Integrase, catalytic region; Zinc finger, CCHC-type
MVKETSSKLDVITKNDGSNNRKKDSGNATIVQDDGYESAEALMVSEKNPETKWIMDSGYGLVLLGDNKPCKIKGIGSIRFKFHYGAERILTEVRYVPELKRNLISLGEFDKRGYVFKGEKGIVNVVKESMVVMRGIMENGLYSVDGEVVIGSGAIATGRVFIKN

SEQ ID NO: 191014 - protein, 240 aa, Glycine max
  Coding DNA Sequence Number=SeqID_74236
  Gene Ontology: Cellular component=protein complex; Biological process= multicellular organismal development
  Homolog annotation: Hit_ID=Q5Z876; Match level="QueryCoverage=92%, HitCoverage=12%, E-value=2e-64, Identity=56%"; Hit description =Proteasome activator subunit 4-like
  Pfam annotation: Domain name=HEAT; Domain location=43-79; Score=21.2; E_value=0.0037; Accession=PF02985.12; Description=HEAT repeat
MLFSFFVLFDSMIIQIGKETSNKDLSTLAKVAFELLKWMIVWEPHLQKAVSVILTAANDSNWRTRSATLTYLRTFMYRHTYILSSSKKQEIWRTVEKLLKFGYFIEHAILVEKVREHAAAVLAGLMKGGDEDLARDFHDRAYKEANIVQKRRKSRNASSGLSIASVHGAVLALVASVLSAPYDMPSWLPDHVTLLARFSGEPSPVKSTVTKAVAEFRRTHADTWNVQKELFTEEQLEVVI

SEQ ID NO: 191015 - protein, 526 aa, Glycine max
  Coding DNA Sequence Number=SeqID_74237
  Gene Ontology: Cellular component=integral to membrane; Biological process=peroxisome organization and biogenesis
  Homolog annotation: Hit_ID=Q9FF99; Match level="QueryCoverage=80%, HitCoverage=95%, E-value=1e-119, Identity=49%"; Hit description =Amino acid transporter
  Pfam annotation: Domain name=Aa_trans; Domain location=104-518; Score= 245.2; E_value=1.3e-70; Accession=PF01490.8; Description =Transmembrane amino acid transporter protein
MDVKTSLPTATSVIGAYDDDGHVKRTGTLWSAVAHIITAVIGSGLLSLAWSTSQLGWIGGPVAFLCFAIITCFFISPFFITGKRNYSYMAAVRVNHGIDGECVSAGTVWTAVAHIVTGAIGSGVLSLAWSIAQLGWIGGLLTIVFFAAITLLSSFLLSNTYRSPDPELGPHRSSSYLDAVNLHKGEGNSRFCGVFVNVSLYGLGIAYVITAAISMRFLTRTPPGKYEEQSKNQTVPKTMGMKKHVDLGMDISSIMSFAYAFIGMGLSIGQVKENGHAEGSIEGIPTSSGMEKLWLIAQALGDIAFSYPFSVILIEIQDTLKSPPPENVTMKRASTISVIITTFFYLCCGCFGYAAFGNDTPGNLLAGFAHYNKHWLVDFSNACIVIHLVGAYQVYSQPLFANVENWLRFKFPDSEFANRTYYLKLPLLPAFPLNFLRLTFRTAYVASTTGIAMIFPYFNQILGVLAGIIYYPLSIYFPVEMYLSKGNIEEWTAKWTMLRTSSIVGFLVGLFTLIGSIEGIVSAKLS

SEQ ID NO: 191016 - protein, 325 aa, Glycine max
  Coding DNA Sequence Number=SeqID_74238
  Gene Ontology: Mol. function=DNA binding; Cellular component=nucleus; Biological process=regulation of transcription
  Homolog annotation: Hit_ID=Q9LSI7; Match level="QueryCoverage=41%, HitCoverage=42%, E-value=3e-54, Identity=71%"; Hit description =Transcription factor-like protein
  Pfam annotation: Domain name=Myb_DNA-binding; Domain location=14-61; Score=49.9; E_value=8.6e-12; Accession=PF00249.21; Description=Myb -like DNA-binding domain
  Pfam annotation: Domain name=Myb_DNA-binding; Domain location=67-112; Score=45.7; E_value=1.5e-10; Accession=PF00249.21; Description=Myb -like DNA-binding domain
  Pfam module annotation: Pfam domain module=Myb_DNA-binding::Myb_DNA -binding; Domain location=14-61::67-112
MGRIPCCEKDNVKRGQWTPEEDNKLSSYIVQHGTRNWRLIPKNAGLQRCGKSCRLRWTNYLRPDLKHGQFSDSEEQTIVKLHSVFGNRWSLIAAQLPGRTDNDVKNHWNTKLKKKLSGMGIDPVTHKPFSHLMAEIATTLAPPQAAHLAEAALGCFKDEVLHLLTKKPINFHQGQHSTAALGNNFTDYVNCKPDEKDATVEKIKFDLSKAIQHDPEIMPANKPWDSNATTSANFAMPYGVFPTMSGFQLSPVSFSKGHASQWSQSVCTGSTCTAMDQQIQLHEKLEAEIGDDSEATKEIRNLSNIFSSDCVVWDLPADDLINPMV

SEQ ID NO: 191017 - protein, 317 aa, Glycine max
  Coding DNA Sequence Number=SeqID_74239
  Gene Ontology: Cellular component=integral to membrane; Biological process=peroxisome organization and biogenesis
  Homolog annotation: Hit_ID=Q9FF99; Match level="QueryCoverage=93%, HitCoverage=64%, E-value=1e-114, Identity=62%"; Hit description =Amino acid transporter
  Pfam annotation: Domain name=Aa_trans; Domain location=1-297; Score =73.6; E_value=6.4e-19; Accession=PF01490.8; Description =Transmembrane amino acid transporter protein
MALFGLVQIVMSFIPDLHNMAWVSVVAALMSFTYSFIGLGLGIATVIKNGRIMGSLTGIPTDKIADKFWLVFQALGDIAFAYPYSILLLEIQDTLESPPPENQTMKKASMVAIFITTFFYLCCGCFGYAAFGNDTPGNLLTGFGFFEPFWLIDLANACIILHLVGGYQIYSQPIYSTVDRWASRKFPNSGFVNNFYRVKLPLLPGFQLNLFRFCFRTTYVISTIGLAIFFPYFNQILGVLGAINFWPLAIYFPVEMYFVQQKIAAWSSKWIVLRTFSFACFLVTVMGLVGSLEGILNASVIESKIEYKQLWGISESE

SEQ ID NO: 191018 - protein, 1265 aa, Glycine max
  Coding DNA Sequence Number=SeqID_74240
  Gene Ontology: Cellular component=protein complex
  Homolog annotation: Hit_ID=Q5Z876; Match level="QueryCoverage=99%, HitCoverage=66%, E-value=0.0, Identity=51%"; Hit description =Proteasome activator subunit 4-like
  Pfam annotation: Domain name=HEAT; Domain location=1129-1165; Score =13.4; E_value=0.8; Accession=PF02985.12; Description=HEAT repeat
  Pfam annotation: Domain name=HEAT; Domain location=611-647; Score =10.1; E_value=2.5; Accession=PF02985.12; Description=HEAT repeat
  Pfam annotation: Domain name=HEAT; Domain location=841-877; Score =10.3; E_value=2.4; Accession=PF02985.12; Description=HEAT repeat
  Pfam module annotation: Pfam domain module=HEAT::HEAT::HEAT; Domain location=1129-1165::611-647::841-877
MGVGGPMHWSVLKLIDRGQYSKNEHLSETVAAATSILSYVEPSLVLPFVASRFRMALETMTATHQLKIAVMSVAFVGRSLFYTSVSASSMKPIDLGGGDETFIDLVGVSLSNALLGMDANDPPKTLATMQLIGSIFSNLALLDDKIDDLSFMPMIRFSEWLDEFLCRLFSLLLHLEPGSVINEGLQSSAATGTFLVDDGPYYFCVLEILFGRLSKSLYNQALKKISKFVRTNILPGAVAEVGLLCCACVHSNPEEAVSQLVEPILLSVISSLKGTPRTGFGGGGTFDASASSKVRSSISPALEASIDYQLKILSVGITYGGPAILRYKDQFKEAIFLAFDSPSWKVNGAADHLLRSLLGSQIHYYPIDQYKCVLSHPDAVALEEWISTKGFSTDEKLIPKWHIPCDEEVHFANELLDIHFKSALDDLLKICQTKIHADQGDEKEHLKVTLLRIESSLQGLFSCLPDFVPDSRNGMVEDSNHMFLIAGATGCTVGSTALREKATEVVHAACKYVLEKKSDDSILLILIIRIIDALGNYGSLEYDEWSSHRQAWKLESAAIIEPPINFIVSSHSKAKKRPRWALIDKAFMHNTWRSSQASYHLYRTSGNFCPSDHVTMLMDDLLSLSLHSYETVRLLAGKSLVKLIKRWPSMISKCVITLTHNLQDTNAKEYAVLGSCSVLASQTVLKHLTTDPKSFSSFILAILSSSHHESLKAQKAINELFVKYNIQFSGVSRSFFRISDKENHTGGLGFSDLVSQIGSMSFDSTGLHWRDKAKIEYIIEVQPSSHELAFGVELGPNSHSKMISELILDPLNETPAMYNLMANRVLLLLALASRNHPNSSSKILSETAGHFLKNLKSQLPQTRILAISALNTLLKESPYKLSHGEKSAVLEDLQDHVKSSLEGTLTQTFQEEGFFNETLTSLSHVHIITDTETASRGGQGDSSFQSLADKSITRFYFEFSASWPRTPSWISFLGSDDTFYSSFARIFKRLVQECGMPVVLALKGAVDEFIIAKERSKQCVAAEALAGVLHSDIDGLSGTWESWLMPQLKNIILAQSVESVSEWASCIRYAVTGKGKYGTRVPLLRQKILDSLMTPLPPTVATTVTAKRYTFLAAALIEISPQKMPVAEIQLHNTLLKEVLGNMCHSSAQVREALGVTLSILCSNIRLYHSSRHDNAQDERNDNVDSLMKDESWVQFLTERAAEAVVNIQIATQSDKVVNPVDSSSQNGHLDGDSQDDIKWMETSGRSSYLLDVLVGLLYPVICLQ

SEQ ID NO: 191019 - protein, 209 aa, Glycine max
  Coding DNA Sequence Number=SeqID_74241
  Gene Ontology: Mol. function=chitin binding; Cellular component =extracellular region; Biological process=chitin metabolic process
  Homolog annotation: Hit_ID=UPI000044A8F0; Match level="QueryCoverage =86%, HitCoverage=99%, E-value=5e-19, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LILCLDPLSTLIRVDPWVLVPSPSEGYTPSPSEDFTPSPSEDNTSSPSKGDTSSPSEDYTSSSLEGCTPSPSEDYTSSPSEGCTPSPLEDYTSSPSEDYTSSPSEGCTPSPSEGYASSPSEGYIHALRGLCVLTFRGLHVLAFRGLHALTFIGLHVFTFRGLHVLAIRGLHVLTIRGLHVLAFRGLHTLSFSGLRTLAFRGMDALAFKG

SEQ ID NO: 191020 - protein, 59 aa, Glycine max
  Coding DNA Sequence Number=SeqID_74242
GQDHLELPSGVETEHEQQKPIKVRQRCGRDWPHQVVSYLQVSSPGRAELAWASHPCTKL

SEQ ID NO: 191021 - protein, 73 aa, Glycine max
  Coding DNA Sequence Number=SeqID_74243
  Gene Ontology: Mol. function=DNA binding; Biological process=DNA integration
MVGWSIELSEFDISYETRGLIKEHVLADFAAEMPSPVTSEGNRECVQSMDGVASKKGNGAGVILEGLDGVMLE

SEQ ID NO: 191022 - protein, 56 aa, Glycine max
  Coding DNA Sequence Number=SeqID_74244
  Homolog annotation: Hit_ID=Q33B99; Match level="QueryCoverage=98%, HitCoverage=8%, E-value=3e-13, Identity=64%"; Hit description =Expressed protein
VDEDISVGLEAFCRIAPSIPIIANVIISENLFEVLSSSTGARLQFPIYDKYLTGLE

SEQ ID NO: 191023 - protein, 83 aa, Glycine max
  Coding DNA Sequence Number=SeqID_74245
  Gene Ontology: Mol. function=ribonuclease H activity; Biological process=DNA integration
MNGSLETANKNIKKIIQKMTVSYKDWHEMLPFTLHDYRTSVHTSTGATPFSLAFSGGALVLTNMDGEELPSPVNSDVVKRYYA

SEQ ID NO: 191024 - protein, 133 aa, Glycine max
  Coding DNA Sequence Number=SeqID_74246
AVHVSSTFEFGAVFHDCLSADPQDNPPFSPFAELHECYCLALFMCPPLSSAKSLVTGKHVILLFSGSVSSPDIRKREGVETRVVITERVGRTKSVSYLCFPLISDESPETSRKSKGSRLARSVKFRNEAEVEK

SEQ ID NO: 191025 - protein, 180 aa, Glycine max
  Coding DNA Sequence Number=SeqID_74247
MTTLTQIWMTLLLSNIQPNDHNSDLPLLKCQLVYAVLTRMSIHVAQLIADAIYLFAGMAPTRHPLDPDKSNRALGFPTLITGLCQSFGVPVAPSKPTNHRAHVQIHDCLYQLSLSLHSQGFTSFLCPTQYQFRAEVAWPGDWPEAQEGEAPAEAPGEADEAHEDEEMTDLLDFLGGSGAT

SEQ ID NO: 191026 - protein, 80 aa, Glycine max
  Coding DNA Sequence Number=SeqID_74248
  Gene Ontology: Mol. function=transporter activity; Cellular component= outer membrane-bounded periplasmic space; Biological process=transport
  Homolog annotation: Hit_ID=Q6MXU4; Match level="QueryCoverage=98%, HitCoverage=32%, E-value=2e-33, Identity=83%"; Hit description =Exported solute-binding protein
AGNLDAVVHDSPNVLYYVKTAGDGKVKASGENDTILPQQYGFAMQKNSSLTPKINAALQALRADGTYSKIYVKWFAKQPK

SEQ ID NO: 191027 - protein, 198 aa, Glycine max
  Coding DNA Sequence Number=SeqID_74249
  Gene Ontology: Mol. function=transporter activity; Cellular component= 1-2nm peptidoglycan-based cell wall; Biological process=transport
  Homolog annotation: Hit_ID=Q6MXU3; Match level="QueryCoverage=99%, HitCoverage=100%, E-value=3e-76, Identity=71%"; Hit description =Membrane transport system permease protein
  Pfam annotation: Domain name=BPD_transp_1; Domain location=15-197; Score=97.0; E_value=5.6e-26; Accession=PF00528.12; Description =Binding-protein-dependent transport s
MNFDSKYIWESLPLLLQGLQLTLIISLSGLLGGFIIGLLAGTCRALGGKIAKTLSLIFVELIRGTPIMVQVMFIYFALPMVLPIRIDPVTAAIVTIVINSGAYIAEITRGAILSINKGFKEASLAMGLSQRSTLWYVIMPLALRRMIPALELTRQGQEIIAGNFRALEVWTAVAMIYLLVTLCLSFLLKQLEKRIHIL

SEQ ID NO: 191028 - protein, 80 aa, Glycine max
  Coding DNA Sequence Number=SeqID_74250
MDIFISANPFSFKSLKIPLITKLIRNKHYTLPLLATTSVHDAILPRKGPITRTMSKRLQEDWARAAEEGPRVLMNLRVDF

SEQ ID NO: 191029 - protein, 109 aa, Glycine max
  Coding DNA Sequence Number=SeqID_74251
MKREEGWKLDTWTEMKRVMQKRYVPTSYSRTMRQILQRTPILDLQSFPSKSQPPTNPPPKPEPRRGEKNLLTLNGEAQRKEGAQRALTRKLQAERGGVREGGEPLREEQ

SEQ ID NO: 191030 - protein, 80 aa, Glycine max
  Coding DNA Sequence Number=SeqID_74252
MENPTYLGKDNVEAYLDWEIRVGKQLKRKSTSKAYGSHSYPKKDQGQGILGVTPSEPKNDKGKTIEKQTLKASDENPKTA

SEQ ID NO: 191031 - protein, 93 aa, Glycine max
  Coding DNA Sequence Number=SeqID_74253
MILGLNSPSTLFCTCAAEPHGDDKVNPPGGVVEEWSQSFFLSLIVEDGVATVVIGRELPHGGVGWLIQKNSKEDFEEDPDEDMWDASSRESCC

SEQ ID NO: 191032 - protein, 96 aa, Glycine max
  Coding DNA Sequence Number=SeqID_74254
MTRGWTRDPIVNFWMLELSSKSAYSALLLPFRSCGDHGDLLFVIFIFFFIFFRCIELHARANLMLTRILSMKCPPRSLEHLLRRTTRSWRTARGGK

SEQ ID NO: 191033 - protein, 129 aa, Glycine max
  Coding DNA Sequence Number=SeqID_74255
MKSLVEEEPNLAKGPNNKSVVVAIVPMLIFTAFLRTCQAVSPLLENLVFLEKVLINSGICPSYECGRLRVCQEWSSELMQAPLELVGLGSSSSMDSFASWKINGSGMEKEEREETPLQGEDESRRSSPP

SEQ ID NO: 191034 - protein, 264 aa, Glycine max
  Coding DNA Sequence Number=SeqID_74256
  Gene Ontology: Mol. function=nucleoside-triphosphatase activity; Cellular component=intracellular; Biological process=protein metabolic process
  Homolog annotation: Hit_ID=UPI00005F72DE; Match level="QueryCoverage =99%, HitCoverage=31%, E-value=4e-96, Identity=66%"; Hit description =COG0542: ATPases with chaperone activity, ATP-binding subunit
  Pfam annotation: Domain name=AAA; Domain location=1-221; Score=-23.2; E_value=0.012; Accession=PF00004.19; Description=ATPase family associated with various cellular activities (AAA)
  Pfam annotation: Domain name=AAA_2; Domain location=1-163; Score =275.8; E_value=8.5e-80; Accession=PF07724.4; Description=ATPase family associated with various
  Pfam annotation: Domain name=AAA_5; Domain location=1-168; Score=3.9; E_value=0.00089; Accession=PF07728.4; Description=ATPase family associated with various
  Pfam module annotation: Pfam domain module=AAA::AAA_2::AAA_5; Domain location=1-221::1-163::1-168
MLCGPSGVGKTETALALAESLYGGEQNIITINMSEFQEAHTVSTLKGAPPGYVGYGEGGVLTEAVRRRPYSVVLLDEIEKAHPDVHELFFQVFDKGWMEDGEGRHIDFRNTIIILTSNVGTQLISAMCADPELMPDPEALSNALRKPLLEVFPPALLGRLLVVPYYPLSDAMLAEIVRLQLGRIVQRLADNHGISAQIDDSVISQIVQRCTEVESGGRMVDAILTNTLLPQMSQMLLSAHARDERYRRVQVRCEQGEFVCQFDV

SEQ ID NO: 191035 - protein, 149 aa, Glycine max
  Coding DNA Sequence Number=SeqID_74257
MLHFMLQNLHRGQSIIMQSLQGLGLPSIMSIDEFDVQVAWPKAQPSPSGGGGASAAQEPELEEPTATVEGKDELTPPEPFYFDSGVHMAQEEETATEQILEPSPVPTPDDSMPSAPASELEQPIPQDSPATQVLDLNEHAQEQPQEQDI

SEQ ID NO: 191036 - protein, 37 aa, Glycine max
  Coding DNA Sequence Number=SeqID_74258
MQVKLTAVAKITKPRSLVGLNQSKLRPQIPLIGLGSI

SEQ ID NO: 191037 - protein, 163 aa, Glycine max
  Coding DNA Sequence Number=SeqID_74259
MFSSNKRWWRLRAFSFHGRFDFSVYDARRLVYTNQADMIGRLLAGSLAFDCRILHYLIVRILLPRSSNLAQVPLDSKPFVQIKKSFSIGAAMVASFGYRKERDGSWSVMDRFDNLQTYVGERFDSLESQVDIRFGEMDSRITKIEGNITFIRDCFDLPPPPST

SEQ ID NO: 191038 - protein, 208 aa, Glycine max
  Coding DNA Sequence Number=SeqID_74260
  Gene Ontology: Mol. function=helicase activity; Biological process =viral genome replication
  Homolog annotation: Hit_ID=Q9LW42; Match level="QueryCoverage=66%, HitCoverage=8%, E-value=1e-21, Identity=43%"; Hit description =Helicase-like protein
SENSESTQGSGSNFMTPFEDCQSPTNQSVINTEGYSDLGDQLIQCRYCNAQMCQYSGIQNHIVSTLSHMLDQHNSHAKSFRMARDRLVGDQANNIKLQLIAARGKDGRVYNMPNVPKIAALIVGDFHPGSKRDIIVETQNGELQRIHELHPSYLPLQYPLLFLYGEDGYRADILHRCTSSSKKRKQNRLTMREWFAYRLQSRLYHGGI

SEQ ID NO: 191039 - protein, 116 aa, Glycine max
  Coding DNA Sequence Number=SeqID_74261
MESAFLKRYFSSMKMDQYIRDIGNFVQKEQETLKTLFRIQEDFEETEGSSPKATKKFKNHQQDVQFRKFLEVMKKLHINLPFIEAITQMPSYAKNLKKIISNKGKLANFGTVGLYE

SEQ ID NO: 191040 - protein, 102 aa, Glycine max
  Coding DNA Sequence Number=SeqID_74262
LLDQKVLSILSKDYESFACPQISEATCLTEGYARNAVERWQEIEARLRNYGEVCGYVPSMRWRCIWLCSIREVVRSRGLTPTTNNFQPSSKDDEDEPPKDPS

SEQ ID NO: 191041 - protein, 98 aa, Glycine max
  Coding DNA Sequence Number=SeqID_74263
MAVLKSTLGVVGNCDTEALEHYGMTTTITAVPSGGSNPARLGELGGNHLAWASWAATTSLFSPINRGKRAEQIRSTLLVFHRSSLFFVRSSSFFGLQP

SEQ ID NO: 191042 - protein, 47 aa, Glycine max
  Coding DNA Sequence Number=SeqID_74264
MPPMDEPDEVDDGHANSVDHDEGSLATPSEVSSHSLMVKSEATFEEE

SEQ ID NO: 191043 - protein, 57 aa, Glycine max
  Coding DNA Sequence Number=SeqID_74265
  Subcellular localization annotation: CTP_CleavageSite=49; ConfidenceScore=5.28e-01
LVFSLSLRVKGSAFSEFTLAQRLCTAHPSSRFFCVLSRRIVRLADDSPSARHGSASS

SEQ ID NO: 191044 - protein, 74 aa, Glycine max
  Coding DNA Sequence Number=SeqID_74266
  Subcellular localization annotation: CTP_CleavageSite=64; ConfidenceScore=5.21e-01
MEMTIPKLKVQFDNYNSVHRWVQMISSSINSIGVAGGVVVSPKTSVERSSRISNNGVEGSAGISCTGVGGSASC

SEQ ID NO: 191045 - protein, 198 aa, Glycine max
  Coding DNA Sequence Number=SeqID_74267
  Homolog annotation: Hit_ID=Q8H3G8; Match level="QueryCoverage=59%, HitCoverage=14%, E-value=2e-11, Identity=38%"; Hit description =Myosin heavy chain-like protein
ASKTAVGWSMSSDTGDHRPHDLGFLEALNESPIGHNQFPKVTSEVVAIAEDINDMSFMSAQSAEVTSHTIDLGRDGWEKAENEGTSLKKQVQALTLRNSTLKDRVTHLDSALKECVRKLRQTRDLIEGAAMASTTNTGGFIHALPILDGKNCDQWVVRMEAILGFHEILGIMKEGILEKEKDDATIMKKDFKAKCLLH

SEQ ID NO: 191046 - protein, 107 aa, Glycine max
  Coding DNA Sequence Number=SeqID_74268
MTTKMRVKYDKYWGTPNTINILLMIVVVLDPRCKVKYVNHFVNYLFNENQTNELKLKLSSSLKSLYEQYQGVEEDFQINQEVAQLDEEDDDDIHGKLNQISNLGSMA

SEQ ID NO: 191047 - protein, 134 aa, Glycine max
  Coding DNA Sequence Number=SeqID_74269
  Homolog annotation: Hit_ID=Q2HU26; Match level="QueryCoverage=98%, HitCoverage=53%, E-value=5e-33, Identity=54%"; Hit description=CCT
  Pfam annotation: Domain name=CCT; Domain location=44-82; Score=77.5; E_value=4.1e-20; Accession=PF06203.4; Description=CCT motif
MRFNGMQHFQHSDSSLSSESSLIIEEMSRTSPYSPEEKKVRIERYRNKRNQRNYCKKIKYACRKTLADSRPRIRGRFARNGEIAINPPAQWSHMGNGEEEEEEEENWANFFDSLVPANLAQEPQGSSSSFGVFY

SEQ ID NO: 191048 - protein, 146 aa, Glycine max
  Coding DNA Sequence Number=SeqID_74270
  Homolog annotation: Hit_ID=Q2HU26; Match level="QueryCoverage=63%, HitCoverage=29%, E-value=1e-08, Identity=41%"; Hit description=CCT
MYTHRNASLSRAADSLGHFLSPPDASTASPMQYSPAAAAAAAPPPLHHHHHGEFDSLLELNYSEMSSNNTYNSCSSGCTSYMGSPSSLASNYESRRVVQRSVSSHSLQKNGGTHHHPFSEFSPLFAEFIDSENGPVRRACSTGELQ

SEQ ID NO: 191049 - protein, 84 aa, Glycine max
  Coding DNA Sequence Number=SeqID_74271
CGKDHWKKEELRPLTVLKHSELAQSNRGAQRASGAKRATNWRRWAWQKPLRALSQPGAQRPIQQKHRPSVHGAPSARSERAKRE

SEQ ID NO: 191050 - protein, 200 aa, Glycine max
  Coding DNA Sequence Number=SeqID_74272
  Homolog annotation: Hit_ID=Q6W257; Match level="QueryCoverage=97%, HitCoverage=98%, E-value=1e-73, Identity=66%"; Hit description =Peptide synthase
  Pfam annotation: Domain name=DUF1185; Domain location=5-181; Score =313.1; E_value=5.1e-91; Accession=PF06684.2; Description=Protein of unknown function (DUF1185)
MHPAIRKTLVTTETLYVDGGKAAEKPLVMIAAAAVIRNPWAGLGYVDDLAPQIREFAPILGELLTGLILKEAGSGEKVEAFGKSAIVGLDGELEHASALIHTLHFGNHYRSAVQSKSYLAFNNTRGPANSPVLIPMMNKNDEGSREHYLTMQFNICDAPRYDEIVIALGAALGGRPHHRIGNRYSDLKELGHDAQNPAAV

SEQ ID NO: 191051 - protein, 225 aa, Glycine max
  Coding DNA Sequence Number=SeqID_74273
  Gene Ontology: Mol. function=transcription factor activity; Cellular component=intracellular; Biological process=regulation of transcription, DNA-dependent
  Homolog annotation: Hit_ID=Q6F9F2; Match level="QueryCoverage=96%, HitCoverage=95%, E-value=1e-57, Identity=53%"; Hit description =Putative transcriptional regulator
  Pfam annotation: Domain name=FCD; Domain location=88-212; Score=52.4; E_value=1.5e-12; Accession=PF07729.2; Description=FCD domain
  Pfam annotation: Domain name=GntR; Domain location=16-78; Score=59.3; E_value=1.3e-14; Accession=PF00392.11; Description=Bacterial regulatory proteins, gntR f
  Pfam annotation: Domain name=HTH_11; Domain location=24-77; Score =11.2; E_value=0.0053; Accession=PF08279.2; Description=HTH domain
  Pfam annotation: Domain name=HTH_CodY; Domain location=35-93; Score =19.8; E_value=0.0096; Accession=PF08222.2; Description=CodY helix -turn-helix domain
  Pfam annotation: Domain name=TrmB; Domain location=16-84; Score=-5.9; E_value=0.016; Accession=PF01978.9; Description=Sugar-specific transcriptional regulat
  Pfam module annotation: Pfam domain module=FCD::GntR::HTH_11::HTH _CodY::TrmB; Domain location=88-212::16-78::24-77::35-93::16-84
MVDNHSLKIDAVPVTLRELALTKVRQAIIAGYFKAGDRLVERQLTEQLGVSRSVVREVIRYLEAEGLIETLPKKGPIVAVLNWESAEQIYKIRMLLEQEAASDCARLANDDDKHQLYQQLQLIAQASREQDDIKRVEASQAFYETLFRVAKHTIAWEIVQRLNSRISRLRALTLASPERQVAGFERMSRIYDAIENNDPQQARQAVLEHLTEAAQLAKQILSSQE

SEQ ID NO: 191052 - protein, 56 aa, Glycine max
  Coding DNA Sequence Number=SeqID_74274
MVQVEARDHNMAGFCAVSKEARSTYTIKMFSIWVDFVECPKVQNEKMEDLHMDLME

SEQ ID NO: 191053 - protein, 129 aa, Glycine max
  Coding DNA Sequence Number=SeqID_74275
MARMKKTSQMTSDAAKEIAKKIVSHFQLTIVIVATYPSAGGRRRAHECVFQERKMSGVTTNVYSRKTSEKPKKVWSTNFKCERFGSYFYARGRRETLSRWTINDLLGWSTKAGFLLLRILNCDEELRPT

SEQ ID NO: 191054 - protein, 136 aa, Glycine max
  Coding DNA Sequence Number=SeqID_74276
MILSVDHIIGPLYEEGPMDLTLLWFYIDHVWIDQSKAKLKLVSHGGKVTDYPTQVTMKGYVDRLGLKALYDAWYMTTNKCTIKPLSRDSMCTHVDSAISKTTGANNNSLNILNEFDSLHKGVVIPTTRTAIVTTKH

SEQ ID NO: 191055 - protein, 78 aa, Glycine max
  Coding DNA Sequence Number=SeqID_74277
MLPGLRQNELGNCFVQLPFILVHPTFFVISNIIHGKSKWVRKAIPNELSSISLYLNGPTSTGSGLYEQQVKSTARCTQ

SEQ ID NO: 191056 - protein, 1069 aa, Glycine max
  Coding DNA Sequence Number=SeqID_74278
  Gene Ontology: Mol. function=microtubule motor activity; Cellular component=microtubule associated complex; Biological process =microtubule-based movement
  Homolog annotation: Hit_ID=Q2HU33; Match level="QueryCoverage=99%, HitCoverage=100%, E-value=0.0, Identity=79%"; Hit description =Kinesin, motor region
  Pfam annotation: Domain name=DUF1474; Domain location=407-500; Score=- 9.5; E_value=0.07; Accession=PF07342.2; Description=Protein of unknown function (DUF1474)
  Pfam annotation: Domain name=Kinesin; Domain location=45-392; Score =557.6; E_value=1.2e-164; Accession=PF00225.13; Description=Kinesin motor domain
  Pfam module annotation: Pfam domain module=DUF1474::Kinesin; Domain location=407-500::45-392
MEAQQRRGGLVPLSPARDLRSADSNSSGHSKFDKYKGVNVQVLVRCRPLSEDEARLNTPIVISCNEGRREVSAVQNIANKQIDRTFAFDKVFGPNSKQKELFEQAMSPIVNEVLEGYNCTIFAYGQTGTGKTYTMEGGARKKNGEFPSDAGVIPRAVKQIFDILEAQNAEYSMKVTFLELYNEEITDLLAPEETLKFVDDKSKKPIALMEDGKGGVFVRGLEEEVVCTANEIYKILEKGSAKRRTAETLLNKQSSRSHSIFSITIHIKECTPEGEEMIKCGKLNLVDLAGSENISRSGAREGRAREAGEINKSLLTLGRVINALVDHSGHVPYRYEWLPFSWLWDSKLTRLLRDSLGGKTKTCIVATISPSIHCLEETLSTLDYAHRAKNIKNKPEINQKMVKSALIKDLYSEIERLKQEVYAAREKNGIYIPRDRYLHEEGEKKAMVEKIERMELEAESKDKQLMELQELYKCQQLLTVELSDKLEKNEKSLEETERSLFDLEEKHTQANATIMEKEFLISNLLKSEKALVEHAIELRADLENAASDVSNLFSKIERKDKIEEGNRILVQKFQSQLAQQLEDLHKTVAASVIQQEQQLKEMESDMHSFVSTKAEAIENLRMRVGKFKNMYGSGIKALDNLAEEFKGNNQLTFEALNSEVAKHSSALEDLFKGIALESDSLLNDLQSSLQKQEAKLTAYARQQEEAHARAVENTRAVSKITVNFFETLHMHASNLIQIVEESQFTNDQKLYELENKFEECTAHEEKQLLEKVAEMLASSSSRKKKLVAVSFRHAKLTYSSFRYYLSVQMAVNDLRESANAKISRLRQETLTMQDSTSSVKAEWKLHMEKTESNYHEDTSAVESGKNDLVEAIQRCRKKAEVGAQQWRNAQESILSLEKRNAASVDTIIRGGMEDNHLRRDRFSSAVSTTLEDAEIASKDINSSIEHSLQLDHYACGNLNSMIIPCCGDLRELKGGHYHRIVEISENAGKCLLSEYTVDEPSCSTPRKRTFNLPSVSSIEELRTPSFEELLKSFWDAKSPKHANGDVRYIGAYEAAQSVRDSRVPLVAIN

SEQ ID NO: 191057 - protein, 503 aa, Glycine max
  Coding DNA Sequence Number=SeqID_74279
  Gene Ontology: Mol. function=protein binding
  Homolog annotation: Hit_ID=Q75KA7; Match level="QueryCoverage=77%, HitCoverage=75%, E-value=1e-80, Identity=38%"; Hit description =Expressed protein
  Subcellular localization annotation: CTP_CleavageSite=70; ConfidenceScore=5.48e-01
MGGDSHSALKSREVSAMIKQGFIPDPTHSFSPSRTFSPPPSSTRPSQTQTQTQSHTHSHPHTQTLFDMMSEEHKFSDEKRRKTQDRVSRLLDEPALRGGGDVRLTVVARDGFRASMEVRKTVLADKSRFFADKLRCAGGDLSHSVEISDCDDIEVYVEAIVLMHCEDLKPRLRSMAEGVPKILSLLKVSAAIMFDLGVVSCLEYLESIPWTEDEQEEVISQLEHLQIDDSATEVLLRVSSDPSTADRADDIFLNLLSGVLQAKDDKARREMKALLSRLLKENVSNDSSRLDVSKDTLYHLCHKCIGSLLLCLSEAASSDEKLDRGAIMSDITREADNIQWIVDILIGKKIGDEFVKIWAEQKELVTLHSKVPTVYRHEISRITAQLCIGIGRGHILVPKEIRFSLLSTWLEALYEDFGWMRRASRAVDRKLVEDGLSQTILTLPLLQQQSVLLNWFDRFLSKGDDCPNIQKAFEIWWRRAFIRQYSAEPENSQLQITLSDYPS

SEQ ID NO: 191058 - protein, 38 aa, Glycine max
  Coding DNA Sequence Number=SeqID_74280
  Homolog annotation: Hit_ID=Q6WD26; Match level="QueryCoverage=76%, HitCoverage=6%, E-value=4e-09, Identity=96%"; Hit description =Phototropin-like protein
MGYGGRMQVEVSKHTEGAKEKMLRPNGLPESLIRYDGI

SEQ ID NO: 191059 - protein, 301 aa, Glycine max
  Coding DNA Sequence Number=SeqID_74281
  Gene Ontology: Mol. function=protein serine/threonine kinase activity; Cellular component=membrane; Biological process=two -component signal transduction system (phosphorelay)
  Homolog annotation: Hit_ID=Q5DW44; Match level="QueryCoverage=91%, HitCoverage=56%, E-value=1e-115, Identity=69%"; Hit description =Phototropin
  Pfam annotation: Domain name=PAS; Domain location=166-280; Score =25.7; E_value=0.00016; Accession=PF00989.14; Description=PAS domain
  Pfam annotation: Domain name=PAS_3; Domain location=191-281; Score =19.4; E_value=0.0013; Accession=PF08447.1; Description=PAS fold
  Pfam module annotation: Pfam domain module=PAS::PAS_3; Domain location=166-280::191-281
MEAFPRDQRGSLEVFNPSSSYSTEKSVNSPVRVQSTWKTWIDELPEQQQQQQCGGTNEVTATSWMALKDSAPPPPTLAAVLGESLSAAVGEVGNAAKRAAEWGLVLKTDTETGKPQGVKVRTSGGEEPSAKVTGGSRRDSSNSVRSSGESSDDGREYRGGIPRVSEDLRDALSAFQQTFVVSDATKPDYPIMYASAGFFKMTGYTSKEVIGRNCRFMQGADTDPDDVAKIREALQSGSTYCGRLLNYKKDGTPFWNLLTIAPIKDDDGRVLKFIGKCQTAPTVMSIVSIHYMRIRLLDNFN

SEQ ID NO: 191060 - protein, 261 aa, Glycine max
  Coding DNA Sequence Number=SeqID_74282
  Homolog annotation: Hit_ID=Q1S0U0; Match level="QueryCoverage=45%, HitCoverage=14%, E-value=2e-28, Identity=57%"; Hit description =Response regulator receiver; CCT
MSVKVLRVEHACMILLFFALYFRNEIGALTIVVFEFFFGLFFPSCCIALANGGLVPVSEALKISSAVSVRMSVNNYHKQLLILFLMILCICKFVWAPWVEYPQKLIVQVLGMWRIHDSLGEDIMFAGPMNNNVGKGKKGLAEQNHMFFDKKSLENGVVNGGVASGSSTEDDTRFNKVVEDGNNGLRGLIQIHGSLQISQQPPQEPAVCWERFLPLRSIKVLLVEDDDSTRHVVRALLQNCSYKGINVVFVVNHALAPRLTN

SEQ ID NO: 191061 - protein, 279 aa, Glycine max
  Coding DNA Sequence Number=SeqID_74283
  Gene Ontology: Mol. function=DNA binding; Cellular component=beta -galactosidase complex; Biological process=DNA integration
  Homolog annotation: Hit_ID=Q1SAZ0; Match level="QueryCoverage=95%, HitCoverage=13%, E-value=3e-24, Identity=50%"; Hit description =Integrase, catalytic region
MDPTAKLIPGQDIIFVVSMVSQFLNATCDSHWDVVMCILQYIKIAPGYGLLYEDKDNTIIIYYFDADWAGSLSDIWYTWQFTTDFVSSKDQLVDMFTKSLKGSHVDYIRDKLEPQDWKWGLRPTVEKSQYQTPVGKFIYLSHTRPDTAYAVSVNASYPRKCIQMKTKLSQLLIKDTSQAMAQNICEILWMKIILDDLKINYENPLRLFWDNNSTISIVHNPVQHDKTKHIEIGRHFIKEKLDNGLITTTYIPSRLQLADVLTKELPMVRFPELDIHLPT

SEQ ID NO: 191062 - protein, 132 aa, Glycine max
  Coding DNA Sequence Number=SeqID_74284
MVGTSVGEGAMEGFTEGHLERASTQLQERAAWLTMAGKLRERFRARGRGAPAESKLEGAATEAVFQNFTMQPYSIILRTSNSLQSVQRVFLLDVADSSSARSSKMDFFGILMGDGFVHGFFGAIGVADTIEG

SEQ ID NO: 191063 - protein, 421 aa, Glycine max
  Coding DNA Sequence Number=SeqID_74285
  Gene Ontology: Mol. function=protein serine/threonine kinase activity; Cellular component=nucleus; Biological process=protein amino acid phosphorylation
  Homolog annotation: Hit_ID=Q1SDM8; Match level="QueryCoverage=87%, HitCoverage=94%, E-value=0.0, Identity=85%"; Hit description =Serine/threonine protein kinase, active site
  Pfam annotation: Domain name=Pkinase; Domain location=70-372; Score =285.5; E_value=1e-82; Accession=PF00069.15; Description=Protein kinase domain
  Pfam annotation: Domain name=Pkinase_Tyr; Domain location=73-372; Score=3.7; E_value=1.1e-12; Accession=PF07714.7; Description=Protein tyrosine kinase
  Pfam module annotation: Pfam domain module=Pkinase::Pkinase_Tyr; Domain location=70-372::73-372
MMSESRCTSKEKSFLIPTLLLQRNNGRKEMENNAESENPKGKGKGIPIHGGKYVRYNILGNHFQVYSKYAPPLQPVGRGAYGIVCCATNSETKEGVAIKKIGNAFDNRIDAKRTLREIKLLCHMEHDNIIKIKDIIRPAERENFNDVYIVYELMDTDLHQIIQSNQALTDEHCQKKYMCARVREVIECVEYFLYQLLRGLKYIHSANVLHRDLKPSNLLLNANCDLKICDFGLARTTSETDFMTEYVVTRWYRAPELLLNCSEYTSAIDIWSVGCILMEIIRREPLFPGKDYVQQLALITELIGSPNDSDLGFLRSDNAKKYVKQLPHVEKQSFAERFPDVSPLAIDLAEKMLVFDPSKRITVEEALNHPYMASLHEINEEPTCPTPFIFDFEQTILNEEDIKELIWKESLNFSQDHQMLE

SEQ ID NO: 191064 - protein, 411 aa, Glycine max
  Coding DNA Sequence Number=SeqID_74286
  Gene Ontology: Mol. function=protein serine/threonine kinase activity; Cellular component=membrane; Biological process=protein amino acid phosphorylation
  Homolog annotation: Hit_ID=Q1SQN8; Match level="QueryCoverage=99%, HitCoverage=99%, E-value=1e-172, Identity=75%"; Hit description =Protein kinase
  Pfam annotation: Domain name=Pkinase; Domain location=94-364; Score =141.0; E_value=3.3e-39; Accession=PF00069.15; Description=Protein kinase domain
  Pfam annotation: Domain name=Pkinase_Tyr; Domain location=94-364; Score=127.1; E_value=4.8e-35; Accession=PF07714.7; Description =Protein tyrosine kinase
  Pfam module annotation: Pfam domain module=Pkinase::Pkinase_Tyr; Domain location=94-364::94-364
MGWFCCPGKSSKKSVTEDYSDTLNQKPINFTATDSVKVDFRVNGNKEDGSKGDQLALDVKSLNLKEEASQDRKDNGNRAQTFSFNELEAATGSFRLDCFLGEGGFGKVYKGHLERINQVVAIKQLDPNGLQGIREFVVEVLTLSLADHPNLVKLIGFCAEGEQRLLVYEYMPLGSLEDHLLGRKPLDWNTRMKIAAGAARGLEYLHDKMKPPVIYRDLKCSNILLGEGYHPKLSDFGLAKVGPSGDKTHVSTRVMGTYGYCAPDYAMTGQLTFKSDIYSFGVVLLELITGRKAIDHTKPAKEQNLVAWARPLFRDRRKFSQMVDPLLEGQYPVRGLYQALAIAAMCVQEQPNMRPVIVDVVTALNYLASQKYDPQLHPAQTSRRSPPSQMMKRDDDDHRHILSIEHETDRS

SEQ ID NO: 191065 - protein, 58 aa, Glycine max
  Coding DNA Sequence Number=SeqID_74287
MELTKQMIPPKRGLVTIRVVKSVVKSVMSFLAAAFTPSAPDQRKEYMKIKNRKMAARG

SEQ ID NO: 191066 - protein, 68 aa, Glycine max
  Coding DNA Sequence Number=SeqID_74288
MATNNSTVHNKKTSFPPKRGQIKAQIFSNLVKIVASKFSKDEKDDDDKNGGDSAISTPPPSAYSSDGV

SEQ ID NO: 191067 - protein, 257 aa, Glycine max
  Coding DNA Sequence Number=SeqID_74289
  Gene Ontology: Mol. function=transcription factor activity; Cellular component=membrane; Biological process=regulation of transcription, DNA-dependent
  Homolog annotation: Hit_ID=UPI000066BAA3; Match level="QueryCoverage =87%, HitCoverage=77%, E-value=7e-40, Identity=37%"; Hit description =Transcriptional regulators, LysR family
  Pfam annotation: Domain name=LysR_substrate; Domain location=48-250; Score=157.5; E_value=3.6e-44; Accession=PF03466.10; Description=LysR substrate binding domain
AGTDAGRAVDRPQCHRRPADYAAQQILPHVRDVFASLQVVRATVSASAGLRAGMLTLGSLGASSSLNILPQLLEMFKARYPGVDVFVTEKPDPEMERALIERRIEIGVVALPKPDFDTLPLVSDELMVVLPQGHPLARLSVIGVKDLAAYPLIMTRAGSQPVITRMFERAGITPRIAHDLSQIMSILEFVRRGQGISVLASLVLPDRYDGLVYRKIGPAVKRRIGLACLNERRLSPAAHAFWTMVREAAPGMTFPVM

SEQ ID NO: 191068 - protein, 256 aa, Glycine max
  Coding DNA Sequence Number=SeqID_74290
  Gene Ontology: Mol. function=endoribonuclease activity; Cellular component=periplasmic space
  Homolog annotation: Hit_ID=Q92QW8; Match level="QueryCoverage=84%, HitCoverage=83%, E-value=1e-63, Identity=51%"; Hit description =PUTATIVE RIBONUCLEASE PROTEIN
  Pfam annotation: Domain name=Ribonuclease_T2; Domain location=70-243; Score=48.7; E_value=8.6e-12; Accession=PF00445.9; Description =Ribonuclease T2 family
  Subcellular localization annotation: CTP_CleavageSite=84; ConfidenceScore=5.08e-01
MKRYAGFIALGLLSLGALWFAQQNPAPTTPADRQTQPQSQTAGNSGPDAPGRSVSQAKPDKRPPPRGSGFDFYVLSLSWSPAFCASSEGSGNRQQCGSDRRYGFVVHGLWPQNENGYPEFCRSDEPERVPDAIGRTMFDIMPSMGLIGHQWRKHGSCSGLSQRDYFSATRAAFEAIRLPERIASGAETATLSADAIETAFTDANPGLSKRGISISCDGKRLEEVRICLNRDMTFRDCPELDRKGCRASSTEIIPIR

SEQ ID NO: 191069 - protein, 113 aa, Glycine max
  Coding DNA Sequence Number=SeqID_74291
MGQLQGLLVKRVPLCHINKRFVSAGWMCEGRITMIHKETPQEQPNWVRPCPPEFELGNWRIAKQPGISVASSISNNESCEGNDTEDLDVDFEQLMNQAEEVEDKDWGLPPELK

SEQ ID NO: 191070 - protein, 71 aa, Glycine max
  Coding DNA Sequence Number=SeqID_74292
MFYPLSKENEIPRELHCQMLSQELLGQTLDNPLRVHPCVPIPLKLLRPQGPTSGSGIKGMSHIISMTHMQQ

SEQ ID NO: 191071 - protein, 93 aa, Glycine max
  Coding DNA Sequence Number=SeqID_74293
  Homolog annotation: Hit_ID=Q9ZW37; Match level="QueryCoverage=37%, HitCoverage=22%, E-value=3e-07, Identity=71%"; Hit description =Expressed protein
  Subcellular localization annotation: CTP_CleavageSite=77; ConfidenceScore=5.92e-01
MSTETFMGRPSSWMTTPPTSSTKFTIAPFANFSLLSFSASPSTSPSFALAFSTHGAICIYGVVLGFVNSLGLNELIDCELPPNLHKGVVLKGD

SEQ ID NO: 191072 - protein, 208 aa, Glycine max
  Coding DNA Sequence Number=SeqID_74294
MLREQELERRRSVRRGEWSEGMPARRSRRQRAQKPVTGTEGWRWQAERRWGLELEDMTHECGGSGSDSGILRRLFCGSDANDDRCNNVNSRSNNNGVNDNDRHSRGIGGDSGNGSNINNDNNNSNDDDTNDDCINVSDDINDSGDERSDIDNSSVKSDCDNDSYESCIGGGGRDIDGDDNNNEGDHVDGGIGVSHENTISNLGSVLFF

SEQ ID NO: 191073 - protein, 90 aa, Glycine max
  Coding DNA Sequence Number=SeqID_74295
MENKESKKAWMEKKTERRRRQREGDETYLGMVAKEKKQRLVMMLECDEHDAQMQTGTDEASSSYCNICRTSFRFLAKTSFDVDPAKNAAR

SEQ ID NO: 191074 - protein, 133 aa, Glycine max
  Coding DNA Sequence Number=SeqID_74296
  Gene Ontology: Mol. function=hydrolase activity, acting on glycosyl bonds; Cellular component=cellular_component; Biological process =carbohydrate metabolic process
  Homolog annotation: Hit_ID=O82019; Match level="QueryCoverage=81%, HitCoverage=27%, E-value=1e-29, Identity=51%"; Hit description =Polygalacturonase precursor
MSFSHSMATLALLLLLASYVKAQASLFDIRKYGVVPNGDITMALQKAWRDACVSTTPSKVVIPSNKYKLRQIDFMGPCKAPIEILVNGIIKAPKNPFDVSGQNQWVRFGYINFLTLSGNGTFHGRGKMAWETK

SEQ ID NO: 191075 - protein, 571 aa, Glycine max
  Coding DNA Sequence Number=SeqID_74297
  Gene Ontology: Mol. function=transporter activity; Cellular component= integral to membrane; Biological process=oligopeptide transport
  Homolog annotation: Hit_ID=Q9M390; Match level="QueryCoverage=99%, HitCoverage=100%, E-value=0.0, Identity=66%"; Hit description =Peptide transport-like protein
  Pfam annotation: Domain name=MFS_1; Domain location=34-516; Score =27.9; E_value=1.7e-05; Accession=PF07690.6; Description=Major Facilitator Superfamily
  Pfam annotation: Domain name=PTR2; Domain location=96-500; Score =477.2; E_value=1.9e-140; Accession=PF00854.12; Description=POT family
  Pfam module annotation: Pfam domain module=MFS_1::PTR2; Domain location=34-516::96-500
MAEEDVYTKDGTVDYRGNRANKKETGTWRACPFILGNECCERLAYYGMSTNLVTYFNTKLNQSGPTASKNNANWGGTCYITPLIGAFVADAYLGRYLTILCFSIVYVIGMTLLTLSASVPGIKPSCDDQGNCHATQAQSAVCFVALYLIALGTGGIKPCVSSFGADQFDDADEAEKEHKSSFFNWFYLSINIGALIAASVLVWVQTNVSWGWGFGIPAVAMAIAVVSFFSGTRLYRNQKPGGSPLTRMCQVIVASIRKSDVQVPNDKSGLYEIEEDSESAIEGSRKLDHTNGLRFLDKAAVLGDSDNVKDPVNPWRLCTVTQVEELKAIIRLLPIWATGIIFSTVYSQMGSYFILQGDTMNNRVGNIKLHISPATLSVFDTISVIFWVPVYDRIIVPVARKFTGRKNGITQLQRMGIGLFISIFAMVYSVILESMRLKMVRRHNYYDREQVPMSLYLQIPPYFIIGCAEVFTFIGQLEFFYEQAPDAMRSTCSALQLLTVSFGSYLSSLLITIVTKVTTRNGGPGWLPDKLNYGHLDYFFLLLTVLSVLNFVAFLQVSKLYSYKNPVGTLH

SEQ ID NO: 191076 - protein, 184 aa, Glycine max
  Coding DNA Sequence Number=SeqID_74298
MTKPRHRHYHSIFLCSSYDRSLSFAMPRKRFQEPQPKTGLQHTQDFLRKIGLGKENYYFWKQIGKALLCTYAVIGAVWVYNETSPLGWWTLKPKPKEELELAHLYERRQFPYPGDEEAMQEFIARGGMIGTTIGPKGMVEGDKDESDYKKELKDKKFGQEAQKLWMRMRSEVIAELQEKGFDVE

SEQ ID NO: 191077 - protein, 213 aa, Glycine max
  Coding DNA Sequence Number=SeqID_74299
MSNVNANVKVSPATFYGAKLLITEKELMDSYVRSSSGDVVQSDCVVESDSKDVADVATRQKGSKKLQKWRGVWNKLGLVQGTERKEDRVREEEGDSGVEVDKPLAESLERLRRVVNVQASEPVGQKLMRSYSVSCRSPCGTDGYATEESENKGSALNGRQELMFQRNRSVRYSPNNPDTGLLRFYLTPTKSYKRSKVGRSSVKDLHSAARSGL

SEQ ID NO: 191078 - protein, 265 aa, Glycine max
  Coding DNA Sequence Number=SeqID_74300
  Gene Ontology: Mol. function=hydrolase activity, acting on glycosyl bonds; Cellular component=cellular_component; Biological process =carbohydrate metabolic process
  Homolog annotation: Hit_ID=O82019; Match level="QueryCoverage=99%, HitCoverage=66%, E-value=8e-93, Identity=58%"; Hit description =Polygalacturonase precursor
  Pfam annotation: Domain name=Glyco_hydro_28; Domain location=2-265; Score=268.3; E_value=1.6e-77; Accession=PF00295.8; Description =Glycosyl hydrolases family 28
MAWKQNNCSTNKNCKKLAMNFGFGFVNNSVIHDITSKDSKYFHVNVFGCKNISFTNFRVSSPAYSPNTDGIHIGKSTQVKITNSKIDTGDDCISLGDGSKEVTILNVTCGPGHGISVGSLGKYSNEDSVEDVIVKNCTLKNTNNGLRIKTWPGTAIISLASDLHFEDITMINVSNPIIIDQEYCPWNQCSKQSPSKIKISKVTFKNIRGTSATQEGITLVCSSGIPCETVELSDINLRFNGTTLVTAKCANVKPKIGRKAPICAT

SEQ ID NO: 191079 - protein, 149 aa, Glycine max
  Coding DNA Sequence Number=SeqID_74301
  Subcellular localization annotation: CTP_CleavageSite=39; ConfidenceScore=5.06e-01
VRITVRYLRVSSGPPPLDDTRARRLWMTQGCRMTKFCLCVSSGAPPLDDTRARRLWMTQGCRMTKFCLCVSSGPPPLDDKRGADNRKARRLWMTQGCRMTKFCLCVSSGPPPLDDKRGQYDKDYGAADKSKALAPTYPPMRNSDLRSSR

SEQ ID NO: 191080 - protein, 131 aa, Glycine max
  Coding DNA Sequence Number=SeqID_74302
FSWAQEGLGVCCLEGSSGTSASTHSSGPHSSSINLHFSVADNSHVVEHPPHPIYNYAKPPTNHYRAPPAYHDVGGLPLTSSLTRGSTSLCLRGESAKDDVATRPSRAGEGNVVEQGDDEDYIADVSVAQTT

SEQ ID NO: 191081 - protein, 329 aa, Glycine max
  Coding DNA Sequence Number=SeqID_74303
  Gene Ontology: Mol. function=ATPase activity, coupled to transmembrane movement of substances; Cellular component=integral to membrane; Biological process=transport
  Homolog annotation: Hit_ID=A0AXF4; Match level="QueryCoverage=97%, HitCoverage=64%, E-value=4e-86, Identity=49%"; Hit description=ABC transporter related precursor
MSPRSVPSTQDATVLGLDRLQCQLEQRRLPCPGLPHQEVDAAAPGVEGRIPDAASIAVAMADMLELDPAAFSVESAGRPRTGNVIDRARDHFKGHVELQQQQVEQHDIADAQVTALIAREQQCEGDDELDRQADAQQRDEADPLQHVGPPAVAHLLGLLFEALDHPRAAAELPQRLHRVHRIADEARILLARFDRRLTMDPCSPRSDGRERDGHRTVAQHDRHHLQVDQRTQCQQGQQDLQCAGNEHHQAKLHHDLQGVAALLPGHLQFGCVVIQEEAVCLLQQPREVAGAGDETQDAGGAEHHRVEQEPSRQFTDAFRADAVDQAREQ

SEQ ID NO: 191082 - protein, 72 aa, Glycine max
  Coding DNA Sequence Number=SeqID_74304
  Gene Ontology: Mol. function=hydroxymethylglutaryl-CoA reductase (NADPH) activity; Cellular component=integral to membrane; Biological process=biosynthetic process
  Homolog annotation: Hit_ID=Q84MM0; Match level="QueryCoverage=65%, HitCoverage=8%, E-value=2e-18, Identity=91%"; Hit description=3 -hydroxy-3-methylglutaryl-coenzyme A reductase
MAGKNAYLRFTCSTGDAMGMNMVSKGVQNVLDFLLNDFPDMDVIGISGLDLSFVNRNDVTIHQCCLLCYMLY

SEQ ID NO: 191083 - protein, 132 aa, Glycine max
  Coding DNA Sequence Number=SeqID_74305
  Homolog annotation: Hit_ID=Q5W7C9; Match level="QueryCoverage=87%, HitCoverage=49%, E-value=2e-28, Identity=75%"; Hit description =Unknow protein
MGESLTEQCRVKVEGLRVMNFFSRRRSNDAAAVRQRMQALSGMIGRKASGSTLDRRWKLPSWSTVGAEGIFGGAVKCVEIGKNPQRAKALCWADTDTEKTKARGANGIRYPSSPSRTPMDTRPLCVSTRAML

SEQ ID NO: 191084 - protein, 132 aa, Glycine max
  Coding DNA Sequence Number=SeqID_74306
  Homolog annotation: Hit_ID=Q5W7C9; Match level="QueryCoverage=76%, HitCoverage=43%, E-value=1e-09, Identity=41%"; Hit description =Unknow protein
  Subcellular localization annotation: CTP_CleavageSite=42; ConfidenceScore=5.14e-01
IARVDTHSGLVSIGVRLGLLGYLIPFAPLAFVFSVSVSAQQSAFARWGFFPISTHLTAPPKIPSAPTVLQLDALRPIIPDNACILCLTAAAGTELADAYSPDTVIASSPGKEVHDPPSVADHPLGPATDHRL

SEQ ID NO: 191085 - protein, 190 aa, Glycine max
  Coding DNA Sequence Number=SeqID_74307
  Pfam annotation: Domain name=zf-CCHC; Domain location=72-89; Score =22.8; E_value=0.00017; Accession=PF00098.13; Description=Zinc knuckle
ENVEANLDWEIRVEQQLKKKSTSKSYGSHSYPKKDQGQGILGVTPSKPKDDKGKAIEKQAPKASMQEKTSSIKCFKCLGKGHITSQCPTTKTMIMRGQDIYSSQDEATTSPSSSESEEEKGEESSEEIYPQEDGQPLVVKKKCKEKNIKETFPLRQPPHLLLCKKTLVSIATPIGLEVIPQVKELLDEGL

SEQ ID NO: 191086 - protein, 116 aa, Glycine max
  Coding DNA Sequence Number=SeqID_74308
  Gene Ontology: Mol. function=nucleic acid binding
MEEGIGLILDLTPKEEKNDRMFQEVSISLPYFHGKNNVEAYLDWEMKVEELFTCHHISEERKVPLATLSFQGYALYWWTSLFKERRIHGDLLVEYWNILRVPFGRGTFPHTMKESL

SEQ ID NO: 191087 - protein, 178 aa, Glycine max
  Coding DNA Sequence Number=SeqID_74309
  Gene Ontology: Mol. function=endonuclease activity
  Homolog annotation: Hit_ID=Q8PA42; Match level="QueryCoverage=50%, HitCoverage=36%, E-value=1e-30, Identity=68%"; Hit description =Endonuclease
  Subcellular localization annotation: CTP_CleavageSite=26; ConfidenceScore=5.63e-01
KASPPAPGSAARRVRSAFRRARGRPVARNRRVRRRSRTARHQRGKGTSTTPGRNAVVQLPAIFPQPSLGGTRAGCHPFPAGRSAQVTPRRLRPGAGRQHVFQRGRCVDRDVARTQQLLQIGDGHQVAVEAAEKGFVGNDPADSLGRAGVRVTGDDGLPEELRCRDAVAGKEVVVETSP

SEQ ID NO: 191088 - protein, 58 aa, Glycine max
  Coding DNA Sequence Number=SeqID_74310
MEEARRVMPSIANKENEWLRVVSCTMSAVNDVKTALNTPTATDIADLPAWADWDHTVS

SEQ ID NO: 191089 - protein, 145 aa, Glycine max
  Coding DNA Sequence Number=SeqID_74311
  Gene Ontology: Mol. function=hydrolase activity; Cellular component =integral to membrane
  Homolog annotation: Hit_ID=UPI00005F71BE; Match level="QueryCoverage =64%, HitCoverage=70%, E-value=5e-24, Identity=58%"; Hit description =COG1380: Putative effector of murein hydrolase LrgA
IKQRAAGEIARVGQVRQQQQWNNDRHGYQQRIDDREVDSGCQTACQQIRHYGDDNRAKLCAEDIGVAHHANADRHKQQRHVADQQLTAGFHPRYRDNLQRQQGKQQQHAKDAAGNGKWQQGSKAVAGIQRGIDDGKGAQIAPAGR

SEQ ID NO: 191090 - protein, 87 aa, Glycine max
  Coding DNA Sequence Number=SeqID_74312
  Gene Ontology: Mol. function=methyltransferase activity; Biological process=mismatch repair
  Homolog annotation: Hit_ID=Q60BC7; Match level="QueryCoverage=90%, HitCoverage=6%, E-value=4e-16, Identity=60%"; Hit description=DNA methyltransferase
  Pfam annotation: Domain name=DUF559; Domain location=2-85; Score =73.4; E_value=7.3e-19; Accession=PF04480.3; Description=Protein of unknown function (DUF559)
MNHTVQPQRALRKAMPQAEQKLWRYLRNRNVCGAKFRRQHPVGGYIVDFACVEQSLIVELDGGQHNTPEDQLTMPGARHIYSAAAGA

SEQ ID NO: 191091 - protein, 85 aa, Glycine max
  Coding DNA Sequence Number=SeqID_74313
  Subcellular localization annotation: CTP_CleavageSite=37; ConfidenceScore=5.55e-01
ISNQPLSLHSLFHGTKKKLKKSGIASHASETSSTAISPAMVTRPCLLFLTPATVSPILLAKHPPRHVANASDGLTLSPIQMAGCM

SEQ ID NO: 191092 - protein, 239 aa, Glycine max
  Coding DNA Sequence Number=SeqID_74314
  Homolog annotation: Hit_ID=Q2KW79; Match level="QueryCoverage=56%, HitCoverage=87%, E-value=5e-59, Identity=77%"; Hit description =Putative ribonuclease inhibitor
  Pfam annotation: Domain name=Barstar; Domain location=125-218; Score=- 2.7; E_value=0.006; Accession=PF01337.8; Description=Barstar (barnase inhibitor)
MDVERLERMNYLVDQAVPRDGGEPVTVRRIQVLTITPSRSLDSLALEHLGDMPAQARALFRVLGVSSDPGRPGGGALMSYLLFESSYTKRLIELGYADTMQPLAHDGLDKKAVVDAAHELGLALFVANCDPARSRSAVLRAIVKAVDFPEYFGGNLDALYDCLCDTVLDHKTGVVLWLYKLHSGDPALEEDAARIESVCADAAEFAHENGRTFAYVVEHAGKHPDPEPGVAAAPYGEND

SEQ ID NO: 191093 - protein, 75 aa, Glycine max
  Coding DNA Sequence Number=SeqID_74315
MKKRTKNVEERLKIFVKIPTETLRKPYGSASARIFFTKMGEMLATQLAQASSACPGKQGDFLQKQPPSGGIFWRA

SEQ ID NO: 191094 - protein, 111 aa, Glycine max
  Coding DNA Sequence Number=SeqID_74316
  Subcellular localization annotation: CTP_CleavageSite=13; ConfidenceScore=5.09e-01
MTPLSSLQNGQVTKSNRTHTLREFPERFAKRIGFPTSNIQSCGFGMTGPLDESISCFLIRVDPWVLVPITLRGLHVLAIRGLHVLNLRGLHALTSRGLHVLALRGLHVLGY

SEQ ID NO: 191095 - protein, 94 aa, Glycine max
  Coding DNA Sequence Number=SeqID_74317
MIILFEISVVSRYSLSAYVTVNRIHEHATCDVTCTRCLSGITRATATSSITPPMMRILKLAKYRLKAQVEKDEDPSGEGQSPQVEKDEGLSGEG

SEQ ID NO: 191096 - protein, 140 aa, Glycine max
  Coding DNA Sequence Number=SeqID_74318
  Subcellular localization annotation: CTP_CleavageSite=31; ConfidenceScore=5.10e-01
IPPLDPNKSNRALGFSALITGLCQSFGVPVTPSKGGNPQAPDASLPPPQADPAGSFDIERAHVQTHDCLYQLSLSLQSQGFASFPCPTLDQFRAEVAWPGDWPEAQAGEAPAEAPGEADEARMDEEMTNLLDFLGGSGAT

SEQ ID NO: 191097 - protein, 70 aa, Glycine max
  Coding DNA Sequence Number=SeqID_74319
AVHVSSTFEFGAVFHDCLREDPQGNPPYSTVIRSTMNKKKEEVEMRVVITEGAGRTKSVSYLCFPLIFDE

SEQ ID NO: 191098 - protein, 283 aa, Glycine max
  Coding DNA Sequence Number=SeqID_74320
  Homolog annotation: Hit_ID=P0A8B2; Match level="QueryCoverage=59%, HitCoverage=92%, E-value=4e-87, Identity=92%"; Hit description =UPF0115 protein yfcN
  Pfam annotation: Domain name=Smr; Domain location=98-173; Score =102.8; E_value=1e-27; Accession=PF01713.11; Description=Smr domain
MKKKTSLSEEDQALFRQLMTGTRQIKQDTLVLRPMRKKISEVPVKRLLQEQADNSHYFSDEFQPLLNTQGAVKYVREDVSHFELKKLRRGDYSPELFLDLHGLTQMQAKQELGALIAACRREHVFCACVMHGHGKHILKQQTPLWLAQHPHVMAFHQAPKEYGGDAALLNYPDRTAGGRVCAPALSHVTSDGFCHLQVARTHLPVEDTFTRFVERNIGNGRCREHRRGFARAQFRYQIANQWQVGNDQRGGDTFIAQRLKISTDKADIATWGEFRENIHTGWQ

SEQ ID NO: 191099 - protein, 285 aa, Glycine max
  Coding DNA Sequence Number=SeqID_74321
  Gene Ontology: Mol. function=chitin binding; Cellular component =extracellular region; Biological process=chitin metabolic process
  Homolog annotation: Hit_ID=UPI000044A8F0; Match level="QueryCoverage =87%, HitCoverage=99%, E-value=1e-44, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
DYTSSSSDGYTPSPSEDYTSLAFRRLQVLTIRGLHVIAIKGLQILSFRGLHVFAFRGLHVLAFRGLHVLAFRGLHVFTIRGLHVLAIRGLQILTFRGLHVLAIRGLHVLLFRGLHAFPFRGLHVLAFRGQHVLAFRGLQVLTIRGLHVIAIKGLQILTFRGLHALTFRGLHVLAFRGLHALTFIGLHALAFRGLHVLTFRGPHVLTFRGLHVLAIKGLHILAFRGLHALAFRGLHILTFRGLHILTFKGRHVLDFRGLHALAFRGLGVLTFTGLHIRILRECGIL

SEQ ID NO: 191100 - protein, 104 aa, Glycine max
  Coding DNA Sequence Number=SeqID_74322
MSFGGSYYALVIIDDYSRFFGRYALSRKKYKRKRNEENKDIQEDIAQENDDLPKEWKTSRNHPLDNIIGDISKGVMSYPNFVRGPLLDDVRPFFGPREVLGTHH

SEQ ID NO: 191101 - protein, 132 aa, Glycine max
  Coding DNA Sequence Number=SeqID_74323
GARRPRARPVEAPSTSAAPPPAHIVAAPSTLPPADFQYSIQTAEQFNEWVAWPGTQPPLHREDEDPAAQDAAATSEKSPEATPEPPTPVANTTSPQQAANPSTPEDQTTPVLSPNTSPVATHVLHLSEEEEG

SEQ ID NO: 191102 - protein, 908 aa, Glycine max
  Coding DNA Sequence Number=SeqID_74324
MASDSDLLTQYSHTRRIVLLIDLTSLHHHHLQDYTKRLVSFFETLISFPPLSSSLFSFKFFFSSLSPLLSFSKLQPFLPNPTLSFNTPSSTLAHLSHTLSSLLSSSFHSFSTPNASHLAESLSQLLHDHSWEHPDDNDHTPHHAIPPNLVLLFSPSFTSLTSLASFLDSDAGLVAHSASFCGRLSLVFSNVSRAFASKGIHCCWISIGSEIGRIETDEAREACCLLETGLGRLGWGFCSLDSILLGSALVPFGLVYPKIGVLWDSVCFSSRDANNVGAQLSLRMLDVKGIPIEYSDCDLEFVDVKVLGGSGDLNLQGGGCGRKERFWKLCLDGGVKLEVKIVQRCDAFVGIEEWLSDSVLVREDFRGLKKKVKGGLDGFFADRVLELVAGEFGCEWRRKQVPVWEILLSFLYREGCWALVSVTNGKGGSCIAILRPFTVFAALLSVLGDPHGACSFGEENVGQYVRMVDNEICGSDGKFNKKEDLLDSQGKKSTAVVEGHQRKKMVDLNTVRDLTWNLFCKLVYDQFETNLLEVYYTMEGNKSKKLRFLKCWIKQMKKSGCSSLALLEKPKPNPIVAEEASSKLNDLTQNAEQPIFSFASAEINPEPEALRIQEDAVLDFRSETSESFFSNLADRINRGIESEVVDTGALAERLVNSSIYWLCQKVDRETISQSQSPLKDHNACGSMIASELMKLLLREPKEIVAKHKSQNPMKSLKFRYSLALEDVVQRIYNKMDLLLFADEDEAPNSLLNSEDSYKPLKKKTYRDEVGENDFSSQPISAENEPFQLQKDGSGRFQRIEDGDHKKLIEAKEKRERAQRFSSFTSSMPVLRRVRATKQKGMKPKTDLLQRVQKRKERERASYGTVCETPMTGNKRSSPRARSSDDDNGLADRSQSYGSVSKALFMDDL

SEQ ID NO: 191103 - protein, 291 aa, Glycine max
  Coding DNA Sequence Number=SeqID_74325
  Gene Ontology: Mol. function=oxidoreductase activity; Cellular component=peroxisome; Biological process=electron transport
  Homolog annotation: Hit_ID=Q2KD39; Match level="QueryCoverage=99%, HitCoverage=76%, E-value=1e-132, Identity=82%"; Hit description=L -lactate dehydrogenase (Cytochrome) protein
  Pfam annotation: Domain name=FMN_dh; Domain location=2-291; Score =169.9; E_value=6.3e-48; Accession=PF01070.8; Description=FMN -dependent dehydrogenase
MAKQRLPGPIFNYIDGAADDEVTYRRNTAAFEKCDLVPDVLRGVADVDMSVTVMGQKLSMPVYCSPTALQRLFHHQGERAVAAAAGKFGTMFGVSSLGTTSLEEARRISGGPQVYQFYFHKDRGLNRDMMARAKSAGVETMMLTVDSITGGNRERDKRTGFAIPFKLNLSGIAQFAMKPAWGINYLTHERFSLPQLDDHIKMDGGALSISRYFTEMLDPSMNWEDVEQMVREWGGPFCLKGIMSGDDARRAVEIGLQRHRALQSCGRQLDGPAALSTSWPRSSMRSVTGLT

SEQ ID NO: 191104 - protein, 141 aa, Glycine max
  Coding DNA Sequence Number=SeqID_74326
QERIHLLWTSSSGGYIHLVVQREKGRVHPLSIFACKGFYKVEKKSQGSQVAWGLDVGTGCCRTSLGESQVDDLGLMVVIWVDDPSFFGFWVDDPVWVGDPEDAEEPFLIVGSSRANLNPFPELRPPLREVPVALGGITTFL

SEQ ID NO: 191105 - protein, 233 aa, Glycine max
  Coding DNA Sequence Number=SeqID_74327
  Homolog annotation: Hit_ID=Q8H6Q8; Match level="QueryCoverage=81%, HitCoverage=6%, E-value=1e-07, Identity=27%"; Hit description=CTV.20
MVKINILFFDWFHAYTIRENLDYPWKQDIIGDLTTNVITNWQIKDGVLIQLELPPATQYQLSKVKDSNDKPVMATPFKTKDVNEEVTSKAIKSPMEQANYTNKYLQVLGETIKEKVSPKQRTHEESTSNVQIEKPLLKPFKVGDKNSELLNKIDSLLKVIPETPQPSEESSKMRTRNTSRLIDVINEDSDQNSEQTTETGFSSQLKGWWDNYLTNDECQTKEEDFSLTYHVMV

SEQ ID NO: 191106 - protein, 437 aa, Glycine max
  Coding DNA Sequence Number=SeqID_74328
  Gene Ontology: Mol. function=RNA-directed DNA polymerase activity; Cellular component=intracellular; Biological process=RNA-dependent DNA replication
MKYADLLPALLAKNLVQVRTPPRTPDVLPPWFRHDLTCAFHQGAPGHDVENCYVLKNEVQKLVRANLLSFKDQNPNVQANPLPNHGPTVNMIQDCGEEGVILNVQHIRTPLVPIHIKMCEAALFDHDHAACEICPVNVKGCPKVQEDIQGLIDSRELTITRKDREVYVITPEFQRLEISYNSGESTTTPLVISLPGPMPYASLKAVPYKYSATMLEGGQEVPLPSPTPAISVDNIASDGKVLRNGRVIPTLFAKKVNDPAVKQATVNGPGTRKEVGQSNGTSKNSDHDEILKLIQKSEYKVVDQLLQTPSKISILSLLLNSEAHREALMKVLDQAFVERDVTVNQLDSIVGNITACNNLSFSDEELPEEGRNHNLALHISVNCKSDALSNVLVDTGSSLNVMAKSTLDQLSYRGPPMRRSGVVVKAFDGSRKSVIGE

SEQ ID NO: 191107 - protein, 72 aa, Glycine max
  Coding DNA Sequence Number=SeqID_74329
MAPKKLSTKRSRRDAAAEGSSAAPEFDSHHFRSAEHQQRFEAIRGWSFCRERRVQLREDEYTDFQKEIARRR

SEQ ID NO: 191108 - protein, 196 aa, Glycine max
  Coding DNA Sequence Number=SeqID_74330
MIESFQQQQEMGVIELCVEVDVVGASTLNVTNSLLSCGNNIAGNESKVQRFVINLDDDSDDDDYMISNSYVEDSLDKEEDIDDISNTDEEGGSETAFWESASNYSNINWSHPDEEDICGFNMGSTFNIGQELFVDMEFESKNAVKNTLQQYVMKVHQTFNVVESKSQKYVVCCANRNDDISCPFYTRAIVSKKTDT

SEQ ID NO: 191109 - protein, 57 aa, Glycine max
  Coding DNA Sequence Number=SeqID_74331
TAIARKHGGVWWAVVFEFGKGTTVESVTDYNSVRVNVMCPVLLNSDQSATRSRYWVR

SEQ ID NO: 191110 - protein, 152 aa, Glycine max
  Coding DNA Sequence Number=SeqID_74332
MTYKYNTLYIFGLEKSSKIHKDSKCTKQKCSNRAGHRSANLFSGTAKGVASDGGSCGDSAGARSGDTAGVRRGAETLLVRGAAASGDAAGRGSIRGRGTEQRSGLFMQSLVSPDLFSSLHIGSSIQDQGQPTWPCIMALWGLSHPNEGSYRA

SEQ ID NO: 191111 - protein, 150 aa, Glycine max
  Coding DNA Sequence Number=SeqID_74333
MANINAKWLQRNSQPRGPGRMPLEKVPVRPCRQIWTLMDTGSGVQNTNNGLRPLKAGHSSKRAKFDPEIVMEFYANAWPTEEGVTDMRSWVRGQWIPFDGMPSISFWGIHWFWRKASVVSSPRGGFRPPALMRSLSVSCYAFRGRTLPRA

SEQ ID NO: 191112 - protein, 36 aa, Glycine max
  Coding DNA Sequence Number=SeqID_74334
MPILGKELWRQQEEQLLQRYQGDISIGKCTVALELE

SEQ ID NO: 191113 - protein, 463 aa, Glycine max
  Coding DNA Sequence Number=SeqID_74335
  Homolog annotation: Hit_ID=Q10BI2; Match level="QueryCoverage=31%, HitCoverage=79%, E-value=5e-13, Identity=29%"; Hit description =Expressed protein
  Pfam annotation: Domain name=DUF567; Domain location=5-171; Score =91.4; E_value=2.7e-24; Accession=PF04525.3; Description=Protein of unknown function (DUF567)
MANKFSVISPSYCVPNSLNLQINTEKGVTYDVKGNRVFYIEDTLFTFHGRRVLCDDKGSPIVTLYKKNVTLHGQCKVFRGNSNGPSELLFSVKRSSIIPSGKMIRLDVFLENKRKGSMCDFRVIVRGSKNSCTIYAGESPTIVAKMENNGGFKVLVYPNVDYAFIVTLLMIIDDIKDYDVLVNATVSSVLTVATGGILPILTLFEGENLEEETLDGENLEEEYLQEGENNSGGENLDGENNPERENLEEETLDGENLEEEYLQEGENNSGGENLDGENNPEGENLEEETLDGENLEEEYLQEGENNSGGENLDGENNPEGENLEEETLDGENLEEEYLQEGENNSGGENLDGENNSEGENLEEETLDGENLEEEYLQEGENNSGGENLDGENNPEGENLEEETLDGENLEEEYLQEGENNSGAENLDGENNPKGENLDGENNPEGENLNGENLEVENNFEAET

SEQ ID NO: 191114 - protein, 311 aa, Glycine max
  Coding DNA Sequence Number=SeqID_74336
  Homolog annotation: Hit_ID=Q47522; Match level="QueryCoverage=16%, HitCoverage=62%, E-value=2e-21, Identity=94%"; Hit description=LacZ protein
  Pfam annotation: Domain name=ATP-synt; Domain location=108-286; Score= -168.4; E_value=0.018; Accession=PF00231.9; Description=ATP synthase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIRGMCGGLNINLFKTVMTEIKQWKDKGVTVELGLIGSKGISFFRSLGLLKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 191115 - protein, 133 aa, Glycine max
  Coding DNA Sequence Number=SeqID_74337
GYRLLVVRGGISGSAADPNYPSGDSRRSVNYWDIGEFLSSYWNFPRYMSYCINTENRKLHFIKRDSERVALKRTGEPLEVSDLTDDLVLELELTSIAKLLFGELRKCRLKVKLPAFLSRSRYYYSYDFLTGNG

SEQ ID NO: 191116 - protein, 453 aa, Glycine max
  Coding DNA Sequence Number=SeqID_74338
  Gene Ontology: Mol. function=RNA-directed DNA polymerase activity; Cellular component=intracellular; Biological process=RNA-dependent DNA replication
PVEHNNPALSPNFESSVYEAEEEEDDEIPEELARLLEYEKKTIRPHEEVVEVINLGTKEDKKEVKIGASLEATVKRRVIELLKEYADVFAWSYQDMPGLDPCIVEHRLPLKPECSPVKQKLRRTRPDMALKIKEEVQKQIDAGFLVTSEYPQWLANIVPVPKRDGKVRMCVDYRDLNKASPKDDFPLPHVDVLVDSAAKSRVFSFMDGFSGYNQIKMAVEDREKTSFITPWGTFCYRVMPFGLINAGATYQRGMTTLFHDMMHKEIEVYVDDMIVKSGTEEEHVEYLLRMFQRLRKYQLRLNPNKCTFGVRSGKLLGFIVSQKGIEVDPDKVKAIREMPIPQTEKQVRGFLGRLNYISRFISHMTATCGPIFKLLRKDQGVIWTEDCQKAFDSIKNYLLEPPILIPPVEGRPLIMYLTVLEDSMGCVLGQQDETGRKEHAIYYLSKKFTDCES

SEQ ID NO: 191117 - protein, 75 aa, Glycine max
  Coding DNA Sequence Number=SeqID_74339
MAKIQGSKEGKTYSNIYKEEWTQPWPMGTSLLIQLPLECECKPLVCLLKQPALLSVDFQDRSIRVYSSCTLVGVP

SEQ ID NO: 191118 - protein, 304 aa, Glycine max
  Coding DNA Sequence Number=SeqID_74340
  Homolog annotation: Hit_ID=Q10BI2; Match level="QueryCoverage=47%, HitCoverage=79%, E-value=6e-12, Identity=28%"; Hit description =Expressed protein
  Pfam annotation: Domain name=DUF567; Domain location=50-213; Score =88.9; E_value=1.6e-23; Accession=PF04525.3; Description=Protein of unknown function (DUF567)
MVVPITVGGSENNNSQISGLCKLAYEPTEYVVKSTGFMGQTQVLPIVMWVKKSSPSYCAPKALNLQINTKKGVTYDVKGNRVFYIKDTLFTFHGRRVLCDDKGNPIVTLYKKNVTLHGQCKVFRGNTSELLFSVKRSSIIPSGNMLRLDVFLGNKRKGSMCDFRVIVRGSKNSCTIYAGESPTIVAKMENNGGFKVLVYPNVDYTFIVALLMIIDDIKDYDVLVNASVSSILTVATGGILPILTLFEGENLEEETLDGENLEEEYLQEGENNSGGENLDGENNPKGENLDGENLEVENNFEAET

SEQ ID NO: 191119 - protein, 210 aa, Glycine max
  Coding DNA Sequence Number=SeqID_74341
  Gene Ontology: Mol. function=nutrient reservoir activity; Cellular component=apoplast; Biological process=auxin mediated signaling pathway
  Homolog annotation: Hit_ID=Q9M3Y4; Match level="QueryCoverage=88%, HitCoverage=90%, E-value=3e-54, Identity=58%"; Hit description =Germin-like protein
  Pfam annotation: Domain name=Cupin_1; Domain location=55-200; Score =91.0; E_value=3.6e-24; Accession=PF00190.13; Description=Cupin
  Pfam annotation: Domain name=Cupin_2; Domain location=90-165; Score =43.3; E_value=8.1e-10; Accession=PF07883.2; Description=Cupin domain
  Pfam module annotation: Pfam domain module=Cupin_1::Cupin_2; Domain location=55-200::90-165
  Subcellular localization annotation: CTP_CleavageSite=91; ConfidenceScore=5.43e-01
MKNMFLILFFSALLISSTSNASNVNDFCVADLKGTNSPSGSNCKPADTVTANDFVFTFQPANTSNPIKTGISTAFLKDFPALNGLDISAVRVVIDKDGFIPLHSHPHATELIIVVEGQITAGFMAATKAYVTKTLKPGDLMVIPPGQLHFLANYDQRRATVFAAFSSSNPTVHSFNNIFANNVPSNVLAQTTFLDVAQVKKLKARFGGRN

SEQ ID NO: 191120 - protein, 145 aa, Glycine max
  Coding DNA Sequence Number=SeqID_74342
MSLIVRHGPSEISMQWQWSRLFHMGLHGLALDTTCLGIKSIHIHTCFHHRRESHHTVLIHISPQPRPRASGVQMLDYVSGVVYSYQRLMDMRVVPKGINSHQVKQQLLLMAHDGLAAGCRSLRSSRGRKPTKVAEEVAIRALEDI

SEQ ID NO: 191121 - protein, 188 aa, Glycine max
  Coding DNA Sequence Number=SeqID_74343
  Gene Ontology: Mol. function=nutrient reservoir activity; Cellular component=apoplast; Biological process=auxin mediated signaling pathway
  Homolog annotation: Hit_ID=Q9M3Y4; Match level="QueryCoverage=95%, HitCoverage=86%, E-value=3e-46, Identity=54%"; Hit description =Germin-like protein
  Pfam annotation: Domain name=Cupin_1; Domain location=31-178; Score =107.7; E_value=3.5e-29; Accession=PF00190.13; Description=Cupin
  Pfam annotation: Domain name=Cupin_2; Domain location=67-143; Score =37.6; E_value=4.4e-08; Accession=PF07883.2; Description=Cupin domain
  Pfam module annotation: Pfam domain module=Cupin_1::Cupin_2; Domain location=31-178::67-143
MVEEGYLKGPDSLSGYPCLPPTTLTDDNFVFNLQPANTSQFPTIKAGISTAFVNEFPALNGLDISVAHVAFEKDGFFPMHSHPDATELIILVEGEITAGFVTGMNSIAYLKTLKPGDLMVIPPGHLHFVANSGNEKATGFATFSSSNPTIHSFNNIFANNIPSDILAQATFLDVAQVKNLKARFGGSN

SEQ ID NO: 191122 - protein, 185 aa, Glycine max
  Coding DNA Sequence Number=SeqID_74344
  Pfam annotation: Domain name=DUF1723; Domain location=20-69; Score =14.7; E_value=0.0093; Accession=PF08330.1; Description=Protein of unknown function (DUF1723)
MKRYVDRSRLKGLYDARYMSTNKGVVNVFIERWHSVTSSFHLSIREMTITLNYLSCLLHLSIIVCFLDQTDTTYATKEIRGLVRLELGIMMDQEVDVATSSSNKVPLSLLESLITVTFPMSHLFGLPRLLLDAKNIFHVLQAWVFEPFSTIPCSEKVLDHDRKHRNMPLRGTNKVVGTRELLDRL

SEQ ID NO: 191123 - protein, 65 aa, Glycine max
  Coding DNA Sequence Number=SeqID_74345
MADQLQLIFGLTDPYMANYVVLIGSKQTQIHKTSSNWGFDDMAMAPVVPVPPALVKKPLNHNMLT

SEQ ID NO: 191124 - protein, 332 aa, Glycine max
  Coding DNA Sequence Number=SeqID_74346
  Gene Ontology: Mol. function=binding; Cellular component=ubiquitin ligase complex; Biological process=protein ubiquitination
  Homolog annotation: Hit_ID=Q9ASI0; Match level="QueryCoverage=93%, HitCoverage=85%, E-value=7e-41, Identity=35%"; Hit description =Putative arm repeat-containing protein
  Pfam annotation: Domain name=Arm; Domain location=111-153; Score =30.2; E_value=7.3e-06; Accession=PF00514.13; Description =Armadillobeta-catenin-like repeat
  Pfam annotation: Domain name=Arm; Domain location=154-197; Score=9.8; E_value=0.73; Accession=PF00514.13; Description=Armadillobeta-catenin- like repeat
  Pfam annotation: Domain name=Arm; Domain location=200-240; Score=4.1; E_value=3.7; Accession=PF00514.13; Description=Armadillobeta-catenin -like repeat
  Pfam annotation: Domain name=Arm; Domain location=28-68; Score=28.0; E_value=3.3e-05; Accession=PF00514.13; Description=Armadillobeta -catenin-like repeat
  Pfam annotation: Domain name=Arm; Domain location=70-110; Score=24.8; E_value=0.00031; Accession=PF00514.13; Description=Armadillobeta -catenin-like repeat
  Pfam module annotation: Pfam domain module=Arm::Arm::Arm::Arm::Arm; Domain location=111-153::154-197::200-240::28-68::70-110
MEKEVVESLWNGNTEMQIQAAVELRKLSRKQRHNLVESGVMVPLISMLHYENYEAIEAALCALLSLAFGSERNKSRIIKSGALPVLLSLFHCQSQTVAELTIATLLTISSCNSNKVAIASSGAIQLLAQFLNSTSSSTQFQLDTLATLHNLSTCQEIITPFVVSSGVIISLLELIHTSEKSSTLVEKAIGLLEHIVTSSKSALCEAASIGGAVRTLVETIEDGSLQSKEHAVGTLLLFCQSSREKFRGMILREGVMPGLLQLSVDGTWRAKNLAKKLLLLLRDCSNYSSTSNKQINYEVVERIMEEIDDAEGEELAETTLRLVEEMIAKLST

SEQ ID NO: 191125 - protein, 214 aa, Glycine max
  Coding DNA Sequence Number=SeqID_74347
  Gene Ontology: Mol. function=nutrient reservoir activity; Cellular component=apoplast; Biological process=auxin mediated signaling pathway
  Homolog annotation: Hit_ID=Q9M3Y4; Match level="QueryCoverage=95%, HitCoverage=98%, E-value=4e-54, Identity=54%"; Hit description =Germin-like protein
  Pfam annotation: Domain name=Cupin_1; Domain location=57-204; Score =105.8; E_value=1.3e-28; Accession=PF00190.13; Description=Cupin
  Pfam annotation: Domain name=Cupin_2; Domain location=93-169; Score =37.6; E_value=4.4e-08; Accession=PF07883.2; Description=Cupin domain
  Pfam module annotation: Pfam domain module=Cupin_1::Cupin_2; Domain location=57-204::93-169
MMMKNKVLILFFSALLSSTSYASNVNDFCVADLKGPDSLSGYPCLPPTTLTDDNFVFNLQPANTSQFPTIKAGISTAFVNEFPALNGLDISVAHVAFEKDGFFPMHSHPDATELIILVEGEITAGFVTGMNSIAYLKTLKPGDLMVIPPGHLHFVANSGNEKATGFATFSSSNPTIHSFNNIFANNVPSDILAQATFLDIAQVKKLKARFGGSN

SEQ ID NO: 191126 - protein, 104 aa, Glycine max
  Coding DNA Sequence Number=SeqID_74348
MAERGLGMYYTPPTFSQYPTQMYQYPFKGHHTDISASKHSFGGVAETHLHFSWSTMTPSQQHDAPIPTPNAPLGTQWNVPRAIPDIGDLLGADLRHQFFAEADQ

SEQ ID NO: 191127 - protein, 176 aa, Glycine max
  Coding DNA Sequence Number=SeqID_74349
  Gene Ontology: Mol. function=iron-sulfur cluster binding; Cellular component=cytoplasm; Biological process=lipoate biosynthetic process
  Homolog annotation: Hit_ID=Q8LEL1; Match level="QueryCoverage=83%, HitCoverage=42%, E-value=5e-49, Identity=59%"; Hit description =Sucrose cleavage protein-like
  Pfam annotation: Domain name=Suc_Fer-like; Domain location=11-159; Score=84.7; E_value=2.9e-22; Accession=PF06999.3; Description =Sucraseferredoxin-like
MVYLCRGISPHFSFVHRWKFCTCLNRGLEESNVDGFFEDVLVNGKPWTAGVPEVFSGSHVYVCAHGSRDVRCGVCGPVLIKKLHEEIELRGLKDQISVTACSHIGGHKYAGNVIIYSPRADGKIMGHWYGYVTPNDVPDLLDQHIAKGEVIQRLLRHVGLKSFGSPGIKLERPTYC

SEQ ID NO: 191128 - protein, 105 aa, Glycine max
  Coding DNA Sequence Number=SeqID_74350
MSLLAIEAWNRIRVVFSQSSNQKGSYALVGHLSEIKLTLLASLESKTHKELEGTSYNSQWTPHHLSGSTNSYMVDSENVSLGNYYELSVEYDMNLLDGRWIEGTW

SEQ ID NO: 191129 - protein, 74 aa, Glycine max
  Coding DNA Sequence Number=SeqID_74351
  Gene Ontology: Mol. function=RNA binding
  Homolog annotation: Hit_ID=Q8LBT7; Match level="QueryCoverage=72%, HitCoverage=13%, E-value=1e-09, Identity=61%"; Hit description=Rev interacting protein mis3-like
MGLLVHARISIQNPKFAFDCDNAQVEGSMTVSTTRKTRDPYIIIKTRDLTKLLSPSILAPQLKLNNRIITILLH

SEQ ID NO: 191130 - protein, 59 aa, Glycine max
  Coding DNA Sequence Number=SeqID_74352
MVILLTGTHGFCSPKPPLVAFACHFWYSYSLQQGMALGLCCILKQWGMPRCPHSLAIHA

SEQ ID NO: 191131 - protein, 91 aa, Glycine max
  Coding DNA Sequence Number=SeqID_74353
MVKLAKINTKSGVKDKAWMTIWRSQLALQLVCMVYTKLLHTNRGLGGLLETPNCLCSIVLDNTIQESLRLILILKSSHNFAPQLNFFIGII

SEQ ID NO: 191132 - protein, 90 aa, Glycine max
  Coding DNA Sequence Number=SeqID_74354
  Gene Ontology: Mol. function=hydrolase activity, acting on ester bonds; Cellular component=cellular_component; Biological process =lipid metabolic process
  Homolog annotation: Hit_ID=Q7Y1X1; Match level="QueryCoverage=65%, HitCoverage=15%, E-value=4e-18, Identity=71%"; Hit description =Esterase precursor
MGLLRNFVVVTVIALSEFLSIGAGETNSSSQTCDFQAIFNFGDSNSDTGCMSAAFYPAALPYGETFFNEAAGRASDGRLIIDFIVTNFII

SEQ ID NO: 191133 - protein, 236 aa, Glycine max
  Coding DNA Sequence Number=SeqID_74355
  Gene Ontology: Mol. function=hydrolase activity, acting on ester bonds; Cellular component=cellulose and pectin-containing cell wall; Biological process=lipid metabolic process
  Homolog annotation: Hit_ID=Q9LY84; Match level="QueryCoverage=94%, HitCoverage=56%, E-value=2e-67, Identity=52%"; Hit description=Early nodule-specific protein-like
  Pfam annotation: Domain name=Lipase_GDSL; Domain location=1-217; Score=65.0; E_value=2.4e-16; Accession=PF00657.12; Description=GDSL -like LipaseAcylhydrolase
MYCLRQGNSFPRPEDFAKAIYTFDIGQNDIAAALQRMGQENTEAAISDIVDQLSNQLIYLYTQGARTFWIHNTGPIGCLPVSMPKHIAYNYTPAEGYLDQNGCVVYANDVAKEFNRKLNDTVVKLRTLYLDASFVYVDMFSAKYQLISNAKKEGFVDPSEICCGYHEGGNHFFCGNYNATVNGTEIYAGSCKSPSSHISWDGVHYTDAANSWIANRIVTGSFSNPQLPITRSCLLA

SEQ ID NO: 191134 - protein, 342 aa, Glycine max
  Coding DNA Sequence Number=SeqID_74356
  Gene Ontology: Mol. function=hydrolase activity, acting on ester bonds; Cellular component=cellulose and pectin-containing cell wall; Biological process=lipid metabolic process
  Homolog annotation: Hit_ID=Q9LY84; Match level="QueryCoverage=96%, HitCoverage=91%, E-value=1e-133, Identity=64%"; Hit description =Early nodule-specific protein-like
  Pfam annotation: Domain name=Lipase_GDSL; Domain location=19-323; Score=227.2; E_value=3.6e-65; Accession=PF00657.12; Description=GDSL- like LipaseAcylhydrolase
MGIGGVEPKASPTCTFPAVYNFGDSNSDTGGISASFVPIPAPYGEGFFHKPSGRDCDGRLIVDFIAEKLNLPYLSAYLNSLGTNYRHGANFATGGSTIRKQNETIFQYGISPFSLDIQIVQFNQFKARTKQLYEEAKAPHEKSKLPVPEEFSKALYTFDIGQNDLSVGFRKMNFDQIRESMPDILNQLANAVKNIYQQGGRYFWIHNTSPFGCMPVQLFYKHNIPEGYLDQYGCVKDQNVMATEFNKQLKDRVIKLRTELPEAAITYVDVYAAKYALISNTKKEGTDNGKDVFGSACENPSQYISWDSVHYAEAANHWVANRILNGSYTDPPTPITQACYRH

SEQ ID NO: 191135 - protein, 173 aa, Glycine max
  Coding DNA Sequence Number=SeqID_74357
  Homolog annotation: Hit_ID=Q1SKD7; Match level="QueryCoverage=90%, HitCoverage=41%, E-value=4e-15, Identity=31%"; Hit description =Ankyrin
MAPRKLASKRSRKDKAAEGTSSAPEYDSHRFRSVVHQQRFEAIKGWSFLRERRVQLRDDEYTDFQEEIGRRRWASLVAPMAKFDPEIVLEFYANAWPTEEGVCDMRSWVRGQWIPFDADAIGQLLGYPLVLEEGQECEYGQRRNRSDGFDEEAIAQLLYMDDVAPQQHPAQRS

SEQ ID NO: 191136 - protein, 252 aa, Glycine max
  Coding DNA Sequence Number=SeqID_74358
  Gene Ontology: Mol. function=hydrolase activity, hydrolyzing O -glycosyl compounds; Cellular component=periplasmic space; Biological process=metabolic process
  Homolog annotation: Hit_ID=Q4UYN7; Match level="QueryCoverage=98%, HitCoverage=36%, E-value=1e-112, Identity=78%"; Hit description =Soluble lytic murein transglycosylase
  Pfam annotation: Domain name=SLT; Domain location=163-251; Score =33.7; E_value=6.3e-07; Accession=PF01464.10; Description =Transglycosylase SLT domain
MSRGDWPAALTAIRKMAGKQRSDPRWRYFEGRMLEKTGQAQQAQPLFREAARAPTFHGFLAADKLQQGYTLCPWKPNDSAQAQAVVARDPAIQRAMALYQIDRAGWAVAEWNSALSRFDDTQRRLAVRVAQDNGWFDRAVFALGKQPQEQRLYDLRFPLHHDATIRRESARNAVDPAWVAAEIRAESTFTPRARSPANAMGLMQVLPATGAGVAKSIGLTGYGGADSLYDPDTNIAIGTAYLRQLMNKYDGL

SEQ ID NO: 191137 - protein, 134 aa, Glycine max
  Coding DNA Sequence Number=SeqID_74359
MAEAVTQFMSRQQKSFVEAAAQEKSPLKEHEEQAQQQWEKYSTVKNQQENILQSDNLPHQLIDKKGRQAEHEETLSAILSLITNTFLEIPFAKHKPHAKCISVHALSRESQALSTQPLHLRLIWSAKLAMVELS

SEQ ID NO: 191138 - protein, 251 aa, Glycine max
  Coding DNA Sequence Number=SeqID_74360
  Gene Ontology: Mol. function=RNA-directed DNA polymerase activity; Biological process=RNA-dependent DNA replication
  Homolog annotation: Hit_ID=Q8H6Q8; Match level="QueryCoverage=84%, HitCoverage=50%, E-value=3e-25, Identity=31%"; Hit description=CTV.20
TSEEETETATSSSVLSDENLNLIQQDDQLSSTDDDDKQINTLTREQDLLFEAINSIPDPQEKKVFLEKLKKTLEVKPRQKDFITNNKFDVSNILKRLENSSTKPTTIQDLQTEINNLKREVKELRQQQEIHQIILSQLEEESDSENTNSEENQPENLEDDMFMGLINKIKIQKFYINIKIIINDFVLETMALFDTGADSNCILEGLIPIKFFEKTSEKLSTTNGSKLKINFKLSNAIIENQGLRINTNFLL

SEQ ID NO: 191139 - protein, 41 aa, Glycine max
  Coding DNA Sequence Number=SeqID_74361
MGPSGLSEYGGDHTLSAGFELSMPLDFFVSLLRAKLALAAK

SEQ ID NO: 191140 - protein, 122 aa, Glycine max
  Coding DNA Sequence Number=SeqID_74362
MANLVEDEGRNGDDKQELEAPYPLVPSKKDKERHLARFLDIFKKFEITIPFGEEMAPKKLSAKRARRATAWEGSSTALQAEIEFDGYHFRSEEHQRCFEAIKDWSFLKERWVQLTEGEYIEF

SEQ ID NO: 191141 - protein, 73 aa, Glycine max
  Coding DNA Sequence Number=SeqID_74363
IYVSSIFGPDVLDIVSDIMDPAAFVLPCALCSNSSIFGQDVLDIVSDIVDPAASILHLTFYLALCIVQPDLIL

SEQ ID NO: 191142 - protein, 163 aa, Glycine max
  Coding DNA Sequence Number=SeqID_74364
  Homolog annotation: Hit_ID=Q9LTY5; Match level="QueryCoverage=76%, HitCoverage=43%, E-value=5e-44, Identity=68%"; Hit description =Arabidopsis thaliana genomic DNA, chromosome 3, TAC clone:K1G2
  Pfam annotation: Domain name=DUF1325; Domain location=9-163; Score= -54.1; E_value=0.00044; Accession=PF07039.2; Description=Protein of unknown function (DUF1325)
MVLLVSISGKHDLMFSYSYILYSCLCILLMIVFCHFVAAPEVVEKPGDNSLARLKFLYTQAKDLSESEASISNLLINQIDALLPTGPQGQTRRRIGKEGNEQKRKRVKTESDISRLTPNMRSQLEACASLKGEQVAARVTPRNADKDEWFVVKVIHFDKESKE

SEQ ID NO: 191143 - protein, 216 aa, Glycine max
  Coding DNA Sequence Number=SeqID_74365
  Gene Ontology: Mol. function=RNA-directed DNA polymerase activity; Cellular component=aminoacyl-tRNA synthetase multienzyme complex; Biological process=RNA-dependent DNA replication
  Homolog annotation: Hit_ID=Q8H6Q8; Match level="QueryCoverage=62%, HitCoverage=50%, E-value=2e-55, Identity=76%"; Hit description=CTV.20
MVDLPYEKDFREKQIPTKARPIQMNEELLQYCQREIKDLLDKGLIRKSKSSWSCAAFYVNKQEELERGTPRLVINYKPLNQALQWIRYPIPNKKYLLNRLNSTKIFSKFDMKSGFWQIQIQESDRYKTFFTVPFGLKKNPPAWSNIHTQTVKDIKLKVQSIKCLYLPIPQAFKIVEIDASDIEYIKGTSNSLPDYLTRDSYRETVMSPKPRTTLRE

SEQ ID NO: 191144 - protein, 205 aa, Glycine max
  Coding DNA Sequence Number=SeqID_74366
MTTVFTTNMIVITVTIDDNDDHNGSNDDYDGGNNNFMTTITVVMVVIVVDLRIKLKYLVTFTLGLDQKDNIDAALLIKEQGKVGEGRERREKMSTKFGDMVWSLSSGCSQEWSWRSWERDSARWEVLRVKKEWKEEKEDERVWERCARVEEGVSKERVGLGRKGWSLEKKRRWEREEKKSLKEKREEESGGKEIRVSKKEMRHFV

SEQ ID NO: 191145 - protein, 118 aa, Glycine max
  Coding DNA Sequence Number=SeqID_74367
  Homolog annotation: Hit_ID=Q9LTY5; Match level="QueryCoverage=31%, HitCoverage=13%, E-value=5e-09, Identity=73%"; Hit description =Arabidopsis thaliana genomic DNA, chromosome 3, TAC clone:K1G2
MSSPDIVSILENSKEFDRVRKEQEDILSEINKLHKKLQAMLHLLRFCDPNGSSCSLVLTSVKNIDRSASEEKWIKWKIRGVEHDSLKLLEIVSRPQVGLGSEMAQQNPGFSFMAWICI

SEQ ID NO: 191146 - protein, 357 aa, Glycine max
  Coding DNA Sequence Number=SeqID_74368
  Pfam annotation: Domain name=Transposase_23; Domain location=243-298; Score=-8.9; E_value=0.011; Accession=PF03017.5; Description=TNP1ENSPM transposase
MYPIEWYMKVLKGYTNNQYRLEASIVERYVTKEAIEFCLEYIQTTTPVGLPKSHHDCTRGGGGTQGFNVVTMNHQQLSQAHLYILNNTTEVISYIDTHKQNLTVTHPKMNIMKVLQEHNRTFINWTSLSSWQNKRDKCFTSKICVTQDGSIVLQGRPTGISHQNDASALDIIETHSFSQQMPYINAEHKEEDGSFVSHGHDDILNTAIGRPENLGHVHAVGTGVTINQYFRQVSHGSNIFSASISPQQLVDIIRNLKEEWRREGDDVVKVNVAKVYDDDAQVPFPTSEIQYVRQALDTFIAWSTHLVKLVSYEKNPQKPVEPGERFNTIAGVDPLGELFKNLYDVYQKSVELSWDAT

SEQ ID NO: 191147 - protein, 62 aa, Glycine max
  Coding DNA Sequence Number=SeqID_74369
  Gene Ontology: Cellular component=cytoskeleton; Biological process =transport
  Homolog annotation: Hit_ID=Q94IP9; Match level="QueryCoverage=95%, HitCoverage=14%, E-value=3e-19, Identity=65%"; Hit description=WD-40 repeat protein
MALIGEALKWQQHQAAVKQDVDDMYPTTLSHTIKFGTKSHAECACFSPDGQLLVSCSVDGIT

SEQ ID NO: 191148 - protein, 966 aa, Glycine max
  Coding DNA Sequence Number=SeqID_74370
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=85%, HitCoverage=96%, E-value=0.0, Identity=46%"; Hit description =Receptor-protein kinase-like protein
  Pfam annotation: Domain name=Pkinase; Domain location=620-892; Score =112.9; E_value=9.1e-31; Accession=PF00069.15; Description=Protein kinase domain
  Pfam annotation: Domain name=Pkinase_Tyr; Domain location=620-892; Score=147.5; E_value=3.6e-41; Accession=PF07714.7; Description =Protein tyrosine kinase
  Pfam module annotation: Pfam domain module=Pkinase::Pkinase_Tyr; Domain location=620-892::620-892
MAVATCHEIANGSCNLPFGLQTLQPAAKACTLELASLTGGSIFQLYRQWQGRFVPVHVQVAAVSGDSRQQQQTRQSHWRTPDGEICRLGSALRRLEVFHLLASISLLMDTSGTRIALGTILPILLLCLPYFSIAVDVIYRPVELLSINCGSSSNFSTLDGRNWTADIKFLSENKDSVAASALTPSTQQGPYTYARFSHSQFTYSFPVSAGPKFLRLFFYSTSYQNFDRSKSDFSVKAGPYTLLHDFNASLNADAGDEPGNYLFREYCINLKDGERLNITFIPSTTDSYAFINGIEVVSMPPYLYYTNLDDNTGFPQIVGGVTYTIESKSALEKIYRLNVAGTNIPPTGDTGMLRTWEADDNYVTTQSNISVDFGGITKLSFTTATENYTAPDKVYRSSRSMGTSGSLNMGFNLTWQLPVDSGFTYLLRLHFCQLDPHVHQAGDLEFYIYIADQLATDRADVLLWTINQKAVPVVTDYIVSIPVNQKKPNISLKLHPHPKSRIKDAQLNGIELFKINHSTGNLAGPNPDPHPKTFEFPLQSKNKKSKGRTGTITAAVAGAVSGVVMLSLIVAFFLIKRKKNVAIDEGSNKKDGTSQGGGSLPANLCRHFSIAEIKAATNNFDELLVVGVGGFGNVYKGYIDEGSTHVAIKRLKPGSQQGEQEFVNEIEMLSQLRHLNLVSLIGYCYESNEMILVYDFMDQGTLCEHLYGTDNPSLSWKQRLQICIGAARGLHYLHTGAKHMIIHRDVKSTNILLDEKWVAKVSDFGLSRIGPTGSSMTHVSTKVKGSIGYLDPEYYKRQRLTEKSDVYSFGVVLLEVLSGRQPLIRTAEKQKMSLVDWAKHRYAKGSLGEIVDPALKGQIATECIHKFGEVALSCLLEDGTQRPSMKDVVGMLEFVLQLQDSAVNGVVVSGGDYEDSEDMFSSTHSSIQLSNYSNSTGLNTTSYGSKESDRLIPENVFSEIKNPEGR

SEQ ID NO: 191149 - protein, 321 aa, Glycine max
  Coding DNA Sequence Number=SeqID_74371
  Homolog annotation: Hit_ID=Q1T003; Match level="QueryCoverage=39%, HitCoverage=18%, E-value=3e-27, Identity=52%"; Hit description =Protein kinase; Concanavalin A-like lectin/glucanase
  Pfam annotation: Domain name=Lectin_legB; Domain location=55-234; Score=9.3; E_value=4.9e-11; Accession=PF00139.10; Description=Legume lectin domain
MIPIQILNKSKKTRLNDRPQHCNLFSRVDSHDQLLNHPRPDTATLSNLACQKEKENIFFYQIIVKGVNDTHLNNNTVSLTCDLVVPTSSASRALYSRPVRFRQPGNRFPASFTTFFSFFVTSLNPSSIGGGLTFVLSSDDDTIGEAGGFLGLSGGGGFVAVEFDTLMVMEFKDLNGNHVGVDLNNVVLSEVVTSVDDGDLEGEGGEDDSVGGAGVEDAEEGEVEAKELEGEEFGGDSGAEEGGMVLGGGEAVGVVRVEVGEGLEEVRVKNEKGLKELSEGWRESDKMKAYTTTVLPENRHRWKAKNMPTKTIFASNFKTIF

SEQ ID NO: 191150 - protein, 95 aa, Glycine max
  Coding DNA Sequence Number=SeqID_74372
MEMKGSVRGTSGCMRFIGVQNPDDVKSRELSLGQCWSWFYNTINDASLHTLRGDAGIIECAYVASQGQNDVWGFFYKLILKNDPFLNIFLKGFFL

SEQ ID NO: 191151 - protein, 135 aa, Glycine max
  Coding DNA Sequence Number=SeqID_74373
  Homolog annotation: Hit_ID=UPI00006A17C9; Match level="QueryCoverage =51%, HitCoverage=70%, E-value=1e-07, Identity=36%"; Hit description =UPI00006A17C9 related cluster
MSSPSEGYMSLPLAGLHVLAFRGLHVLAFRGLHVLAFRGLHVIAFRGLHVLVLRGLHVLAFRGQHVQVFRGLHALCHTLISSGDLFLVACNFHLTILRPTWALQKIPPEGGCFWRKSPCSPGRAGLQASPPFCYK

SEQ ID NO: 191152 - protein, 80 aa, Glycine max
  Coding DNA Sequence Number=SeqID_74374
MEGPMEAKARRKRSCYIQEQPASHVGDPWARQIAITIGDLALTDALCPSLPWQATGAPSAVGTRQFDWRFPMASANRHYS

SEQ ID NO: 191153 - protein, 49 aa, Glycine max
  Coding DNA Sequence Number=SeqID_74375
MGMGNGERSENGNRMGKGSGNTRTEEQRSIKEGLLLDMWQHTTMSKEEG

SEQ ID NO: 191154 - protein, 148 aa, Glycine max
  Coding DNA Sequence Number=SeqID_74376
  Subcellular localization annotation: CTP_CleavageSite=76; ConfidenceScore=5.46e-01
MKDCKNTSGEDVSFTSRISQSLTNSSQALKLAPASSSSLCRSSHNKISQKLSGTWTFLSLEYLDMQSSESQPKLASQNLISGLNRWPCSCSKEHTLRCPYRTHAKARVMSEIEEVQQQMKADMEATKEKMTTMMESMMSDVPLFSPIS

SEQ ID NO: 191155 - protein, 74 aa, Glycine max
  Coding DNA Sequence Number=SeqID_74377
MEVNTTTIVTTSIATKVDLTHPSGLNQVQSKHSFPPYGLPPNYTPPNVSHAPDENVDNSALIPIESQHPQSGHA

SEQ ID NO: 191156 - protein, 115 aa, Glycine max
  Coding DNA Sequence Number=SeqID_74378
  Gene Ontology: Mol. function=protein binding; Cellular component =nucleus; Biological process=ethylene mediated signaling pathway
  Homolog annotation: Hit_ID=Q2PQJ1; Match level="QueryCoverage=97%, HitCoverage=21%, E-value=1e-26, Identity=50%"; Hit description=EIN3 -binding F-box protein 1
MKLKSLSLVKYMGVKDIDMEVSILSPCESFQSLVIQKCPGFGSASLAMINCEAGLVNVNLTGFWNLTNNIVSTLAWLYGGKLEVLNLDGCGKITNASLVVIANNFIVLNDLDVSN

SEQ ID NO: 191157 - protein, 146 aa, Glycine max
  Coding DNA Sequence Number=SeqID_74379
  Gene Ontology: Mol. function=chitin binding; Cellular component =extracellular region; Biological process=chitin metabolic process
  Homolog annotation: Hit_ID=UPI0000612705; Match level="QueryCoverage =83%, HitCoverage=92%, E-value=1e-09, Identity=30%"; Hit description =UPI0000612705 related cluster
MRGIVHEPQTNLGANQNTLTFRGLHALPFRRLCILAFRGLHVLPIRGLHALTFKDYMSSPLVSCTPPPSEGYTSSSSEDYTSSPSKDYMFSPLDSCTPSPSEEYTSSPSEDYTPSEDYKSSHSEGYMPSPSENYTSSPSEGYMPSP

SEQ ID NO: 191158 - protein, 93 aa, Glycine max
  Coding DNA Sequence Number=SeqID_74380
MPISPCRCISWDRAHKASSGPEEVQQGPGVSRSGYGPLSVLQGAHSPNKESHPQRHSVDPEKSNRGPGGFQLWLRASAVLQGAHSPRQGHVII

SEQ ID NO: 191159 - protein, 185 aa, Glycine max
  Coding DNA Sequence Number=SeqID_74381
MEAETQTTQQKGEEAYLDGRQWSSVMHVLNAKREEPPKHHEHANTDNKRKKEIKRGRVEEEEGAEDKGALAVAEEEEAGCTKVFKKRPGHHFMPPYYSTMSFHLCRHQSSSLPSVCVAAILLPLCQCHLGFDPSFPPSALCTCSTVEEIGLGLQMKYFVGLYIWIKLICMRFRDQVDPQASYGST

SEQ ID NO: 191160 - protein, 78 aa, Glycine max
  Coding DNA Sequence Number=SeqID_74382
  Subcellular localization annotation: CTP_CleavageSite=23; ConfidenceScore=5.24e-01
MNVIAVHVSSIFQFGVVFHDCLSADPQGNPPFSPLFRSSMNCVYVHVYSTFEFGAVFHDCLSADPQGNPPFSPFFGAP

SEQ ID NO: 191161 - protein, 57 aa, Glycine max
  Coding DNA Sequence Number=SeqID_74383
AKCASTAKRSFSATEESDRASISGSRAKCEISALSTAVVFSQAQRTTDAKLKSTYSR

SEQ ID NO: 191162 - protein, 121 aa, Glycine max
  Coding DNA Sequence Number=SeqID_74384
TPDEAHIIFKPSNPGIYGIEALTHKSSKVTELCGYFSQKRSGISPLWWRKWGTFVENRRWQVLFANPLTINILSITKGGNRTGNNGKQPFNLDIWFIIQRNIEMMKKKSNKVGIRQRCIGP

SEQ ID NO: 191163 - protein, 115 aa, Glycine max
  Coding DNA Sequence Number=SeqID_74385
MSRAPVSCWMKNGQPRFQTLGYLELGPQILRSDCIDVGTYRFVLVLPKAVRLDHAILNITLSCIHLVNLNCDDFQFPMDEVNFMAKCGVDTMALILLRVGLPSKMLYDVSTSTST

SEQ ID NO: 191164 - protein, 89 aa, Glycine max
  Coding DNA Sequence Number=SeqID_74386
  Gene Ontology: Mol. function=RNA-directed DNA polymerase activity; Cellular component=chromatin; Biological process=RNA-dependent DNA replication
  Homolog annotation: Hit_ID=Q1T2D5; Match level="QueryCoverage=83%, HitCoverage=4%, E-value=4e-21, Identity=60%"; Hit description=Chromo
MAGKACSSLPESWNGKPVAYCDGVEGAVVHAELPRVIMFANEEHQRREGTGAGSNKTLLQHGFDLEFNLLFLIMRVLVGAHINRGSLQK

SEQ ID NO: 191165 - protein, 89 aa, Glycine max
  Coding DNA Sequence Number=SeqID_74387
MAKLGCGEKLKNKKVVGAGVPLSEACALSENHSLSKALISLSEFKEFAKHLRTQRVISSLSESFVFSRAKRAQLAQRKITYSRLARKWH

SEQ ID NO: 191166 - protein, 826 aa, Glycine max
  Coding DNA Sequence Number=SeqID_74388
  Homolog annotation: Hit_ID=Q1RSI0; Match level="QueryCoverage=24%, HitCoverage=25%, E-value=5e-56, Identity=49%"; Hit description=IMP dehydrogenase/GMP reductase
  Pfam annotation: Domain name=RVP_2; Domain location=720-826; Score= -54.8; E_value=0.019; Accession=PF08284.2; Description=Retroviral aspartyl protease
  Pfam module annotation: Pfam domain module=RVP_2::RVT_2::Retrotrans _gag; Domain location=720-826::222-363::533-615
MATSSSSGEDDSTPPPPPSFTDPNNYRPLPPCSCSAKTYHQQDFIIRFLKGLDERFAMAEATHNKGGPNQHVNVTFVAASFGYPHGHPKYPSHPRLSNNKYTSGGGTTSSGGGAVNSAEVVTPTHGGESKKESSTQDHGFHITMAQYQELMNLLSKSSGPGGASSETTLTRANLTHSSPNQIHNSGFGSHFDMSTLRAIRLTDLKEGLFHLIIGKDRSPSTNNITTTNTNNSKLWHFRLGHLSDGSIERYKARLVAKGYSQIEGIDYFETFSLVVKMATVRDVLALASINRWHLHQLDVSNAFLHGDLREDVYMEIPPGLLGYTSIAHSDKGISLCQHKYCLDLLKDSGMLGCKPFSTPMDSSLRLHNDSSGFLDDPLSYRCLVGRLVYLTSTRPDIAFATQQLSQFMSKPTKAHHAAAVHVLRYLKGCPGQGTGPRNQPKLSLTFGALIPIVDQPLYGNPHSPLEAVILKLTTLQVSLGQTVQSMAQKFDELLIRLPSISSSPSSQPIPSISPVPVHQHRMKLDIPRFDGTDPLALAWFQWMATNGQLTSWLAFIQALQTRFAPSHYDDPTGNLFKLTQRGSVTQYLSEFKELANRIAVGLARLQEEKLLDTRPTFCNRTLPALSIPQPRQVTTPALLQAPSSPAPPPRLPPLVKRLSPAKIASRHERGLCFTCEEKYHRGHRCASRVFLLVAAEDENPDPYIEDLDPAPESPDSPNPTTAQISFNSLAGNLAPETLRLLGTTASHHVVILIDGGSTHNFIQEDLVQRIGLPTQDTTPLRVLVGNGQHLACSRWCPRVPLTIQELTCEVDLYVLPIVGANIVLGV

SEQ ID NO: 191167 - protein, 675 aa, Glycine max
  Coding DNA Sequence Number=SeqID_74389
  Gene Ontology: Mol. function=RNA-directed DNA polymerase activity; Cellular component=chromatin; Biological process=chromatin assembly or disassembly
  Pfam annotation: Domain name=Chromo; Domain location=582-630; Score =17.6; E_value=0.0082; Accession=PF00385.14; Description='chromo' (CHRromatin Organisation MOdifier
  Pfam annotation: Domain name=rve; Domain location=339-462; Score =15.7; E_value=0.00029; Accession=PF00665.16; Description=Integrase core domain
  Pfam annotation: Domain name=zf-H2C2; Domain location=280-321; Score =5.9; E_value=0.06; Accession=PF09337.1; Description=His(2)-Cys(2) zinc finger
  Pfam module annotation: Pfam domain module=Chromo::rve::zf-H2C2; Domain location=582-630::339-462::280-321
MNWAKLVGFRNSICCKDITKFVCIPQTLLQRPFALTTTTEFKVEYLGHVVSQRGVEPVTSKVDAVRQWPTPHSAKALCSFLGLARFYRRFIKGYATIAAPLVAATTTKPFQWTAPAQLAFKHLKQALSEAPVLTLPDFQLPFTVETDASSIGMAVYSDDGGQEVVQTLEQHMYLTRLMGYDYQIQFRSGATNQAADALSRLPEEESSLSLVLSVPCLIFMEELCKQLAQHETYQTHLQAIQITPTKFPDFTISNNLILRRGRIWLPPHIPLITTLLIEYHATPTGGHLGIAKTIARLMDNFYWDGLRDVMAKFVSSCLDYQHAKYETKRVAGLLCPLLVSHRSWEDLSLDFITGLPAFQGNTVVLVVVDRFPKGIHMGMLPTSQQFWQDLFRLSGTQLHMSSSYHPQSDGQTEALNHVIEQYLRAFVHRRPNSWGKLLMWVEWSHNTSWNAATGSTPYEITFGRKPFNYPEYLARKSKLDVVDDMLTTREDTFRLIRKKLLKAQGLMKKYADAKCRDFVYQVGDWVMVKLRPHRQTSAKPQSHISSKLSKHFYGPLEIIERIGPVAYRLKLPEDARIHPPLISLVAILDYRRSSTTAGSPWEVLVQWSGLAPDETSWESWSQLCRDYHLEDKVHFQGPWDDRETEVQQAIEKEQGANNNREEDLQGLLSRIRGQP

SEQ ID NO: 191168 - protein, 154 aa, Glycine max
  Coding DNA Sequence Number=SeqID_74390
MEEASIIQSFQKQLKVLQKRNGKEKVVLRQKQEVNLKALREENDAIQAQFQAPKANIVPTQRGATKLEHSSHETNHHAITTGQSQQKSYGQPTEACHQHLFVILDIPLPLGWRPLNIYYYNGTTDPNEHIEAYVINTQTKSIWEQPMQEEANKH

SEQ ID NO: 191169 - protein, 189 aa, Glycine max
  Coding DNA Sequence Number=SeqID_74391
  Homolog annotation: Hit_ID=Q1RTB4; Match level="QueryCoverage=52%, HitCoverage=21%, E-value=4e-10, Identity=39%"; Hit description=IMP dehydrogenase/GMP reductase
  Subcellular localization annotation: CTP_CleavageSite=23; ConfidenceScore=5.02e-01
MYGWSLTFFSMKVDPTVPYKVIACVPRKGKRIGSNSWRVWKGASVKWFPRWKEGGARVLCSCEGFPNVPLMGTRGCINYNPILAIRKLGYPMRGVPLEEIITPFIARGFYEGNSNVLQRVQKAWNAVERKDKELRVSNNDVIGGYHKWLKARMQGITWLPKLKISSGEEAEVPEESEKVQALKAELERT

SEQ ID NO: 191170 - protein, 94 aa, Glycine max
  Coding DNA Sequence Number=SeqID_74392
MAYSDQTTEIKYYERTSSHCKSNRSGFGDTKLRAPYPIYRVCPSQSSTNLLSERGLEDRKLRKIMKDEKEIDRNKVPVGIEGSEFVEMESSMTA

SEQ ID NO: 191171 - protein, 131 aa, Glycine max
  Coding DNA Sequence Number=SeqID_74393
MTSLKVVIQNLGKRLVINNLVSDPNFVRELSFANVLILANRKVLFDTNFCSRREIVRRFGQECGKYPMGGAKGSFQAIFWTLARQASLWLSWAPKLLRVEGTSLTGRASFFWTKLQLAWASCHSPKCPHFL

SEQ ID NO: 191172 - protein, 53 aa, Glycine max
  Coding DNA Sequence Number=SeqID_74394
MSRSEQPRDLKTLVFLSFFAQFFFGGEVNDNEKNAIGMVVIRGNSVIIVEVLN

SEQ ID NO: 191173 - protein, 84 aa, Glycine max
  Coding DNA Sequence Number=SeqID_74395
MKAKKRIPKVNEMKNESEQNKNELKASDSKTYRLKIEEWQKIFTESLTKTSGSVTEAFRLGFPSVFHFFSLKTTEIHSIEVRDP

SEQ ID NO: 191174 - protein, 44 aa, Glycine max
  Coding DNA Sequence Number=SeqID_74396
MNSARQSIHGTPNSMMDDARTALGCMNSARQSIRGAPDSMVEDA

SEQ ID NO: 191175 - protein, 86 aa, Glycine max
  Coding DNA Sequence Number=SeqID_74397
  Subcellular localization annotation: CTP_CleavageSite=16; ConfidenceScore=5.05e-01
MIPLGSKGSTPCGGPTASVGSSWCLPVVVGGEGGEFMVWVRVYEKRGRRIMFFSLLNIFVTPLNSPGRNFARLGKLAQLKLAKGCF

SEQ ID NO: 191176 - protein, 150 aa, Glycine max
  Coding DNA Sequence Number=SeqID_74398
  Homolog annotation: Hit_ID=Q9SSB5; Match level="QueryCoverage=25%, HitCoverage=9%, E-value=2e-14, Identity=94%"; Hit description=26S protease regulatory subunit 7
  Subcellular localization annotation: CTP_CleavageSite=76; ConfidenceScore=5.44e-01
MTKAVVWHKPQKKSAQFMVLVCILNICILLSKSGKPNSTLRSNRPGRNSAGSRVHRTATQPKLEPVPPSIGSPSTSGDTLSEFNIGVFKDMAVVSESAREPSWKDRSEGHAVGGSRHTLAYGYGVAASDGASSLWQLLVGSGSTLCLSIF

SEQ ID NO: 191177 - protein, 261 aa, Glycine max
  Coding DNA Sequence Number=SeqID_74399
  Gene Ontology: Mol. function=calpain activity; Cellular component =intracellular; Biological process=proteolysis
  Homolog annotation: Hit_ID=Q1S3Q9; Match level="QueryCoverage=67%, HitCoverage=34%, E-value=1e-24, Identity=36%"; Hit description =Cyclin-like F-box; F-box protein interaction domain
  Subcellular localization annotation: CTP_CleavageSite=53; ConfidenceScore=5.24e-01
MGRQATQEDAHVKKTILNNSGSVGIVPLGFWKNNGCCCFSSSPSGTHSRNPVMASSEASNAIQNPSSTVIDGCHRFKYYNFVFGVCNGLVCLFDSSHKDGFEEYRIRIWNPATRIMSEDFPRLRLHSNDCKVVNYRRACEYTKFGFGYDDLSDTYKVVVILLYGKSQQREVRVRCLGDPCWRKILTCPAFPILKQQLCGQFVDDTVNWLALRRPGSDYQWETVAINELVIFSYDLKKETYGYVLMPDGLSEVPVVEPCLGV

SEQ ID NO: 191178 - protein, 172 aa, Glycine max
  Coding DNA Sequence Number=SeqID_74400
  Gene Ontology: Mol. function=nucleic acid binding; Cellular component= nucleus; Biological process=DNA integration
MGYKWIFKKKSTLSSEYVIHYKAHLVAKGYNQKEEVDYSEMFSPIDRHTSIHALLTLVATLDMELYQFDVKTSFPHGRLKEDILMQQPKGFELEGKESFVYRLERSLYGLKQSPRLWYKRFNEFIVSHGYTISPYDSCFYHNKVKDDLDARRSVTRYAFTISNSLDSCKAIL

SEQ ID NO: 191179 - protein, 141 aa, Glycine max
  Coding DNA Sequence Number=SeqID_74401
MVKGMNKERNGRKRDHSVAARSRVADMKKQASSTFLMWVMVISLHAHLIIAAVSKSNGTISVCDGSVEDCLNVVHLDSELLPTISSSHFRRILAGKYDGVTNDALIPDKPFKGCKIGEAYRSCLAQVEGRARNCAIYKRGC

SEQ ID NO: 191180 - protein, 239 aa, Glycine max
  Coding DNA Sequence Number=SeqID_74402
MESVSALMCCDGDTIPSYEGIMFECPSDPKVITISEDMSLDALRKTIFYANEGCKFLLDLFYHQPIYVGDDCVEYDYMELKHDNDVGKIFFIYSEFSIKGLIELNATFERSLDEIIALMHKPRKPRTTAKIIALMRFESDSDVLLNVDGAEASLAEDVSHHKSSWLLSPTCRAGTQSRACRAVCCFYCYRTVWNRIALTAFRIFHLKHKSRKIMEKQRNCGVSWTVVGGDVGLLSLLAR

SEQ ID NO: 191181 - protein, 148 aa, Glycine max
  Coding DNA Sequence Number=SeqID_74403
MTTNPNPRSETLLIYTNALETFLLYFMSWNPMLQILNPKPNIRSGNPMLYISVLETLSLCVSVSKTLLLYVSALGNPMLQTLTLNLTLGNPMFFVSTSETLLLYAREYDAILPRKGPVTRAMSKRLQEDWARATEEGPRVLMNLGVDF

SEQ ID NO: 191182 - protein, 101 aa, Glycine max
  Coding DNA Sequence Number=SeqID_74404
MAKLGLNSGVGFQLVESPPQDLKPLLMADALGVEFLPGCAIGGIVEHAVKRKRFGGRGEDEGGDQRVVIMTRKAPKRLDSPTWWLLSDHNVLKSSVICCFE

SEQ ID NO: 191183 - protein, 155 aa, Glycine max
  Coding DNA Sequence Number=SeqID_74405
  Homolog annotation: Hit_ID=Q8H6Q8; Match level="QueryCoverage=47%, HitCoverage=2%, E-value=2e-13, Identity=50%"; Hit description=CTV.20
  Pfam annotation: Domain name=MP; Domain location=6-153; Score=-17.2; E_value=0.0018; Accession=PF01107.9; Description=Viral movement protein (MP)
MDDWNIPEIPQDQLYVPKTIKDKHNFDYIIKTVENNIPLGQDIGEEFHLLSKNSIYEHSRKYKYLHIGCVQVAIKPLIDMGIDAAVLMCLRDIRHNQFEDSLIGTVETSLGQGPIYFNCYPNKTASLMDRNILDSLFLNIHFHGLGMKEVYLILN

SEQ ID NO: 191184 - protein, 97 aa, Glycine max
  Coding DNA Sequence Number=SeqID_74406
MAAAMYMIGHCFDSNHNLYTSHDQHSQTANNDNRSPLNQVIMIRIKGTICNCGFDLYYDMYCTTHELDRNNWRPAQDQVNSEDENVKYLTYQSYSLM

SEQ ID NO: 191185 - protein, 101 aa, Glycine max
  Coding DNA Sequence Number=SeqID_74407
MFWSRQIENGGLYGVLYLVLYGTGGTTWCLEVQPFTGIKYLYFWPEFVVLKAAYQMLVGLLGGLFMVCCGLAGVGPCGEVLLYLEVRGVGVCLVMPLVGYV

SEQ ID NO: 191186 - protein, 83 aa, Glycine max
  Coding DNA Sequence Number=SeqID_74408
  Gene Ontology: Mol. function=metal ion transporter activity; Cellular component=membrane; Biological process=metal ion transport
MLKHEDICMYNHTQKHIRLAKGTYRRCACMDTYRRELVQGAINLDKVSLQEHLKLLDIKLLGDGTIGGVVAGSMVVPTENIVE

SEQ ID NO: 191187 - protein, 250 aa, Glycine max
  Coding DNA Sequence Number=SeqID_74409
  Gene Ontology: Mol. function=DNA binding; Cellular component =intracellular; Biological process=DNA integration
MLIASRCKADIEEVKVLLEREFEIKNLGAASKILGMQITRDMVQGVLCLDQRSYVAKVLKTFNMDQSKAVLTPMAQYFKLSHQHSPQTKEEATYMEKVPYANAVGSLMYLMIRTRPDLAYATMLDASTLDGHLLHVVSLSTTEAEFIALTEAIKEAVWMKGMATSLYTKVNGVKVYCDNQSGIHLAKNQTYHERTKHIDVKLHFVREVIAKGEVVVEKIHTKNNPAETSTKALPGPKFKQCVQIMKVEGA

SEQ ID NO: 191188 - protein, 564 aa, Glycine max
  Coding DNA Sequence Number=SeqID_74410
  Gene Ontology: Mol. function=nucleic acid binding; Cellular component= intracellular; Biological process=DNA integration
  Homolog annotation: Hit_ID=Q1S9T9; Match level="QueryCoverage=94%, HitCoverage=43%, E-value=1e-116, Identity=42%"; Hit description =Peptidase S8 and S53, subtilisin, kexin, sedolisin; Integrase, catalytic region; Zinc finger, CCHC-type
  Pfam annotation: Domain name=rve; Domain location=283-446; Score =151.8; E_value=1.8e-42; Accession=PF00665.16; Description=Integrase core domain
MRIKRCCCSDHYQVSMIASQTRSYMSLDEAKAALFSKELKKKLEGGGYQDAEGLYTKGRMEKKDPKNKKGSRSKSHDGRKRRCFGNQKSQNGDADVAVEGYDSTDVMCVSDVKIKPKWVLDSGCSFDMCPEKNWFCSYEECNGGQVLLGDNKACKVVGIGAIELRLADSTIRTLKESPEGHEGSLVILKGRLVHGLYLLEGNTTSFNIASSSTKSSSAAIVTAQMHSQASLWHKRLGHISEGGIRELSKQKLLGKKSLDALEFCEHCIYGKAKRLKFVVAEHHLKGTLDYIHSDLWGPTYVLSHSGARYFLSIIDDFSRKVWVFILKSKDEVFAKFKEWKVLVETQTSKKVKKLRTNNRLEFCSDEFNQFCKRNETERYRRIKGTPQQNGLAKRMNQTIMERVRCLLSDSNCSGHFWGEAVMTVCYLINRCPSTATNMVTPEEMWSDHSPNLKNLRVFRCVTYAHIRQDKLEPRALKCMFLGYPQGVKGYRLWCMEKGHVVFKESEMYHLKEDSSKGKAVWTQESVQLEVESGAGSSSAGRGRPLLGSTSAEVERPEHGSSGAR

SEQ ID NO: 191189 - protein, 80 aa, Glycine max
  Coding DNA Sequence Number=SeqID_74411
MTIICLRMSSGSPPLDDTRAQNDHYLSLRAIRHDRAWMERRRMTIICLCAPSDTIASGWGKGVRNDHNLSLHVIELAASG

SEQ ID NO: 191190 - protein, 100 aa, Glycine max
  Coding DNA Sequence Number=SeqID_74412
MVILRPLSFRSNKSSDKRAETNYGHSVPFVIQGQFRWRGVCPAEWCSTRTKLVSYLYIPFISNKRQVKRGNCHTLISSGDHLFIGMRPSLDHFEVLDAHH

SEQ ID NO: 191191 - protein, 287 aa, Glycine max
  Coding DNA Sequence Number=SeqID_74413
  Gene Ontology: Mol. function=3-isopropylmalate dehydratase activity; Cellular component=3-isopropylmalate dehydratase complex; Biological process=branched chain family amino acid biosynthetic process
  Homolog annotation: Hit_ID=Q7NUB8; Match level="QueryCoverage=58%, HitCoverage=79%, E-value=2e-75, Identity=80%"; Hit description=3 -isopropylmalate dehydratase small subunit 2
  Pfam annotation: Domain name=Aconitase_C; Domain location=10-141; Score=128.7; E_value=1.7e-35; Accession=PF00694.9; Description =Aconitase C-terminal domain
VDSRGSHEGRQGPGGRTHLVSPEMAAAAAIAGHFVDFLKSIKRSGFGPYLFDEWRYTNYGEPGMDCSTRPLNPDFVLNQPRYQGAQVLLARDNFGCGSSREHAPWAIEDQGFRVIIAPSFADIFFNNCYKNGILPIVASAEQVDSLFKECFANEGYKLSVDLEAQTVTTPSGQSFSFEITPTRKHNLLNGLDEIGLTLQHADEILLPGDGIGPEIIAQALRVLEVLKKEGLDMTFTEAPLGGQAYDQYGHPYPEFTQEICRKADAVLLGAVGGPQYDNLNRPLRPER

SEQ ID NO: 191192 - protein, 141 aa, Glycine max
  Coding DNA Sequence Number=SeqID_74414
MSTSRVPDSKGSIARIASTGINPTIPRGRRIPIKSSFDDFKAWLENYNLTHLYTKGAFTWSNENHRIGVGSIVPSSPMFILTHKLKLLKVALKSWNNDSFGNIHDSIDRAKKELSSIQLLIDQNRPSVDLVLQERRAQDNL

SEQ ID NO: 191193 - protein, 68 aa, Glycine max
  Coding DNA Sequence Number=SeqID_74415
MARHKHRFGDYRKIAGGGIRTSMSGCGDGVGAKSVGGRKPQRQIDRGVTMVGQCTLGKSKGLRQADGS

SEQ ID NO: 191194 - protein, 176 aa, Glycine max
  Coding DNA Sequence Number=SeqID_74416
  Homolog annotation: Hit_ID=O22159; Match level="QueryCoverage=64%, HitCoverage=22%, E-value=3e-20, Identity=46%"; Hit description =Expressed protein
  Pfam annotation: Domain name=DUF247; Domain location=1-176; Score= -161.9; E_value=0.0061; Accession=PF03140.6; Description=Plant protein of unknown function
STLEDPTILPGVDISKFTIDHFHMHYQQYIMKPDHIDMQLHNLTDLLRVFYLPPDGMPRREKETVKHLYSASQLVEAGVKLHVGKNKSALELQFEKGVLTIPRFEVCHWTEILIRNVVAIEQCHYPFQTYITDYIFVFDFLIDTSQDVDTLVDKGIMINTLGDSSAVANMKTELLL

SEQ ID NO: 191195 - protein, 94 aa, Glycine max
  Coding DNA Sequence Number=SeqID_74417
MKQKSFSSNNSFFTYDENHGLSKVGGKCDGDSLAKKRNLENKLNKSKSHIPPKSKRGESSITIITYMEEEVVSDEVIPFNMMFSKCLVEFQVQK

SEQ ID NO: 191196 - protein, 110 aa, Glycine max
  Coding DNA Sequence Number=SeqID_74418
MASMLAFIRTHYSGSSTHSDDNVFSHCMLSKGDIDFHLHFKDDNVFSHCMLSKGDNDLHLDFEDDNVFSHCLPSKGDSDPHLHFEDNDVFSHCMLSKGDNAIIYAFEDDN

SEQ ID NO: 191197 - protein, 117 aa, Glycine max
  Coding DNA Sequence Number=SeqID_74419
  Gene Ontology: Mol. function=nucleic acid binding; Cellular component= intracellular; Biological process=chromatin modification
  Homolog annotation: Hit_ID=Q10QG1; Match level="QueryCoverage=75%, HitCoverage=17%, E-value=3e-34, Identity=77%"; Hit description=Zinc finger, C2H2 type family protein, expressed
  Subcellular localization annotation: CTP_CleavageSite=67; ConfidenceScore=5.49e-01
MKLWALALSCAKTSQNALEQGSAVASVFSGTASFHMSLPIGVYVVFLRTTFALPLFLTVFSAEVLLDAGEVVERPCGVVVDSGRFGTHGFSGSKELNGRGEERNRLQECVKLDKDRL

SEQ ID NO: 191198 - protein, 337 aa, Glycine max
  Coding DNA Sequence Number=SeqID_74420
  Homolog annotation: Hit_ID=Q10Q83; Match level="QueryCoverage=44%, HitCoverage=34%, E-value=3e-15, Identity=34%"; Hit description =Expressed protein
  Pfam annotation: Domain name=DUF566; Domain location=10-337; Score =14.1; E_value=3.5e-08; Accession=PF04484.3; Description=Family of unknown function (DUF566)
  Subcellular localization annotation: CTP_CleavageSite=67; ConfidenceScore=5.87e-01
MDKTASTLSGRHHPTAVLPSPRLVRSRSGSGPAAAITTPERSSHRFSSSERFTITSVQRSKSTSRTRATNNEGNNINLNSTLTTSILSNPTHNRVHEKKGRDDGYGKLMQRGVSPDINNVGASKRTTSTIKSPSAWALSPGRWSLNSSVWPQPPAKANDGGNNNSSSSVGGRVIKVLKYLKQRKVSSVQEEEYYRFRILHNRLLQLRFINARAEVVRANVKNIAEIQLFSVWLRILMLRKITIQKSIELRKIKQVIKLYHILDGQLYLLTEWAQLERRNQESVGRLTRKLTALSNILPLTHTVKVDTESVFEALNTAVQVMESVEPLIAKYHETKVT

SEQ ID NO: 191199 - protein, 259 aa, Glycine max
  Coding DNA Sequence Number=SeqID_74421
  Homolog annotation: Hit_ID=Q8TGM6; Match level="QueryCoverage=46%, HitCoverage=97%, E-value=1e-09, Identity=43%"; Hit description =Protein TAR1
VCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILVSFFPPLIDMLKLSG

SEQ ID NO: 191200 - protein, 280 aa, Glycine max
  Coding DNA Sequence Number=SeqID_74422
  Gene Ontology: Mol. function=RNA-directed DNA polymerase activity; Biological process=RNA-dependent DNA replication
WAETQTKRLPDASAGGKIKLKTPKEATELIENMSASDHAILHDRVHQPTKKSLLQVVPSVGPYNQQGQWRSHPGNQFNKDQGGPSNRPIKQGPNIFQRTTKLEDTLTQFMQIADKSSNSFVANTEKNPKEECKVMMTRSKRFMEEEDEDNVVMPKKKVAEKKDTDDKKEDVRERSRSEQAREKKKEKVVNEGMEVPYLVVPSKKEKDRHLDILTRKHKYIHWENIVVEGNCSAVIQKILPPKHKDPGSVTIPCSIGEVTVGKDLIDLGASINLMPLSMCR

SEQ ID NO: 191201 - protein, 180 aa, Glycine max
  Coding DNA Sequence Number=SeqID_74423
  Gene Ontology: Mol. function=two-component response regulator activity; Cellular component=cyanelle; Biological process=two -component signal transduction system (phosphorelay)
  Homolog annotation: Hit_ID=P0AE88; Match level="QueryCoverage=99%, HitCoverage=77%, E-value=3e-90, Identity=92%"; Hit description =Transcriptional regulatory protein cpxR
  Pfam annotation: Domain name=Response_reg; Domain location=1-60; Score=-1.0; E_value=0.0042; Accession=PF00072.14; Description =Response regulator receiver domain
  Pfam annotation: Domain name=Trans_reg_C; Domain location=99-176; Score=82.7; E_value=1.2e-21; Accession=PF00486.18; Description =Transcriptional regulatory protein, C
  Pfam module annotation: Pfam domain module=Response_reg::Trans_reg_C; Domain location=1-60::99-176
MMPKKNGIDTLKELRQHHQTPVIMLTARGSELDRVLGLELGADDYLPKPFNDRELVARIRAILRRSNWSEQQQQVDSGAPTLDVDGLQLNPGRQEASFDGQVLDLTGTEFTLLYLLAQHLGQVVSRELLSQEVLGKRLTPFDRAIDMHISNLRRKLPDRKDGHPWFKTLRGRGYLMVSAT

SEQ ID NO: 191202 - protein, 262 aa, Glycine max
  Coding DNA Sequence Number=SeqID_74424
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q2NQW9; Match level="QueryCoverage=100%, HitCoverage=57%, E-value=1e-122, Identity=84%"; Hit description =Sensor protein
PLRFGFDARQFVAFAVAAAHQRGGQLQARQRRAQLVRDVRYQALLSIHHAFQRADHLVEAGAGGQEFLRAGLQFRMLLQVAARYFIGGVFQLARRFRQAPGQPQQQRGADQHGDDQQQQRPVEHQVDEIGLRAVGGTDQVQLVVVFAVAHRERPYQLDAAVLFLLRMIRVVGLADEVADDLHFIALRADHPAFAGDQQQALARRRPFVDGAEQAAPPHQIVGRIVLQLGLDVLFQHQPLPLFAVEQRGHLAGVKLGHHQHQH

SEQ ID NO: 191203 - protein, 63 aa, Glycine max
  Coding DNA Sequence Number=SeqID_74425
  Homolog annotation: Hit_ID=Q9LXA6; Match level="QueryCoverage=98%, HitCoverage=8%, E-value=2e-09, Identity=53%"; Hit description =Oligopeptidase A-like protein
MVNHLKVVNDSSELRSTIEHVQVITFGVLTRISGLLFCLHAEKLKFHLRLGDNKPIYNAFKAI

SEQ ID NO: 191204 - protein, 97 aa, Glycine max
  Coding DNA Sequence Number=SeqID_74426
MGSYLAHGLKIYPKAHENPRVFPWISGPIYLESSIQCPCGVGLHQYGVGKWAGTPRVRPARIGSGRGQLAPYSYTDQINWSAPAAWTPLVKRAGPQA

SEQ ID NO: 191205 - protein, 116 aa, Glycine max
  Coding DNA Sequence Number=SeqID_74427
  Subcellular localization annotation: CTP_CleavageSite=19; ConfidenceScore=5.11e-01
MRGKRVFLLSFLDPSSPKLASGLSGPPNDFRVKESARLGVLGRLRKGSKVHKLRELREERKKKKKEKEMKSRRRRIATVINVYIVPCSVFFVRLSGSGVVYAWATPHAPVTRDGSL

SEQ ID NO: 191206 - protein, 62 aa, Glycine max
  Coding DNA Sequence Number=SeqID_74428
MEFSPQIEMTHFIVSDIVATRRVVTMVTPIICGGGDDCALLILSTPVLIMLEVDGSLLEKLL

SEQ ID NO: 191207 - protein, 83 aa, Glycine max
  Coding DNA Sequence Number=SeqID_74429
MKLIAPRNADTIGTMEEVEVVIEVVTKADMLKDEVITNELLEKLNKDNKKIPKVLSEVLPTPLSVALLEKVAQTPVGNNTSKH

SEQ ID NO: 191208 - protein, 183 aa, Glycine max
  Coding DNA Sequence Number=SeqID_74430
MAKLDPEVVLEFYANVWPIEEGVWDMRSWLRGMPPTRHLLDPDKSNRALGFPALITGLCQLFGVPVTPSKYCTPRQAQGDGPQAADAPPPPHQADPARSLGMERYLQHLVRQQAANHRGQSQGFAPFSCPTPYHFRAEVEWPGDWSEAQAGEAPAEAPDDMEGARMDEEMTDLLDFLGGRGAT

SEQ ID NO: 191209 - protein, 148 aa, Glycine max
  Coding DNA Sequence Number=SeqID_74431
  Gene Ontology: Mol. function=RNA-directed DNA polymerase activity; Biological process=RNA-dependent DNA replication
MAPDRTQLQNMSKREHESFKEYAQRWRDLAAQVAPPMVEREMITMIVDTLSVFYYEKLVGYMPSSFADLVFADEGIEVGLKRGKFDYVSPTDTSNRRIGAAGAKRNEGDAHAITSTPAWLKPQQALHGTHQYAQCGVPKIMTGLIVMI

SEQ ID NO: 191210 - protein, 95 aa, Glycine max
  Coding DNA Sequence Number=SeqID_74432
  Homolog annotation: Hit_ID=Q3L8J2; Match level="QueryCoverage=47%, HitCoverage=25%, E-value=2e-13, Identity=64%"; Hit description=CBF -like transcription factor
  Pfam annotation: Domain name=AP2; Domain location=62-95; Score=-6.4; E_value=0.003; Accession=PF00847.10; Description=AP2 domain
  Subcellular localization annotation: CTP_CleavageSite=86; ConfidenceScore=5.16e-01
MEFEIINESPADSTSLSSSSVSPCTPPNPNLLCDSPNPQPNTNTNPSHKRKAGRKKFRETRHPVYRGVRQRNGTNGTYLTPEVAARAHDVAGLET

SEQ ID NO: 191211 - protein, 75 aa, Glycine max
  Coding DNA Sequence Number=SeqID_74433
MANANCPQESLHSVSNGNLSGQGRQQICLVERLTKGFHQLTPRIDYPTGNEVECGQRIPNKVLGGQVEWGGGIIG

SEQ ID NO: 191212 - protein, 243 aa, Glycine max
  Coding DNA Sequence Number=SeqID_74434
MNYLFLTIVRVVNDLNLILNSIGHPPIIIDMSVPMGGMKKNYLKKNLLLRIILLNWLTRLEISSLKLFLVVVLLVVSGSDKKKVIWRNKPKPTNKCRSYNIETRSKSLHDLPLPPSKKQNIVDLEGDVQPIRTSLIPTNKLSGPHMWMSSRSKIDRIIMSEDWEAFQKKGLDDVENLLEEFNQLKIHANELEAYVQQEREGNVWLKEKNTQLKGDGEFCMRVNGELIPTRLRALGTVNQDCVT

SEQ ID NO: 191213 - protein, 93 aa, Glycine max
  Coding DNA Sequence Number=SeqID_74435
MAARPGELELTPKVTGSPRRAGYFTLKSFGGPGKPEASLGKLGSRKLNKKTLLPLFFGIFRILNQNIEWFLALHCNWCSTPKSTSKDQKINER

SEQ ID NO: 191214 - protein, 163 aa, Glycine max
  Coding DNA Sequence Number=SeqID_74436
MAYGIEVVIPKEIGELTFKIANLNLEQNEESLITELDFIEERRKVAAIRDTTLKGKIMTRYNMKAPLGNGFPNQGKYLNGLLVQLQVSILGNEFLNQGKHLNDLHVQLQVAILGNGSPKQSYSSHIEKSQANNLQPLIKNSSILKATTKCIKMTRVTNGRTKK

SEQ ID NO: 191215 - protein, 270 aa, Glycine max
  Coding DNA Sequence Number=SeqID_74437
MKPFKILHMHLLHSLLLFNIILCSSIPQHNHANFCGNIKTQTPFLDSNSSMLDNITLCISQNLYLRTSLGLFHVSSLDNNGRLLTITHSSCSSLQYVSPLAVTSGFPSPPEPNSLVLFNCSSRRDTTLPIMQNCSDLYKCGGAGSPPSRPQEHLEHPYSCFFVEDLQKVDKDFHPEHLNCSHYSWVHRSTSDGGHDQGYKVGTRLSVDIPRVPEICQGCEKPNGNCGAGLNCLCHPKECKDKVISKAGIKSTASAFFSMLSLIGSVTVAY

SEQ ID NO: 191216 - protein, 325 aa, Glycine max
  Coding DNA Sequence Number=SeqID_74438
  Homolog annotation: Hit_ID=Q9SJQ8; Match level="QueryCoverage=61%, HitCoverage=69%, E-value=2e-27, Identity=35%"; Hit description =Expressed protein
  Pfam annotation: Domain name=DUF868; Domain location=42-324; Score =309.2; E_value=7.4e-90; Accession=PF05910.3; Description=Plant protein of unknown function (DUF868)
  Subcellular localization annotation: CTP_CleavageSite=71; ConfidenceScore=5.66e-01
MRDIVSCFSENAVNVSHSSMSCSSYSNNACISPSSSSSSSVVPSTQNSISSVYKLVLSTLKQILITVTWCRSNSNQGLTITFNDGDDPPPPPFRLNTNSRLFRKKKGSKILESSSSDSSTKVEILWDLSNAKYESGPEPVQGFHVLIIIDSEIGLVLGDTAAAEETVSKRQNFKNNKNTPLAKVSLLSRREHCSGNTLYTTKAQFCDTGTWHDVMIRCSVEKENEGLLFKSPVLCVCIDKKTVIRVKRLHWNFRGNQTIFVDGLLVDLLWDVHDWFFNPSSSGYAVFMFRTRSGMDSRLWLEEKNAHKDKDRVEFSLLIYACKTS

SEQ ID NO: 191217 - protein, 152 aa, Glycine max
  Coding DNA Sequence Number=SeqID_74439
  Gene Ontology: Cellular component=integral to membrane; Biological process=lipid transport
  Homolog annotation: Hit_ID=Q0PIW2; Match level="QueryCoverage=79%, HitCoverage=77%, E-value=2e-13, Identity=41%"; Hit description=HyPRP2
MALYMVCLEQALRSKLSEIERLRLMPRMFALRAVQRHTAASRSIRPLRREQQGVTSGWPKVTLSNPFSTLAHTPSLSASRGHKPPEGLGLGFGLGSGLGVRVGLGLGVGLGFGFGPGLEPLPQSHAETSAMKRRLSVKKRAREEQVLEAILS

SEQ ID NO: 191218 - protein, 544 aa, Glycine max
  Coding DNA Sequence Number=SeqID_74440
  Gene Ontology: Mol. function=protein kinase activity; Cellular component=integral to membrane; Biological process=protein amino acid phosphorylation
  Homolog annotation: Hit_ID=Q1SI44; Match level="QueryCoverage=84%, HitCoverage=64%, E-value=1e-179, Identity=68%"; Hit description =Leucine Rich Repeat, putative
  Pfam annotation: Domain name=LRRNT_2; Domain location=24-65; Score =51.0; E_value=4.1e-12; Accession=PF08263.3; Description=Leucine rich repeat N-terminal domain
  Pfam annotation: Domain name=LRR_1; Domain location=122-144; Score =13.6; E_value=0.71; Accession=PF00560.23; Description=Leucine Rich Repeat
  Pfam annotation: Domain name=LRR_1; Domain location=146-168; Score =16.5; E_value=0.096; Accession=PF00560.23; Description=Leucine Rich Repeat
  Pfam annotation: Domain name=LRR_1; Domain location=170-193; Score =15.5; E_value=0.19; Accession=PF00560.23; Description=Leucine Rich Repeat
  Pfam annotation: Domain name=LRR_1; Domain location=195-217; Score =16.7; E_value=0.082; Accession=PF00560.23; Description=Leucine Rich Repeat
  Pfam annotation: Domain name=LRR_1; Domain location=220-242; Score =4.5; E_value=41; Accession=PF00560.23; Description=Leucine Rich Repeat
  Pfam annotation: Domain name=LRR_1; Domain location=98-120; Score =11.1; E_value=2.4; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1; Domain location=24-65::122-144::146-168::170 -193::195-217::220-242::98-120
MTLSSFLCLVFIFQFLFTSPSLSLSSDGLALLALKSAVDEPSAAAFSDWNNGDPTPCGWSGIACTNISGEAEPRVVGISLAGKSLSGYLPSELGTLRFLRRLNLHDNAFSGVLPAQLSNATALHSLFLHGNNLSGAIPSSLCTLPRLQNLDLSKNAFSGHIPEHLKNCKNLQRLVLAGNKFSGEIPAGVWPDLRNLLQLDLSDNELTGSIPGEIGTLISLSGTLNLSFNHLSGKIPASLGKLPATVSYDLKNNNLSGEIPQTGSFSNQGPTAFLGNPDLCGFPLRKSCSGLDRNFSPGSDQNKPGNGNRSKGLSPGLIILISAADAAVVAFIGLVIVYIYWKRKDDENACSCIRKRSFGEEKGNMCVCGGLSCVGGVKSDDDEEEEYEGGEGEGEGELVRIDKGLSFELDELLRASAYVLGKSGLGIVYKVVLGNGVPVAVRRLGEGGEQRYKEFAAEVMAIGKVKHPNVVRLRAYYWAHDEKLLISDFISNGNLTHALRVDDVDGICHLLEQKAMLLVQHVSGDFFILIVFVCWVGLASCSEV

SEQ ID NO: 191219 - protein, 221 aa, Glycine max
  Coding DNA Sequence Number=SeqID_74441
  Gene Ontology: Mol. function=protein kinase activity; Cellular component=integral to membrane; Biological process=protein amino acid phosphorylation
  Homolog annotation: Hit_ID=Q1SI44; Match level="QueryCoverage=94%, HitCoverage=30%, E-value=2e-92, Identity=77%"; Hit description =Leucine Rich Repeat, putative
  Pfam annotation: Domain name=Pkinase; Domain location=1-216; Score= -48.5; E_value=1.1e-05; Accession=PF00069.15; Description=Protein kinase domain
  Pfam annotation: Domain name=Pkinase_Tyr; Domain location=1-216; Score=-89.0; E_value=5.2e-07; Accession=PF07714.7; Description =Protein tyrosine kinase
  Pfam module annotation: Pfam domain module=Pkinase::Pkinase_Tyr; Domain location=1-216::1-216
MLHFTRLFAAGRHGQPSTNLSWSTRLRITKGTARGLAYLHECSPRKFVHGDIKPSNILLDNDFQPYISDFGLNRLISITGNNPSTGGFMGGALPYMNSSQKERTNSYKAPEARVPGCRPTQKWDVYSFGVVLLEILTGRSPESSPTTSTSMEVPDLVKWVRKGFDQESPLSEMVDPSLLQEVRVKKEVLAVFHVALSCTEGDPEARPRMKTVSENLDKIGT

SEQ ID NO: 191220 - protein, 112 aa, Glycine max
  Coding DNA Sequence Number=SeqID_74442
  Homolog annotation: Hit_ID=Q2QM63; Match level="QueryCoverage=88%, HitCoverage=29%, E-value=7e-09, Identity=37%"; Hit description =Transducin family protein, putative, expressed
FNFHPNLFVSVHRKHAINDLAIHPSGEVALTISQDKCFAVVDLMHGLVVDCRSFCRPLGKEESLSLVKFNAAGDRFFVAALEKVSVYVTKTERFLLEFECSKRVLCAASSRV

SEQ ID NO: 191221 - protein, 66 aa, Glycine max
  Coding DNA Sequence Number=SeqID_74443
MEEAKEWKRTKQKKRSEGVGGVNPNGKGLGVLGKGRGCTLLAPTGMAREASVNGEDEQCKLGLVRN

SEQ ID NO: 191222 - protein, 38 aa, Glycine max
  Coding DNA Sequence Number=SeqID_74444
MTFTGRAVRVRRSKIFEEPNFQFYKKKFYIGSETIDVE

SEQ ID NO: 191223 - protein, 407 aa, Glycine max
  Coding DNA Sequence Number=SeqID_74445
MGMWHVRSSNITINTPSLENIVEEDSCEFPQKRPKKLVHGGLKALVMRKGYGYGRSYLPPTSLQLGAQARFSGRKGTSRASRSQVEYWVVSGCGTGAGIGEEEDPAKDGGVVSVERGVGVVTRVRWYKAEILLVWAKRRTCWAEAGLGCMGTFGVERNEHVVSMVFPLPIITRIVGSGTWGKMQKGNEASLDKVVGATTIHKYNHLMMGNVAVNAKCLRCRHFRQGVEANLGGREWDGGSNVINEGATTVTENPFLVTMVAQPFVPTDFQFFSGKTLNRWAKWRSGYSPEMKQLSNTVGERPMIQFARRSNSVGANRDSKACNRVSHDAMNPLWVIHWYHDKDLGRQIRVHQASYEVCMKVVRVWALGMGGYAVKLVEWRGWRDVRAWNPFSGSWKFGSGLRKHGLG

SEQ ID NO: 191224 - protein, 108 aa, Glycine max
  Coding DNA Sequence Number=SeqID_74446
  Gene Ontology: Mol. function=transporter activity; Cellular component= integral to membrane; Biological process=oligopeptide transport
  Homolog annotation: Hit_ID=Q7XAK5; Match level="QueryCoverage=89%, HitCoverage=18%, E-value=2e-37, Identity=74%"; Hit description =Nitrate transporter
MNTLPQTPGKTIPDACDYKGRPAERSKTGVEACERLTTMGVAVNLATYLTGTMHLGSANSANTVTNFMGTSLMLCLFGGFVADTFIGRYLTIAIFATVQATVRHYCNV

SEQ ID NO: 191225 - protein, 298 aa, Glycine max
  Coding DNA Sequence Number=SeqID_74447
  Gene Ontology: Mol. function=DNA binding; Cellular component=beta -galactosidase complex; Biological process=DNA integration
  Homolog annotation: Hit_ID=Q1SDN3; Match level="QueryCoverage=96%, HitCoverage=23%, E-value=1e-88, Identity=53%"; Hit description =Polynucleotidyl transferase, Ribonuclease H fold
NNIDEIQSITALLDQTFKIKDLGNLKFFLGLEIARTAQGMLGCRPHSTPMDYSTKLQATSGTPLPVETSSSYRRLVGRLIYHTNTRPDITYAVQQLSQYMANLTTSHHQAAFRILRYLKGTPGSGLFFATTGTHQLQAFSDSDWAGCRDSRRSITGFSIYFGSSLISWQSKKQSTVSRSSSEAEYRALASATCELQWLTYLLQDFRVSFIQPATLYCDNQSAIQIANNPVFHERTKHIEIDCHIVRNKINSGLIKLLPISSSNQLADIFTKALSPAVFQGLCNKLGMMNIHSQLAGGS

SEQ ID NO: 191226 - protein, 33 aa, Glycine max
  Coding DNA Sequence Number=SeqID_74448
MAQRRLHNIGDRTAQWRRGMYTDIRSKTSIFLR

SEQ ID NO: 191227 - protein, 475 aa, Glycine max
  Coding DNA Sequence Number=SeqID_74449
  Gene Ontology: Mol. function=DNA binding; Cellular component =intracellular; Biological process=DNA integration
  Homolog annotation: Hit_ID=Q1SKN1; Match level="QueryCoverage=99%, HitCoverage=33%, E-value=1e-130, Identity=50%"; Hit description =Integrase, catalytic region
  Pfam annotation: Domain name=rve; Domain location=3-107; Score=20.3; E_value=0.00012; Accession=PF00665.16; Description=Integrase core domain
  Pfam module annotation: Pfam domain module=RVT_2::rve; Domain location=306-475::3-107
MNFIASVETQFDSKVKIIRSDNGPEFLMHDFYASKGIIHQTSCVETPEQNEIVERKHQHLLNVTCALLFQASLPPSFWGYALSHAAYLINCIPTPFLHNISPYEKLHGHPRDISNLRVFGCLCYINTLKAHCQKLDPRAHPCIFIGFKTHTKGYLVYDFHSHSINCSRNVVFYENHFPHFPETSSLKSTFTIPTPESFSSDQYEPPVDIIITIRRTQNGPTQDEPSSPHLRRSTRQKHAPTYLQDYHRGLTSSATSASTIARYPLSSVLSYSRLSPSHQHFVMTISSNIEPSSYAEASRHDCWIKAMQAELHALQENKTWTLTNLPPHKTAIGCRWVYKIKYHADGSIERYKARLVAKGYTQMEGLDYLDTFSPVAKLTTVHLLLALAALHQWHLRQLDVNNAFLHGELAEEVYMQIPPGLSIKDPNLVCRLQRSLYGLKQTSRQWFTRLSSFLISHGFRQSTSDHSLFLRFTDN

SEQ ID NO: 191228 - protein, 91 aa, Glycine max
  Coding DNA Sequence Number=SeqID_74450
MLSSTSTSFSLPPSSPYDSIGGNIAHNIATEINSPNLGIVLQQLHCTAPTLPHHHMLEIMVDETTNQEGRLWFKQRYHTHKKMPSVKNLNQ

SEQ ID NO: 191229 - protein, 78 aa, Glycine max
  Coding DNA Sequence Number=SeqID_74451
  Subcellular localization annotation: CTP_CleavageSite=65; ConfidenceScore=5.44e-01
MVFGNRKLMMISGCGVGGGGKGKSSWSSSTSSWVTTILVSMLTLGKNGGFQICDNVVSFGYGGAMATRRVCGVNMKGL

SEQ ID NO: 191230 - protein, 323 aa, Glycine max
  Coding DNA Sequence Number=SeqID_74452
  Gene Ontology: Mol. function=DNA binding; Cellular component=beta -galactosidase complex; Biological process=DNA integration
  Homolog annotation: Hit_ID=Q1SS72; Match level="QueryCoverage=93%, HitCoverage=23%, E-value=4e-58, Identity=36%"; Hit description =Integrase, catalytic region
  Pfam annotation: Domain name=zf-CCHC; Domain location=205-222; Score =14.2; E_value=0.0045; Accession=PF00098.13; Description=Zinc knuckle
  Pfam module annotation: Pfam domain module=Retrotrans_gag::zf-CCHC; Domain location=36-151::205-222
MITALSAKNKLEFVDGSAPEPLKTDRTYGAWRRCNNMVVSWIVHLVATSIRQSVLWMDKAEEIWRDLKSRYSQGDLLRISDLQQEASTMKQGALSVTEYFTRLRVIWDEIENFRPDPACSCNIRCSCSALTIIAQRKLEDRAMQFLRGLNEQYGNIRSHVLLMDPLPAISKIFSYVVQQERQLLGNVSSNLNLEPRDISINAAKVVCDFCGRTGHMENVCYKKHGMPLNHDGKNRNNNKHGYPPGYKAFNGRSSVNNVIAVEGKVTDDQEQRHESQEIISFSPEQCKALLALIQQSSAGSTASNHPQTKQVASISSTDTVTNP

SEQ ID NO: 191231 - protein, 57 aa, Glycine max
  Coding DNA Sequence Number=SeqID_74453
MAVDQPGCVFCAHDLESLNHLFAQCTYSHQRNSIIFMGGVLLEFRSILSQIQRLSWT

SEQ ID NO: 191232 - protein, 465 aa, Glycine max
  Coding DNA Sequence Number=SeqID_74454
  Gene Ontology: Mol. function=protein binding; Cellular component =cytoplasm; Biological process=steroid metabolic process
  Homolog annotation: Hit_ID=Q9SU36; Match level="QueryCoverage=96%, HitCoverage=58%, E-value=0.0, Identity=71%"; Hit description =Putative SWH1 protein
  Pfam annotation: Domain name=Oxysterol_BP; Domain location=85-463; Score=174.7; E_value=2.3e-49; Accession=PF01237.9; Description =Oxysterol-binding protein
MAANIEPEATALHDSEYQLTKNEFSSLGRGKYSECSTTESSDDIEKQEMEEVSDEDEISYYDTKEYFTEHGFRCGSTGDLDSMNMSGEGNTQCIDLENSLVGKTINDFGYPQIARRKKLPDPVEKEKGVSLWSIIKDNVGKDLTRVCLPVYFNEPISSLQKCFEDFEYSFLLDRAYEYGKSGNSLLRALNVAAFAISGYASSEGRHCKPFNPLLGETYEAHFPDKEVRFFSEKVSHHPTVVACHCEGRGWKFWADSNIRSKFWGRSIQLDPVGVLTLEFDDGEIFQWSKVTTTIYNLILGKIYCDHHGNMDIRGNRQYSCRLQFKEQAILDRNPHQVHGFVEDVMGKKVATLFGKWDDSIYYVNGEVNVKPKDFTMSDTNLLWKRTKPPSNLTRYNLTSFAITLNELTPGLKEKLPPTDSRLRPDQRHLENGEYEKANMEKQRLEKRQRMTCYIITHFRMVDDMA

SEQ ID NO: 191233 - protein, 284 aa, Glycine max
  Coding DNA Sequence Number=SeqID_74455
  Gene Ontology: Biological process=steroid metabolic process
  Homolog annotation: Hit_ID=Q9SU36; Match level="QueryCoverage=82%, HitCoverage=33%, E-value=6e-62, Identity=54%"; Hit description =Putative SWH1 protein
  Pfam annotation: Domain name=PH; Domain location=52-187; Score=43.5; E_value=7.4e-10; Accession=PF00169.19; Description=PH domain
MRVKEMHPLCCISLESPGIGSDSPEPEAAALSRTRSLPAGGSDGIARRGSEATVAGVLYKWTNYGKGWRSRWFLLRNGVLSYAKIRWPENLNLLSPVDDVRLIGEVTANRLAREAASAAATVRRKNHKPPSSSSSSAVVHLKISSFRESKSDDRRFYIFTSTKTLHLRTDSRKDRVAWIQALVSTRGLYPLRPLSDHLSLAPNNISVSAERLKKRLLEVGSSESLVKDCEQIMLAEFSELQEQLQILCQERMNLLDTIRQLELRTLLRITSLLPRTTTPPFQIW

SEQ ID NO: 191234 - protein, 107 aa, Glycine max
  Coding DNA Sequence Number=SeqID_74456
  Subcellular localization annotation: CTP_CleavageSite=32; ConfidenceScore=5.04e-01
MAEPSKKRKGTSSQSQRHSGSQEALIPPSIPSGSLFSSEEQRIWYTNLFSSRSIVDPKFIDMEFFSNENFECFQTFENSNVIPFMSPKLPVYSELVKSFYSNLEIHE

SEQ ID NO: 191235 - protein, 78 aa, Glycine max
  Coding DNA Sequence Number=SeqID_74457
MTSYSNMYKDNWTQPWPMGSEIYPEVHENPRAFSCFFGPIFLESSIQCPWGVGLHQYCLRQLPYLLAVSNDSLSAWTR

SEQ ID NO: 191236 - protein, 252 aa, Glycine max
  Coding DNA Sequence Number=SeqID_74458
  Gene Ontology: Mol. function=nucleic acid binding; Cellular component= integral to membrane; Biological process=DNA integration
  Homolog annotation: Hit_ID=Q1S4N1; Match level="QueryCoverage=94%, HitCoverage=21%, E-value=8e-67, Identity=49%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=zf-CCHC; Domain location=218-235; Score =11.4; E_value=0.013; Accession=PF00098.13; Description=Zinc knuckle
MEAYLDANDVWETVEEDYEVPPLPNNPTVAQMKSHKERRLRKSKAKSILFTAVSPVIFNRIMMMKTTHKIWNFLKEEYEGSEKIKGMQALNLIRELEMQRMKDSETIKDYADKLLGIANKIQKYEATLTSLENSKDLSTITLAELLTALQAPEQRRLMRQEGTTEGALVAKSLEKKRRASQEVSTTKMVANPLMIFHHVLFVKKNNHPQTKCWWRPNVKGHKCGQLGHVEKICKSSQKQENVQAVVEEVDEE

SEQ ID NO: 191237 - protein, 226 aa, Glycine max
  Coding DNA Sequence Number=SeqID_74459
  Gene Ontology: Mol. function=nucleic acid binding; Cellular component= nucleus; Biological process=DNA integration
  Homolog annotation: Hit_ID=Q1SIY6; Match level="QueryCoverage=99%, HitCoverage=23%, E-value=1e-66, Identity=50%"; Hit description =Integrase, catalytic region; Zinc finger, CCHC-type
  Pfam annotation: Domain name=rve; Domain location=101-225; Score =70.4; E_value=5.8e-18; Accession=PF00665.16; Description=Integrase core domain
MTYDQELFKDLDATYNTNVRIGNGEKIAVKGKGTIMIEGCTDNTLVWHKRMGHFHQGALLYLRKNDLVQGLPEFEDKSPVCVACQYGKQTRLSFPKGKSWRATSKLQLVHTDVEGPQKTPSLNGSKYYIAFIDDFSRMCWIYFMKNKTEVASIFYKFKAWVENQNERKMQILRSDNGTEYTYDKFSKFCEDAGIEHQLTTPYTPQQNGVVERKKQNDLGNGKMFTS

SEQ ID NO: 191238 - protein, 703 aa, Glycine max
  Coding DNA Sequence Number=SeqID_74460
  Pfam annotation: Domain name=RRM_1; Domain location=130-200; Score =35.0; E_value=2.7e-07; Accession=PF00076.12; Description=RNA recognition motif. (a.k.a. RRM, R
MGASSPAFSRNTDNEDAHWCNKSSTDCTWFSIAGKLPKVAGSLASRAAQELERPKACASRCWVNVDVTKFDYEICGAQLDFALSSASSFEEQHRATRREDTHQTPSGIRNGHGQRYSQDSWRGRTDIVSFYFTRFLEKATEKDLWKHFKKFGDVREVFIPKNRNKTGRRYGFVRFKGVEDVHSLERKLDNVVYGGLRIYVNTPKFARTQQSKLELKQFTPVEHRGVEVRWPRQMQPRPNQGSYADVVTGNQRGTRNKRIVVTENSSNEGSWSSVYLEVPETGINWLKEAWVGRLKNLVMFDRLEDDVYWGDNEDLALKYLGDDMVLILGLTDERAEKMMAEENEGRVTPFHSLEKWSPKLRTGYRLTWVSCWGIPLQAWDSMQISKIMAFIGDIVDMEDDVDAAWRLDKVRVLLKTPRRPLIRHTAEVHIKGEVYRVYIVEEGGGGNPDRTHCTSWGGYGSSEEIESFVSDREDDCSPMAELGKTEQKSLLKAIRNAGATSSAPFALVQGRRAMPVVEEQPEPRKGPLSAPKMDEQPIILARGALTDVTYHMHVASTSTAYSEVLAVAAEQSTEDTLVVAAEQSTEDTLAAKQDQPAIMASVTSEETQVHVFGSLPSGYSKPKCLLDKEITQEIPNLTATVHCGASDTALSATVNTPPQDQLHAQQGTTIEFNQNEERQGPEVKKGSAERTEKGSLAETIEKV

SEQ ID NO: 191239 - protein, 327 aa, Glycine max
  Coding DNA Sequence Number=SeqID_74461
  Gene Ontology: Mol. function=RNA-directed DNA polymerase activity; Biological process=RNA-dependent DNA replication
MGALDVLYWSMFQQLGIPESQIEPFLEPLINFVGETIDTIGYAHLLTTFKDKKADQITTQECYTVSLRVGKEKKGTKPKAQLVRCTSLNNLRDIELDPRETNGRPKLTEVVKSFQRGKETSQYTRIGCQMNPEVEKVVTRVLEANEDLFAWSMKRKLSPKRGKIVDKEARKLLSARLKNVGATYQRLMDKIFANQLGNNLEFYVDDMVSVELPKFGIKYESRGPVKAQCLADFVIELSTNTKSESEWWRLYVDGSSNRKGSGAGVILESLDEVILKQSLRYEFEIPHNQVKYEALVAELRMANEIRVKYLKCWSNSKLFIDQLNEEY

SEQ ID NO: 191240 - protein, 197 aa, Glycine max
  Coding DNA Sequence Number=SeqID_74462
  Gene Ontology: Mol. function=transferase activity, transferring glycosyl groups; Cellular component=chloroplast; Biological process =biosynthetic process
  Homolog annotation: Hit_ID=Q6DW76; Match level="QueryCoverage=87%, HitCoverage=28%, E-value=5e-54, Identity=57%"; Hit description =Digalactosyldiacylglycerol synthase 1, chloroplast precursor
  Subcellular localization annotation: CTP_CleavageSite=22; ConfidenceScore=5.12e-01
MQQQPPMVPRHRKVFHQRCFAMATHLQTPTSSNAFLFISKGWREDLATSFDRELENFFDFTMSPFSMSAMCSPLPKEIEFIKSLGPKLTQIRINLSAIKNVIVLAEEGIVDFEKRRRRRLSFWEEWKNDGEGESRDWELIQVLKTQFKVFEKCGSSFEAFKNSESVEKVKSSLKSMCKEPQESKYTNPWILKQLLYA

SEQ ID NO: 191241 - protein, 168 aa, Glycine max
  Coding DNA Sequence Number=SeqID_74463
MSFSGEGSVRFDDDRMFSQKVHPIGESSNNNPIHLHGGSNVASGQVSDVRVANAIVGGVTVPPDAGQIPWLNPPPNVIDLGLEVTTIQSVPRIPFFWTSSPMKFIKNPIAYMSDSDQENMVVLLIMGKFDYHSIKKAQVEKDEKAKAEKMEEKLKTDFSEAETEILKT

SEQ ID NO: 191242 - protein, 1173 aa, Glycine max
  Coding DNA Sequence Number=SeqID_74464
  Gene Ontology: Mol. function=RNA-directed DNA polymerase activity; Cellular component=nucleus; Biological process=RNA-dependent DNA replication
  Pfam annotation: Domain name=Exo_endo_phos; Domain location=1-229; Score=-13.5; E_value=0.086; Accession=PF03372.13; Description =EndonucleaseExonucleasephosphatase family
  Pfam module annotation: Pfam domain module=Exo_endo_phos::RVT_1; Domain location=1-229::488-744
MLEGLGGGSNGQQLKDWSLGIRLTCFVYKRRKRSLLISPLAKLCGGDPNVSWESQPASNSAGGILCIWNNKTFKLERKVSGPGFLMLEGKWHQEDHLIHIINIYSPCDIQNKRVLWNNVQQLKSQSQRGLWCILGDFNNIRHPSERLSAYHRELGESNINEFNEWIDELEVDDAPWLGRKFTWVRPNGTVRSKLDRFMLSSEWLAKWPGSTQQALDRNFSDHCPILLSSKIVDWGPKPFRILDCWLSDKSFSKMVQDSWNSTQQSGWGGFVLKEKIKKLKQSMKVWNTQHFGDTFKKFKKIEEELNKMENDTCHRHLTPEESLVRKRLQEELWIAAQSHESLLRQKARSRWIREGDCDSRYFHLLMNASRRNSCLKGVMIDGLWIEEPVRVKEAVRSFFMQRFQEPVSDRPRLDGISFQIIDRLHNDMLVERFKEEEVKVAMWECGSEKCPGPDGLNFKFIKKYWNLIKPDVLRFLDEFYVNGKFPRGCNASFIALIPKVHEPQCLNEYRPISLIGCIYKIVAKLLANRLKKVMPFIIDERQSAFIEGRHLLHSVVIANEVVEDARRGQKSCIVFKVDYEKAYDSVSWDFLLYLLRRMSFHSKWIQWIEGCLKSASISMLVNGSPSQEFIPQRGLRQGDPLAPFLFNIVAEALNGLVRQAIVKNLYRGYSVGPNNVDISILQYADDTIFFGEASMRNVKAIKAILRSFELVSGLKINFAKSSFGVFGMSDQWRSEAADYLNCSLLTIPFIYLGMPIGANPRRIPKKMVDKLVRIQRKFLWGGALDHNKIAWVKWDTVCLPKDKGGLGIKDVNTFNHALLAKWKWHLFQHHGQLWAKVLESKYGGWRGLDEDVRGSKESIWWRDLKEATHHPEHGDAVQKSTVWRVGCGDKIKFWEDDWIDGSGALAAKYPRLYLISSQQNQTIQQMGVHKESGWEWQFTWRRSLFDNEIDTAIAFLKDIEIQQIQPQRSDGWVWMADSSGQFSVKSAYSAMREAPSEMTEGTAYVELWNTKVPNKILVFAWRLLRDRLPTRSNLHRRHVEINDRRCVLCGSMEEDTEHLFFHCSKVIPLWWESLSWVNYVGPFPQNPKQHFLQHIHGVTQGVRRDRWRWWWLALTWSIWQQRNKIIFSDDTFDANKIMDDASFLLWTWLRNLEKDFNISYSHWSSNLRSGFVY

SEQ ID NO: 191243 - protein, 80 aa, Glycine max
  Coding DNA Sequence Number=SeqID_74465
MSSLTSFILKGVAMTGGILEVVSNPWRFILENWLCDSDLDNPTRIDRVLIEKDLLADAYSDCPEASILDEKEFLLLKGQV

SEQ ID NO: 191244 - protein, 74 aa, Glycine max
  Coding DNA Sequence Number=SeqID_74466
MPHNGKWNGQGERKWRVYGGLNGRDLVQSLNVFGWRMMKKENEEGCWKNHSSGIGVTHKMVFLDKPIFLNHSSN

SEQ ID NO: 191245 - protein, 229 aa, Glycine max
  Coding DNA Sequence Number=SeqID_74467
  Gene Ontology: Mol. function=RNA-directed DNA polymerase activity; Biological process=RNA-dependent DNA replication
MVEREKFDHIEERLRAIEGGRDYASVDMVELCLVPDVVISPKFKVLDFDKYKGTTCPKNHLKTYCRKMEAYVKDEKLLMHFFQESLDGVAITWYTNLEHSRVCFWKDLMVAFIRQYQYNSDMASNRMQLQNMCKREHESYKEYAQRWRDLAAQVAPPMMERKMITMIEDTLPVFYYEKMVGYMPSGFADLVFAGERIEVGLRRGKFDYVASGIRSLGKMERIRREKPML

SEQ ID NO: 191246 - protein, 230 aa, Glycine max
  Coding DNA Sequence Number=SeqID_74468
  Gene Ontology: Mol. function=transporter activity; Cellular component= integral to membrane; Biological process=transport
  Homolog annotation: Hit_ID=Q9ZUY2; Match level="QueryCoverage=99%, HitCoverage=33%, E-value=2e-37, Identity=45%"; Hit description =Putative membrane transporter
  Subcellular localization annotation: CTP_CleavageSite=68; ConfidenceScore=5.30e-01
MSSSDPNNRNRHAPSLHEPKPMPPSSWAKKTGFRPKFSGETNVTDSGPISTPPPNVDLEAGRVRTPATANGVANGDKAPVPVPPPPAAARKRRDSDGGPRSSVPSTNGQAPAAETAPPPRRTARHEEVVDGLPADDDGFVSRHSHMKYELRDSPGLVPIGVYGIQHYFSILGSLILIPLVIVPAMGGTHCFDFGGKVVNVLVSVGGNFYGGIDRALCLGGDYSLAYCFWL

SEQ ID NO: 191247 - protein, 304 aa, Glycine max
  Coding DNA Sequence Number=SeqID_74469
  Gene Ontology: Mol. function=transporter activity; Cellular component= integral to membrane; Biological process=transport
  Homolog annotation: Hit_ID=Q9ZUY2; Match level="QueryCoverage=87%, HitCoverage=36%, E-value=1e-113, Identity=74%"; Hit description =Putative membrane transporter
  Pfam annotation: Domain name=Xan_ur_permease; Domain location=7-286; Score=-71.7; E_value=1.9e-05; Accession=PF00860.11; Description =Permease family
MRELQGAIIIGSAFQTLLGYTGLMSLLVRLINPVVISPTIAAVGLSFYSYGFPLVGTCIEIGAVQILVVIVFSLYLRKISVLGHRIFLIYAVPLGLAITWAFAFLLTEAGVYSYKGCDVNIPASNMVSEHCRKHFSRMRHCRVDTSQALKSSTWFRFPYPLQWGTPVFHWKMAIVMCVVSLISSVDSVGSYHASSLLVASRPPTPGVLSRGIGLEGLSSVLAGLWGTGTGSTTLTENVHTIAVTKMGSRKAVQLGACFLIVLSLVGLAQCECGLEREIQYDNAPEKLDPGLSPKDLTLFNNQIP

SEQ ID NO: 191248 - protein, 105 aa, Glycine max
  Coding DNA Sequence Number=SeqID_74470
SWSSSSFLVVSDLVEVHCYGGSLEVHGCRGGWCCDVMTDEDQWIYDNIMSEEVNKNEDNIEEFGVFENIDCPDSFNISQVFVTRDDVLHWGRFVAYDIGFVAVIM

SEQ ID NO: 191249 - protein, 128 aa, Glycine max
  Coding DNA Sequence Number=SeqID_74471
MANINNIAALKLQLYNHIRSMHDEGLVNQQFLQLQVLRQPFRCDIILRLVTTYCNSCKDLFSSLSHQLDQERVNYERLNDLALDFYARTSSIGAEGVRRACASLIEACERKDKNGMSDIFPPNYVPNQ

SEQ ID NO: 191250 - protein, 90 aa, Glycine max
  Coding DNA Sequence Number=SeqID_74472
MGQWREMVDGFKSLDGGEVGSNEKEVFKWLWQIKISNKDDLASCLSGQGEEDISHACSFLMQSGSSYLVEMLYSHVGCLSNSSVIASASL

SEQ ID NO: 191251 - protein, 252 aa, Glycine max
  Coding DNA Sequence Number=SeqID_74473
  Gene Ontology: Mol. function=protein serine/threonine kinase activity; Cellular component=cytoplasm; Biological process=protein amino acid phosphorylation
  Homolog annotation: Hit_ID=Q0WN21; Match level="QueryCoverage=99%, HitCoverage=56%, E-value=5e-96, Identity=67%"; Hit description =Protein kinase like protein
  Pfam annotation: Domain name=Pkinase; Domain location=31-212; Score= -34.5; E_value=1.7e-06; Accession=PF00069.15; Description=Protein kinase domain
MLGVIYRDLKPENVLIRSDGHIMLTDFDLSLKCDDSSSTAQIISDQKTLPTVPRNNSHVEPARATSSSCMISNCIVPTASCFNPKRSRKKKQTHFNGPTFVAEPVNVRSMSFVGTHEYLAPEIVSGEGHGSAVDWWTLGIFMFELFYGVTPFKGMDHELTLANVVARALEFPKEPAASAAMKDLISQLLVKDPAKRLGSVMGASAIKQHPFFQGVNWALLRCTPPPFVPPPSSVNAVYDDHESCPEIFIDCF

SEQ ID NO: 191252 - protein, 266 aa, Glycine max
  Coding DNA Sequence Number=SeqID_74474
  Gene Ontology: Mol. function=RNA-directed DNA polymerase activity; Cellular component=chromatin; Biological process=chromatin assembly or disassembly
DGHDDLGNVYAPHAHEDAWGLIHGVGVEDTWHDVIGGMRVSGEAKPSEAPFQEEKFRDLRQPLRPCPYTQGSFAPHPPQSNSTPTPPLLPPQLLLPTQTKPSIPFKCLSPKEIAICKEKGLCFNCDERFSHDHRCSSKLFILIVDDDKVSPEELPPTNTFPVAKEHDEQVSTQISFHVISGHMAPETLRLVGSISSQKVLILADGGSTHNFIHEHLVTILGLQAQPTQPIRVMIGNGTEIDYLHVCRHVKLHIRGHDFIVDLAART

SEQ ID NO: 191253 - protein, 237 aa, Glycine max
  Coding DNA Sequence Number=SeqID_74475
  Gene Ontology: Mol. function=chromatin binding; Cellular component =chromatin; Biological process=chromatin assembly or disassembly
  Homolog annotation: Hit_ID=Q1SAV4; Match level="QueryCoverage=93%, HitCoverage=62%, E-value=6e-51, Identity=43%"; Hit description =Integrase, catalytic region
  Pfam annotation: Domain name=Chromo; Domain location=170-218; Score =23.1; E_value=0.001; Accession=PF00385.14; Description='chromo' (CHRromatin Organisation MOdifier
MNRIIEQYLRAFVHHHPSSWGKFLPWVEWSYNTSRNGSTGTTPFEITYGKKPLTIMQYLSGSSPVEAVDTLLTTRETVFESLRKNLLKAQAQMKHFANKNRREIYYTEGDWVLVKLCAHRTFAYKLLLPKGSRIHHVFHCSLLKPFHHDAITELQPLPLSEKDFDNHPAITPLTILGTHWNGPINDSHLHVLVQWVDLPVDDTSWEDLASLKADYHLKDKVILDGVGSDRPSTIHGA

SEQ ID NO: 191254 - protein, 153 aa, Glycine max
  Coding DNA Sequence Number=SeqID_74476
MAAWLFSLLLSPIPPLCGRGEGKMEGLECVANEDHDGRNGAVLFLWGSTWTTWEGTTEKPNSLNDDLLACAQGVTGRSCHWTHGLDLGLRFGDETGELGGGVVCMCSGGDEVLEALSFASKCGCQRANTRLLKWTMKTRVRDDGKEGMEENGQ

SEQ ID NO: 191255 - protein, 285 aa, Glycine max
  Coding DNA Sequence Number=SeqID_74477
  Gene Ontology: Mol. function=RNA-directed DNA polymerase activity; Cellular component=chromatin; Biological process=chromatin assembly or disassembly
  Homolog annotation: Hit_ID=Q8H7X6; Match level="QueryCoverage=42%, HitCoverage=14%, E-value=9e-21, Identity=45%"; Hit description =Putative retroelement
  Subcellular localization annotation: CTP_CleavageSite=60; ConfidenceScore=5.65e-01
MVVYPQYGGNLTMKSRDKSSHGRVGTSNRANNPTSFLFHLRVRNSGLSANSPLSSVIKVKCGIGRAKIIPLLGLNCLGHEFLEALMAWRSLGHNCLLKKAIGWCYWDRTAPMPDLDASVSRVNGREKSGKRNTGAMLIACCKAEMREWLPVTRPGGLWLKAGLGAKGHHMEFIMAIVSTEHRFMHIFVTYKDLMISLQQIKFGKPTRAPPSSSSNSSMVGMGNQSLMHQQGEQALARSDDSAAQHGFDLSLNLVLMKIWISVRLDVNRNRAGKKVNGVGNVTVWG

SEQ ID NO: 191256 - protein, 91 aa, Glycine max
  Coding DNA Sequence Number=SeqID_74478
  Homolog annotation: Hit_ID=Q1RST0; Match level="QueryCoverage=49%, HitCoverage=3%, E-value=3e-12, Identity=93%"; Hit description =Peptidase S1 and S6, chymotrypsin/Hap; Immunoglobulin/major histocompatibility complex; ...
  Homolog annotation: Hit description=AAA ATPase, central region
MAPGAKFCLLLKIIRSSKIGVRFDKSIPDGNDLGGLCEDDRGFFCSDDLEATWASFPKQSDNTAASATEAGANFINISMSSITSKRSGNAG

SEQ ID NO: 191257 - protein, 172 aa, Glycine max
  Coding DNA Sequence Number=SeqID_74479
  Homolog annotation: Hit_ID=Q1S3Q9; Match level="QueryCoverage=69%, HitCoverage=23%, E-value=3e-14, Identity=38%"; Hit description =Cyclin-like F-box; F-box protein interaction domain
MARVTVVEETLKGKETIHSEIVIISVDLEKETCRSLFLPDDFCFVDTNIGVFRDSLCVWQDSNTHLGLWQMRKFGDDKSWINLINFSYLHLNIHPYEEKSMIFPLCMSKNEDFFMLKFTRNADDEYQTILYNQRDGKSQVSVVPSDSSERCCGATSRFLPKVWSYLIEILQI

SEQ ID NO: 191258 - protein, 437 aa, Glycine max
  Coding DNA Sequence Number=SeqID_74480
  Homolog annotation: Hit_ID=Q1T035; Match level="QueryCoverage=36%, HitCoverage=18%, E-value=1e-25, Identity=42%"; Hit description =Integrase, catalytic region
MEGGEDIQTVFGRFQTILNELHSLAIKNLDSMTPEELIGILNVHEQELSQDEGIKKGKSLALIVQKPKCNFASKESSSKVFAINDASEKESDDDDSDEEDYELRHFKLECLDLEKPKDKKKKFFNKVEPTLDTSLDDEDSQPKDTVNSDAEEADCQHYKKMSFDLNYKLKEHEVLRELPPEIVQRNPKDKSGHGFRDNKIVHGQPTKGDAILPRRGPITIAMARRLQEDWAKDAGECPRVLMSLRSTAIDLQEAKDSIDEEDPRPTSSTWSYIKGDNLGKFDSKCDSRILLGYSKSSKAYRVYNSRTFIVEEAIHVRFNDNKFDTTMLELDNSFPEMKIENIVKCSSASSQDELASNRPVDDQPKKVREPIGPLLTKHHPKPQIIGDPKDKVKTRNSLKHTVLLSKIEPKHIDDAMFDEHWVKAMQVELDQFPKNNV

SEQ ID NO: 191259 - protein, 47 aa, Glycine max
  Coding DNA Sequence Number=SeqID_74481
MSASGESNFDEGDDSDISKVDDPEVKMDLTDDLLHMLPSPPRAPPPE

SEQ ID NO: 191260 - protein, 152 aa, Glycine max
  Coding DNA Sequence Number=SeqID_74482
MAEAAKPVNNVEASNPTPLTTIFAKPLLDISKIELSLLFPLPNMMSLLMPLNLNNGFELIRYRVVRNDNPYKPRANLVEGDGIIAAYVYPLHYVGDGEEQVYLSDLRTISVQGKGKVLLKLTSRKTPALNNVLHVPSIRVNLISIALLGNVG

SEQ ID NO: 191261 - protein, 201 aa, Glycine max
  Coding DNA Sequence Number=SeqID_74483
MHHHRWINETIFENYHNLQIHQQMHWISQNLNTSQYNEGHCKTKQYITFLDNICNLPLSQFRNEHQLCRQRIRTAGRGCYGSRSRKWVMLLCGRELAAKVRVKGSTIRGSKEAQESRDFKLKCTHGNYVIRGKNNNVFIYKPIVAFQHSKHELQYCSRGAVFVSSANVDAANEYARQGEVAVATKDDVELFAEVGDAIVRP

SEQ ID NO: 191262 - protein, 245 aa, Glycine max
  Coding DNA Sequence Number=SeqID_74484
  Gene Ontology: Mol. function=nucleic acid binding; Cellular component= intracellular; Biological process=protein modification process
  Homolog annotation: Hit_ID=Q56WR8; Match level="QueryCoverage=94%, HitCoverage=39%, E-value=4e-99, Identity=72%"; Hit description=ATP -dependent RNA helicase A like protein
  Pfam annotation: Domain name=DUF1605; Domain location=61-174; Score =105.4; E_value=1.6e-28; Accession=PF07717.6; Description=Domain of unknown function (DUF1605)
MFLPWWCSFKFYCIDQASDHIALLKAFEGWKEAKRSGNEKQFCWDNFLSPATLRLIDNMRMQFLNLLSDIGFVDKSRGANVYNQYSHDLEMVCAILCAGLYPNVVQCKRRGKRTAFYTKEVGKVDIHPASVNAGIYLFPLPYMVYSEKVKTTSIYIKDSTNISDYALLLFGGNLVPSKSGEGIDMLGGYLHFSASKSVIELIRKLRGELDKLLNRKIEEPGFDVSAEGKGVVAAAVELLHSQVMR

SEQ ID NO: 191263 - protein, 230 aa, Glycine max
  Coding DNA Sequence Number=SeqID_74485
  Gene Ontology: Mol. function=nucleic acid binding; Cellular component= intracellular; Biological process=multicellular organismal development
  Homolog annotation: Hit_ID=Q56WR8; Match level="QueryCoverage=99%, HitCoverage=44%, E-value=6e-96, Identity=70%"; Hit description=ATP -dependent RNA helicase A like protein
  Pfam annotation: Domain name=Helicase_C; Domain location=41-138; Score=36.2; E_value=1.2e-07; Accession=PF00271.21; Description =Helicase conserved C-terminal domain
DIDVDTNYKNYSLGVRKSLEAWSGSQIDLGLVEATIEYICRNEAGGAILVFLTGWDEISKLLDKLKGNNLVGDPSKKIVLATNIAESSITIDDVVYVIDWGKAKETSYDALNKLACLLPSWISKASAHQRRGRAGRVQPGVCYRLYPKLIHDAMPQYQLAEILRTPLQELCLHIKSLQLGTVGSFLEKALQPPDPLAVKNAIELLKTIGALDEQEELTPLGILCWICLSP

SEQ ID NO: 191264 - protein, 286 aa, Glycine max
  Coding DNA Sequence Number=SeqID_74486
  Gene Ontology: Mol. function=nucleic acid binding; Cellular component= intracellular; Biological process=chromatin modification
  Homolog annotation: Hit_ID=Q109A0; Match level="QueryCoverage=65%, HitCoverage=98%, E-value=2e-25, Identity=42%"; Hit description =Expressed protein
MASAWVKSWQCKSRAFEDVYHPHPKILSASCRKTMESIKEMVEIPKPRPRPRPKPKTPLEKHPSSKYPSSATKPEFEARTTMTRSRSSTTTTTSSRGIIELPEGHPSRNVVEIIFHTSWGPKPFPGRVELIFKLQNAPRTVSRFEEFREAMKGRAAAGLAEGNDGEENARCIADGNEVMRFHCLGPAGDGGPYDAGCAWSFPEKKGAAICTFSGSGGAHETAGGGRGRRAMLVCRVVAGRVSKQLGFLDSLLDKRVGFDSVSRDNGELLVFDSRAVLPCFLIIYRL

SEQ ID NO: 191265 - protein, 423 aa, Glycine max
  Coding DNA Sequence Number=SeqID_74487
  Gene Ontology: Mol. function=ATP-dependent helicase activity; Cellular component=intracellular; Biological process=protein modification process
  Homolog annotation: Hit_ID=Q9FW67; Match level="QueryCoverage=76%, HitCoverage=33%, E-value=3e-82, Identity=52%"; Hit description =Putative ATP-dependent RNA helicase
  Pfam annotation: Domain name=DEAD; Domain location=151-341; Score= -5.0; E_value=1.5e-05; Accession=PF00270.19; Description=DEADDEAH box helicase
MTCVEIGDGDGRLKMYVKVAWLGFDTRIRQFTKGLSVTSSWCCTWSGQFFGYPKVHIVLVLLIKMSTDIERRVGNLLNSSQSTGATLSSLPSISADLGQKQSAAPIKYVSSRQTDSSKEKLSVALKERQELVQASDSLKEMKSFREKLPAFKMKSEFLKAVQENQVLVVSGETGCGKTTQLPQFLLEEEISCLRGADCNIICTQPRRVSAISVAARISAERGESLGEAVGYQIRLESKRSAETRLLFCTTGVLLRQLGGEKGGVRGGCMSHTCSKYKTIYEPSSNSVQDPDLTGVSHLLVDEIHERGMNEDFLIIILRDLLPRRPDLRLILMSATINADMFSKYFANAPTMHIPGFTYPVAEHFLEDVLEKTRYSIKSDFDNFEGNSRRRRKQQDSKKDPLTEMFEACIFDPSIHVFKIFMMY

SEQ ID NO: 191266 - protein, 171 aa, Glycine max
  Coding DNA Sequence Number=SeqID_74488
MVIRTPFRHPETIESDGTQRQIMVILHFCHPKAVSPMTCGEPFGPALFHLLSSRGGGGPDDMRGTIWSCTFFTFCHPEAAGLMTCGESFGPALFLPLSSRGGGPDGMWETIWSHTFYTFCHPEAADSTPDSTQRLKSSSAPFVIQGQQVRWWVKIPYGHLRLSSTEGNEFG

SEQ ID NO: 191267 - protein, 85 aa, Glycine max
  Coding DNA Sequence Number=SeqID_74489
MSNHKSTESALKNLEVQVGQLAKQIADKSSNSFVANTEKNPKEECKVVMTRSKRFVEAEDEDSGFVPKKKAVEKKGTDDKKGDVR

SEQ ID NO: 191268 - protein, 60 aa, Glycine max
  Coding DNA Sequence Number=SeqID_74490
VTQGSFVPRGRQDVLIAAIGCPEHRGRVRAAGAGVTIKQYFGSAPRTSHISSSLPPEELQ

SEQ ID NO: 191269 - protein, 83 aa, Glycine max
  Coding DNA Sequence Number=SeqID_74491
  Gene Ontology: Mol. function=ribonuclease H activity
  Homolog annotation: Hit_ID=Q1SZM6; Match level="QueryCoverage=97%, HitCoverage=27%, E-value=8e-15, Identity=48%"; Hit description =Ribonuclease H
MVQLAFSTSRTSAPRIVSWSPPLDGGVKLNSDGNSQGNIGLSGFGGLLRDSFGIWIHGYSGFCGYTSILNEELLGILYGMKLA

SEQ ID NO: 191270 - protein, 250 aa, Glycine max
  Coding DNA Sequence Number=SeqID_74492
MQDEDPAAALRLLLNTSQANTSSEKNPGASSSSDAEINSSVRQDCLLLKLSMEYAREDVLKSIEENPSAAFGHLNFLKKLHNPLTSDEILGKVIQIESIIDQFASTVQKKCENGARLDAQKQAHILLLEKARAAQREVERLTKEAKEGSSEVKACDDNISSWEATITDLLSQVDDLRQKIVTEQAKRQELQEKAANSIQKLVAEKGREGLKAFSASQAVADEARVMESADQVLSKEMATLKKLYEDLVMH

SEQ ID NO: 191271 - protein, 121 aa, Glycine max
  Coding DNA Sequence Number=SeqID_74493
MDEPYLGVDLGNVDVLVHFVGMKDEPCEIHNVDPDKNKEELWHEPQLATPVVNEPINKGINEQSGEYSSFDEHVESIDGDVLSDFDESVDANGAGVADDYIWRIHASPVVDKETYQIKSYE

SEQ ID NO: 191272 - protein, 84 aa, Glycine max
  Coding DNA Sequence Number=SeqID_74494
MVAMVLNMVGHGVGITHDACVFENALTTIFMNFPHPPPDVCNLECMPKFKCETQRRKPSWKGCSGSKIVGHRGGDRGARILHVV

SEQ ID NO: 191273 - protein, 335 aa, Glycine max
  Coding DNA Sequence Number=SeqID_74495
  Gene Ontology: Mol. function=protein transporter activity; Cellular component=integral to membrane; Biological process=intracellular protein transport
  Homolog annotation: Hit_ID=Q9ZSD5; Match level="QueryCoverage=85%, HitCoverage=93%, E-value=1e-101, Identity=66%"; Hit description =Syntaxin-related protein Nt-syr1
  Pfam annotation: Domain name=SNARE; Domain location=217-279; Score =89.5; E_value=1e-23; Accession=PF05739.9; Description=SNARE domain
  Pfam annotation: Domain name=Syntaxin; Domain location=41-148; Score =96.9; E_value=5.9e-26; Accession=PF00804.15; Description=Syntaxin
  Pfam module annotation: Pfam domain module=SNARE::Syntaxin; Domain location=217-279::41-148
MNDLFSGSFSRFRSDQSSPDRHHDIEMGATASSGGRGGEVNLDKFFEDVEGVKEELKELEGLAQSLRSSHEQSKTLHNAKAVRDLRARMDGDVSAALKKAKLIKLKLEALERSNAANRNMPGCGPGSSSDRTRTSVVNGLKKKLKDAMESFNEIRQLVSSEYRETVQRRYFTVTGENPDDKTLDLLISTGESETFLQKAIQEQGRGRILDTITEIQERHDAVKEIEKNLKELHQVFLDMTVLVQHQGEQLDDIESHVARAHSFVRTGAEQLQTARKHQKNTRKWTCYCIILLLVIILFVVLFTVKPWENSSSGGNGGGQPAPAQTPPSPSPPVNA

SEQ ID NO: 191274 - protein, 90 aa, Glycine max
  Coding DNA Sequence Number=SeqID_74496
MKNTCRMVADRKRVNGTSMHIDGLPPRLVVCTAKRIKLASCNVEFRYESGHGGMFVLTIMEWYAESSKVSDWELWLRNSIKWEWWPPIYI

SEQ ID NO: 191275 - protein, 330 aa, Glycine max
  Coding DNA Sequence Number=SeqID_74497
  Gene Ontology: Mol. function=transcription factor activity; Cellular component=nucleus; Biological process=regulation of transcription, DNA-dependent
  Homolog annotation: Hit_ID=Q8LFU0; Match level="QueryCoverage=85%, HitCoverage=94%, E-value=6e-32, Identity=37%"; Hit description =Nuclear transcription factor Y subunit A-10
  Pfam annotation: Domain name=CBFB_NFYA; Domain location=142-198; Score=123.4; E_value=6.3e-34; Accession=PF02045.6; Description=CCAAT- binding transcription factor (CBF-BNF-YA) subunit B
MAMQTVYLKEHEGLVHSSVGQLSSVTSAPWWSALGSQPVYGEYCGQMKSFSLEISNYVDQFGAGKQAARGVEQLLDKGHTTQFTIFPGISSSDDCKMSGDAQNPQATLSLQSSLAEPHNRFEIGVNQPMGRIMLPINLTSDEGPTYVNAKQYHGIIRRRQSRAKAVLENKMIKRRKPYMHESRHLHATRRPRGCGGRFLNTKSSTDGNGKNESEVIKTSGRQFQSSASQSSEVLQSEVGMLNSSKQTNRSSPNISGSEVTSMYSREGFDGFSVNPLGSSVHSLADMIGSEHGIIRPTKWVAAVPGEEVLFPFPVFIVTNFVLEACLYIWF

SEQ ID NO: 191276 - protein, 762 aa, Glycine max
  Coding DNA Sequence Number=SeqID_74498
  Gene Ontology: Mol. function=DNA binding; Cellular component=beta -galactosidase complex; Biological process=DNA integration
  Homolog annotation: Hit_ID=Q1SS72; Match level="QueryCoverage=99%, HitCoverage=56%, E-value=0.0, Identity=47%"; Hit description =Integrase, catalytic region
  Pfam annotation: Domain name=rve; Domain location=5-118; Score=44.7; E_value=3.2e-10; Accession=PF00665.16; Description=Integrase core domain
  Pfam module annotation: Pfam domain module=RVT_2::rve; Domain location=312-523::5-118
MHTKAETRKIIIDFVAYIETQFDGKVKIIRSDNGAEFLMHDFYALKGIIHQTTCVETPEQNGIAERKHQHLLNATRALLFQANLPLNFWCFALPHAAYLINCIPTPFLHNKSPYEKLYEHPCDISNLRVFGCLCYISTLKTHRQKLDPRAHPCIFIGLKPHTKGYLVYDLHSHNIIASRNIVFYEDHFSLFHENQASNTTHTSLSPTPFSSNPENFDSPITPIVNPSSSHAHDPHLRRSTRPKHAPTYLQDYHRDLTSLTVTTSPNVRYPLNSVLSYSRLSPSLRHFVMSISVSTEPKSYAEASRFDCWIKAMQAELQALQQNQTWTLTTLPQHKTTIGCRWVYKIKYNADGSVERYKARLVAKGYTQMEGLDFLDPFSPVAKLTTVRLLLALAALNNWHLRQLDVNNAFLHGDLNEEVYMHLPKADHYLFLYSTNNNITTILVYVDDSILTSNNLATIQHITMLLDQAFSIKDLGTLKFFLGLEVARSSHGIHLCQRKYVLDILSDSGMLGSRPTSTPMDYSTRLNALMGTPLSNTSASSYCRLIGRLIYLTNTRPDITHVVQQLSQYMANPTTAYSQAAFHVFRYLKGTPGSGIFLAAQGSPQLKAFSDSDWAGCRDTRRSITDFSIYLGNSLISWQSKKQSTVSQSSSEVEYRALASTMCELHWLTYLLHDFHVSFIQPVTLYCDNQSAIQIASNPVFHERTKHIEIDCHIVRDKVNSGILKLLPVSSSMQLADIFTKPLSPALFQGLCSKLGMMNIHS

SEQ ID NO: 191277 - protein, 58 aa, Glycine max
  Coding DNA Sequence Number=SeqID_74499
MDMSWPPPTVTRVIYSNQIHRRQSHKWTNNSNELLDQMNTLGGKKGKSDLQFANGRVK

SEQ ID NO: 191278 - protein, 215 aa, Glycine max
  Coding DNA Sequence Number=SeqID_74500
MSLPAPPWPYAFWPARLDLALTGLPPSCKDSAPPLDALRPRFVQAALLGYVLPIAKAVLLPGFFSAKLGNLPFSERLYPGTKRKRGGRPSTRSQGSGWWSLTRAIQETIQSKASKKKQKDSQSSRDSSRRQVLQRKLSIQREDRVVVVNRGREQLIRQDGIPLLHVFGLSFSCVDASKAAPSPPPPSALPVGYLRGLELRDCLLNVPYLTYRSIR

SEQ ID NO: 191279 - protein, 105 aa, Glycine max
  Coding DNA Sequence Number=SeqID_74501
MHDAIKEYARGLYETMHHEKRKTLDEASLLSQPTLRREGDARLAGCVFHKRNTRGVTTNVYLRKTSEKPGKTRSTNFLSERFGSLYLRAGKVLAPHTSVTRDDGL

SEQ ID NO: 191280 - protein, 189 aa, Glycine max
  Coding DNA Sequence Number=SeqID_74502
  Gene Ontology: Mol. function=transmembrane receptor activity; Cellular component=exocyst; Biological process=exocytosis
  Homolog annotation: Hit_ID=Q9FFX6; Match level="QueryCoverage=82%, HitCoverage=25%, E-value=1e-52, Identity=68%"; Hit description =Putative leucine zipper protein
MERGRFNKQASIRRYQARRSTADRKKRVTFRGAVNEGDGASGHKSRRKSEAKIKGSTEIYEVMGETWCRKRSTELRTYHKNYQVETWSKILSSLSPKGLNENGKVHKPVLKERFKSFNAAFEEIHKTQSAWVVYDEQLQSELRVSISALVIPAYRSFLGRFSQYLYPGRQVLKYVCMCVCVRACVLYAA

SEQ ID NO: 191281 - protein, 116 aa, Glycine max
  Coding DNA Sequence Number=SeqID_74503
MSRGSGDLGDVRVLCNSCLASGNRLPRLCNRLPEMKSLEIVMAAQVIHDRVEMECLEGAWETLEGNARCRFRGTIRFMATSLVHPEEPTRTLQRTMEWILPTPTPYRLVEPVQVIK

SEQ ID NO: 191282 - protein, 311 aa, Glycine max
  Coding DNA Sequence Number=SeqID_74504
  Gene Ontology: Mol. function=hydrolase activity
  Homolog annotation: Hit_ID=UPI00005FA93C; Match level="QueryCoverage =72%, HitCoverage=65%, E-value=9e-70, Identity=54%"; Hit description =COG2220: Predicted Zn-dependent hydrolases of the beta-lactamase fold
MASLMMSLVVLLVGLVVWFFVNRASSRTNEQIELLEALLDQQKRQNALLRRLCEANEPEEKDAPKDTVAEDKKDEDDFIRLVAVVWKNPWYDPSLNHHTPNGFRNTQPGGHQPGDLDRWRKARKEAGLPKPPTLGYDNFIRQWWQPAVLTQPHEDGVWWLGHASVLLQMDGNILLTDPVFSRRASPLPFLRPQRRTPPALSVDMLQQLDAVVISHNHYDHLDDATIRRILRRFPNVQLFVPLGLAAWFRRRGAKQVVELDWWQSFTWQGMTLTAVPAQHWSMRTPWNRNRSLWCGWVMEGRRHRFWFSGDT

SEQ ID NO: 191283 - protein, 79 aa, Glycine max
  Coding DNA Sequence Number=SeqID_74505
  Homolog annotation: Hit_ID=Q2MB16; Match level="QueryCoverage=98%, HitCoverage=100%, E-value=2e-19, Identity=54%"; Hit description =Uncharacterized protein yobH precursor
MRVIIRTIIVLAILWIGLLLTGYGVLVGSTENAAGLGIQCKYVTAQGVSTAQYLHSDSGIIGLTNCPVLRKMSVVVDNG

SEQ ID NO: 191284 - protein, 79 aa, Glycine max
  Coding DNA Sequence Number=SeqID_74506
MEELINKTQLSPKSNPNFITSAQRLHNRISLPAPYCCHSAPMNIVRDHHRMMHALDLNSQMQCGTYRIQYQGNSLSVST

SEQ ID NO: 191285 - protein, 143 aa, Glycine max
  Coding DNA Sequence Number=SeqID_74507
MAARHRAKEPVDMQRLVSSSAPFVILTYEGYRMVIRTFRQPGVNEPVDAQRLTSSSAPFVIQGQRFRWQAEIPYGHSHLLSTKANEFDGIRMMLVYSHRPETFKPDDTQDSSLQGGGRSSSMAWGNVMGPLFGGMHPSLDRLE

SEQ ID NO: 191286 - protein, 365 aa, Glycine max
  Coding DNA Sequence Number=SeqID_74508
  Gene Ontology: Mol. function=protein disulfide isomerase activity; Cellular component=periplasmic space; Biological process=cell redox homeostasis
  Homolog annotation: Hit_ID=Q7WEL4; Match level="QueryCoverage=73%, HitCoverage=97%, E-value=2e-96, Identity=64%"; Hit description =Probable thiol:disulfide interchange protein dsbC precursor
AQVRQRADAVGGERRAFAHGDDDVERRERGLDLLVGDEVVEDPHFGVAAEGSPVRVALGDVVVIVEYCDFQVGLRVAWRSLRQPPGRRDPRRSVQSCLELVQRQRAAGARAVGEEHRGRPAHHQLLAQRQQLVLGHAAIGGGRLLAAQHPVIPRLARVRRAPDVTHLHVGVGRQDRVQEGVDGDVVDVFERLAQLLAVTAVGVLEDRDLARAVALDLLDGQVQRQLVERDGTELFLRLAGDVAARHGVDQRTFHHPGHFFIGVDQVHAQLHLEQPVGRAAHGGHVHAGEALPETFLDRIRHGIGGRHLGGGIALAALARLADRAGGNGLVARCLRLSAGGQAQARGHEAGGQRGGKTEIHGDSCI

SEQ ID NO: 191287 - protein, 110 aa, Glycine max
  Coding DNA Sequence Number=SeqID_74509
MIVPSFRHSYRKSLRGRTRPIAEDVEHVNHVAKEVHEQPQEVVTVDVVADAQGFPGEPHNTSVFMEYVHHVPTTVWNGEERPKLKLSSHGRKVEKFGRHAPKIEGIVVAT

SEQ ID NO: 191288 - protein, 137 aa, Glycine max
  Coding DNA Sequence Number=SeqID_74510
MDEDQWMHDSIMSKEVDMNEENEKESGLNEENGEEPSVHQHVDCSDAFNTSQVFVTHDDALHWAQCVAYDIGFVAVIMSDMTKSMVKPRNILLPLKKHNANSYTTIKQVYNARYAYRYSIRGSNTEMKQLMKLLECD

SEQ ID NO: 191289 - protein, 91 aa, Glycine max
  Coding DNA Sequence Number=SeqID_74511
MPISPVLLAEPMGDGCMHGHVMDGMNGACMHNGFRQWWWRNPHACECFLLFLCKNSDVVGYFTAMDFIKVERDNENEENKQGLLKGGPDNG

SEQ ID NO: 191290 - protein, 90 aa, Glycine max
  Coding DNA Sequence Number=SeqID_74512
MAKHGAEKEVLEEALVQFDIEAFLHESEDHVIETGFGVEPIRSNLVSDANERQIDVVLSEVISEDTIISFEAIYGPSTTNNIADVQAGLK

SEQ ID NO: 191291 - protein, 94 aa, Glycine max
  Coding DNA Sequence Number=SeqID_74513
MFPKKSEPNLGPWAQKSTLRFMRTLGPSLAGLRVGLHHPFPLRKDLTSNPEPQISLILGGVGSEIYPEVHENPRAFFSRSSPILLESSIQYPWG

SEQ ID NO: 191292 - protein, 69 aa, Glycine max
  Coding DNA Sequence Number=SeqID_74514
MHDSCSRFSILASQLFFVRNFIRIEGFTAIDEACEILSPILLVEARIDSENHQAFLRSEEKIEDVEAYT

SEQ ID NO: 191293 - protein, 99 aa, Glycine max
  Coding DNA Sequence Number=SeqID_74515
  Gene Ontology: Mol. function=nucleic acid binding
MPQKCKDPGTFIIPCTICESTFVDVMLDLGAPLNVMPTSVYRSFQLGDLRPTKVFILLVNRSTAQPLGVMEDGNYTQAYEFLHQGMMTIKIVVCKHQIF

SEQ ID NO: 191294 - protein, 170 aa, Glycine max
  Coding DNA Sequence Number=SeqID_74516
MILMSQSSQSNVVEKFLQNAQVVSIGEINNLRQDCYCLTVGTVDEIIIDAPWSYDSCPNCTTTFDPLKGGSACRSCHTSVVDTVPRLAMIIFCTDYLFTHFAVLENFPEISMDVKVGDDIKVFPTCVDEILLKTWAVRFKFRSQLRQSSVLDVSEELHHIQSLIAILGLK

SEQ ID NO: 191295 - protein, 44 aa, Glycine max
  Coding DNA Sequence Number=SeqID_74517
MYSNAAFDLELEQLQAELVAIAVIQSMTSHFPGLPSQEAAVALH

SEQ ID NO: 191296 - protein, 82 aa, Glycine max
  Coding DNA Sequence Number=SeqID_74518
MSHPSSSVNGEGTSHKDPLSRILDELGSLKLWKEKLERKEKGKEKVEINQDEREQIREEERRKIMKEMEKEKHASYMTLARA

SEQ ID NO: 191297 - protein, 128 aa, Glycine max
  Coding DNA Sequence Number=SeqID_74519
MRKNAGTWGHITRFGTPLRLKLITRGKVACAQQSDLDTCCLVFKMSNSKCLGGKSFVGAANREKCAKRNSNPRGNCVERELLCLAQEKLCSVQIITLSANSNLRGNCAKQELSHLAAKVDSRLARRAH

SEQ ID NO: 191298 - protein, 202 aa, Glycine max
  Coding DNA Sequence Number=SeqID_74520
MDTTTMTQPGHQQLEEEEEEEEATLPSNGKSLTIETFDDTSNLDEQLDVYTTQSPTLKYSGFVQNTGSLLWHTVYNQSTSSANLGSISQRSPRKEGAFLNLHEKFQKDSFKHLKSRPGSCYASSNNCSKGKMRLSHEVPKVTVELSSSVSSARLSARMALSPNPLTRAKHEGGAKRNIPEHTIVPILGKDSGGKRSSFCRDT

SEQ ID NO: 191299 - protein, 97 aa, Glycine max
  Coding DNA Sequence Number=SeqID_74521
MASNNGSWQSPVVVGGGGGGLGFWVRLVVEGNFMDKWGVDTMAPKAFKDEHMSVLDFGGPTMFRKMALGGVLALLELGPRYGIYSHEERYNACSRVP

SEQ ID NO: 191300 - protein, 136 aa, Glycine max
  Coding DNA Sequence Number=SeqID_74522
  Gene Ontology: Mol. function=catalytic activity; Cellular component =cytoplasm; Biological process=carbohydrate metabolic process
  Homolog annotation: Hit_ID=Q7XAS4; Match level="QueryCoverage=72%, HitCoverage=25%, E-value=5e-37, Identity=76%"; Hit description =Transaldolase
  Pfam annotation: Domain name=Transaldolase; Domain location=10-130; Score=-89.9; E_value=0.0028; Accession=PF00923.9; Description =Transaldolase
MPLSGRNNYDFGTGLYINLNSQVHDLLKLYNDSNVPPQRLLFKIPSTWQGIEAARLLESEGIQTHLTFVYSFAQAAAAAQAGASVIQIFVGRIRDWARNHSGDTEIESAQLRGEDPGLALVRSLIFCSCFCSILRI

SEQ ID NO: 191301 - protein, 183 aa, Glycine max
  Coding DNA Sequence Number=SeqID_74523
  Homolog annotation: Hit_ID=P16181; Match level="QueryCoverage=20%, HitCoverage=23%, E-value=5e-09, Identity=73%"; Hit description=40S ribosomal protein S11-1
MRGKGTYVNGSKSHDSHGDYAIDLRGVAYGEAMKERERGERKQNEEGDEGTRNDGTALEERVPERVGIDFGSPMWFALRLPGRSSSFSFCLSSSLSQTGLHFRDCNHIVEFVFVEFVSTTYRLSSKKTRKGKSPGKGGNRFWKSIVVDFKTPREAIEGDFFVFFSRCQGSLLLVFYVLLSDQC

SEQ ID NO: 191302 - protein, 717 aa, Glycine max
  Coding DNA Sequence Number=SeqID_74524
  Gene Ontology: Mol. function=hydrolase activity, hydrolyzing O -glycosyl compounds; Cellular component=vacuole; Biological process =carbohydrate metabolic process
  Homolog annotation: Hit_ID=O24509; Match level="QueryCoverage=87%, HitCoverage=97%, E-value=0.0, Identity=83%"; Hit description=Acid beta-fructofuranosidase precursor
  Pfam annotation: Domain name=Glyco_hydro_32C; Domain location=474 -588; Score=180.2; E_value=5.2e-51; Accession=PF08244.2; Description =Glycosyl hydrolases family 32 C termi
  Pfam annotation: Domain name=Glyco_hydro_32N; Domain location=118 -433; Score=663.3; E_value=1.9e-196; Accession=PF00251.10; Description=Glycosyl hydrolases family 32 N termi
  Pfam module annotation: Pfam domain module=Glyco_hydro_32C::Glyco _hydro_32N; Domain location=474-588::118-433
MDHRKPLLPTSSDAAPNPHTRKDLLLVICGLLLLSSLVAFGGYRASNAPHADVASATSNDEQRSPTSVPSPKWYPVSRGVSSGVSEKSSSMLFAVKDGASKAFPWDNSMLSWQRTAFHFQPEKNWMNGPMYYKGWYHFFYQYNPNGAVWGDIVWGHAVSRDMIHWLHLPLAMVADQWYDMQGVWTGSATILPNGEIIMLYTGSTNESVQVQNLAYPANPSDPLLVDWIKYPGNPVLVPPPGIGAKDFRDPTTAWLTSEGKWRITIGSKLNKTGIALVYDTEDFKNYELKEGLLRAVAGTGMWECVDFFPVSKENENGLDTSINGAEVKHVMKVSLDDDRHDYYSIGTYDEKNVLFTPDDAKNDVGVGLRYDYGIFYASKTFYDQNKERRVLWGWIGESDSEYADVAKGWASVQSIPRTVELDRKTGSNLLQWPVAEIESLRLRSDEFKNLKAKPGSVVSVDIETATQLDIVAEFEIDKETLDKIPQSNEEYTCSTSGGSKQRGALGPFGLLVLADEGLSEYTPQYFYVIKGSNGNLKTSFCADQSRSSQANDVRKQIVGSAVPVLKGEKFSLRILVDHSIVESFAQGGRTVVTSRVYPTKAIYGAARLFLFNNATEATVTASLKLCPELKFLLFTPPLILFIVKVIIVVVDNVDDGDAEHEANTVLELKKAKQKKPKVTVAEGVVVMVVRISNLGVVAVWFGHSGDGSSSVMVMVQV

SEQ ID NO: 191303 - protein, 96 aa, Glycine max
  Coding DNA Sequence Number=SeqID_74525
  Subcellular localization annotation: CTP_CleavageSite=84; ConfidenceScore=5.45e-01
MAKLGAQPYASLGSDLLYGRCPSFDKSSCNGVDNTSRLVEGFCFPFSRPALAPMSFSFGSTVSEFDEVFNLVFQNTTFLNGVSSVAMISSTLGEIG

SEQ ID NO: 191304 - protein, 168 aa, Glycine max
  Coding DNA Sequence Number=SeqID_74526
  Gene Ontology: Mol. function=sequence-specific DNA binding; Cellular component=nucleus; Biological process=regulation of transcription, DNA-dependent
  Homolog annotation: Hit_ID=Q8W4H1; Match level="QueryCoverage=56%, HitCoverage=19%, E-value=8e-22, Identity=59%"; Hit description=GATA transcription factor 28
MVPSKKRTHVGRPKPLYVEKLMRDLCTILHEQQSYFSASSEEDLLFESDTPMVSVEIGHGSILIRHPSSIARDEEFEASTLSVDNKQCLMNEAYSFSSTIPMYSDCNNMNFSSHRVEKIKNLVGQIMQQEKLERHVFPDQFTIFHYSRTSLSLKNYKFIEIMIHHCVQ

SEQ ID NO: 191305 - protein, 125 aa, Glycine max
  Coding DNA Sequence Number=SeqID_74527
MFGLVWFFMVLLREVEDEPSSAEGSFLPRVSGCRWRSGGRSFLPRTPAEDGRYGTPVGFRGRTIFREKEMSRTRYPRKKLLPRVSKTFAEEPYLPSSTGVRGRKVLPWECFSFLRKNLLPRVPIL

SEQ ID NO: 191306 - protein, 71 aa, Glycine max
  Coding DNA Sequence Number=SeqID_74528
QRKGKEVAGKGSAGKRKGAFDDNMQDRWRPKEKQARCPLVISDDELNAAPRRMDMPDKGQSSRPRVVPQEE

SEQ ID NO: 191307 - protein, 473 aa, Glycine max
  Coding DNA Sequence Number=SeqID_74529
  Gene Ontology: Mol. function=oxidoreductase activity; Cellular component=anchored to membrane; Biological process=lignin catabolic process
  Homolog annotation: Hit_ID=Q9SU40; Match level="QueryCoverage=93%, HitCoverage=65%, E-value=1e-148, Identity=62%"; Hit description =Putative monocopper oxidase precursor
  Pfam annotation: Domain name=Cu-oxidase; Domain location=165-377; Score=179.5; E_value=8.2e-51; Accession=PF00394.12; Description =Multicopper oxidase
  Pfam annotation: Domain name=Cu-oxidase_3; Domain location=39-155; Score=207.4; E_value=3.3e-59; Accession=PF07732.5; Description =Multicopper oxidase
  Pfam module annotation: Pfam domain module=Cu-oxidase::Cu-oxidase_3; Domain location=165-377::39-155
  Subcellular localization annotation: CTP_CleavageSite=44; ConfidenceScore=5.14e-01
MSSSSSSRAFFFFFFFLINVSLLLTLSSAADPFVSYEFEVSYITASPLGVPQQVIAINNKFPGPTINVTTNNNVAVNVRNKLDESLLIHWSGIQQRRTSWQDGVLGTNCPIPAKWNWTYQFQVKDQIGSFFYFPSLHLQRAAGGFGGFIINNRPIIPIPFDTPHGDIVVFIGDWYTRNHTDLRKALDDGKDLGMPDGVLINGKGPYRYNDTLVPDGIDYETIEVHPGFFRHRNMESLTNTLVRIVRKTIDLKVMENKQNLSCILHTALCMFRQTFLQLLQGEEGKTYRLRVHNVGVSTSLNFRIQSHNLLLAETEGSYTVQQNYTSLDIHVGQSYSFLLSTDQNASTDYYIVASARFVNESRWQRVTGVAILRYTNSKGKARGPLPPGPDDQFDKTYSMNQARSIRWNVSASGARPNPQGSFRYGSINVTDIYVLKNKPLEKINGKQRATLSGNSFVNPSTPIRLADQYKLKG

SEQ ID NO: 191308 - protein, 138 aa, Glycine max
  Coding DNA Sequence Number=SeqID_74530
  Homolog annotation: Hit_ID=Q6AU09; Match level="QueryCoverage=96%, HitCoverage=10%, E-value=8e-24, Identity=51%"; Hit description =Putative Fip1 motif containing protein
MSQMMNSKILAEDALNWNAGQAIRKEISVSTTGKPADEPAKTVDVDNQHLLLAEARDSADMENRDADTKELGDRHLDTVERLKKRSERFKLPMPSEKETLVIKKLESEPLPSAKSENPVVDSEVKQERPARKRRWVTN

SEQ ID NO: 191309 - protein, 103 aa, Glycine max
  Coding DNA Sequence Number=SeqID_74531
MELLVKTETLLGKCSPTGYVNKAKLSSSVEGASIRLNASPDMPMVSECHCIQPWSRSPIILITQIHLVYNKCIGSKVYKMTLLKYKLSQTLQMPFSTFDSDRG

SEQ ID NO: 191310 - protein, 1136 aa, Glycine max
  Coding DNA Sequence Number=SeqID_74532
  Gene Ontology: Mol. function=identical protein binding
  Homolog annotation: Hit_ID=Q9FGU0; Match level="QueryCoverage=81%, HitCoverage=68%, E-value=4e-95, Identity=31%"; Hit description =Arabidopsis thaliana genomic DNA, chromosome 5, TAC clone:K21L19
  Pfam annotation: Domain name=Fip1; Domain location=345-407; Score =118.4; E_value=2e-32; Accession=PF05182.4; Description=Fip1 motif
MEDDDEFGDLYTDVLRPFASSSPSSSSAQQLHQLSPAPPSLDLNLNPNPDAAQIPCDAPHTYSPAPTNPLPEPDPREPPPESPKIPDAEPLPDSNLVAAVVAGVDPMDREVKFDIEEDDDDGGCGGDVVGETVIPGLSGEAAAAVPPEGEGDDWDSDSEDDLKIVLNENNHMAMERGGVADGDEEEEDGDEELVIVAGGDLNQGVEEPEWGENAALAAGDGDRKDAAGELAKVGGAAVPPKIGYSNHGYHPFHSPFKYQYVRPGAALMPGAAASAPGGPPGQIRPLANMAGRGRGEWRPPGIKGGAAMQKGFHAGPGLPGWGSSAAGRGFGGGLEFTLPSHKTIFDVEIENFEEKPWKYPNVDISDFFNFGLNEESWKDYCKQLEQLRLESTMQSKIRVYESGRTEQEYDPDLPPELAAATGIHDVPGEHTNSLKSDVGQSDVMKGSGTGRVRPPLPTGRAIQVEGGYGDRLPSIDTRPPRIRDSDAIIEDTEDDESSAGIAQDPPESGDPHREDFREDHVAGDEIPRLEPKYFDGFPQDYNGRKKEIAGRRMPFINSCAANMPNGDEKLFFPQEEPIEYSGSRGQNRRNYGGNFSSSHDERQMQRRVRGQSPPIIPIQELATDNSQKEESAESMEGRHRSSPAVKDVGESSVEYKDIELEDTETADGSSRLEKEETVDRVDTLEDGVAKRQKVTSQVEPPLPDEVDDDWEDSKAAKSSDNSKARSASSRDNQKRQEGFEEEVVQDPQSAHLGSIRQHPDEIEPGFYKREHDAKQEPERNRMMLKGRERSYPYKDRHPSSAPQLHANTDGFDGQKERDNSEMDWARRDDDLYNRRVRNDEPRKRDRAKVRENERNDKEDSLHSRKQLDNGSYRVLYEKDVGSRDSRHRERDEGLRIRYEAVEDYRGKRRKDEEYLRREHIDKEEVLHGYRENASRRRRERDEVLDPRKRDDLQRARDNPDDQYATRQKDDAWVPRERGDRQRDREEWHRMKQSHEEHLPKREREEGRSSVRSGRGAEHKLSEKEYQSREAMRQNDQLKRRDRIQDESPHHKGRDDASARGNQYTTEERRSRQERSSSRSDRVANFSDNQKVKHREGSRKSKERDVSDLNSLGLSKRSQENQIGPTNEKVCTLHVKT

SEQ ID NO: 191311 - protein, 176 aa, Glycine max
  Coding DNA Sequence Number=SeqID_74533
  Gene Ontology: Mol. function=protein serine/threonine kinase activity; Cellular component=membrane; Biological process=protein amino acid phosphorylation
  Homolog annotation: Hit_ID=Q93XL9; Match level="QueryCoverage=92%, HitCoverage=19%, E-value=7e-48, Identity=58%"; Hit description=CTR1 -like protein kinase
MDVYTWTISTDLQNVGMIPSFESLMSIEPSDDLSILVVAVDKSRDPGLRELQNRVASLSNNWITTKDATDQLANLVCNRMGGGSLTEENLGTRWKECTQLLKSCLHSVILPIGSLPIGLCVHRALLFKVLADLINLPCRIAKGCKYCRKDVGASCIVQFGSDRNKKERSGEISRLI

SEQ ID NO: 191312 - protein, 388 aa, Glycine max
  Coding DNA Sequence Number=SeqID_74534
  Gene Ontology: Mol. function=nucleic acid binding
  Homolog annotation: Hit_ID=Q1T034; Match level="QueryCoverage=66%, HitCoverage=49%, E-value=4e-10, Identity=24%"; Hit description=Zinc finger, CCHC-type
  Pfam annotation: Domain name=zf-CCHC; Domain location=117-134; Score =14.0; E_value=0.0048; Accession=PF00098.13; Description=Zinc knuckle
MELNTKAHYTLTYVLSKNEFSKICILKTTNEIWDSLSINYEGIKDVQLRKAATLHVTMKMVESDASYDNSDESIDNEMALTSRKSKQMMKKKRKFRHFSRRKDARFKKKHKEKNNEIICFECKKHVHIKAKCPQIKRKGHSGDKKKKSLMVTWDDSDNEKSNILDDEQANIYLMANTNEKVEVKTCFESNSSSSSSSLDNGEDMPYDLLQNSHMISLKWKKYKEKYKISACENTELKKSNEVLQEKIQALEKSLSQTSKIDESYTVRKPREKITCLTKDFGKFLESSNTLTHASKISSTSSKSLFVAEKCDFYGKSAHCKFRCIHKKKQMSKGTNAYGPKKIWVPKSQIVPIIDILGRKRLGFKLVPRQWMLTTRDGGKVYVPQPKTH

SEQ ID NO: 191313 - protein, 112 aa, Glycine max
  Coding DNA Sequence Number=SeqID_74535
VIRPPITRAFIEKYCTPRQAQGDAPQAADALPPPHHADPAGSFGMERYLQHLVRQQAANHRGQFRAEVAWPRDWPEAQAGEAPAEAPGDAEEARMDEEMTDLLGFLGGNGAT

SEQ ID NO: 191314 - protein, 215 aa, Glycine max
  Coding DNA Sequence Number=SeqID_74536
MDGGAKTHIPTQLQGLDVMLCALSEEEYTKVHNFRSAKQIWDTLVVTYEGTSQVTTLRTLKNLDSMSLEELVGTLKNKKAPSSKEQVSRSSSKALKVDNSSDDDYKEESDGDELAFISQKIIKMWKDKGGSKWKNSSRKMPKEKKDKDKSSIICVATYPSAGGRRVTRGMRVPRKEYARSRHQRLFEENVGKTGKDAIYELFSEKVRELYLRTGK

SEQ ID NO: 191315 - protein, 71 aa, Glycine max
  Coding DNA Sequence Number=SeqID_74537
MGKRLEIPGHVNPQVAALIELCWATVRVVAHAKQVLINMVAKWQCHGEWRGIFYANCHRQFCEGSPAMGTP

SEQ ID NO: 191316 - protein, 130 aa, Glycine max
  Coding DNA Sequence Number=SeqID_74538
MRSYGGHSSTGEGDDRWMHFAEHVLPMGKLCLVLGQVGDQPRDAPAADPEEYIQPPSPQVPVAFDPSPHAVDDYDGYEVIAQRLERVLNLRMVTAGTELYDIMQDCLTIARGGASADGSVRARQRRRTEH

SEQ ID NO: 191317 - protein, 159 aa, Glycine max
  Coding DNA Sequence Number=SeqID_74539
  Gene Ontology: Mol. function=sequence-specific DNA binding; Cellular component=nucleus; Biological process=regulation of transcription, DNA-dependent
  Homolog annotation: Hit_ID=Q1SD46; Match level="QueryCoverage=94%, HitCoverage=64%, E-value=4e-28, Identity=43%"; Hit description =Transcription factor, MADS-box
  Pfam annotation: Domain name=SRF-TF; Domain location=1-49; Score =68.2; E_value=2.6e-17; Accession=PF00319.9; Description=SRF-type transcription factor (DNA-binding and dimerisation domain)
  Subcellular localization annotation: CTP_CleavageSite=21; ConfidenceScore=5.21e-01
MSNKRNLQVTFSKRRTGIFKKASELTTLCGMNLAVIMSSPGNRVFSFGSPSVDSVIQHYTAQGPPPLLNLELNEASIDEHELHVHLNNLSDQIAAEKKHKKDLNRMLNAAEEHVWFVMPIKSMNDAQLETYKKMLEELKTYANEKREKLLQRLPNTSMG

SEQ ID NO: 191318 - protein, 111 aa, Glycine max
  Coding DNA Sequence Number=SeqID_74540
MEKGVASAIWWIRSTVVSAEKRGEEEEEKEVLQSSLKPLKAKTTKVERRALQEAQRAAKAASKVLVITLYPAEGSKAVVESGRATLGKSTKQSSQKKGGPSYVSPVVTDII

SEQ ID NO: 191319 - protein, 102 aa, Glycine max
  Coding DNA Sequence Number=SeqID_74541
  Subcellular localization annotation: CTP_CleavageSite=56; ConfidenceScore=5.69e-01
MLHQTFRLPSLTSFFTFVSSSLFHLRSFFTVRFTVSHCLHLLHRSFHLNLKRGPCRESGHGDRTINTPTMRNGEADGEQGKVRGRRAGEYSPPLPRAGVMPN

SEQ ID NO: 191320 - protein, 198 aa, Glycine max
  Coding DNA Sequence Number=SeqID_74542
MDIYAERRKRGKTILQEGKRQRSATNETIVIDNLQCISQCSPTINHNNNSATSFQSTPPSHETLSIDDSERCSKRHAINVSSIQRNLMSSYDNQKNITASTSTYQASNAYSNITQLDIHIDEHQRPTDTTQHDQFVGYDSSNSSDDDVNMTQENIDIEYSLNDPTIDDLDDYDEQTFLSASSAYPNTGGTYIDIGDPV

SEQ ID NO: 191321 - protein, 93 aa, Glycine max
  Coding DNA Sequence Number=SeqID_74543
MVSTLKEDGVGGSKELLLQVKRRVSPESVWCKLQGWKITESGTGKRERGKCMQMGTKIEERTMKRVAATVRLWARLIKEDMVLEMPFFGSNQF

SEQ ID NO: 191322 - protein, 108 aa, Glycine max
  Coding DNA Sequence Number=SeqID_74544
MHTEKRIQDKYEIYHNFSILFNQLRQGKLYRHSWSTEIGEVTAQKEWQGNAMQCPLPLMSILIELTRHLHANASDHPNTYQHHILLWIKCYNTLTLCYDETNKKMRYL

SEQ ID NO: 191323 - protein, 58 aa, Glycine max
  Coding DNA Sequence Number=SeqID_74545
MHWQKRKLMRALQLNKIKNVKEGRGGNEPNSLSRVFNSTYVRLGSAWLVYYKDLAQAF

SEQ ID NO: 191324 - protein, 415 aa, Glycine max
  Coding DNA Sequence Number=SeqID_74546
  Homolog annotation: Hit_ID=Q93YH8; Match level="QueryCoverage=33%, HitCoverage=25%, E-value=2e-20, Identity=46%"; Hit description=HMG I/Y like protein
  Pfam annotation: Domain name=Linker_histone; Domain location=213-282; Score=59.8; E_value=9.1e-15; Accession=PF00538.9; Description=linker histone H1 and H5 family
MSLVQKYPFEDKNSKLCFVAGRRRAKTEQWNPKVHRRQLGRSHEVHLSTIFAHSSPHSNPNNHYTLSPTSFFGTRITLIRATSSSCSLPNTNCRATSAIVSFSLLTPKPLLDTPKKTPKWSARAIKSYAIGELEARKLKYPNTRTNALLMGILVEDFINTTTNSAFHDVNSKSVVENRFDLGAMALKKRRRRVHLPTEPNDHLPPPIPEPPSNHPPYAEMIYTAIEALKEKDGSSKRAIAKYIEQVYTQLPPNHSNLLTQHLTHLKSRGLLQMVKKSYGLPRSVPVSIPGPAPTEGTSVVPAAVVAITTTPRPRGRPHKAQNPVQNSPLPQDIVNVQVQQNAEPVWTALGLADEIGLSHIPLYLYPFLNTTSKSRLFEYLRLTTIGIIGASNKTPELLKMNPIGKVRFACSRLTT

SEQ ID NO: 191325 - protein, 77 aa, Glycine max
  Coding DNA Sequence Number=SeqID_74547
MTSYILETCVDPLIHTPRSHYLTKQFSFAQVPPLCYGGRTDNMASSPRLVVHDHHVCHPNLNPNPKPNSQICQKHNT

SEQ ID NO: 191326 - protein, 44 aa, Glycine max
  Coding DNA Sequence Number=SeqID_74548
MRLERQVQLARKVPLHKLNHSMKAHNGTSNGQEYPYPHMPKAKI

SEQ ID NO: 191327 - protein, 47 aa, Glycine max
  Coding DNA Sequence Number=SeqID_74549
MKKEWRLSKNFPSKVLASTWSHIYKEANHVDDALAKQDLSSSQRDQV

SEQ ID NO: 191328 - protein, 52 aa, Glycine max
  Coding DNA Sequence Number=SeqID_74550
MRLSLSRTATAREVRLPSLITVVVGTGNSFAMVVSLLSRRAKLHKELHNIEK

SEQ ID NO: 191329 - protein, 221 aa, Glycine max
  Coding DNA Sequence Number=SeqID_74551
  Gene Ontology: Mol. function=sequence-specific DNA binding; Cellular component=nucleus; Biological process=regulation of transcription, DNA-dependent
  Homolog annotation: Hit_ID=Q1SEL3; Match level="QueryCoverage=74%, HitCoverage=97%, E-value=1e-20, Identity=32%"; Hit description =Transcription factor, MADS-box
  Pfam annotation: Domain name=SRF-TF; Domain location=56-110; Score =18.1; E_value=0.0035; Accession=PF00319.9; Description=SRF-type transcription factor (DNA-binding and dimerisation domain)
MESTPSLIINVEVEYNNNKECEINGKGDHESNSEGHRGVTLARIKKTKGQQKIEMKKVNNERYLQVTFSKRRIEIFKKASELAPLYSVDLAPHLPLLSYNTMDEHKLHAHLNDLANRLAKDKKHIEDLNHLLKVAEDHFWWAIPIESINSAQVEKYKRLLEELKTHVDEKCGSSYSNVNSTLTMHRPPLMQNYVGVIDGSILCHRQFNNIHINGHGDGPTL

SEQ ID NO: 191330 - protein, 94 aa, Glycine max
  Coding DNA Sequence Number=SeqID_74552
  Subcellular localization annotation: CTP_CleavageSite=54; ConfidenceScore=5.04e-01
MPWRFSFGLFKNVGKLAMKFCSPWIRKSTKWKDTSHNGYVRSLSLRKIIERPVRVMLFCESAPTMWDRHMLKGALKPGDPQGLHFEESIRASPS

SEQ ID NO: 191331 - protein, 134 aa, Glycine max
  Coding DNA Sequence Number=SeqID_74553
  Gene Ontology: Cellular component=anchored to membrane
  Homolog annotation: Hit_ID=Q6F3C5; Match level="QueryCoverage=84%, HitCoverage=74%, E-value=2e-31, Identity=57%"; Hit description =Putative ML domain protein
  Pfam annotation: Domain name=E1_DerP2_DerF2; Domain location=10-125; Score=62.0; E_value=2e-15; Accession=PF02221.6; Description=ML domain
GEGAESEGEGELDDKKADYDVEVKGVEIYPDPIARGQPATFSIAATTALSGGKLAIDVSYFGWHIHSETHDLCGETTCPVSVGDFVIAHSQVLPGFTLPVSYSLKMKMFDGNKHELTNITFGFDIGFGSSVADS

SEQ ID NO: 191332 - protein, 77 aa, Glycine max
  Coding DNA Sequence Number=SeqID_74554
MGKGWLRWRLPEDPFRVLPDLPEEGFLEDFWKKGSSGNTERSSGKTGLPESFRNTSSGNSPEEVVLPESFWKKGSSG

SEQ ID NO: 191333 - protein, 38 aa, Glycine max
  Coding DNA Sequence Number=SeqID_74555
MGPVLSDPQRPLVGGCAEKGTGHPETKHCPPRVFSSEL

SEQ ID NO: 191334 - protein, 101 aa, Glycine max
  Coding DNA Sequence Number=SeqID_74556
MSSSSEDYAPSPSEDYMSSPSEDYMNSPSEDYTSSPSEDNMSSPSPSEDYTSLPSVGYTPSPSKDCVTSQKFLPGVFGNNCICLCVLGRSRDSGGKIRGLG

SEQ ID NO: 191335 - protein, 515 aa, Glycine max
  Coding DNA Sequence Number=SeqID_74557
  Gene Ontology: Mol. function=aspartyl esterase activity; Cellular component=cell wall; Biological process=cell wall modification
  Homolog annotation: Hit_ID=O04887; Match level="QueryCoverage=95%, HitCoverage=95%, E-value=0.0, Identity=70%"; Hit description =Pectinesterase-2 precursor
  Pfam annotation: Domain name=PMEI; Domain location=22-171; Score =113.7; E_value=5.3e-31; Accession=PF04043.6; Description=Plant invertasepectin methylesterase inhibitor
  Pfam annotation: Domain name=Pectinesterase; Domain location=207-501; Score=764.8; E_value=5.2e-227; Accession=PF01095.10; Description =Pectinesterase
  Pfam module annotation: Pfam domain module=PMEI::Pectinesterase; Domain location=22-171::207-501
MKAFRLLLALLIPFLLSSFVSGYSWNEVKLWCNQTPNPQPCEYFLSNNPTYQYKPLKQKSDFLKLSLQLAQERALKGHENTLSLGSKCRNPRERVAWADCVELYEQTIRKLNQTLKPNTKLSQVDAQTWLSTALTNLETCKAGFYELGVQDYVLPLMSNNVTKLLSNTLALNKVPYQEPSYKEGFPTWVKPGDRKLLQASSPASRANVVVAKDGSGRFTTVSAAINAAPKSSSGRYVIYVKGGVYDEQVEVKAKNIMLVGDGIGKTIITGSKSVGGGTTTFRSATVAVVGDGFIAQGITFRNTAGAKNHQAVALRSGSDLSVFYKCSFEGYQDTLYVHSERQFYRECNIYGTVDFIFGNAAVVLQNCNIFARNPPNKVNTITAQGRTDPNQNTGISIHNSRVTAASDLRPVQNSVRTYLGRPWKQYSRTVFMKTYLDGLINPAGWMEWSGNFALDTLYYGEYMNTGPGSSTARRVKWSGYRVITSASEASKFSVANFIAGNAWLPSTKVPFTPSL

SEQ ID NO: 191336 - protein, 456 aa, Glycine max
  Coding DNA Sequence Number=SeqID_74558
  Homolog annotation: Hit_ID=Q94F64; Match level="QueryCoverage=27%, HitCoverage=25%, E-value=8e-26, Identity=46%"; Hit description=CDPK adapter protein 1
MALSDTSTPTSCQEEKGSDCDSPIESNVCDDLSLTKERTFDLKPVSPNSSGQGLPYAPEGWPNPSDVWGWKVLKRTSNAGHFCDRHLYLPKSLQISSHKRQSFRTKRDVERYIESNFPNMGIEAFFGLFSWKIPATKKTPRKVKSLETEEAGNATEQIGTKLKRKIQICSQPTRKSSKLLHLRPHIVPDQDANIVIDLCDQDDEEARVDSTENSKGISDSEEGSAMQTAVEKDPKAINVLENLDTLENSPDHATLDNEIIQYCKKKLSFLLDVDFPSLLSCNDVVVEVATLASQIRKDPTLSVEQLAQVKLVEQLPLVSEAFLEAKGDIEEADKFLGVLEAKKRKVLSLKNDYKEKVAQRESEMDRNTLAIQEIDDQIRQLQSKRSELSAALESMQKGKVELTSGEAGVANSILSLVGEINHGLSEKSKWEMKKANSARRVAEIQKKFINIRGLKF

SEQ ID NO: 191337 - protein, 62 aa, Glycine max
  Coding DNA Sequence Number=SeqID_74559
MVSDEKMKNKKVVVAGVSLSDAYALSEQHPLSETSACLASEENLPCIHALSSLSESFVSSDA

SEQ ID NO: 191338 - protein, 70 aa, Glycine max
  Coding DNA Sequence Number=SeqID_74560
MEVREKATNNKEMIKNDQVREKATSNNEMIKNDQNDLDQNMDVVNANTQTPAGQYDMVPETQLEVQMVTT

SEQ ID NO: 191339 - protein, 90 aa, Glycine max
  Coding DNA Sequence Number=SeqID_74561
MVLGWVMSCPGKESSAQTNHQKKRIAIYSDHDRIQLFFQYVVRDKIIHPVKAKNFDPSLNDFIFHDVGYNDGHPPSLYPVFHRLRIAFLQ

SEQ ID NO: 191340 - protein, 62 aa, Glycine max
  Coding DNA Sequence Number=SeqID_74562
LADFEMATRDVVFSANVDGNGGSGKEPPGSGDSYTPQRPTVDLIKEKVAKIVFEEDNPSKPM

SEQ ID NO: 191341 - protein, 55 aa, Glycine max
  Coding DNA Sequence Number=SeqID_74563
MTKWWNYMNYVERVSQVIHEGVKGLYQEPISAISLNCRKLNLSVFLKLDMSIHDE

SEQ ID NO: 191342 - protein, 252 aa, Glycine max
  Coding DNA Sequence Number=SeqID_74564
EENTETLSSLTSYPELRRSEFLIGGYVGARASLLSTIPPFVAMTQELVARGDTLRLFAPFCHPEAAGPMTSRDQVWSFCTLVSSRGGGPDDTRRYLTVIRTLLSSRGGGPDDKQRPSLVILHPCIIQRRRADDTRRYLTVIRTLLSSRGGGPDDKQRPKTKFGHFAPLYHPEAAGPMIRGDTLRLSAPFCHPEAAGPMTSRDQVWSFCTLVSSRGGGPDDTRRYLTVIRTLLSSRGGGPDDKQRPNLVILHP

SEQ ID NO: 191343 - protein, 68 aa, Glycine max
  Coding DNA Sequence Number=SeqID_74565
MVIFNHGVVAKDKGEEPSTWEASLRSKEGSFLGKLEEESFLEKQEEESFLTTKTTQNALKYKAKTLYY

SEQ ID NO: 191344 - protein, 198 aa, Glycine max
  Coding DNA Sequence Number=SeqID_74566
MRMLDFRKYFFRKLLRPFPEEVVPEDTFGTTSSGIGASNFRKKFFRKLLRPIPEEVVPEVELALATSGRINFWMWLYDNLNVLVYDAYVLKMDEDQWRYDYAMSQEVHMDYDYDNEEECGVNEPHVDCSNAFNTSQVFGTRDDVLQWARTIAHENGFVVVIMRFDTETSSRGRSSFVLIGCERSGFVGNQCMEGKVGW

SEQ ID NO: 191345 - protein, 103 aa, Glycine max
  Coding DNA Sequence Number=SeqID_74567
MVIPKFKVPDFDKYKGTTCPKNHLKMYCRKMGAYAKDEELLIHFFQENLTGVAVTCVSTILIWLQIGCNYRTCAKKSMNPSRNTPKGGKIWQPKWHPQRQRKR

SEQ ID NO: 191346 - protein, 236 aa, Glycine max
  Coding DNA Sequence Number=SeqID_74568
  Homolog annotation: Hit_ID=UPI000038436E; Match level="QueryCoverage =51%, HitCoverage=96%, E-value=2e-21, Identity=42%"; Hit description =COG1032: Fe-S oxidoreductase
  Subcellular localization annotation: CTP_CleavageSite=29; ConfidenceScore=5.24e-01
PAPAGLTAHSRGSARAPRDRCGRSAARFRASGADSGDSGAAAPRGNPARSACFAPPHAINLQIGKIQRQFLTKLFRDVIFRIKQPVERDALTALRQLVKQIEQAEQHLGAGAVEVAQRDSDDHRVVVGGLPLLKGIQQRAIKRRRVLRPRLAAQRKLAGGKIKTHFGRAVSGSDNQVLHTTSILVNGGFKPKRGVAAGGQRTQFILQRFTDITGKRQQTDIGPFAGGGALGAQTDT

SEQ ID NO: 191347 - protein, 502 aa, Glycine max
  Coding DNA Sequence Number=SeqID_74569
  Gene Ontology: Mol. function=cysteine-type endopeptidase activity; Cellular component=vacuole; Biological process=proteolysis
  Homolog annotation: Hit_ID=Q9LLQ5; Match level="QueryCoverage=94%, HitCoverage=95%, E-value=0.0, Identity=95%"; Hit description=Seed maturation protein PM40
  Pfam annotation: Domain name=Peptidase_C13; Domain location=55-479; Score=1050.3; E_value=0; Accession=PF01650.8; Description=Peptidase C13 family
MAVDRSLTRCCSLVLWSWMLLRMMMAQGAAARANRKEWDSVIKLPAEPVDADSDHEVGTRWAVLVAGSNGYGNYRHQADVCHAYQLLIKGGLKEENIVVFMYDDIATDELNPRPGVIINHPEGQDVYAGVPKDYTGENVTAQNLFAVILGDKNKVKGGSGKVINSKPEDRIFIYYSDHGGPGVLGMPNMPYLYAMDFIEVLKKKHASGGYKKMVIYVEACESGSMFEGIMPKDLQIYVTTASNAQENSWGTYCPGMDPSPPPEYITCLGDLYSVAWMEDSETHNLKRESVKQQYKSVKQRTSNFNNYAMGSHVMQYGDTNITAEKLYLYQGFDPAAVNFPPQNGRLETKMEVVNQRDAELFFMWQMYQRSNHQPEKKTDILKQIAETVKHRKHIDGSVELIGVLLYGPGKGSSVLQSMRAPGLALVDDWTCLKSMVRVFETHCGTLTQYGMKHMRAFANICNSGVSEASMEELKNPVDDVILLYCILPTGFCCMCQIFSKLE

SEQ ID NO: 191348 - protein, 169 aa, Glycine max
  Coding DNA Sequence Number=SeqID_74570
  Gene Ontology: Mol. function=nucleic acid binding; Biological process= DNA integration
  Homolog annotation: Hit_ID=Q1S2E5; Match level="QueryCoverage=74%, HitCoverage=58%, E-value=1e-15, Identity=38%"; Hit description =Integrase, catalytic region
MATQANSLGSKDVWYVDSGCTNNMARDSSFFTSLDKAIKTRVKLENGEIVQVEGRGSLDDLCDAFQLGKMHKKSFQATNVTRAKSKLEFVHTDLCGPIYEHTFSKPKQLHPKLNVVSKRTNITVMKMTRCLIAEKKLPKSFWIKAIYTTTYLSNRLPTRVVQEKTPIEA

SEQ ID NO: 191349 - protein, 590 aa, Glycine max
  Coding DNA Sequence Number=SeqID_74571
  Gene Ontology: Mol. function=binding; Cellular component=cellular _component; Biological process=response to unfolded protein
  Homolog annotation: Hit_ID=Q9STH1; Match level="QueryCoverage=99%, HitCoverage=100%, E-value=1e-178, Identity=55%"; Hit description =Stress-induced protein sti1-like protein
  Pfam annotation: Domain name=TPR_1; Domain location=2-35; Score=23.5; E_value=0.00073; Accession=PF00515.18; Description=Tetratricopeptide repeat
  Pfam annotation: Domain name=TPR_1; Domain location=210-243; Score =23.5; E_value=0.00078; Accession=PF00515.18; Description =Tetratricopeptide repeat
  Pfam annotation: Domain name=TPR_1; Domain location=337-374; Score =15.0; E_value=0.087; Accession=PF00515.18; Description =Tetratricopeptide repeat
  Pfam annotation: Domain name=TPR_1; Domain location=36-69; Score =12.1; E_value=0.19; Accession=PF00515.18; Description=Tetratricopepti de repeat
  Pfam annotation: Domain name=TPR_1; Domain location=401-434; Score =36.0; E_value=1.3e-07; Accession=PF00515.18; Description =Tetratricopeptide repeat
  Pfam annotation: Domain name=TPR_1; Domain location=435-468; Score =37.2; E_value=5.8e-08; Accession=PF00515.18; Description =Tetratricopeptide repeat
  Pfam annotation: Domain name=TPR_1; Domain location=469-502; Score =38.3; E_value=2.6e-08; Accession=PF00515.18; Description =Tetratricopeptide repeat
  Pfam annotation: Domain name=TPR_1; Domain location=70-103; Score =33.5; E_value=7.6e-07; Accession=PF00515.18; Description =Tetratricopeptide repeat
  Pfam annotation: Domain name=TPR_2; Domain location=2-35; Score=24.8; E_value=0.00032; Accession=PF07719.7; Description=Tetratricopeptide repeat
  Pfam annotation: Domain name=TPR_2; Domain location=210-243; Score =23.4; E_value=0.00083; Accession=PF07719.7; Description =Tetratricopeptide repeat
  Pfam annotation: Domain name=TPR_2; Domain location=337-374; Score =5.5; E_value=7.5; Accession=PF07719.7; Description=Tetratricopeptide repeat
  Pfam annotation: Domain name=TPR_2; Domain location=36-69; Score =20.7; E_value=0.0051; Accession=PF07719.7; Description =Tetratricopeptide repeat
  Pfam annotation: Domain name=TPR_2; Domain location=401-434; Score =30.1; E_value=7.8e-06; Accession=PF07719.7; Description =Tetratricopeptide repeat
  Pfam annotation: Domain name=TPR_2; Domain location=435-468; Score =24.6; E_value=0.00036; Accession=PF07719.7; Description =Tetratricopeptide repeat
  Pfam annotation: Domain name=TPR_2; Domain location=469-502; Score =27.0; E_value=6.6e-05; Accession=PF07719.7; Description =Tetratricopeptide repeat
  Pfam annotation: Domain name=TPR_2; Domain location=70-103; Score =27.9; E_value=3.7e-05; Accession=PF07719.7; Description =Tetratricopeptide repeat
  Pfam module annotation: Pfam domain module=TPR_1::TPR_1::TPR_1::TPR _1::TPR_1::TPR_1::TPR_1::TPR_1::TPR_2::TPR_2::TPR_2::TPR_2::TPR _2::TPR_2::TPR_2::TPR_2; Domain location=2-35::210-243::337-374::36 -69::401-434::435-468::...
  Pfam module annotation: Domain location=469-502::70-103::2-35::210 -243::337-374::36-69::401-434::435-468::469-502::70-103
MAEEAKAKGNAAFSAGDFAAAVRHFTDAIALSPSSHVLYSNRSAAHASLQKYAEALADAQKTVDLKPDWPKAYSRLGAALLGLRRHRDAVSAYKTGLHLDPDNAALKSGLADAHAAASRPPPTSPFATAFSGPDMWARLTADPTAQGHACRWGLAQCQNSNPLTTTTPDAAGDDVSEDDPVSQSESESEPEPEPEVAEEEKEARDRKGQAQKEKEAGNAAYKKKDFETAIGHYTKALELDDEDISYLTNRAAVYLEMGKHTLCSLIMKMICKVDVRERLVEAGARHEVECGIEGEAEQMKKKTGKLPSAVYFEDCIKDCEKAVERGRELRSDYKMIARALTRKGTALAKMAKCSKDFEPAIETFQKALTEHRNPDTLKKLNEAEKAKKELEQQEYFDPKLADEEREKGNELFKQQKYPEAIKHYTEAIKRNPKDAKAYSNRAACYTKLGAMPEGLKDAEKCIELDPTFSKGYTRKGAVQFFMKEYEKALETYKEGLKHDPNNQELLNGIRRCVEQNNKASRGDFTPEELKERQAKAMQDPEIQSILQDPVMRQVLTDFQENPRAAEEHAKNPMVMDKIQKLISAGIVQMR

SEQ ID NO: 191350 - protein, 222 aa, Glycine max
  Coding DNA Sequence Number=SeqID_74572
  Gene Ontology: Mol. function=enzyme inhibitor activity; Cellular component=cell wall; Biological process=cell wall modification
  Homolog annotation: Hit_ID=Q1SBU7; Match level="QueryCoverage=74%, HitCoverage=88%, E-value=2e-50, Identity=58%"; Hit description =Putative ripening-related protein
  Pfam annotation: Domain name=PMEI; Domain location=40-204; Score =177.3; E_value=3.8e-50; Accession=PF04043.6; Description=Plant invertasepectin methylesterase inhibitor
  Subcellular localization annotation: CTP_CleavageSite=24; ConfidenceScore=5.20e-01
MASKLLLTLSLLLLTLILHTFGTTALAKRTNPNPPPNQNPTTTEFIKSSCKATRYPAACVQTLSGYASAIRQSEQQLAVTALSVSVSKTRSCASFVKGMKPREYNALRDCVENMNDSVDRLNQSVKELGLVGMGMGMGKAKGKGKAKDFAWHVSNVQTWVSAAITDQDTCLDGLDGPHVDANLRASVRPRVVYASQVTSNALALVNHFASKRSRGLPLQAGD

SEQ ID NO: 191351 - protein, 211 aa, Glycine max
  Coding DNA Sequence Number=SeqID_74573
  Subcellular localization annotation: CTP_CleavageSite=32; ConfidenceScore=5.09e-01
MEKSLSTIPRIEMAPLCPSFSWRRQISYPSFTLSMVKCAVGLVKTNDDKLVSFGHTSSVSSTVRVHDTTNIPGEHTQNCTIHTKLIKGGADESPTEVQDQRETHHVPTQDGKPEFSIGLGMLDHALRGVGLGVALHSLSKFSFFSPRVGVLLATWKEDVACVPGVARCGHRLTVYWIKFEIIQLIDMKICDLYFSFTNYDGFNGGCFNIII

SEQ ID NO: 191352 - protein, 149 aa, Glycine max
  Coding DNA Sequence Number=SeqID_74574
  Gene Ontology: Mol. function=RNA-directed DNA polymerase activity; Biological process=RNA-dependent DNA replication
MCGDFSEVVLPSEDSGGYFSTSTAEKFLDVINTCGIVGIEAEGSQFTWKLNHPWHFLTAWSRHYKFHGVVEDAWNKEQHEISGKLDEVGSKSQNFNKNIFGNSFCRKRRIEVLKQEESLWYQKSTEGREQEAQGVGWGRDQGCRLVAES

SEQ ID NO: 191353 - protein, 166 aa, Glycine max
  Coding DNA Sequence Number=SeqID_74575
  Subcellular localization annotation: CTP_CleavageSite=54; ConfidenceScore=5.10e-01
MSCTGSLSAPLHLTKRTASVHPLSEKGALSQKSLTCAKRAIRSLDWDSELCMSRVSRERKVQVLESFERFCCTKICRDQSLKQEPASWYGKLNPLLDLPCRAELSCFHEESGCDNLVEYVCLNAVLVEFSLKGGICGRCLIKIRLNYHEESGFFSILWECDLCLPS

SEQ ID NO: 191354 - protein, 101 aa, Glycine max
  Coding DNA Sequence Number=SeqID_74576
MGEIHGAEIVDGMTDGLKKHDDELARRGRVQRSDQERNWRRMCEVDVGDDENGEEEAVREIHGEGCGKGKEGGELEELQHSEEEGNEVVNVWRERFKEGDT

SEQ ID NO: 191355 - protein, 220 aa, Glycine max
  Coding DNA Sequence Number=SeqID_74577
  Homolog annotation: Hit_ID=Q1SZM6; Match level="QueryCoverage=37%, HitCoverage=26%, E-value=2e-07, Identity=35%"; Hit description =Ribonuclease H
MWLLQGICDSLDIATRQFICGSTSSHWLLAKPIYRLSEPSVERTILAAEREEEFGRRMSWTHSNKRDLRMMLDQDWARLSRGIGDLSLKHDRSSDKGIICKQLDVIDIKDGSYTARSVFRWLIQARQPTVALMGRGPWKACNNEFFSHKVIRDLVLVNQIHTLHDLTIKAFNQKARTHQQRLVQWDPPTHNSYKLNVDGNAFGNPDNAGFGGLVRDTNGR

SEQ ID NO: 191356 - protein, 36 aa, Glycine max
  Coding DNA Sequence Number=SeqID_74578
MGGLIALNLAHERFLDDTEASTYHHAVTKSIGDSLS

SEQ ID NO: 191357 - protein, 277 aa, Glycine max
  Coding DNA Sequence Number=SeqID_74579
  Homolog annotation: Hit_ID=Q47522; Match level="QueryCoverage=17%, HitCoverage=59%, E-value=2e-21, Identity=97%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIRSDPSQMGGHQMIYLAESGAVKYLHLMQDCFHDNIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 191358 - protein, 106 aa, Glycine max
  Coding DNA Sequence Number=SeqID_74580
MGWEWEGLLLLGVVVGFLLAVVSKGILAAKLSEQWHLCKDCHVSHSPPVTCVLNYGFKFQGGYSSTTPTIQNIEKWHSLHPFGLISEIGCCYAIFVKLVESCIVSF

SEQ ID NO: 191359 - protein, 612 aa, Glycine max
  Coding DNA Sequence Number=SeqID_74581
  Gene Ontology: Mol. function=manganese ion binding; Cellular component=mitochondrion
  Homolog annotation: Hit_ID=Q9SZ63; Match level="QueryCoverage=93%, HitCoverage=86%, E-value=1e-106, Identity=71%"; Hit description =Nudix hydrolase 14, mitochondrial precursor
  Pfam annotation: Domain name=NUDIX; Domain location=141-284; Score =32.8; E_value=1.2e-06; Accession=PF00293.18; Description=NUDIX domain
  Pfam annotation: Domain name=NUDIX; Domain location=447-601; Score =50.3; E_value=6.6e-12; Accession=PF00293.18; Description=NUDIX domain
  Pfam module annotation: Pfam domain module=NUDIX::NUDIX; Domain location=141-284::447-601
  Subcellular localization annotation: CTP_CleavageSite=59; ConfidenceScore=5.35e-01
MAMNIRSVCGALKRFTPLHSSNWVSKKNKGFSCKMSTESTSLTHTITLPNKHNEPVHVVAAPGVSPSDFWSAVECSLFKQWLHNLQTENGVLADGTLALRQVLIQGVDMFGKRIGFLKFKADIFDKETGKMVPGIVFARGPAVAVLMLLESEGETYAVLTEQARVPVGRIILELPAGMLDDDKGDFVGTAVREVEEEIGMKLNVGDMVDLTAFLDSATGCKVFPSGGGCDEEISIFLYRGRVDKEIISQLQGKETGLREHGELIKPKRTIVGSDSYFVKLYASMAMNIRFVCGALKRFTPLHSSNWVSKKNKGFFCKMSTESPSLTHTITLPNKHNEPVHIVAAPGVSNSDFWCAVESSLFKQWLHNLQTENGILADGTMTLRQVRIQGVDMFGKRIGFLKFKADIFDKETGKMYAYCLNLLYKYYLDYCATISEGKPRSNGIVFARGPAVAVLILLESEGETYAVLTEQARVPVGRNILELPAGMLDDDKGDFVGTAVREVEEETGLKLNVEDMVDLTAFLDSTTGCRVFPSGGGCDEEISIFLYRGCVDKEIITQLQGKETGLREHGELIKVRVVPYKKLWRTTADCMVLVAVALLEMAMKEGLLPTLST

SEQ ID NO: 191360 - protein, 59 aa, Glycine max
  Coding DNA Sequence Number=SeqID_74582
MALDCGHVFATCYLAESITVHQAWICTSLSVQKHLVKISLACWLEFNKMMVQGPYKYLQ

SEQ ID NO: 191361 - protein, 153 aa, Glycine max
  Coding DNA Sequence Number=SeqID_74583
MKKILGKVSRSSENRSKIHYELKHEGYARNSMKRCKKIEGKGTWGYSEWRGLKNLGELGTHRPHFATLEWLLDYSFWSWELGDRYTLYPYVVITPNCYPCGCVRPLVPKRLGGIVGLCYVSSTDIKGDHDDLMPATCGDRGVQITVVAVRAFI

SEQ ID NO: 191362 - protein, 179 aa, Glycine max
  Coding DNA Sequence Number=SeqID_74584
  Gene Ontology: Mol. function=oxidoreductase activity; Cellular component=intracellular; Biological process=metabolic process
  Homolog annotation: Hit_ID=Q9D7B1; Match level="QueryCoverage=98%, HitCoverage=35%, E-value=3e-58, Identity=63%"; Hit description=tRNA -dihydrouridine synthase 2-like
  Pfam annotation: Domain name=Dus; Domain location=8-179; Score=-96.3; E_value=0.0012; Accession=PF01207.8; Description=Dihydrouridine synthase (Dus)
MEYRNKLVLAPMVRVGTLPFRLLAAQYGADITYGEEIIDHKMLKCDRQINELIGSTDFVEKGTKNVVFRTCDEEKDTVVFQIGTSDAVRALATAQLVCNDVAAVDINMGCPKSFSVSGGMGAALLSKPELIHDILTTLRRNLNTPVTCKIRLLKSPHDTVELARRIEKTGVSALAVHGR

SEQ ID NO: 191363 - protein, 161 aa, Glycine max
  Coding DNA Sequence Number=SeqID_74585
MSYLNFVRGLLFIYLLILASRLTVLNASYSVKQMIVQCFDQECQRYQKGWAKGLASGLPGPSNYFNLKEPARLGEPVTSGVSLGSPGRAAMVPSPFFSINRCEGELGKGFKHSALREIREKKKKEEKTKPRHYRIVIVINLYIVLCSVFFVRPSVSFVFKI

SEQ ID NO: 191364 - protein, 51 aa, Glycine max
  Coding DNA Sequence Number=SeqID_74586
MDKSKEYREKGRAQAWNAKRSALRRGVEMGFGPSKARLARQHALSTFRLCA

SEQ ID NO: 191365 - protein, 93 aa, Glycine max
  Coding DNA Sequence Number=SeqID_74587
MGKFKFWEEIDQPCYCQATGSHRRSLISIVKGFFQSGAKPPLLPLASTKNKNQVWSKGYSSPRSFPSRLRFSMSGISMRREGQGLGVVKGESG

SEQ ID NO: 191366 - protein, 101 aa, Glycine max
  Coding DNA Sequence Number=SeqID_74588
MGDGARELSNCGNRKVSGDVSSHNHNTWELYNSTLTPGIPAGKASVTLNYTATEGTHCGEGPLATALYCAILIPARLHTSSFDINVKQRPVWPALAVLPAR

SEQ ID NO: 191367 - protein, 413 aa, Glycine max
  Coding DNA Sequence Number=SeqID_74589
  Gene Ontology: Mol. function=ATP-dependent helicase activity; Cellular component=nucleus; Biological process=rRNA processing
  Homolog annotation: Hit_ID=Q7FGZ2; Match level="QueryCoverage=95%, HitCoverage=85%, E-value=1e-134, Identity=58%"; Hit description=DEAD- box ATP-dependent RNA helicase 1
  Pfam annotation: Domain name=DEAD; Domain location=51-240; Score =165.5; E_value=1.4e-46; Accession=PF00270.19; Description=DEADDEAH box helicase
  Pfam annotation: Domain name=Helicase_C; Domain location=311-387; Score=82.7; E_value=1.1e-21; Accession=PF00271.21; Description =Helicase conserved C-terminal domain
  Pfam annotation: Domain name=ResIII; Domain location=47-235; Score =21.8; E_value=7e-07; Accession=PF04851.6; Description=Type III restriction enzyme, res subunit
  Pfam module annotation: Pfam domain module=DEAD::Helicase_C::ResIII; Domain location=51-240::311-387::47-235
ACLIHIHAVLPWMRHPVDITRCPELPVCSVPLMKRRLQSVLEENMGISKLFPVQVALWQETVGPGDFERDLCINSPTGSGKTLAYALPIVQNLFTNPGGRLRALVVVPTRDLALQVKRVFDALASPLGLRIGLAAGQSSLRHELSSLIYLPGEDDGPDPGFLSPLWFQSKVDILVATPGRLVDHVNKLSLKHLRYLVVDEADRLLREDYQSWLPTVLKLTQSRLAKIVLSATLTRDPGRLAQLNLHHPLFLSAGKMRYRLPEYLECYKLICERKVKPLYLVALLKSLGEEKCIVFTRSVESTHHLCKLLNCFGDLKIGIKEFSGLKHQRVRSKTVGEFRRGEFQVLVSSDAMTRGMDVEGVRNVINYDMPKYTKTYVHRAGRTARAGQTGRCFTLMSKDEIQLMHLSQRKKLQ

SEQ ID NO: 191368 - protein, 486 aa, Glycine max
  Coding DNA Sequence Number=SeqID_74590
  Gene Ontology: Mol. function=motor activity; Cellular component =myosin complex; Biological process=negative regulation of actin filament polymerization
  Homolog annotation: Hit_ID=Q1T0L3; Match level="QueryCoverage=97%, HitCoverage=42%, E-value=0.0, Identity=67%"; Hit description=IQ calmodulin-binding region; Myosin head, motor region; Myosin, N- terminal, SH3-like
  Pfam annotation: Domain name=Myosin_N; Domain location=37-78; Score =27.0; E_value=6.9e-05; Accession=PF02736.9; Description=Myosin N -terminal SH3-like domain
  Pfam annotation: Domain name=Myosin_head; Domain location=90-486; Score=145.9; E_value=1.1e-40; Accession=PF00063.11; Description =Myosin head (motor domain)
  Pfam module annotation: Pfam domain module=Myosin_N::Myosin_head; Domain location=37-78::90-486
MNKDVESPYVALSSSDSSGMVWELDDDDNISYFIKKKLRVWCRQPRGQWELGTIQSTSGEEASISLSNGNVIKVVRSEILPANPGVLEGVDDLIKLGYLNEPSVLHNLKLRYSQGMIYNKAGPILIALNPFKDLQTNGNDYVSAYRQRIIDSLHVYAVADVAYNKMIRDEVNQSIIISGESGSGKTETAKIALQHLAALGGGGSCAIENEFLQINRILEAFGNAKTSRNNNSSRFGKLIEVHFSSMGKICGAKIKTLLLEKSRVVQLANGERSYHIFYQLCAGSSSDLKERLNLRAVCEYKYLVQSDCTSIDDADDAKNFPQLKDQEMIFKMLAAILWLGNISFQVDSENHIEVVDDEAVTSTAQLMGCSSQELMTALCSHKIQSDEDTIAKNLTLRQAIERRDAIAKFIYASLFDWLVEQVNKSLEVGKQYTGKSISILDIYGFQTFQKNSFEQFYINYANERIQQHFNRHLFKLEQEVSNYVMC

SEQ ID NO: 191369 - protein, 1657 aa, Glycine max
  Coding DNA Sequence Number=SeqID_74591
  Gene Ontology: Mol. function=RNA-directed DNA polymerase activity; Biological process=RNA-dependent DNA replication
  Pfam annotation: Domain name=Exo_endo_phos; Domain location=667-945; Score=7.7; E_value=0.0039; Accession=PF03372.13; Description =EndonucleaseExonucleasephosphatase family
  Pfam annotation: Domain name=RRM_1; Domain location=64-133; Score =40.7; E_value=5e-09; Accession=PF00076.12; Description=RNA recognition motif. (a.k.a. RRM, R
  Pfam module annotation: Pfam domain module=Exo_endo_phos::RRM_1::RVT _1; Domain location=667-945::64-133::1127-1353
MRGERKDRERNSGWERVRTRREKRESNKERAREGQCLQFAGNSRGHKQDYTRVNWRDHKDVASFYFTRFPEDTTEEALWQHFKKAGDVREVFIAKKRNKNGRRYGFVRFKGVEDLQQLEKLDNIVFGGLKMFVNIPKFGRAVQGKPQPVTWGCPYTKSNEEESRDTNLRVQQRGYLGKKSGSYAEAVKRKNTGADQRRPADKRELSGHWSQSKVHLDISLTEHKWLTEAWVGRLKNLSLFDKVEDDILWDLGANVSPRYIGDDMILLLGLTDDQARQMETEENEGGSLFHTVEKWNPRMRPGHRLTWIHCWGIPLMAWNIQQMKKIVAGIGDVVEVDDNIEGPRKMDMARILIKTPWRPLIQHTVWVHIQEEIFQVHIIEECGTPSNTCLCRRDTEYSSSDEILSKESEGGSLWWILGQTTKEKEGSSSWTVAPSSQEGRHDPCTLEENDATTGDATSSERRNPQWYCHAKKGNGSAEVERWWEAHRTQGSRDGNDSDGGNGGQSACAGKGRPTPVVGQAKVSTDSNSATKQQTARMGHGTTDTKQWTMHERRGKQAMGICTSDGRGENLHEKGKMGAERTVGAVEKDVLNTDKPRDQEAENTNGLISAIHTPTKLIDKNINSSSTSPKGPNTSSKVYYRKRGCSKQSVSVLEDDMGQQITPTTPKMQGNVHKLDRNHEQTAHQLSTRIAAIDEAKLVNINIQEAETLWDIAKILGVTEGQFQRNNLQQLIIDMEDRDTKEAARLGRLGRGSSGRQLEALWENSDVRWEAQPSVNSSGGILCVWSAKSFKLERKINGVGFIMLVGKWRQETQTLYIINIYSPCDIQSKRVLWDNIKQLKNQNPEGLWCILGDFNSIRTPVERVGVCNRGVEVNNSREFNDWIAELEVEEAPWVGRKFTWIRPNGTARSKLDRFLVSPEWLTKWPGTSQYTLDRNFSDHCPLLLRGWGGYVLKQKIKSLKDRLKVWNRDQFGDALRKYKRIEEDLNKMEEESVVSQKQMQQDLWEAAQAHENNGLQGVMIDGAWNDDPKIVKEEVRRFFMQRFQESHFDSPTLDGIQFQTIGSQHNDMLVEHFQEDEIKRVVWSCGSDKSPGPDGLNFKFIKQFWQLIKSDFLRFLDEFYANGIFPKGSNASFIALIPKVLDPQTLNEYKPISLIGCTYKIVAKILANRLKKVMPLFIPKRQSAFIEGRHMLHSVLIANETIEEAKRCHKPCIVFKVDYEKAYNSVSWEFFIYMMSRMGFCSKWIKWMEGCLKSAFVSVLVNGSPSSEFFPQKGLRQGDPLSPLLLNIVVEALNGLMSQALAQRLYKGFLVGSNKVEVSILMQTTQSSLGSHFGAFGVPDQWKIMAANYLNCSLMSFPFTYLDVPIGVNPRRSQTWDPIIRKVPKKLVNKLVRLQRNFLWGGAQEQNKIAWVKWESVCMRKEVGGLGVKDINSFNLSLLWKWKWSLFQHQGELWARGLKVGDSTPATWADIEQFNIMEGSLLDKYPRLYTISSQQNQIIQHMGTVKDSGWEWEFKWRRPMFDNELDMAISFLKDVESHNIQQQERDQWVWMADSNGHYSVRSAYNVLREDIAEEIQDGAFEEMRKLKVPTKIATFAWRLFRDRLPTKTNLRKRQIELDDFLCPFCIAMEETTDIISSNTSMEVRRNLKLTDGIGGGSH

SEQ ID NO: 191370 - protein, 429 aa, Glycine max
  Coding DNA Sequence Number=SeqID_74592
  Gene Ontology: Mol. function=motor activity; Cellular component =myosin complex; Biological process=negative regulation of actin filament polymerization
  Homolog annotation: Hit_ID=Q1T0L3; Match level="QueryCoverage=87%, HitCoverage=45%, E-value=2e-64, Identity=57%"; Hit description=IQ calmodulin-binding region; Myosin head, motor region; Myosin, N- terminal, SH3-like
MALIGLSYSTFSGNWAVVMVVVLFVSTSGLYVQKPHGLLSLLDEESNLAKASDLTFANKLKHHLNANPCFKGEKGRAFRVRHYAGELFSKMFNQSQMQSVATKFKLESTTPHFIRCIKPNTKQLPGIFDEVLVLQQLRCCEVLEVVRVSRAGYPTRMAHQEFSRRYGFLLSEANVLQDPLSISVAVLQKFNIPSEMYHVGYTKLYLRAGQPDLSKEPVQNLLSALADLQRRVDKADAIVKQKEDENTELREQLKQSERKRIEYETKMKSMEEAWQKQMASLQMSLVAARKSLAPENASVQPVRRDFVLPRGYDSEDATSMGSRTPGGSTPMLSGSLSASDAGRQVNGTLTTVGNLMKEFEQERQNFDDEVKALNDVKPEQSANTNSFEELRKLKQRFEGWKNQYKHNDIQFSNSFAENRNAGESAKLAK

SEQ ID NO: 191371 - protein, 132 aa, Glycine max
  Coding DNA Sequence Number=SeqID_74593
MLKTLLVSLLALSPILDVNVLDSRSERCSYFLMIYEADPFFHAVEIGKTRGDTEKFDKFYKNRLQNIIWFGKKSLSTVNTKKDGQLLSFDSDTKIIICCPVLWSPRALTLRNSRMREEVISSGGTVDPTPAA

SEQ ID NO: 191372 - protein, 137 aa, Glycine max
  Coding DNA Sequence Number=SeqID_74594
  Subcellular localization annotation: CTP_CleavageSite=52; ConfidenceScore=5.41e-01
MPNSMNLMCFNFSFNASSAYSARHLSLPPLSAPSSFNEYSLTRTMHEIGAKRAFEDKKPFLRLKLGKSAGRLIQSIESRTEAKNKARKPKTSAFKRILGLGVNSRFLELKGAALQWKACFWSDHPLAKFNETSEKEV

SEQ ID NO: 191373 - protein, 163 aa, Glycine max
  Coding DNA Sequence Number=SeqID_74595
MDRHIDVALVKEFYLNLSTLEALEEGSNDTGPDLECVIILQPRPHFSYVQFGILEKREKLEGVAAGVSLSLANVLSKYHPLSETSARLASKSNLEGNLPCKHEPSASPARPVSHLSLLALSTPGSLSQRSLTHAKRENGAKCAFEDRMPFLKPEVKEKIGLGE

SEQ ID NO: 191374 - protein, 121 aa, Glycine max
  Coding DNA Sequence Number=SeqID_74596
  Subcellular localization annotation: CTP_CleavageSite=39; ConfidenceScore=5.54e-01
MSTTQLVVNMKGRPKIKGILVSSSMSITTKSAGKGPMTRSRTKQSMDTLQQMVTGILSKAQVEKDEDRSGKGRSPKWRRMKVQVDKDKGPSGEGRKIQVEKDEGPKAKALLSILIVAEGPD

SEQ ID NO: 191375 - protein, 55 aa, Glycine max
  Coding DNA Sequence Number=SeqID_74597
MLASLDVAALTQHNRSGRTLTKQESNGCRVKAIDGGAIHPRHMCRKPTLRREGDA

SEQ ID NO: 191376 - protein, 101 aa, Glycine max
  Coding DNA Sequence Number=SeqID_74598
MEHSRTMFTWINSYHYSYMVEEETRLHVHFGCIRRHFLQLDEPQIPPIIIEKPLAGTHRTSYRSIVEEKPTLLLELWVEENPRRSWNSRGCSKLKALYAAS

SEQ ID NO: 191377 - protein, 471 aa, Glycine max
  Coding DNA Sequence Number=SeqID_74599
  Homolog annotation: Hit_ID=Q10CF1; Match level="QueryCoverage=48%, HitCoverage=25%, E-value=4e-46, Identity=46%"; Hit description =Expressed protein
HEAEIHGADISVHRADSVVGEMEQRVEDAENQGQTGESVSDPGLMDEFIPDMNREDPIGDSQEMMSHSAGRTDSGSKIGCSTESVESGEKISQNCNLLPANSSHPSQIMKHDKSSFANNCALPESDFAIANGIGPPKGESNYEAAEFDPIVHHNQCCPWVNGNVAAAGCASSVPSSDAIALSVWQLTIDALDALSLGHNAIPTVPSESAASLYKQFVVNLVVPPHYLTGDDRIADRVNPEYETWEVQDRTLLVWLQSTLSKSVLSRVLGLNHSYQVLELMILSPRIVNTRLRPCLHRVSVNWDRVGLKAQVEKDEGPSGEGQSPRVEKDEGPSGLFVQLHYNSLLNQSQTYQGNPCGVYPDLSSFTGSGVYPDLSSFTGSGVIQTSVACIKRSTPTQVHITRYRNSGEKDSKISHRRSTSGTAIFLSPNLVSWWSHKQKADVLTKPLSASRFEALRGKLNVKSVSNENSPP

SEQ ID NO: 191378 - protein, 77 aa, Glycine max
  Coding DNA Sequence Number=SeqID_74600
MPNSVNLMCFNFSFSEACALSENRALSEALSLLSELGESGGESEKHLRSICALSASSACLVRRLSLPARPAHSADIH

SEQ ID NO: 191379 - protein, 132 aa, Glycine max
  Coding DNA Sequence Number=SeqID_74601
MMMVSTTNNNNRNNSDDHNNNAIDVTFGCDSDDVVVTANDVMSMILVWSSGGSNVGKGRNDASSCGHEGGIVVVRNGGDDNDNGESDMDDDGGDNNISSDDNVSGNNGDNNNSVGGVCNHISDDCAGNNDHP

SEQ ID NO: 191380 - protein, 136 aa, Glycine max
  Coding DNA Sequence Number=SeqID_74602
MIKKIITEGGPEVGAKEKIPAQEKLLKKDITTAGEKVTDSTINKATKAQARSTSPSREKVHELEKTKELNLLDDEEEISSQAMDKSAKEMRNRDGLESIAQLYGEAFETHTDMEISEHVHILILDAKVDLEISHIQ

SEQ ID NO: 191381 - protein, 794 aa, Glycine max
  Coding DNA Sequence Number=SeqID_74603
  Gene Ontology: Mol. function=ATP-dependent helicase activity
  Homolog annotation: Hit_ID=O80792; Match level="QueryCoverage=72%, HitCoverage=68%, E-value=1e-91, Identity=50%"; Hit description =Putative DEAD-box ATP-dependent RNA helicase 33
  Pfam annotation: Domain name=DEAD; Domain location=532-710; Score =157.9; E_value=2.6e-44; Accession=PF00270.19; Description=DEADDEAH box helicase
  Pfam annotation: Domain name=Tetraspannin; Domain location=11-195; Score=36.4; E_value=5.7e-08; Accession=PF00335.10; Description =Tetraspanin family
  Pfam module annotation: Pfam domain module=DEAD::Tetraspannin; Domain location=532-710::11-195
MATSDKERKKIWILGIILDIVLAVSDHPVLCLGGNSGLHSIGVSMFIVTNNGSGHSVTGLRYKEYQLQDFSSWFLKELNNSRNWERLKVCLVKSDDCNNLSKKYKTPKQYKSAKLSPIEAGCCRPPSQCGYPAVNASYYDLTFHPVSPNNDCKRYKNYRAVKCYDCDSCKAGVAQYMKTEWRVVAIFNVVLFVVLSAAMWGWMVGEARRAACNWNWVSLRSMGGGPRTFPGGVNKWKWKRMHEKLARDKQNRLIQQEKQLYPARIRSHIRSSLSPDHRSAAAATHRPLSPNDHFKALADRFVKDGAEDLWNNHDGPLTPNPTTPNLDFCPKHTRGYRAVPEVGNSRVGAHKYRFWRKGSDDSSSGESESEIEVELSMKKRGSSASLGEYDVKRERRVVPKTSPEFEFISYELNKRKLSQIEDQQSEQQQSNESILSNTRLKWLMQPQLCLQSLDECGISPLTVKALSSAGYVHMTRIREASLPICLEGIVENNRSPISAKSNLTLEYISEGQPSPLELAFGPSLCGDKHQPFEGQPSPLELAFGGMDAVVKAKTGTGKNRKQLPAIETVLKAMSSNTSQRVPPIYVLILCPTRELANQVAAVAKVLLKYHDAIRVQTLVGGIRFKVDQKRLESDPCQILVATPGRLLDHIENKSGISLRLMGLRTLVLDEADHLLDLGFRKDVEKIVDCLPRQQQSLLFSATIPKEVRCVSQLVLKREHKYVDTVGMGCVETPVKASYSNYCHCHTLKIAKVKQSYLIAPHESHFQLVHHILKEHILQTPDYKVIVFCITGMVK

SEQ ID NO: 191382 - protein, 134 aa, Glycine max
  Coding DNA Sequence Number=SeqID_74604
  Gene Ontology: Cellular component=integral to membrane; Biological process=intracellular signaling cascade
  Homolog annotation: Hit_ID=O64668; Match level="QueryCoverage=72%, HitCoverage=21%, E-value=1e-09, Identity=38%"; Hit description =Presenilin-like protein At1g08700
NDEEGGEVRVVEEEGSAIVVVEEDGEERQECDEDDEDDDVEDHALEFLRGGVGRVLNVDEVGGGGDGCGDEQRGERVNQQNHKEHANRDRAHHADYLHICPETFQNSIPFSQILGIFWFWKLFLAPVINKLHFL

SEQ ID NO: 191383 - protein, 140 aa, Glycine max
  Coding DNA Sequence Number=SeqID_74605
  Subcellular localization annotation: CTP_CleavageSite=84; ConfidenceScore=5.06e-01
MKKRNKEKSFAYKGVGMSPPPLGITQSLKDSQISLKGQNLAPGFGLCSSLTTLFVVYLDLSSSVQIRLKKGFLTSTSRLMPFLRLARVSEFWLSAKLALSLEGGKRLAERVDDALSACLHDRFPSRFLLLAKRAKASLSG

SEQ ID NO: 191384 - protein, 227 aa, Glycine max
  Coding DNA Sequence Number=SeqID_74606
  Gene Ontology: Mol. function=hydrolase activity, acting on ester bonds; Cellular component=nucleus; Biological process=lipid metabolic process
  Homolog annotation: Hit_ID=Q1SQA1; Match level="QueryCoverage=89%, HitCoverage=68%, E-value=6e-72, Identity=61%"; Hit description =Lipolytic enzyme, G-D-S-L
  Pfam annotation: Domain name=Lipase_GDSL; Domain location=34-225; Score=32.2; E_value=1.8e-06; Accession=PF00657.12; Description=GDSL -like LipaseAcylhydrolase
MAALDLTISMLTLIVVVSLGLWSGVQGALQVPCYFIFGDSLVNNGNNNQLQSLARVDYLPYGIDFPGGPSRRFSNGKTTMQLGGRISFSGQVQNYQSTVSQLVNLLGNKDSAANYLSKCIYSIGLGSNDYLNNYFMPQFYSSSRQYSQHEYADVLILAYTKQTLYNYGPRKMVLFGICQIGFSPNELAQNSPDGKTCVEKINYANEENMWHIYTGVGEKVFKDDFES

SEQ ID NO: 191385 - protein, 128 aa, Glycine max
  Coding DNA Sequence Number=SeqID_74607
  Homolog annotation: Hit_ID=Q2N2B2; Match level="QueryCoverage=56%, HitCoverage=37%, E-value=3e-11, Identity=45%"; Hit description=RPGR ORF15 isoform
MILIPMQDKGEDFESYEEFESYEGEDFEPSEGEDLESSKARTLSPPKARTLSPLKARILSPLKVRTLSPLMAMTLSPLKVRTLSPLKARTLSPLMARTLNPLKARTLSPLKVHATFVLKCSKCRFRMQ

SEQ ID NO: 191386 - protein, 572 aa, Glycine max
  Coding DNA Sequence Number=SeqID_74608
  Gene Ontology: Mol. function=RNA binding
  Homolog annotation: Hit_ID=Q6Z7B3; Match level="QueryCoverage=95%, HitCoverage=79%, E-value=5e-76, Identity=31%"; Hit description=Heat shock factor protein hsf8-like
  Subcellular localization annotation: CTP_CleavageSite=34; ConfidenceScore=5.47e-01
MGSLPLTSSKPFFTQLHWFSSDRTRTLSLNQRVKVFASRSRNEGEKEPPKFDSYDLMELKFGRLLGEDPKLTLAKIMGRKVNPDASYLDIEKAFYKNKGKIVEVEQVPFEGSKGGRSSRKLDDQGLVRPVPAKGMEFKSDDSKPALEIKKPVRAENKVGSVRKSIVPNVILRKPAVLKDDGDGDTLTSRLRMRPKMQDEQVKDTFSDMTLLRKPEAAVAKNTDAIQEPSSSVDGQGNNDDELKMWNEELSDEIGGFTLLERPHKPSGEKEEKLEEVNVMIPNDGLEQHEQRQLEFHEEPNDLCQLSDLKSDDSRVELSAEAALQAKPKRLDKYVKQTSKFVGEEGASRNIGGRTNNDDLGKIVDMSDFQESEDADWTRTQDLIKTGDREDVELVSCNTKGFIVSFGSLVGFLPYRNLASKWKFLAFESWLKQKGLDPSIYKQNSGTITSFDAEIKNLSPDSPPSLEIDGKVEDRISPDMKLEDLLRIYDQEKLKFLSSFVGQKIKANVLVADRKMRKLIFSLRPKEKEELVEKKRNLMVEGVSALIHQSELSWDATLNPASYFQIGQVWHEQ

SEQ ID NO: 191387 - protein, 40 aa, Glycine max
  Coding DNA Sequence Number=SeqID_74609
MAKNTILCEEYYRLDSSIIVLREGLSMQLAHDGLRVPINL

SEQ ID NO: 191388 - protein, 206 aa, Glycine max
  Coding DNA Sequence Number=SeqID_74610
  Gene Ontology: Mol. function=protein kinase activity; Cellular component=cytosol; Biological process=protein amino acid phosphorylation
  Homolog annotation: Hit_ID=Q60DP4; Match level="QueryCoverage=97%, HitCoverage=18%, E-value=6e-66, Identity=58%"; Hit description =Calcium binding EGF domain containing protein
  Pfam annotation: Domain name=Lactamase_B; Domain location=30-201; Score=2.9; E_value=0.09; Accession=PF00753.17; Description=Metallo -beta-lactamase superfamily
MRCLIDPSDPPCPVCAYSLSFPPHLNPNYRCNSSLLIDYYCRSDATHKYILIDAGKTFRETALRWFVFHHIPRVDSIVLTHEHADAVLGLDDVLALQPFSLTNDTDPIPVYLTQHSMDSVEKRFPYLVKKKHKEGQEMRRVVQLCWNIIADDCNGPFFASGLKLIPLPVMHGEDYICLGFLFGEKNRVAYISDVSRIPASIEYGAF

SEQ ID NO: 191389 - protein, 97 aa, Glycine max
  Coding DNA Sequence Number=SeqID_74611
  Gene Ontology: Mol. function=DNA binding; Cellular component=plasma membrane; Biological process=cell-cell signaling
  Homolog annotation: Hit_ID=Q1T3L8; Match level="QueryCoverage=93%, HitCoverage=69%, E-value=7e-23, Identity=55%"; Hit description =Remorin, C-terminal region
  Pfam annotation: Domain name=Remorin_C; Domain location=2-92; Score =75.5; E_value=1.6e-19; Accession=PF03763.4; Description=Remorin, C -terminal region
MKFKAYKRHNAVVLWENSKKASAEAHLKRIEEKLDRNKAKCVEKMQNKVAEIHRTAEEKRAMIEAYKGEEFLEIEEKAAKFRTRGYSPKKYLPCFGS

SEQ ID NO: 191390 - protein, 146 aa, Glycine max
  Coding DNA Sequence Number=SeqID_74612
  Gene Ontology: Mol. function=chitin binding; Cellular component =extracellular region; Biological process=chitin metabolic process
  Homolog annotation: Hit_ID=UPI0000612705; Match level="QueryCoverage =70%, HitCoverage=91%, E-value=6e-14, Identity=28%"; Hit description =UPI0000612705 related cluster
MPSPLEDCTSSPLEGYKLSPLKDCISSPLEDYTSSPSAECMFLPSEGYTSSPSGGYTPSSSEGYTPSPLEGYTLSPSKDCTSLPAEGFTSLPSMDCTSSPSEGYMPSVEATFMMMNQVDSSSFDDDKDDDKKPNIMISRWSQQVQL

SEQ ID NO: 191391 - protein, 43 aa, Glycine max
  Coding DNA Sequence Number=SeqID_74613
MGESGNQRGKEVEDGDTSSGVRQEYAISPLNLCFKGLQEFLII

SEQ ID NO: 191392 - protein, 273 aa, Glycine max
  Coding DNA Sequence Number=SeqID_74614
  Homolog annotation: Hit_ID=Q8LCP6; Match level="QueryCoverage=36%, HitCoverage=23%, E-value=1e-34, Identity=61%"; Hit description =Endoglucanase 10 precursor
  Pfam annotation: Domain name=Glyco_hydro_9; Domain location=66-271; Score=-242.7; E_value=0.0061; Accession=PF00759.9; Description =Glycosyl hydrolase family 9
MQGITRMDAALDAMRPLGFRTQLILRTVNELLDVYGGNQGWCFIEEAYYKLLMEALPGPPGAVDQKYRTALKTAMQFFDDGSQAKLDLSKGMYDVGDNMKFGFSMAFTATVQSWSILEYGDQMDHVGQLDAAQYSLKWITDFLINAHPSENVLYIQCYCVMLMVWDIQSSMSPLLFVVAPGPHRQSCEMWKELQTKVAELPKAKPQKRKLHQGRGGNYYQATPKRITEGQNNVVIIDRMWARLLSSTNLPSFTIAKTVSKEKRQEEANDHVPE

SEQ ID NO: 191393 - protein, 1075 aa, Glycine max
  Coding DNA Sequence Number=SeqID_74615
  Gene Ontology: Mol. function=receptor activity; Cellular component =striated muscle thick filament; Biological process=ventricular cardiac muscle morphogenesis
  Homolog annotation: Hit_ID=Q9FLL5; Match level="QueryCoverage=98%, HitCoverage=97%, E-value=0.0, Identity=40%"; Hit description =Similarity to myosin heavy chain
  Pfam annotation: Domain name=HSBP1; Domain location=543-593; Score =5.1; E_value=0.075; Accession=PF06825.3; Description=Heat shock factor binding protein 1
  Pfam annotation: Domain name=M; Domain location=324-344; Score=7.5; E_ value=13; Accession=PF02370.7; Description=M protein repeat
  Pfam annotation: Domain name=M; Domain location=569-589; Score=5.4; E_ value=25; Accession=PF02370.7; Description=M protein repeat
  Pfam annotation: Domain name=M; Domain location=665-685; Score=6.1; E_ value=20; Accession=PF02370.7; Description=M protein repeat
  Pfam annotation: Domain name=M; Domain location=729-749; Score=3.6; E_ value=42; Accession=PF02370.7; Description=M protein repeat
  Pfam annotation: Domain name=M; Domain location=851-871; Score=2.8; E_ value=54; Accession=PF02370.7; Description=M protein repeat
  Pfam annotation: Domain name=M; Domain location=904-924; Score=0.2; E_ value=1.2e+02; Accession=PF02370.7; Description=M protein repeat
  Pfam module annotation: Pfam domain module=HSBP1::M::M::M::M::M::M; Domain location=543-593::324-344::569-589::665-685::729-749::851 -871::904-924
MTNLRFEFLPGEMVQSAVDGLVLSIVPGDIGKVTTRLEKAAVRGGVCRWENPVYETVKFVREPKIGKFNERLYHFVVSTGLSKASSFGEVSVDFAEYAEATKPSTVSLPIKNSHCDAVLHVSIQRLQENNDKREEEDCEDAKLKANDRSLRTYLSNGEIDANSKIDSSEDVSAKANTNGAALSADCRTSSGSDITLSSSDGSSGLDTLRENGLRNGGIHHNDHGFLSEASHPSEPQKPAVNASAVMYDIHQRSHWDWSARSEHSLSTDSSTNGSQDVFPRERSHQTSDMEVERLKAELAALARQADVSDLELQTLRKQIVKESKRGQELSKEIISLKEERDALKLECDNLRSFRKRMEEAKVSNRPQLDSGDLCTLVEEIRQELKYEKELNANLQLQLKKTQDANSELVLAVQDLDEMLEQKNSEIYSLSNKHEEGKNSHELAGKLSNCETDDEEQKELEELVKEHSNAKESHLLEQKIIDLYGEIEMYRRDKDELEMQMEQLALDYEILKQENHDIAYKLEQSELQEQLKMQYECSSPPPAVDDVEAHIQNLENQLKQQSEEFSNSLATIKKLETQISRLEEELEKQAAGFEADLDAVTRDKVEQEQRAIRAEEALRNTRHKNANTAERLQEEFRRLSTQMASTFDANEKAAMRALTEASELRAQKRLVEAMLHKVNEELQSAKAEYEVKLNELSNKIDMMTAQKQQMFLEIEDKSKQLENQKTREEQVSRDFSEEIQMLKAENERLKVEISCLSEQVEQKEMLRNDLELMNKSLEESEAQLQNRTVESNELVSEIALLKKEAERSLDELNRMKNLKDEKEMAGRVLQSELEALRAQYNDLKSYLLGDEAEKENLRKQVFQLKGELKKKDDALINIEKKFKDSNGRTQLSEGTKTNSKNKKGASIPQSSKEMANLREKIKTLEGMIKSKETALEMSTSSFLEKERELQSKIEELEDKVEEFNHSIALQKVVEDKNTTTSNGVAVSLFKSDVHLSEKEAEISTIDSNEGGYLCETLAELSLLKERNNSMETELKELQQRYSEMSLRFAEVEGERQKLVMTVRNLKNARKAQMTSS

SEQ ID NO: 191394 - protein, 107 aa, Glycine max
  Coding DNA Sequence Number=SeqID_74616
  Gene Ontology: Mol. function=protein kinase activity; Cellular component=membrane; Biological process=protein amino acid phosphorylation
  Homolog annotation: Hit_ID=Q1S8D8; Match level="QueryCoverage=79%, HitCoverage=17%, E-value=4e-34, Identity=82%"; Hit description =Protein kinase domain, putative
LLNNAIFGKSGEKASNVVYNGKLENNRLVVVKRFSKLSLPDAQQFMVETTRVGKVRHKRLVNLIGCCAEGDERLLVAEYMPNDTLSKHPFHCTSLLCIHSFNFVSCH

SEQ ID NO: 191395 - protein, 63 aa, Glycine max
  Coding DNA Sequence Number=SeqID_74617
MGVKRQKLNKIVMQNIQRMTVEWGVIFLKQLGPDLNFQKMHTSIKKEKCSCCGLKTIIHLPSG

SEQ ID NO: 191396 - protein, 92 aa, Glycine max
  Coding DNA Sequence Number=SeqID_74618
MVVAAMFVVIVVMLTKTLVMTMTVVMVTILVVMIIVTVKMVLVVAMGDNGGYNDISGGRGYIDDGVALAIMVVVIANNNGDNDNKDNHDCDN

SEQ ID NO: 191397 - protein, 58 aa, Glycine max
  Coding DNA Sequence Number=SeqID_74619
MENSARVSNSPCNKASNKEEDMLDRSKKKVKTWNMEIVESGENNGQEQSYQDILLGAE

SEQ ID NO: 191398 - protein, 268 aa, Glycine max
  Coding DNA Sequence Number=SeqID_74620
  Gene Ontology: Mol. function=transferase activity; Cellular component= nucleus; Biological process=response to stress
  Homolog annotation: Hit_ID=Q1RY55; Match level="QueryCoverage=96%, HitCoverage=100%, E-value=2e-93, Identity=67%"; Hit description =Glutathione S-transferase, N-terminal; Glutathione S-transferase, C- terminal-like
  Pfam annotation: Domain name=GST_N; Domain location=3-78; Score=31.1; E_value=4e-06; Accession=PF02798.10; Description=Glutathione S -transferase, N-terminal domain
MMGKLKVYADRMSQPSRAVLIFCRFNGIDFEEIKVDISKRHHLSPEFREVNPLQKVPAIVHGSFNLSERVVLEMVSVNVFFMLYSGLCASSLGNHAILVYLASAFPGIADHWYPSDLYRRAKIISVMDWHHSNLRHGAGPATGRPLNPKAAAEAEKVLLSSLSKLEDIWLNGDGHFLLGVSQPSIADLSMVCELMQLEVLDEKDRSRILSPYKKVLQWIEDTRTATNPHFEEVHNILYRAKKKFEQQRSRVAETGTEPSNKMGGHSKM

SEQ ID NO: 191399 - protein, 116 aa, Glycine max
  Coding DNA Sequence Number=SeqID_74621
  Gene Ontology: Mol. function=protein-tyrosine kinase activity; Cellular component=cytoplasm; Biological process=protein amino acid phosphorylation
  Homolog annotation: Hit_ID=Q1RY61; Match level="QueryCoverage=84%, HitCoverage=18%, E-value=4e-43, Identity=83%"; Hit description =Protein kinase
MCLLKKLLSFLQEEARAVGQLRNQRLINLLGCCCEGEERLLVAEYMPNDTLTKHLFHWETQPMRWAMRMRVALCLAQALEYCTSKGRALYHDLNAYRVLYDDVKVLLDGAQNMQIC

SEQ ID NO: 191400 - protein, 656 aa, Glycine max
  Coding DNA Sequence Number=SeqID_74622
  Gene Ontology: Mol. function=protein-tyrosine kinase activity; Cellular component=integral to membrane; Biological process=protein amino acid phosphorylation
  Homolog annotation: Hit_ID=Q8GY10; Match level="QueryCoverage=96%, HitCoverage=96%, E-value=0.0, Identity=65%"; Hit description =Putative receptor protein kinase
  Pfam annotation: Domain name=LRRNT_2; Domain location=25-66; Score =42.3; E_value=1.6e-09; Accession=PF08263.3; Description=Leucine rich repeat N-terminal domain
  Pfam annotation: Domain name=LRR_1; Domain location=119-141; Score =14.9; E_value=0.3; Accession=PF00560.23; Description=Leucine Rich Repeat
  Pfam annotation: Domain name=LRR_1; Domain location=143-165; Score =9.6; E_value=4.5; Accession=PF00560.23; Description=Leucine Rich Repeat
  Pfam annotation: Domain name=LRR_1; Domain location=167-190; Score =13.7; E_value=0.67; Accession=PF00560.23; Description=Leucine Rich Repeat
  Pfam annotation: Domain name=LRR_1; Domain location=212-234; Score =5.4; E_value=28; Accession=PF00560.23; Description=Leucine Rich Repeat
  Pfam annotation: Domain name=LRR_1; Domain location=71-93; Score=4.3; E_value=45; Accession=PF00560.23; Description=Leucine Rich Repeat
  Pfam annotation: Domain name=LRR_1; Domain location=95-117; Score =12.7; E_value=1.2; Accession=PF00560.23; Description=Leucine Rich Repeat
  Pfam annotation: Domain name=Pkinase; Domain location=357-630; Score=- 12.9; E_value=8.6e-08; Accession=PF00069.15; Description=Protein kinase domain
  Pfam annotation: Domain name=Pkinase_Tyr; Domain location=358-630; Score=-73.3; E_value=5.7e-08; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::Pkinase::Pkinase_Tyr; Domain location=25 -66::119-141::143-165::167-190::212-234::71-93::95-117::357-630::358 -630
MKLYTSFLFLALVSMLSFVASVMVPKNEVLALKTFKEAVYEDPHMVLSNWNTLDSDLCDWNGVSCTATRDHVIKLNLSGASLRGFLAPEFGKITYLQELILHGNSLIGVIPKELGMLKSLKVLDLGMNQLTGPIPPEIGNLTQVMKINLQSNGLTGRLPPELGKLKYLQELRLDRNKLQGSLPGGGSSNFSSNMHGMYASGVNLTGFCRSSQLKVADFSCNFFVGSIPKCLAYLPRSSFQGNCLHIKDIKQRTSVQCAGASVVNPKYQPATKHVTKHQEASKPAWLLALEIVTGTMVGSLFIIAILTAIQRCNNKSSIIIPWKKSASGKDYMAVHIDSEMLKDVMRYSRQDLEVACEDFSNIIGSSPDSVVYKGTMKGGPEIAVISLCIREDNWTGYLELYFQREVADLARLNHDNTGKLLGYCRESNPFTRMLVFEYASNGTLYEHLHCYEEGCQLSWTRRMKIIIGIARGLKYLHTEIEPPFTISELNSNAVYLTEDFSPKLVDFESWKTILERSERNSGNVSSQGAVCVLPNTLEARRLDTKGNIYAFAVLLLEIISGRPPYCKDKGYLVDWARDYLEMPEVMSYVVDPELKHFRYEDLKAICEVITLCISPDPSVRPSMRELCTMLESRIDTTINLELKASSLAWAELALSS

SEQ ID NO: 191401 - protein, 620 aa, Glycine max
  Coding DNA Sequence Number=SeqID_74623
  Gene Ontology: Mol. function=metal ion binding; Cellular component =nucleus
  Homolog annotation: Hit_ID=Q9FLL1; Match level="QueryCoverage=98%, HitCoverage=99%, E-value=1e-169, Identity=51%"; Hit description =Arabidopsis thaliana genomic DNA, chromosome 5, P1 clone:MEE6
  Pfam annotation: Domain name=NOB1_Zn_bind; Domain location=483-554; Score=135.2; E_value=1.8e-37; Accession=PF08772.1; Description=Nin one binding (NOB1) Zn-ribbon like
  Subcellular localization annotation: CTP_CleavageSite=47; ConfidenceScore=5.07e-01
MEEAPSSVPATASCWSNVVKKQPPPPPPQQHTERVLVETSESPNAISVAVVDANAVIQSGEKLHGLADKFISIPEVMEEIRDPVSRHKLSFLPFTIQTMEPSPESINKVVKFARATGDLQTLSDVDIKLIALTYTLEAQIHGTKHLREAPPPVQMVNVKRLPEKDLPGWGSNVPNLDEWEALEQTEDVSNSNSRILPLQDLSLNIVSHDEHFVDGSVERASEADSGIQEGDQNGSMKPRRYLPKKKEINIEGKMMVADGIDASQGEVDDSAGDWMPAVSRSTHRRYLRRKARREYHELLSSNQDQQQLEGNVDGSVGEDASALNQPAHHNEEQHIENAVTEDDNVVKENKDNESIYEIMQQMRLQEGSLEVLDEESKPSSSPEELQSDNAGLVETASDGNATVVNKLCDSRIDTIDGQSNQLEIASQTSEAADFSYADDDDSDQSWMVRSLSESSVACITGDFAMQNVLLQMGLRLLAPGGTQIHQLHRWILKCHACNTVTAEIGRIFCPKCGNGGTLRKVAVTVNENGIVLAARRPRVTLRGTKFSLPLPQGGRDAVTKNLILREDQLPQRDDDFFTPDSVFSHHIDKKAPFQPPVRKAMAVFSGRRNPNDNHYSRSKA

SEQ ID NO: 191402 - protein, 319 aa, Glycine max
  Coding DNA Sequence Number=SeqID_74624
  Gene Ontology: Mol. function=pyridoxal phosphate binding; Cellular component=cellular_component; Biological process=amino acid metabolic process
  Homolog annotation: Hit_ID=Q1RY50; Match level="QueryCoverage=99%, HitCoverage=100%, E-value=1e-138, Identity=75%"; Hit description =Pyridoxal-5-phosphate-dependent enzyme, beta subunit
  Pfam annotation: Domain name=PALP; Domain location=26-304; Score =161.0; E_value=3e-45; Accession=PF00291.15; Description=Pyridoxal -phosphate dependent enzyme
MEEESQITKGKYAADISSIKEAHARIKSLVHKTPLLSSSSLNAMSGRKLYFKCECLQKGFCKALLIVFYKISGNHAAALALAAKLRGIPSYIVIPKNAPTCKIENVKRYGGQVVWSEASVQSREEIANKVWQESGAIFIHPYNDGRILSGQGTISLEILEQAPQIDTLVVPISGGGLISGIALAAKSINPAIRIFAAEPKGADDAAQSKAAGRIIRLPETNTIADGLRAFLGDFTWPVVRDLVEEIITVEDSEIIKAMKLCFEILKVVVEPSGAIGLAAVLSDTFQKNPAWKDCNHIGIVVSGGNVDLAMLWDSLNKGK

SEQ ID NO: 191403 - protein, 82 aa, Glycine max
  Coding DNA Sequence Number=SeqID_74625
  Subcellular localization annotation: CTP_CleavageSite=45; ConfidenceScore=5.23e-01
MTHYKESNLNHNLTATVSLKHKCLSYSLISTSKRSNLCTSSHAIKSKMYKQNQKDFPRLVVRLGYKNSLVFLGFKGLDSKRA

SEQ ID NO: 191404 - protein, 112 aa, Glycine max
  Coding DNA Sequence Number=SeqID_74626
MEEFTVQVAWPRVQPSPFGGGKASVAQKPQSEPQPQPEATLETTPRTSPITTLGVEVFHEEDGIADTDYAANMAAAQSTWDPWHFTAQDIPQPAQDALSSPQDEPTAAQEEP

SEQ ID NO: 191405 - protein, 257 aa, Glycine max
  Coding DNA Sequence Number=SeqID_74627
  Gene Ontology: Mol. function=transferase activity; Cellular component= mitochondrial matrix; Biological process=metabolic process
  Homolog annotation: Hit_ID=Q8ZH09; Match level="QueryCoverage=99%, HitCoverage=87%, E-value=1e-125, Identity=87%"; Hit description =Probable inorganic polyphosphate/ATP-NAD kinase (EC 2.7.1.23) (Poly(P)/ATP NAD kinase)
  Pfam annotation: Domain name=NAD_kinase; Domain location=7-256; Score= 289.5; E_value=6.4e-84; Accession=PF01513.11; Description=ATP-NAD kinase
MNKKFACIGIVGHPRHPSALATHEMLFHWLVARGYSVMVERQIAHDLGLKDAVTGSLADIGQRADLAVVVGGDGNMLGAARVLARYDIKVIGVNRGNLGFLTDLDPDNALQQLADVLEGEYIDEQRFLLETIVHKEHQQCRISTAINEVVLHPGKVAHMIEFEVYIDDRFAFSQRSDGLIIATPTGSTAYSLSAGGPILTPSLEAIALVPMFPHTLSARPLVINGDSTIRLKFSQIGSDLEISCDSQIALPIQEGEE

SEQ ID NO: 191406 - protein, 112 aa, Glycine max
  Coding DNA Sequence Number=SeqID_74628
MSTLMKFYPNKVCARLLTLNSNRKKKTKLIAPTFPIRHAIKWHIYFFLSAKKLKRSLQEGNEFFEDDARHVKAFICLVQKACEDGKEHITKQFSRWVEEDLEMHMRKYAVPN

SEQ ID NO: 191407 - protein, 91 aa, Glycine max
  Coding DNA Sequence Number=SeqID_74629
  Pfam annotation: Domain name=zf-GRF; Domain location=15-49; Score =23.1; E_value=4.7e-05; Accession=PF06839.3; Description=GRF zinc finger
  Subcellular localization annotation: CTP_CleavageSite=18; ConfidenceScore=5.13e-01
MSANSSTRRNVTSNRLCYCGRRATIQTTRTTRNNGRLFYACPLPQVNIDVGATAIGRIEPIPDFGLRLRREILQREVRDQFEREFITFSIR

SEQ ID NO: 191408 - protein, 265 aa, Glycine max
  Coding DNA Sequence Number=SeqID_74630
  Gene Ontology: Mol. function=voltage-gated potassium channel activity; Cellular component=integral to membrane; Biological process=potassium ion transport
  Homolog annotation: Hit_ID=Q93YI7; Match level="QueryCoverage=87%, HitCoverage=29%, E-value=3e-79, Identity=65%"; Hit description =Inward rectifying potassium channel
  Pfam annotation: Domain name=cNMP_binding; Domain location=102-191; Score=58.1; E_value=2.8e-14; Accession=PF00027.19; Description =Cyclic nucleotide-binding domain
MYFFPLIKRIMLLVAQRDTVRAASEFASRNHLPHHIQDQMLSHLCLKFKTEGLKQQETLNGMPKAIRASIAYHLFFPVVQKVYLFQGVSHDFLFQLVTEMEAEYFPPKEDVILQNESPTDLYMLVSGAVDLIRYVNGHDQVLKKAIAGDTIGEIGVLYCRPQPFTVRTTELSQILRLSRTSLMNSLHAYPEAAQIIMKNIFMSIKRHEGLDFEYPPRDPGMPHYQMHDWDNTGGRFSDASTNNSHGEARLHNLIPEDGKRDPHDT

SEQ ID NO: 191409 - protein, 136 aa, Glycine max
  Coding DNA Sequence Number=SeqID_74631
  Gene Ontology: Mol. function=protein-tyrosine kinase activity; Cellular component=membrane; Biological process=protein amino acid phosphorylation
  Homolog annotation: Hit_ID=Q1RY61; Match level="QueryCoverage=93%, HitCoverage=24%, E-value=3e-63, Identity=90%"; Hit description =Protein kinase
DYNPRLSCFGLMKNSRDGRSYSTNLAFTPPEYLRTGRVTPESVTYSFGTLLLDLLSGKHIPPSHALDLIRDKNLQMLSDSCLEGELTNDDGTELVRLASRCLQSEPRERPNPKSLVAALIPLQKDSEVSWFESGSA

SEQ ID NO: 191410 - protein, 149 aa, Glycine max
  Coding DNA Sequence Number=SeqID_74632
  Gene Ontology: Mol. function=protein-tyrosine kinase activity; Cellular component=thylakoid; Biological process=protein amino acid phosphorylation
  Homolog annotation: Hit_ID=Q1RY61; Match level="QueryCoverage=89%, HitCoverage=26%, E-value=7e-51, Identity=73%"; Hit description =Protein kinase
MGRIDCIVFSPVKRGTKPRQTLEEIVRRDLMLSFQMWTNQMQETLNSKKKGDAAFRHKDFKTAIDSYTMFIDVGTMVSPTVYVRRSLCYLMSNMPDEALNDAMQAQVISPVWYIAFYLQAVALLALGKENDAQVALKEGSSLETKKNTN

SEQ ID NO: 191411 - protein, 143 aa, Glycine max
  Coding DNA Sequence Number=SeqID_74633
  Gene Ontology: Mol. function=glutamate-cysteine ligase activity; Cellular component=chloroplast; Biological process=glutathione biosynthetic process
  Homolog annotation: Hit_ID=Q9SEH1; Match level="QueryCoverage=83%, HitCoverage=23%, E-value=2e-65, Identity=95%"; Hit description=Gamma- glutamylcysteine synthetase precursor
MSYLSFEQYVDYALDVPMYFVYRKNRYIDCTGKTFRDFLAGRLPCIPGELPTLNDWENHLTTIFPEVRLKRYLEMRGADGGPWRRLCALPAFWVGLLYDELSLKSVLDMTADWTPEERQMLRNKVESLITLFSFLLLLFNPDA

SEQ ID NO: 191412 - protein, 147 aa, Glycine max
  Coding DNA Sequence Number=SeqID_74634
MTFANDPLNFAYMGTMYSSDCIEVLDYMFPSEGTVAEALVLSKDGLVRVGGQHRRDARKRVGRKDGSDGKENDEEGKDEDRDGNVLTITFDKTPLPPVATYPSAGGRRVTRGMRVPRKEYARSRHQRLFEENVGKTGKDAIYELLSE

SEQ ID NO: 191413 - protein, 95 aa, Glycine max
  Coding DNA Sequence Number=SeqID_74635
  Subcellular localization annotation: CTP_CleavageSite=34; ConfidenceScore=5.18e-01
MVISLGHKGVPKPSDTRPSTSSPPHKELQGHPTRSMHPSMNIHNIRRMNVNTIKDIRQGQCTPQHTQHPTYETWAPSSTLTMDELKILRHSLRDA

SEQ ID NO: 191414 - protein, 142 aa, Glycine max
  Coding DNA Sequence Number=SeqID_74636
  Homolog annotation: Hit_ID=Q1RY71; Match level="QueryCoverage=27%, HitCoverage=6%, E-value=5e-10, Identity=70%"; Hit description=Bromo adjacent region; Transcription elongation factor S-II, central region
MGNRRFTQVATSDDEDEAPPAPAPPPKQQSSVSASEENCSKQQQQQQRKRKRMKLQEEEEEEKEEEKKKKRKIKDKQEERSNEEEEPPQEDAKPIGEPVRLSGKGRGRKKHYESFEYDGNQYTLVLPFLVSRNYFRLFDLNA

SEQ ID NO: 191415 - protein, 51 aa, Glycine max
  Coding DNA Sequence Number=SeqID_74637
MTTSLDLSKGDEHNGDCARQGAPTSEITGEKWLWPVQWPMAMTVARDDIQQ

SEQ ID NO: 191416 - protein, 209 aa, Glycine max
  Coding DNA Sequence Number=SeqID_74638
  Gene Ontology: Mol. function=translation elongation factor activity; Biological process=transcription
  Homolog annotation: Hit_ID=Q1RY74; Match level="QueryCoverage=95%, HitCoverage=16%, E-value=6e-54, Identity=57%"; Hit description=Bromo adjacent region; Transcription elongation factor S-II, central region
MQHYANFVKWNWVCLSMSLDSSMGQELELDLDDKSSVGLSPNTVLPPHQYCVNVKKRSKKGKPTGKDDFFTLKEGFAGIKFARFRSSSCKSHLSRPHELEGNTETRRSSMYQSSEEVKSIKKMGTMVEGRRKIEISRRSDTSFVGSIVDSLCGSDDEGSGLRSSEISRSRTCKAPDSPNSFIEICINSDVKNKNSATVQGRESINLNPR

SEQ ID NO: 191417 - protein, 571 aa, Glycine max
  Coding DNA Sequence Number=SeqID_74639
  Gene Ontology: Mol. function=translation elongation factor activity; Biological process=transcription
  Homolog annotation: Hit_ID=Q1RY74; Match level="QueryCoverage=97%, HitCoverage=34%, E-value=1e-130, Identity=68%"; Hit description =Bromo adjacent region; Transcription elongation factor S-II, central region
  Pfam annotation: Domain name=BAH; Domain location=1-115; Score=60.4; E_value=5.9e-15; Accession=PF01426.8; Description=BAH domain
  Pfam annotation: Domain name=TFIIS_M; Domain location=267-362; Score=- 19.8; E_value=0.038; Accession=PF07500.4; Description=Transcription factor S-II (TFIIS), ce
  Pfam module annotation: Pfam domain module=BAH::TFIIS_M; Domain location=1-115::267-362
EDPILLTPEDKDQKPYVAIIKDITQSLNGSMMVTGQWFYRPEEAERKGGGSWQSCDTRELFYSFHRDDVPAESVMHKCVVHFVPIHKQLPNRKQHPGFIVQKVYDTVERKLWKLTDKDYEDNKQQEIDELVQKTLQRLGKLLDIEPEEPVADQEDLMKNKRILRKKSISPLDVSKEEETTRQGDQPLKPETPWSCVNNASEHYRILVDFNALTGDTHRDKCLEKLLQSVQFMFNSDDSIKKEEKGNDNSGAANNGSNNKSLESANECEDKVQKSSKPFVWPDDAVPAVVALEKASHDTLSSDYQKYNQKLRQLVFNLKNNAILARRLLNGELEPSIILNMTPNELKGLAVEFVWVGMSACSSQLVVLSILEFVNQFEGGFGIMQSNQSTLKSDTNTFYRTPVKTKARRTVTEESATNRSVNKYRSFHGSCSLAEVYRLQALDGVKGVIGFMFSSISVLEKEGLTAEETTKKEPDESQHMQMTGARCHRCTEGKVGLRDIIHAGHGDRYQLECTACGHSWFASRDEVSELTIDASDSKRSVGTAPWATAKFEDVEKKLSRKDGNIQASKLAD

SEQ ID NO: 191418 - protein, 1074 aa, Glycine max
  Coding DNA Sequence Number=SeqID_74640
  Gene Ontology: Mol. function=microtubule motor activity; Cellular component=microtubule associated complex; Biological process =microtubule-based movement
  Homolog annotation: Hit_ID=Q5JKW1; Match level="QueryCoverage=85%, HitCoverage=93%, E-value=0.0, Identity=46%"; Hit description =Putative kinesin heavy chain
  Pfam annotation: Domain name=CH; Domain location=25-126; Score=23.0; E_value=0.00056; Accession=PF00307.21; Description=Calponin homology (CH) domain
  Pfam annotation: Domain name=Kinesin; Domain location=491-814; Score =447.7; E_value=1.5e-131; Accession=PF00225.13; Description=Kinesin motor domain
  Pfam module annotation: Pfam domain module=CH::Kinesin; Domain location=25-126::491-814
MQWEQEGRGKGGTDKGNGFPRAGSQQLVSLVKWINAVLPNFNLPLDTTEEELRARLRDGSVLCSILDNLVPGSVKGSGSLNELIGVKRFLVALDELGLSGFELSDLEQGSMVPVLQCLETLKTHFAYNTAQENIQSGSRKRWDQSNLTFFEESDSCLKDASKLQHAVDGSVVSDEITSIDHIGIKSNELFQLKQGLLADFSDAKLNEVFKSNNLDSVSTQLLFNIGNRILSDIFERKNGDVPQAHRAACLLRKILQQNNLFKAREGKYQTRINALETLAVGTTEENEVVTSWVQQLKVEQTKFEEKKKLEEQDFSRLKKEKVHSEIEISALKQDLEIVKRTHEEHVSELELRATESKAEYEKRIEELKLHLADARKQVKELEAFSESRFLKWKNKEDTYQTIVNFQFGAFQELRAAMKSVKDDVIKTKRNYLEEFKYFGRMYLQLTRCAYVGIKLKGLAEAAENYHVVLAENRKLYNEVQDLKGNIRVYCRIRPFLPGQSQSHTTIEFVGDDGELIVGNPLKQGKENRKLFKFNKVFGQATSQGEIFKDTQPLIRSVLDGYNVCIFAYGQTGSGKTYTMSGPGLSSKSDWGVNYRALHDLFHISQSRRSSIVYEVGVQMVEIYNEQEKHTKYCFLDLHTLGIWNTAQPNGLAVPDASMHSVNSMADVLELMNIGLMNRATSATALNERSSRSHSVLSVHVRGTDLKTNTLLRGCLHLVDLAGSERVDRSEATGDRLKEAQHINKSLSALGDVIFALSQKSSHVPYRNSKLTQLLQSSLGGQAKTLMFVQLNPDVASYSETVSTLKFAERVSGVELGAARSNKEGRDVRELMEQLASLKDAIARKDEEIERLQSLKANHNGAKLGMISVRHGSSSPRRHSIGTPRISTRLAGARSFGVNGKAASDMDNCSEYSDKHSETGSHQSMDDFRNKSSSLRLKLTRDHISQNVNEDIDLLRFGDADSEERLSDISDGGLSMGTETEGSISSIVEYTLFPELEKAAEITPMKDTTTDNLPAESTEKPIMPSKIPKASQVPQKVQSKHSRHSMNKTSSKVLSSVRKPAASSSSSVKPPKRWQ

SEQ ID NO: 191419 - protein, 533 aa, Glycine max
  Coding DNA Sequence Number=SeqID_74641
  Gene Ontology: Mol. function=translation elongation factor activity; Biological process=transcription
  Homolog annotation: Hit_ID=Q1RY74; Match level="QueryCoverage=99%, HitCoverage=40%, E-value=0.0, Identity=71%"; Hit description=Bromo adjacent region; Transcription elongation factor S-II, central region
  Subcellular localization annotation: CTP_CleavageSite=29; ConfidenceScore=5.59e-01
MVHWLQKSLSAKAGISHMPSPLGSDCSSRSSPKVQVTHCRKRLNHFTKSKSLRSPVSKILENSEIKSNGIANIARHRTYQKSLLNDLSNKGKHSDIISEFISREIQYSGIASSPVHLHGNLKMENKHGVLFFEFKVKCPEDVFVAKTWRTGNAFNWVYTFHSIDNRKKSNANGLGSHDFDKDSSIVAQMLVSCNLGSELEDKVFDNFMVTEFVLYDFTHSRQSVSREKKSFCELDGSKTPKASHVGLKEETLGLDGNHVVKNKLQDKPLSSSVEFDDLNSYPYLSTECYPNLEIAAIVLQIPFSKRESLKYKRGERKSAKECSNRSDLSAVKDRKSLHYDQIQEQVKVVIPTGNHGLPNAESQAPSSLLDRLRHGGGCDCGGWDMACPLILLGNPTIQFAEDCSLMEEHQPLELFVQMYAALTPPGAKGSSPTFSMTRIEEGHYAVDFHAQLSTLQAFSICVAILHGTSAFSNASHQKNQQLSQCSSLKMLLEEDVDFFFKSVTTEKETGCKNQKGIPRSYVLNPPFSPIARV

SEQ ID NO: 191420 - protein, 65 aa, Glycine max
  Coding DNA Sequence Number=SeqID_74642
MKEKQMQKTDLRGKREADRREPIWRKQCGKKVRERNLTLRKAEIKSNVLEDCNVDETAMRADTDR

SEQ ID NO: 191421 - protein, 650 aa, Glycine max
  Coding DNA Sequence Number=SeqID_74643
  Gene Ontology: Mol. function=binding; Cellular component=integral to membrane; Biological process=transport
  Homolog annotation: Hit_ID=Q6ESH9; Match level="QueryCoverage=96%, HitCoverage=97%, E-value=6e-86, Identity=34%"; Hit description =Mitochondrial substrate carrier protein-like
  Pfam annotation: Domain name=Mito_carr; Domain location=355-439; Score=63.5; E_value=6.8e-16; Accession=PF00153.17; Description =Mitochondrial carrier protein
  Pfam annotation: Domain name=Mito_carr; Domain location=444-538; Score=6.8; E_value=0.00084; Accession=PF00153.17; Description =Mitochondrial carrier protein
  Pfam annotation: Domain name=Mito_carr; Domain location=541-633; Score=125.4; E_value=1.6e-34; Accession=PF00153.17; Description =Mitochondrial carrier protein
  Pfam module annotation: Pfam domain module=Mito_carr::Mito_carr::Mito_ carr; Domain location=355-439::444-538::541-633
MSGCNKSPKNGQQSFKYWRIQHGGASSEAVLSCVDYSPSLSTNENKQCYGSSQPKSPQILSTSQLISAIGLIWDSASRPLSVLLSKETVNQDDKGFQKEKILDSVDERKNDLVYASTDIKYYPVTEGGAQIVQGKLDFPKVMQKISVLDSSNESQDYIDSLFKRCLLASDKTTNKDWKEMELRREEMSCKSGNVYWWVGRNITKALNCQVDVAQPEIPESNAPVAGGNISVDTSTPALAIESDVSSPNSITHETQSLYNAATLNTRIVSPLCSDYFLQAVPDTCQILSSSICADYHINSLASYNSASNQCQHEIDDNKSLEIQRRHFLDIADDEPKVQTSATHLKPCNYQAKQEHVFSGALAGICVSLCLHPVDTIKTVIQACRAEHRSIFYIGKSIVSDRGLLGLYRGITTNIACSAPISAVYTFSYESVKAALLPHLPKEYYSFAHCMGGGCASIATSFIFTPSERIKQQMQVGSHYRNCCSCKISVWFGHVKYICPVKRCLLCLCWRAVLCRNVPHSIIKFYTYESLKQVMPSSIQPNTFQTLVCGGLAGSTAALFTTPFDVIKTRLQTQIPGSANQYDSVLHALYKISKSEGFKGLYRGLIPRLIMYMSQGSLFFASYEFFKRTFSLEASHPTDLCIQDNDGNAEE

SEQ ID NO: 191422 - protein, 184 aa, Glycine max
  Coding DNA Sequence Number=SeqID_74644
  Gene Ontology: Mol. function=RNA-directed DNA polymerase activity; Cellular component=nucleus; Biological process=RNA-dependent DNA replication
  Homolog annotation: Hit_ID=Q1SKJ4; Match level="QueryCoverage=90%, HitCoverage=26%, E-value=3e-32, Identity=39%"; Hit description=RNA -directed DNA polymerase
MKKVVSLIQSSFVPNRQSRDNIIITQEVIHSMKMKNGEKGWMDIKVDLEKVNDRLSWDFIIHTLKEVGLPSNYADVFHCVSSSSIKMLWNGEALEEFYPTRGIRQGDPLSSYLFVLCMERWKLLDAIKASIIAAMTVQFSHVYRECNKVAGLLAKKGLSLDEGIVYFLDYLALWYQLFKLMLLA

SEQ ID NO: 191423 - protein, 626 aa, Glycine max
  Coding DNA Sequence Number=SeqID_74645
  Gene Ontology: Mol. function=transcription regulator activity; Cellular component=nucleus; Biological process=regulation of transcription
  Homolog annotation: Hit_ID=Q675M8; Match level="QueryCoverage=99%, HitCoverage=97%, E-value=1e-170, Identity=50%"; Hit description=Myc -like anthocyanin regulatory protein
  Pfam annotation: Domain name=HLH; Domain location=423-472; Score =56.4; E_value=9.2e-14; Accession=PF00010.16; Description=Helix-loop -helix DNA-binding domain
MVPENLKKQLALAVRSIHWSYAIFWTDSTTQPGVLSWGEGYYNGDIKTRKTSQGVELNSDQIGLQRSEQLRELFKSLKTVEVSPQTKRPSAALSPEDLTDAEWYYLVCMSFIFNIGQGLPGRTLAKGQSIWLNNAHSADCKIFSRSLLAKTVVCFPFREGVIELGTTEQVSEDLSVIERIKTSFLNSLHVDVPNKSVATLKSRKQEDLSYVAFDHNDYNVESIPEVGYEIANTTSPNGSSNAIQANQPLDDTLMVESITNGTSQVQNWQVIDDELSNCVHNSMNSSDCISPTFASLENIASAPKCNNPSDPCARDFQKCNNPKMTLVDPRSDEWHYQRVISTLIKNTDQLLMGMHLQKFPQASSFVSWRKGEPMDSQWPRAGTSQKLLKKVLFEVPQMHLDGLHESQEENDYKEGMRVEADENGMNHVMSERRRRAKLNQRFLTLRSMVPSISKDDKVSILDDAIEYLKKLERRINELEAHRGVTDIETGTRRSPQDTVERTPDHYFSKNNNNNGKKPGMKKRKACGVDEKGREINLDALKGSYANDVIVSTSDNGIVIEMKCPSRAGRMLEIMEAINSFNIDFSSVQSTEADGNLYLTIKSVLTGPRVATAKRIKLALQKVASKC

SEQ ID NO: 191424 - protein, 41 aa, Glycine max
  Coding DNA Sequence Number=SeqID_74646
MSMLWTQLLTSFFISPETGGMQSCTRLLVEKPMTIHLFEMD

SEQ ID NO: 191425 - protein, 70 aa, Glycine max
  Coding DNA Sequence Number=SeqID_74647
MENARKVKRKAEKGEDNLKMDCDNGKVGEKENLLAGEEAIPLSTFDGRCYGSPDKQIPPQSISKEEMERF

SEQ ID NO: 191426 - protein, 92 aa, Glycine max
  Coding DNA Sequence Number=SeqID_74648
MEIGIHIGGDVEDRPVTTIQSRGKFVRICVELDLDKPLQPKVIARGYLLIIQYEDFTPEDIYDSQSSKNEGVTMKMDSSINNLEMIMRLEQK

SEQ ID NO: 191427 - protein, 348 aa, Glycine max
  Coding DNA Sequence Number=SeqID_74649
  Gene Ontology: Mol. function=RNA-directed DNA polymerase activity; Cellular component=chromatin; Biological process=chromatin assembly or disassembly
  Homolog annotation: Hit_ID=Q947Y6; Match level="QueryCoverage=98%, HitCoverage=27%, E-value=2e-74, Identity=38%"; Hit description =Putative retroelement
MCVDYRTLNSLTIRDRFPIPTIDEMLDELGKIVFRTLRKQHFKTHQRHYEYRVISFGLCNAPSTYQAAMNSLLAPFLHRFAIVFFYDILVYSDSLPSHLHHLETIFQTLLQGKFYLKRTKCMFAQTQLEYLGHLVFGKGVEPEPSKVRAMVQWPTLAMASPKELHAFLGLTRFYCKFIKNYATIVTPLTSLICKDVFVWTSVSQSCFEQLKLAMTQALFWLSQILMHHSSLELHAIVTTVRKWRQYLFGHSFTILTGHKSLRELMSQVIKTPEQYYYLSKLLGYDYSIQYKSSASNVVTYALSRSAPATPGQLLLLYVPNFDFIDDLRRTLHASPAFQAQLSKVRDTP

SEQ ID NO: 191428 - protein, 336 aa, Glycine max
  Coding DNA Sequence Number=SeqID_74650
MVPADCSSRPDRSKAHCISQTRLRDTRSAADGEEGELVFGRWSRTLIAKLQWREWDVGDEEALHLGSKNRFGPNNYIRAKLDWAAQGAPLIGRIWKVTVNGWPWRVKGVFDGKAGVVDNVEEAKSLGRGKAGKGVEADMGNGRGGGVVRNEEENMTFAMMSGTPLFIVIVVKALLVAEGHFVWGVLYERGFRFRGSGLRQGNWLKGQHLATKFQRQAGDEATQQERGWKADDVVGQALELESVLGIIVKERCKARLQRLQEARPGGDESITEHALKYTTEGIASIKMGNIEFHRIAMKMESVKDRINLAKEIIVLICEPISGGLAGGMVGPVDKRR

SEQ ID NO: 191429 - protein, 467 aa, Glycine max
  Coding DNA Sequence Number=SeqID_74651
  Gene Ontology: Mol. function=structural constituent of ribosome; Cellular component=small ribosomal subunit; Biological process =metabolic process
  Homolog annotation: Hit_ID=Q1RW27; Match level="QueryCoverage=91%, HitCoverage=83%, E-value=1e-79, Identity=42%"; Hit description =Octicosapeptide/Phox/Bem1p; CBS
  Pfam annotation: Domain name=CBS; Domain location=99-217; Score=84.0; E_value=4.6e-22; Accession=PF00571.18; Description=CBS domain
  Pfam annotation: Domain name=PB1; Domain location=332-418; Score =43.4; E_value=7.8e-10; Accession=PF00564.15; Description=PB1 domain
  Pfam module annotation: Pfam domain module=CBS::PB1; Domain location =99-217::332-418
MIMFSGRFRHLPVVENGEVVAILDIAKCLYDAIARMERAAEKGKAIAAAVEGIEKHWGTSTPASNSTFMETLREQIFKPSLSTIIPENSNYYIKLIQQIVALSRVVTVSPTDSVLTTTKKMLELRASSAVVTIDDKPCGILTSKDILMRVIAQSLPPSSTLVEKVMTPNPECGTIDTPIVDALHTMHDGKFLHLPVVNRGGIVVATVDVIHITHAAVATASQVGNTPNFNNEAANSMIQKFWDSAMALAPNEEDEDSQSEASLKMISEGGETGRSISYLTSSMQNVFSFKLQDRKGRLHRFTCVFSNVSCTYCTSHNSNRGLCLINTEMNKRETEKEKWMGDETRERKQEDTRSLAEVITSIVQRVGDDIDPMNLPQILYEDEDNDKVVLASDSDLAAAVDHAKTAGLKGLRLHLDYSGTHGYGTDSSSVSWKYANSEAWASAYSAIAAGTAVVAALGLLAFVRRSR

SEQ ID NO: 191430 - protein, 194 aa, Glycine max
  Coding DNA Sequence Number=SeqID_74652
  Homolog annotation: Hit_ID=Q47522; Match level="QueryCoverage=26%, HitCoverage=64%, E-value=7e-24, Identity=100%"; Hit description=LacZ protein
MKHFTDTLISANIKVVKEKNALAERLKNAEAARKRFDEELKRFATENVTREEIRQSLEDEVRRLTQTVGQSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 191431 - protein, 274 aa, Glycine max
  Coding DNA Sequence Number=SeqID_74653
  Gene Ontology: Mol. function=transporter activity; Cellular component= integral to membrane; Biological process=auxin mediated signaling pathway
  Homolog annotation: Hit_ID=Q84YG8; Match level="QueryCoverage=77%, HitCoverage=33%, E-value=2e-75, Identity=64%"; Hit description=Auxin efflux carrier protein
  Pfam annotation: Domain name=Mem_trans; Domain location=9-274; Score =46.1; E_value=1.2e-10; Accession=PF03547.8; Description=Membrane transport protein
MINDKEVYNVMAALVPLYVPMILAYYSVRWWKIFTPEQCSGINRFVAIFAIPFLTFHFLSSNSPYTMNILFIAADTLQKVVILGALFLWTAFAKRGGGLDWTITLFSLSTLPNTLIVGVPLLTAMYGDSSASLMSQLVFMQGVLWFTLMLFLYEYQGAMHLFLNRIPDSGDSIITTFTVDPDVNTLNGNEPLLVDLEKKENGELHVMVRSSSLKIFNRSTEMCCAHLPKRRASSFSTILDLQSEGFEEMPKIHEEKMCKRDAFKYLLNSGLLSS

SEQ ID NO: 191432 - protein, 263 aa, Glycine max
  Coding DNA Sequence Number=SeqID_74654
  Homolog annotation: Hit_ID=Q1SP88; Match level="QueryCoverage=29%, HitCoverage=28%, E-value=4e-10, Identity=45%"; Hit description=NAD -binding site; L-lactate/malate dehydrogenase
MEPRKTHRLSKKLINRNNLSAKIEVAKEIRKMVQKLSLLLKKHAKLATSSVIELLVLSSSNLDARQSSLLNLVIHNEGRRRLAEASRFGDSTCPPPTLPKSPPNFPPLNPNSLEFHNFLCYALHILSNHLTPFVAPNAAATTDSIKRHLASTAIPPKPSPSPTSSPNSSENVDRVGNDEENSVGGVTNERQNGGAEEGEVPLEEVRVSGDRGISRGIDLGAGEEGGGVLEVEHLVGVGIERDKLVGEKMIKFVVAAKVEKKKR

SEQ ID NO: 191433 - protein, 472 aa, Glycine max
  Coding DNA Sequence Number=SeqID_74655
  Gene Ontology: Mol. function=nucleic acid binding; Cellular component= intracellular; Biological process=DNA integration
  Homolog annotation: Hit_ID=Q1S9T9; Match level="QueryCoverage=87%, HitCoverage=61%, E-value=3e-43, Identity=39%"; Hit description =Peptidase S8 and S53, subtilisin, kexin, sedolisin; Integrase, catalytic region; Zinc finger, CCHC-type
MGLTKFNIEKFSRSNDFGLWRIKMQVVLIHQGLGDALKGFEESSKGTNNCNNMVEAGISLHDKILDDLKNLEVKTRDEDKALILLNGLPRSYEHFKDDKLFGRDQTITLEEGHYKKDCPKMRGKDLKKSQEPRDVDIAQASNETIDVLVVSNSEIKKDWVMDSGCTFHVCQRYGFNSTKNVEWSRNTLDRCKGIKMNGLYILDGSTVIAQVVVGIQNQHDKTNLWHMRFGHGEAVTTTSNLINRCPFSALGFKAPMELWSGKPVDYSNLRVFRALAFAYIKQDKLGARAIRCAYIGYPPGIKGYKLWRMEPGEPKCIINISVIFDETKMAMQVKDQQQAINQGKNLDIIEVEVELPTQSVQVKGTDNDQKPEPVANDYNLARDRVRRNIVPLRREVLNNKESEEWITDMEEEILSLEKKNLDSTPLELVGLGSSSSMDSFASWKMNDNRMEKEEREETPLQGEDESRRSSPP

SEQ ID NO: 191434 - protein, 229 aa, Glycine max
  Coding DNA Sequence Number=SeqID_74656
MGSSPSPPAFDDNEELQDHFGNPGGGVKDMRVRVTLSQGVHKDKGMEKDVNVGDMAEDVGVERGRVVDDLKELIGTTYTDKMYILFGSSSLKNSIVKVQAIEKLTLRGITNGIKAYLTFIMVWFEDEPELHSEACLTWSNYGIVKCYPVKCHRVQAIEKLTMRRVTGGFELVVFSEGVGKNMVALEDEEEVFMSWRTVIKIFYMLQKSRYYVSDAGNVNWREEIEEGRW

SEQ ID NO: 191435 - protein, 147 aa, Glycine max
  Coding DNA Sequence Number=SeqID_74657
  Gene Ontology: Mol. function=transporter activity; Cellular component= integral to membrane; Biological process=auxin mediated signaling pathway
  Homolog annotation: Hit_ID=Q9LU77; Match level="QueryCoverage=99%, HitCoverage=22%, E-value=1e-54, Identity=71%"; Hit description=Auxin efflux carrier component 2
  Pfam annotation: Domain name=Mem_trans; Domain location=1-147; Score=- 82.9; E_value=0.00073; Accession=PF03547.8; Description=Membrane transport protein
  Subcellular localization annotation: CTP_CleavageSite=11; ConfidenceScore=5.02e-01
MPRASVMVRLTLSMVWRNLVRNPNTYASFFGLVWSLISFRWNIKMPSIINGSILILSQTATGIAMFSMGLFMALQPKIIACGKTSAAMSIVARCLVGPAVIGVTSIVIGIRGVLLRVAIVQAAIPQSIVAFVFAKEYNIHADILSTA

SEQ ID NO: 191436 - protein, 79 aa, Glycine max
  Coding DNA Sequence Number=SeqID_74658
  Gene Ontology: Cellular component=integral to membrane; Biological process=cell death
MVGGGATAERSLKETPIWAVVAVCSVFVIISVLIEHGIHSLGKICIPVSTGDIMLPCKKVEVSNSDDDSNDRRKLLFFF

SEQ ID NO: 191437 - protein, 735 aa, Glycine max
  Coding DNA Sequence Number=SeqID_74659
MARRSPPRVSQTYETGCTWRMLRIFNFREGNSDRRLVSNRRLNAHANGNGNSRSRSDVLSTFDEKYLQIGVSSRRRRDYSCKSISGIENEQVADWREEVTKMIVDPRFVNKNYQGKDGADCEPNQFLDALQILFSNKELFIKLLQDPNSLLVKQIHDLQSTQVKEPYQQARQKMMTKLKKPQDGNATQCVKPFKPFDRSDLRLSVKPQSSNRIVVLKPGTVNVETSFASPPHSPDSFRSHAQNIMPSYFPFSCIKRKLKHVMRVRRQEQQWRTDDEMSSKFSCSSQGLEDGQKVKQLEIAERNSPINAHPNAGKRLNSYLDLKKRDNIIKLEDSELCMGLETASFGESRSKNSYHTSVGHSEENIHVEGRKGPSQMLNCGSEECEQCTNSLGRSIPRPDSLYLPSMHRYCKHSSITERMRHYSNYQMVHRTRLGLPKEGENGSYNFLEPKIKDSPLAIVNMHTDKLQLFGEDIRIRNSVPGDSLFAHYDIPREPDGRYRDSPTRNIDMNDITGGSRSFLDLHPEIQTFPFSQDVISSRQRTDDYVNMGNKVEHTSAESVVQQFTKDDVTNPQITTFQQDESPIQVMQDKFEESHFEDLIRLSLDPMNNLTFSKDILHNVYQNCGFPPHVSTKNPNVQAYVVKKLLVKEITELVKLHFHPRPSPLTLEQLAEKDLARRGSWLNIQVVTEDIAIEVEKDVLEKMVLEIASEMDVRSMSTYYSWDDKALWKDYQATIF

SEQ ID NO: 191438 - protein, 572 aa, Glycine max
  Coding DNA Sequence Number=SeqID_74660
  Gene Ontology: Mol. function=nucleic acid binding; Cellular component= nucleus; Biological process=meristem development
  Homolog annotation: Hit_ID=Q6J732; Match level="QueryCoverage=98%, HitCoverage=61%, E-value=5e-92, Identity=39%"; Hit description=AML1
  Pfam annotation: Domain name=RRM_1; Domain location=251-317; Score =65.9; E_value=1.3e-16; Accession=PF00076.12; Description=RNA recognition motif. (a.k.a. RRM, R
  Pfam annotation: Domain name=RRM_1; Domain location=336-402; Score =40.6; E_value=5.2e-09; Accession=PF00076.12; Description=RNA recognition motif. (a.k.a. RRM, R
  Pfam module annotation: Pfam domain module=RRM_1::RRM_1; Domain location=251-317::336-402
MDQRGVSASSHFFDDISFRSERNVGLQKPKSINDHYPQGNNGMVASPGSILNATPPLDVNAKVGLLVPQASLPEDSIHSTESSNCRPKSLSDACLQSAPTSYGLIGNKIVTNAAPCESSLFSSSMSEIFSQKLRLFGNDVRSDHLINADSPPEEEPYKSLEEMEADTIGNLLPDEDDLFSGVVDELGCSSHARTNDDFEDFDLFSSGGGMEMEGDEHLSSGKRISALDGDFGFFGGYKGKLPFVEQPSRTLFVRNINSNVDDSELKALFEQYGDIRTIYTASKHRGFVMISYQDLRAAQNAMQELQNRPLRSRKLDIHYSIPKVNAPEKDIGHGTLMLSGLDSPVLDDELKQIFGFYGEIKEIYEYPEMNNHKFIEFYDVRAAEAALRALNKIDISGKQIKLEPGHPSLMHQSRKGQEERDLGQSIIDNLSSRQKATVPSGVIGSGCFENGYNQRFQSTVRQPLNAFMDNAFIHVNSGIHNTVRGAPAGKVSSVCESSSFIDAMNFASGSRFHPHSLPEYRDSLANGSPYNFSSSISNMANNIGAGATEASDGRHIQGMGSTGNLAEFNAGG

SEQ ID NO: 191439 - protein, 174 aa, Glycine max
  Coding DNA Sequence Number=SeqID_74661
MKIGWFESCVEWKVGSLVLEAFLEKGMVCVERELVDNLMESLHHVVVHRFERDRWAWLREQSGLYSVWKFFINKLAMLLMLPHMTEQHFWQHVLVGESGRVNDRWKYLWCANVGGFEADFNVSFIQWEIDFAACIRGSPSRSTGHRITKAHGFKRECGLGIENGSEAFMEDDWE

SEQ ID NO: 191440 - protein, 136 aa, Glycine max
  Coding DNA Sequence Number=SeqID_74662
MAIVVIAAMVVVTMTIMAVSGGDDGYDYCYDDDGGDGDNGGSGYDVDDDGSCYGGGDCYDDNGGSGYDADGVNNSDNGESGYDVDGGGNCYGDDDSSSDCYDDDGGDSDNDGSGYDIIGDVDNGDDYNDNDGGMRR

SEQ ID NO: 191441 - protein, 713 aa, Glycine max
  Coding DNA Sequence Number=SeqID_74663
  Gene Ontology: Mol. function=phospholipase C activity; Biological process=intracellular signaling cascade
  Homolog annotation: Hit_ID=Q53KW8; Match level="QueryCoverage=79%, HitCoverage=72%, E-value=4e-49, Identity=35%"; Hit description =Expressed protein
IVEQSSCGFVAADATAEDVKSSYLKRQEKSPCLDKVVLLLPPAYDSIRAIGASEHFKVGRFHEIDHSTLSPISPVQLKSVRIVMVSDIGEHLVSLRYPSLQSLRTHFSDQSFGKPDGKKIPALDEKYVMGMDMAIKALVRSIPTEEFAQRRNSWSFWVSSPSNENPQEYYENPPRIDAARSLICKQGSCWSQLKFTGMVQWGTRRQVRFLGRHEEQKVESLPKMCEGKRVRVEVREEGGSEKKRKKGEEEEMEGTKAGSLGVMMRVTRQCKKTHIQNVSSSSSGVKKFKKAKNDDSKNKKELVVYKDNKRKITINRWSAERFNLAEENILKVMKEKEAVYGNPILRPDLRTEARKYIGDTGLLDHLLKHMAGKLAPGGAERFRRRHNAEGAMEYWLESADLVDIRKKAGVQDPYWTPPPGWKLGDSISQDYVTQRELREVKDEILKLKQEMRYLASKKGEEEALAIVTTPSFWLSSLNSEDYGSLAPKQEIYAELVSKKAKLEEQLKEISLTLSGMEGQLKMLKPTTVEEQTVSEWETPPALLPGPITSEAENIGGETRKEKKINNNKETKSAEETQMQEDKEAKIKRLKSGFQICKSQGTFVWPNIGLSPQVVTTHDDDDHTVVPTPPSASSSTTSARKLTISTPQTQPLPLQSLTHPSSPVKPLAERRPVSTATLTHVTGQFSPSGSTPRSKITTPTITINLNETPLTLTP

SEQ ID NO: 191442 - protein, 71 aa, Glycine max
  Coding DNA Sequence Number=SeqID_74664
MNTIVWSPIFEGVMSLLNTDQISELNMEKISGIYHIDVKLIYLVFGRYMENEVILKDAQPDMGRVMAGTES

SEQ ID NO: 191443 - protein, 74 aa, Glycine max
  Coding DNA Sequence Number=SeqID_74665
  Homolog annotation: Hit_ID=Q1SMR9; Match level="QueryCoverage=78%, HitCoverage=20%, E-value=2e-07, Identity=49%"; Hit description =Pathogenesis-related transcriptional factor and ERF
MERDHFLWKKKRKRFRFILLGPSKTYRLWYRLLFKSLVAIQNTKIQQQRLSQVLLEMIQMNNHNHHNIKIGLKT

SEQ ID NO: 191444 - protein, 149 aa, Glycine max
  Coding DNA Sequence Number=SeqID_74666
  Gene Ontology: Mol. function=transcription factor activity; Cellular component=nucleus; Biological process=regulation of transcription, DNA-dependent
  Homolog annotation: Hit_ID=Q1SMR9; Match level="QueryCoverage=86%, HitCoverage=57%, E-value=1e-25, Identity=48%"; Hit description =Pathogenesis-related transcriptional factor and ERF
  Pfam annotation: Domain name=AP2; Domain location=3-67; Score=143.4; E_value=6.3e-40; Accession=PF00847.10; Description=AP2 domain
NVRRHYRGVRQRPWGKWASEIRDPKKAARVWLGTFETAEAAALAYDEAALRFKGTKAKLNFPERVHFSKEFGYLTNRPSLFHASATPLSDQHSQVFGGTATNNDAMPRLYGTDVVFLSAEQDLLPFSMQSSTSEPPRKPTCDLDGKDKL

SEQ ID NO: 191445 - protein, 88 aa, Glycine max
  Coding DNA Sequence Number=SeqID_74667
MRLLRLGVGLHVEHGLPLPGREEASRFSELELMLGERWPCNTVSLASDREICGSQHKFGILSLWDTRLKNKKKVEILSKNNIDILIKI

SEQ ID NO: 191446 - protein, 178 aa, Glycine max
  Coding DNA Sequence Number=SeqID_74668
  Gene Ontology: Mol. function=oxidoreductase activity; Cellular component=mitochondrion; Biological process=metabolic process
  Homolog annotation: Hit_ID=Q0VH86; Match level="QueryCoverage=99%, HitCoverage=75%, E-value=2e-38, Identity=81%"; Hit description=3 -ketoacyl-CoA reductase 3
  Subcellular localization annotation: CTP_CleavageSite=56; ConfidenceScore=5.07e-01
MWFLGWKGASGFSASSTAEQVTQGIDGTALTAIVTGATSGLGLETTRVLALRGVHVVMAVRSLDSGKNVKETILKEIPSAKIDVMELDLSSMASEGRIVILSSEAHRFAYREGIQFDKINDESGYSSYFAYGQSKLANILHANELARRLKEEGVEITVNSLHPGSIITNILRYHDYIN

SEQ ID NO: 191447 - protein, 73 aa, Glycine max
  Coding DNA Sequence Number=SeqID_74669
MAGTECCVSKENADFRTASETPNKNDIMDLGHGAYYPGMHLGVHDPSTAVVIHNQPNMTSHHEILSGLPGQPS

SEQ ID NO: 191448 - protein, 140 aa, Glycine max
  Coding DNA Sequence Number=SeqID_74670
  Gene Ontology: Mol. function=transporter activity; Cellular component= intracellular; Biological process=transport
  Homolog annotation: Hit_ID=O48940; Match level="QueryCoverage=63%, HitCoverage=34%, E-value=6e-45, Identity=98%"; Hit description =Polyphosphoinositide binding protein Ssh2p
  Pfam annotation: Domain name=CRAL_TRIO_N; Domain location=16-87; Score=18.3; E_value=0.00037; Accession=PF03765.5; Description =CRALTRIO, N-terminus
MDGITLTHDKNSTNAGLVPCSQNQSLLCLCKLQSIPTYSVALQIYCSQEEDDFMIRRFLRARDLDVEKASAMLLKYLKWRNSFVPNGSVSVSDVPNELAQDKVFMQGHDKIGRPILMVFGGRHFQNKDGLDEFKRMFNFK

SEQ ID NO: 191449 - protein, 165 aa, Glycine max
  Coding DNA Sequence Number=SeqID_74671
MHGMLSSVVQILLTSGIVQVARTMSNQSLMMQININHTIRINYISSRSINNIDNFKEETIMDNASSCPNTHIHEVYNDTRALPIHVLSMYVKYKIIIGTNHKCNNARSHLDHSRRLELILWRKCGFIKNGLVSVVAYLGKTCKDLNLSRNSPTSPFYRPIPISHH

SEQ ID NO: 191450 - protein, 75 aa, Glycine max
  Coding DNA Sequence Number=SeqID_74672
MATTKPPWSQYQGHPFVKNAMLERSILAAVPSEDPTAIINAVRSLAIGPAKHNLCLDSEVAGIYPHRSLRTGSGS

SEQ ID NO: 191451 - protein, 200 aa, Glycine max
  Coding DNA Sequence Number=SeqID_74673
  Gene Ontology: Mol. function=racemase and epimerase activity, acting on carbohydrates and derivatives; Cellular component=soluble fraction; Biological process=carbohydrate metabolic process
  Homolog annotation: Hit_ID=Q43070; Match level="QueryCoverage=99%, HitCoverage=56%, E-value=2e-99, Identity=87%"; Hit description=UDP -glucose 4-epimerase
MNPYGRTKLFLEEIARDIQKAEPEWKIILLRYFNPVGAHESGKLGEDPKGIPNNLMPYIQQVAVGRLTELNVYGHDYPTRDGSAATGQDIRGKCDTGQNGHIAALRKLFTTENIGCTAYNLGTGRGTSVLEMVAAFEKASGKKIPVKLCPRRPGDATEVYASTERAEKELGWKANYGVEEMCRDQWNWAKNNPWGYAGKP

SEQ ID NO: 191452 - protein, 113 aa, Glycine max
  Coding DNA Sequence Number=SeqID_74674
MDEDQWMYKGIIPEEVDMDENEEECGVNEPHVDCSDAFNTSQVFHSQEDVLRWARSIAYENGFVTVIVRSDTNTRVMSIGIGRNNAFEETLGPENVGVPSNFVASQWLEDKVG

SEQ ID NO: 191453 - protein, 91 aa, Glycine max
  Coding DNA Sequence Number=SeqID_74675
MGEVEEVQEKMKADMEAMKEQMATMMTMMSMRKIMEANAVAVAASSTVAKVNPMPPSGLNQMNHRTSTMIWEVGTAPMMCKIKTSTPSRHM

SEQ ID NO: 191454 - protein, 96 aa, Glycine max
  Coding DNA Sequence Number=SeqID_74676
MKEQINLLKKQQACCFKPEESSPSRLKESSTMKDNEIKDCMHLGQHLNITFKQSLDLQVVPHSQLLSVVLLLSMTTLHGGEEFMKAIGIGDEDLPI

SEQ ID NO: 191455 - protein, 303 aa, Glycine max
  Coding DNA Sequence Number=SeqID_74677
  Gene Ontology: Mol. function=helicase activity; Biological process =protein amino acid phosphorylation
  Homolog annotation: Hit_ID=Q9LTU4; Match level="QueryCoverage=99%, HitCoverage=22%, E-value=3e-79, Identity=48%"; Hit description =Helicase-like protein
  Pfam annotation: Domain name=DUF889; Domain location=85-303; Score =295.7; E_value=8.6e-86; Accession=PF05970.5; Description=Eukaryotic protein of unknown function (DUF889)
SSGIASILLPGGRTTHSKFAIPVPATKNSTCNIHQGSDLAELLHITKLIIWDEAPMCHRYSIEALDKSLQDIMHNSNPFGGKVIVFGGDFHQILPVVPRGNRSDIVYATLNSSYIWNHCQILKLTKNMRLQSNPTDHSNLDELKQFSEWLLDIGDGKLAEPNDGYGEITIPDEFLIKDFQDPIQEIVEATYPDLLHNYNNGDFLQKRVDLASTKDEKEHCSADSVDKSDELLNPAFGVLTVEFLNSLKTSGIPNHKLIIKVGTPIILLRNLDQADGLCNETRLIVTRLGSSVVEAKIITGSNI

SEQ ID NO: 191456 - protein, 192 aa, Glycine max
  Coding DNA Sequence Number=SeqID_74678
MVIPKFKVLEFDKYKGTTCPKNHLKMYYRKMGACAKDEELLIHSFQENLTGVAVTWYTNLKPSRVYSWKDLMVAFIRQYQYNSDVAPNRMQLQNMCKKGARIFQRIRPKMERLGNSNLVFASKKIEVGLKRGKFNHPAWTNEKTGANEEGKDEGETHVVTTIPVRPSFPPTQQCHYSTLLLTYCPFIHKGHS

SEQ ID NO: 191457 - protein, 146 aa, Glycine max
  Coding DNA Sequence Number=SeqID_74679
  Gene Ontology: Mol. function=calcium-dependent phospholipid binding; Cellular component=membrane; Biological process=transport
  Homolog annotation: Hit_ID=Q6H7E3; Match level="QueryCoverage=96%, HitCoverage=99%, E-value=3e-55, Identity=69%"; Hit description =Putative elicitor-responsive gene-3
  Pfam annotation: Domain name=C2; Domain location=6-87; Score=73.7; E _value=5.7e-19; Accession=PF00168.20; Description=C2 domain
MPQGSLEVFLVNAKGLDNTDYLCNMDPYVILICRTQEQKSSVATGHGSEPEWNENFVFNVSEGVSDLRLKIMDSDSTTAHDLVGEATIPLDALYIEGSIPPTSYNVVKDGHYCGEIKIGLTFTPQDRSERCLEENFGGWKESGYRD

SEQ ID NO: 191458 - protein, 123 aa, Glycine max
  Coding DNA Sequence Number=SeqID_74680
MIMRGQDIYSSQDEATTSPSSSESEEAKEEESSKEIYPQEEGQPLTVKEKCKEGVPTNPKRIKVIPEWPTPPSIRKIQGFHDLTNFYKSVEGRSPEFHEPQDLRSNPFQVGGNDAILSPKGIG

SEQ ID NO: 191459 - protein, 99 aa, Glycine max
  Coding DNA Sequence Number=SeqID_74681
  Gene Ontology: Mol. function=translation initiation factor activity; Biological process=regulation of transcription, DNA-dependent
  Homolog annotation: Hit_ID=Q8RU47; Match level="QueryCoverage=81%, HitCoverage=29%, E-value=2e-11, Identity=46%"; Hit description =Putative Transcription initiation factor IIE, beta subunit
  Subcellular localization annotation: CTP_CleavageSite=35; ConfidenceScore=5.01e-01
MALQEKLDKFKKQQEKCQTTLSSIAASKAAATQKSAAHGSANGRNAAPAVKFSNDTERLQHINSIRKAPVGAQMKRVIDLLLEVVPIPFSLIIYSHRFG

SEQ ID NO: 191460 - protein, 1015 aa, Glycine max
  Coding DNA Sequence Number=SeqID_74682
  Gene Ontology: Mol. function=DNA binding
  Homolog annotation: Hit_ID=Q9SLR5; Match level="QueryCoverage=34%, HitCoverage=95%, E-value=5e-16, Identity=23%"; Hit description=AHM2
  Pfam annotation: Domain name=MBD; Domain location=4-72; Score=23.4; E_ value=0.00014; Accession=PF01429.10; Description=Methyl-CpG binding domain
MVVVEKSTVEDLPPGWVKELKIRKNSKGIRKDPFYIDPASGYVFRSKKDVLRYLESGDIRSCAFRPSRRQIQDEDNLTPPPVAKRQKLKQSASEQQLSSATEILDKSSLELLDANSSRKWKNANVSSGTMVASVPMGESVVKMHSLEDGAANSSEVKKTSDPGSSALLNESLKESEEVLSADDVQEKEHVLNVMENANEKNHGNHSISKNRKEFNVPHRSSPRLAGSKPVQLANNLINERTLQVPKRNLRKSRNTLDVDISEDQTVSKDQPHQQEADKIEDNNKPEIQISPNKSSKKKEYHLPRRASKRLAAIEHETMNSKAKLQQSECGPVTVLADQAPINGKSANKRKKSAPQLEKRENEEMDDEKSESQLSFAFHYSWSDPSLEYAINTLTGVLPPAETDIPKTLVDNVTGKGATTVPEIDIPKTVVDNVTGKGATTVPEIDIPKTVVDNVMGKGATSVPETDIQKTLVDNVTVRNTATVPETDIQKTLVDNVTGRNATTFPETDTQKTLVDNFVGRSASTIPETDDKKTLADNDMGRSATTVPETDIQKTLLDNVTGSRDSENNLLDTVTGGSDRKSQVRSNKPQRKKEVKVPMRLSKRLAGLEPEVAPAERAIEYSTRKSCKEEPTATATLTNGVSDHHDAGEETKLTPQASDSLKTEVLGESLNQSGKSCDAQTGDKEQLQKVEAENIGDARSEPQLPLLFGDSWSDPCLEFAIKTLTGALPVDAGDIMPALPPGFDNPPYKQLHGSLATSINQEAHDNSNQSQNKKELNMVSQPVLRTSSTSYENAPKFTTRVSYLDQGNIIRNLNEEPRHTGNTTPPVHHSRNINSLTHEEPLKQNGQFVEGGFVTMGQQLFETGTVNHDNSESQYSAPFMNSWSDPCLEFAFKTLTGVIPVEENLTLQGCFQEPVNYHERRDGGSMLPDLGSSSFSQSDFSFLHDTGVKSMPGKQSSMSSSFLPLEKTSLQGFTGVDPQTHFSQCNNNFQRRKCCKRLKLTIAFEVAYSEKIIFFC

SEQ ID NO: 191461 - protein, 201 aa, Glycine max
  Coding DNA Sequence Number=SeqID_74683
  Homolog annotation: Hit_ID=Q2A962; Match level="QueryCoverage=15%, HitCoverage=15%, E-value=2e-09, Identity=83%"; Hit description=Zinc finger (C2H2 type) containing protein
  Pfam annotation: Domain name=zf-C2H2; Domain location=35-57; Score =21.6; E_value=0.0028; Accession=PF00096.16; Description=Zinc finger, C2H2 type
MEGNYLNRNSTTPQREDSFGFEEHSWGTPWPARNYACSFCKREFRSAQALGGHMNVHRRDRARLRSSLSSWVSECPKPNPNNNPTLLPPPSSSSPSPLPDEPLNYAHPSPLCSPCLTLSSSPSPASTSGDKKPRLTPSHQFPLLIPQSEIKMMSMNTRSDFIADEEMKGCVVEEEEHKGFKNNEQNITLELGIGVLKHQEE

SEQ ID NO: 191462 - protein, 456 aa, Glycine max
  Coding DNA Sequence Number=SeqID_74684
  Gene Ontology: Mol. function=motor activity; Cellular component =myosin complex; Biological process=protein amino acid phosphorylation
  Homolog annotation: Hit_ID=Q67VX5; Match level="QueryCoverage=99%, HitCoverage=32%, E-value=0.0, Identity=74%"; Hit description =Putative myosin heavy chain PCR43
  Pfam annotation: Domain name=Myosin_head; Domain location=1-454; Score=421.2; E_value=1.5e-123; Accession=PF00063.11; Description =Myosin head (motor domain)
MQSNPVLEAFGNAKTVRNDNSSRFGKFVEIQFNKYGRISGAAIRTYLLEKSRVCQISDPERNYHCFYLLCASPPEEKEKYKLGDPRSFHYLNQSNCYELIGVNSAQEYLSTKRAMDIVGISQEEQDAIFRVVAAILHLGNIKFAKSEETDSSVLEDEESKFHLQTTAELLMCDPNSLEGALRERVMITPEEIIKRSLDPLGATVSRDGLAKTLYSRLFDWLVQKINISIGQDPSSKCLIGVLDIYGFESFQMNSFEQFCINFTNEKLQQHFNQHVFKMEQEEYTKEGIDWSYLEFVDNQDVLDLIEKKPGGIIALLDEACMFPKSTHETFSQKLYQTFKDHKRFIKPKLTRSDFTVVHYAGEVQYQSEQFLDKNKDYVVPEHQDMLSASKCSFVSGLFPPISEETAKSAKFSSIGSRFKGVLEAVRIKCAGFPTHWTFHDFLTRLGILAPEVLRGK

SEQ ID NO: 191463 - protein, 75 aa, Glycine max
  Coding DNA Sequence Number=SeqID_74685
MDHLPRRRLSNQGEEELLRRPTRTIEEDEGYVAEEEPQTPTANRNGDRKKQHRRKRKRKKKRHRKRKKNEEALYG

SEQ ID NO: 191464 - protein, 245 aa, Glycine max
  Coding DNA Sequence Number=SeqID_74686
  Gene Ontology: Mol. function=motor activity; Cellular component =myosin complex; Biological process=signal transduction
  Homolog annotation: Hit_ID=Q67VX5; Match level="QueryCoverage=78%, HitCoverage=12%, E-value=7e-79, Identity=73%"; Hit description =Putative myosin heavy chain PCR43
  Pfam annotation: Domain name=Myosin_N; Domain location=12-53; Score =25.0; E_value=0.00026; Accession=PF02736.9; Description=Myosin N -terminal SH3-like domain
MIQGIPENIVVGSHVWVGDPELVWIDGQVLNINGEEAEIQTSNEKKVVSRLSKLYPKDMDAPTDGVDDMTKLAYLHEPGVLHNLETRYMMNEIYTYTGNILIAINPFQSLSHLYDTNVMQRYKGATIGDLDPHVFAIAESAYRAMINEEKSNSILVSGESGAGKTETTKMLMQYLAYLGGNTASEGRTVEKQVLEVRRLSNSDYGCYCFYMFCCELYQGILFKAICMLFLLAKFMANIYLTLLYH

SEQ ID NO: 191465 - protein, 70 aa, Glycine max
  Coding DNA Sequence Number=SeqID_74687
MKGTKEFCSSLSCANGGGCERGNVRSKALQNRHACGLALFPLLSEPHGLRGYQRYRLNTHMLWKYVKWVK

SEQ ID NO: 191466 - protein, 236 aa, Glycine max
  Coding DNA Sequence Number=SeqID_74688
  Gene Ontology: Mol. function=motor activity; Cellular component =myosin complex
  Homolog annotation: Hit_ID=Q9M2K0; Match level="QueryCoverage=81%, HitCoverage=12%, E-value=8e-11, Identity=30%"; Hit description =Myosin heavy chain MYA3
MKCQVLGTPVLNESPSMEESSNPVQEESSSPFQDDENIEAIRDSSSPLKDTEKIEVLTVEIKNLKEEKQRGDEYERKYVEAQGSSEELRKKLAETEKRVYQLQDSLNSPWYTKRKADRIKEGVRQPQNNCVWAAAGVLYKYGIHLMNISKASFMMISSMSSQVAELKTILSTSSRLSSTFRPIARVDIASSNSDTSSTDSDFTFPAPVSNTEPLSSPESNSFQLVVQDVTAGDGSG

SEQ ID NO: 191467 - protein, 54 aa, Glycine max
  Coding DNA Sequence Number=SeqID_74689
MLKGTWGNMQEVVPLEHKATLEGESALVDGRGSGNAIRVELEVDVVDTKSGINS

SEQ ID NO: 191468 - protein, 438 aa, Glycine max
  Coding DNA Sequence Number=SeqID_74690
  Homolog annotation: Hit_ID=Q6ZIG6; Match level="QueryCoverage=85%, HitCoverage=50%, E-value=2e-35, Identity=28%"; Hit description =Putative ZipA
  Subcellular localization annotation: CTP_CleavageSite=59; ConfidenceScore=5.85e-01
MAFSASIRPTSSHSQLFCSVRFNRRHHSSSRIGFSSNGGRRCRRLRNSVRSVLNDNRPSASVNDDYGAAESARVLFERLFTENRITGDEPDLRILESDLEAALAALKMKEDHLMEAERTVLLENSKLKLTKEELERQESEIEAARIRYEKLEEEMKETMVKLVSQAGEIEELKLRVRGRDSEIDAVKYALGLKEGEVEKIRVELEERSREAANFDSELREKGRILDEANEVMKKQEAELEELKRVVREKEEEIEVLLVQREVEREKLRVAEANLEKQAMDWMLAQEELKRLGEDAARHAEESSETLEDFRRVKKLLNDVRSELVSSQQALASSRSKMEEQERLLELQLSELGEQRASVMSYMENLKDAQIEVESERTKLRVAESRNRELERDLKMEKELISELEEELKKERTSLEQAVKEVALLQEELEKKTAESRET

SEQ ID NO: 191469 - protein, 147 aa, Glycine max
  Coding DNA Sequence Number=SeqID_74691
  Gene Ontology: Mol. function=transporter activity; Cellular component= integral to membrane; Biological process=transport
  Homolog annotation: Hit_ID=Q9I1Y5; Match level="QueryCoverage=87%, HitCoverage=15%, E-value=1e-23, Identity=43%"; Hit description=Usher CupA3
MEGDFINGMPLKKKPEALDGDKKYFLESVLPQSKVGLDLSSLRVDIAVPQSLLETRPDDYIPASEFEAGSSVLFSNYTVNQYESHSAYGSVLSSTYLGLNSGFNAGKWQFRQQGNFSRNRYGSRWNSSRLYVRRGLPALRSELSLGQ

SEQ ID NO: 191470 - protein, 52 aa, Glycine max
  Coding DNA Sequence Number=SeqID_74692
MAQPPPCESTLREMAAPDFTYESLCIQYSNEDIPYFLKTGLIHLLPKFHGLA

SEQ ID NO: 191471 - protein, 88 aa, Glycine max
  Coding DNA Sequence Number=SeqID_74693
MWTNRCNIIGIGDFTLPSPTYTISNDRGMIQGGPSSKRRAMVLDGLAHLEYKEEEDAKRQNRVETNHRNKGLMSYGSSQELNSRRPHP

SEQ ID NO: 191472 - protein, 130 aa, Glycine max
  Coding DNA Sequence Number=SeqID_74694
QNRGGACHPARPGEQGCFLQKQQPSGGRIWKAQLSKKLRKLTDCAKHLFSISVTLRNFHESHRYKGSQFLEEGVEAIPSKVILMMPKNQELSKFQRFKNQVSRIKIQHSRIMKIKIQDSRFKNQEKTQSR

SEQ ID NO: 191473 - protein, 78 aa, Glycine max
  Coding DNA Sequence Number=SeqID_74695
MLLKGSLSEPDWLSKANPLSEEARSLSERKTQKNVKLESSALSTQPTRPAKLLSLLALRASKPAKGPVTNSRSARHAR

SEQ ID NO: 191474 - protein, 119 aa, Glycine max
  Coding DNA Sequence Number=SeqID_74696
EAKGASGNRLPACVIDYTEGWVTVQPLVIDYQAYVIDYQRRKALRYPSYLHVMIVMTAQLIRDRVEMECLKGAWETLEGNTRCRFRGTIRFPTTSLVHPDEPARTLQRTVEWTTPWISL

SEQ ID NO: 191475 - protein, 73 aa, Glycine max
  Coding DNA Sequence Number=SeqID_74697
MEDAPVSFDSPARKRVVVVVDNVIETSALTLSDGPFMGDKHGNSLWPQVDHLGGELRCMTGWPQQILHGFLSE

SEQ ID NO: 191476 - protein, 86 aa, Glycine max
  Coding DNA Sequence Number=SeqID_74698
MKFLELKQGNMTVAEYAAKFKELTKGALSQPTLLRASEARLTGASSEGGKCVESPPALICGKRRKNQRKPVMKNILDLGVVFTFEE

SEQ ID NO: 191477 - protein, 95 aa, Glycine max
  Coding DNA Sequence Number=SeqID_74699
MSFHVGSIPIVEAEASSLLAVINLIIDLRLHNVVFEIDCKQVFDNLQSNKTMIFELGFILNACPYSTKARKNKFIAQPGRKPEILIPRGAKIKHK

SEQ ID NO: 191478 - protein, 98 aa, Glycine max
  Coding DNA Sequence Number=SeqID_74700
MDKVDIFVPHPLTNACLLIQLSLECGCKPLVCLLKQPALLSVDFQDRSIRDYSSCTLVGGQPFPCVQESSTTRDPRSLNPFSEIRRREEEVSRKKGRL

SEQ ID NO: 191479 - protein, 50 aa, Glycine max
  Coding DNA Sequence Number=SeqID_74701
DVPQWISAKDDLHKHDLHNVVAVTEAQATLTQGERRRTIWFKRKEKEEER

SEQ ID NO: 191480 - protein, 141 aa, Glycine max
  Coding DNA Sequence Number=SeqID_74702
MRGEVSSDHLGELVTSPLSFLGAQASLGEPGVSKDKDTNFILAILPSDRPLAETQAAKPMKRKNIRGIRRAQKAHGCAFQRRKDARSLHQRLFVENVRKNRTKPVKMKILSSGVVFTFEEGRQKWGFCSYVPPIEEEIRPT

SEQ ID NO: 191481 - protein, 58 aa, Glycine max
  Coding DNA Sequence Number=SeqID_74703
MRPRRFRIAFVTDSYIVLHSFFIRQPFVYQKGMDDLNMNVGLGSQLMLDPSWPLMENN

SEQ ID NO: 191482 - protein, 325 aa, Glycine max
  Coding DNA Sequence Number=SeqID_74704
  Gene Ontology: Mol. function=phosphatidate cytidylyltransferase activity; Cellular component=integral to membrane; Biological process=phospholipid biosynthetic process
  Homolog annotation: Hit_ID=Q7VYC5; Match level="QueryCoverage=79%, HitCoverage=91%, E-value=3e-83, Identity=61%"; Hit description =Phosphatidate cytidylyltransferase
MAGQQRAGILAAGAALEQGLEQVADDRQHSQQGGDRQGQPEAPARDQGVAIGAVPQTGQADPDHRAQYAGHRARHCLAGADPRRQFTLAERAAGKISGDVGHPDQRQQRHHEAGAMGHEHLRQHRPGREGGRHGKQRPGQAGRRRVGTAAHHRGGGAQQPYRGNQRRRVAQDPGGVGDAFASAREPGRRQCQHGREQQDRDTGGDQRRRRLRQRQAQPLPIGAGRGQREQRHEPPGIGTHHRRRQDGEQDDGGNDTLTQHVTVSSRKLEMRCSPPVRMNRSGSGAQDMDRCRASRSSSTSSGCVARAGSAASMARVACRMSQRPP

SEQ ID NO: 191483 - protein, 304 aa, Glycine max
  Coding DNA Sequence Number=SeqID_74705
  Homolog annotation: Hit_ID=Q47522; Match level="QueryCoverage=14%, HitCoverage=53%, E-value=9e-19, Identity=100%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDSLQYPKPPAQIRVRCSVTLCFSPKNRRFYTVYSRMRPPVFPYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 191484 - protein, 90 aa, Glycine max
  Coding DNA Sequence Number=SeqID_74706
  Subcellular localization annotation: CTP_CleavageSite=29; ConfidenceScore=5.36e-01
MWRKSKRCVFTQSQSGPLGSSKSFLQKAVASGGSNLARLGELGGKLLPYFAINRGRSEEEKGSAFLALLPLSKLLRKIVSVKKIQAVALP

SEQ ID NO: 191485 - protein, 48 aa, Glycine max
  Coding DNA Sequence Number=SeqID_74707
MAMEEAATATLSPPTGCHCDKVIRVWYAIREGLVVWYPSTTEMGLTSS

SEQ ID NO: 191486 - protein, 94 aa, Glycine max
  Coding DNA Sequence Number=SeqID_74708
MMLSYNLRQVQENKNPDPVNHPVHAHSGPVLVQMMDPEKEAGPTLAQVEWALRCQQKHPPVEAEAPGMHRPHPLPKEKVGLLARPPSKEILQRS

SEQ ID NO: 191487 - protein, 112 aa, Glycine max
  Coding DNA Sequence Number=SeqID_74709
MGLRVQRLRAERRFFTLRWRPCKSQGGNGDFVVDATAGTGVAIFNGVLQEAWTRQFDWRVEGFAVPRCRLFPTLQSATCNGQFLGAGCRQLQWRFGWTKSPARSAICLAWGF

SEQ ID NO: 191488 - protein, 77 aa, Glycine max
  Coding DNA Sequence Number=SeqID_74710
MVLHCSLRFNDYGILVVRQVDSSVGAGAMSGVGTTGGTSKGKSLIVKEKNGVVYKNATSAKTKYPEVKERSIGNPFG

SEQ ID NO: 191489 - protein, 92 aa, Glycine max
  Coding DNA Sequence Number=SeqID_74711
  Gene Ontology: Mol. function=1-acylglycerol-3-phosphate O -acyltransferase activity; Cellular component=integral to membrane; Biological process=phospholipid biosynthetic process
  Homolog annotation: Hit_ID=O80437; Match level="QueryCoverage=76%, HitCoverage=14%, E-value=1e-26, Identity=81%"; Hit description =Glycerol-3-phosphate acyltransferase 6
MNPMPTYEITFLNQLPAELTCKGGKSAIEVANYIQRVLAGTLGFECTNLTRKDKYVILAGTDGRHVVQLAKYQPRQKKVTETNNHSISKRHQ

SEQ ID NO: 191490 - protein, 82 aa, Glycine max
  Coding DNA Sequence Number=SeqID_74712
MLFGGGDFIATGVWVFLGVRVFCSFTGGEGNGGGGGTREKVEKCNGKRREKEKEKTTREWGEEQTPAGKEKEQVPHLRKEEE

SEQ ID NO: 191491 - protein, 109 aa, Glycine max
  Coding DNA Sequence Number=SeqID_74713
MVWRLQSSFFFLHSAAIKLQEAKDSIDEEDPRPTSSTWSYITGEMVLAFELVAAFALVASRILTSSWMRLLVPSTPMAPNRVKCERTSTTLRPSYPESSIVPIDSAPGF

SEQ ID NO: 191492 - protein, 127 aa, Glycine max
  Coding DNA Sequence Number=SeqID_74714
  Subcellular localization annotation: CTP_CleavageSite=70; ConfidenceScore=5.02e-01
MLRTTEKVCYTPDFNEKPIMFLKQTSVGGGGNKKRVTGTWTFRFPKDPKFSPVRFLQQLGAKVASAIRVVSMRRRSSRKVSSSSLVRTRSVSDPPDSHRAKAVEDCIEFLHSSSSRERPSSVSESSL

SEQ ID NO: 191493 - protein, 141 aa, Glycine max
  Coding DNA Sequence Number=SeqID_74715
  Gene Ontology: Mol. function=DNA binding
  Homolog annotation: Hit_ID=Q1RUD8; Match level="QueryCoverage=52%, HitCoverage=14%, E-value=3e-12, Identity=44%"; Hit description=IMP dehydrogenase/GMP reductase
MARVAKVVKISAKELDRAKQNRNGVVGIPRKRLEKKAKALADQGKWTSFIDVLALLVFGIVLFPNVDELVDLAAINVFLAYYHSKESPIVAVLADAYDTFDQRCEKSSARIVCCTPALYVWLVSHIFRHESRPVCPLQRLH

SEQ ID NO: 191494 - protein, 223 aa, Glycine max
  Coding DNA Sequence Number=SeqID_74716
MVTLRQKQEADLKALCEENDTIRAQLVEAVEHRSDDGTTNPNKYIKAYVMQENLFTDDNFILCRVFSSSSKGLALTWWHQLSPGLLIHSTYLSSVSVDNTPHVNHIRVVGVQRLYEQPHKYRSSNTRICLCIYAKYAHTFGCILCKKRPSSMDELRHHVAGFIQMEELLEFSDFMSNLTSIDLRTPEFAYAYMQSMPIPLVASFHQTIVGSSSTNQPNINDFV

SEQ ID NO: 191495 - protein, 68 aa, Glycine max
  Coding DNA Sequence Number=SeqID_74717
MPHQIYAHACNDFELGSPTRSMMSLPTLQKPVTGNLLCLFSLATVFEHSLRGGGISDRVVRLVVREWD

SEQ ID NO: 191496 - protein, 268 aa, Glycine max
  Coding DNA Sequence Number=SeqID_74718
  Gene Ontology: Mol. function=RNA-directed DNA polymerase activity; Cellular component=chromatin; Biological process=chromatin assembly or disassembly
  Homolog annotation: Hit_ID=Q1SAV4; Match level="QueryCoverage=43%, HitCoverage=30%, E-value=2e-18, Identity=39%"; Hit description =Integrase, catalytic region
  Subcellular localization annotation: CTP_CleavageSite=50; ConfidenceScore=5.05e-01
MSTPILHLPDFTHPFIVKTNASGTGMGAVLSQQGHPIAYFSKAFPPKLLYASTIALVTPTWSLMPCPDFQKVLLELKTRLAQDPEFSQFRQAIVDHPDEPSSWGKLLRWVEWSYNTSWHSSSSFSPYKITFGKKTFNYIQYLAGDSNIDVVDDMLIDREAVFAEVKKKMEKAQAHMRHFADTKHNNVQFMVGDLVLVKLKPHRQTSVSGLSPDDTSWEDWNILQTDYRLEDKVILEGMGNDSNTEKPEATKTRPQRKSRAPTYLKDFL

SEQ ID NO: 191497 - protein, 129 aa, Glycine max
  Coding DNA Sequence Number=SeqID_74719
MEQRKKLITAINDKNVLVTKKIDIINGLQQTIIDHERMVSAKATENEKLFKDVEGLNDKLNLENVLEFVLIKAVKQMHCQVGNSCSTNIEHPPIVTIIVARYRGKLDNEINQTLRFNGFSRFKLQLKFR

SEQ ID NO: 191498 - protein, 159 aa, Glycine max
  Coding DNA Sequence Number=SeqID_74720
MDCVDLEAMRKITIMGEVGLREKESGFFQTEKRAKGRPTLNVLGAIVFTPHLTMKFTLSHREIATIKANQQNACESYVKSCKIEPYIMVNKENYKALTTSVNTVSTEWKDLDLRANSEDRRPTPIEKFEPFQIRKESHQCTKISEKMEEGSGTSALKKC

SEQ ID NO: 191499 - protein, 236 aa, Glycine max
  Coding DNA Sequence Number=SeqID_74721
MSYSIFGGDESSVVCQKSMLDTKYFGIGEESESSSGSFVCLFHSDEETFQNLMKGTKVTSNVNVFVSDINAIPIESNEDEEKYVFDRIWDEPDIGGDNIVVGGGGFKSWADQLLSPKERQDAVIIMEFPRRMNIKKVLNLPYCGNVENTLEGKHYDKEVGKFCDKNDQPQVKVARIMEIGSTNFEKEKKKNKSPEKEKEIPKTINVEEPTIDGGNPPDVTQPRNMDKPITTLDEAA

SEQ ID NO: 191500 - protein, 126 aa, Glycine max
  Coding DNA Sequence Number=SeqID_74722
MNESSIKTGEAQEAMQSVRRMRFGPLLDGFNFGQHWFDPTRQDHMTQHRINPGFDFGFFGNASNGRVERGQGLSLGPTVYGGLWVGKAEEPGEFETGKQIGSKGIGLQEFHGQSSIVREDGVSIEQ

SEQ ID NO: 191501 - protein, 245 aa, Glycine max
  Coding DNA Sequence Number=SeqID_74723
  Homolog annotation: Hit_ID=Q1RV57; Match level="QueryCoverage=36%, HitCoverage=19%, E-value=3e-20, Identity=61%"; Hit description =ENSANGP00000004406, related
MTDKIKSCSLDSQLNRNATLDGNERCKLALHNLLDKMYDIEWDLIMIDMPKGSLMAAITCFMGLQYGHIIVHLQGHKHRVRLWFVFSFSLLLIGYILEILGMPLSKALYTLSYTCITARASGLVLTAIFYICYTHPQSLILLSSNGPNKNTLVYNESQAKRCRVRDANKGITSAYNKGSGIECMAFLCQIFSHSGLKLSRGNEIREVLAMISGRKIREHIDEFLSELDTEAYIYIRIHKCKGNYN

SEQ ID NO: 191502 - protein, 101 aa, Glycine max
  Coding DNA Sequence Number=SeqID_74724
MVSEQTLTLGPRIRLRCDKHPPFVVHAPSPIIPHRLPQSLECSLYICWATDDTNGNGDDDVDAYDDRNDSAITMVLMSVLVVSICGADASDNNYQKDHYQM

SEQ ID NO: 191503 - protein, 51 aa, Glycine max
  Coding DNA Sequence Number=SeqID_74725
MVDEVDEGIGDLGVAKVVIRVFTERQLMSGELGKGVLQSVRGELRAGGLRH

SEQ ID NO: 191504 - protein, 82 aa, Glycine max
  Coding DNA Sequence Number=SeqID_74726
MLISSKLLFLHRARDRDNSFPYLGLFGELMLTARTLQSVWGAHSCSQGLILIENTMAATSHFECVVPILVTTVVLADFLKVE

SEQ ID NO: 191505 - protein, 416 aa, Glycine max
  Coding DNA Sequence Number=SeqID_74727
  Gene Ontology: Mol. function=two-component sensor activity; Cellular component=membrane; Biological process=two-component signal transduction system (phosphorelay)
  Homolog annotation: Hit_ID=Q3JEJ0; Match level="QueryCoverage=92%, HitCoverage=65%, E-value=1e-75, Identity=40%"; Hit description=PAS sensor diguanylate cyclase and phophodiesterase
ALHAKPGQRTGNLGGLHPLGHHFHLQLAPELADRANCGVADWISIHVPHEGAVDLQDVRRQLAQIAERRQAGAEVIQCHPAAPRLDRIDESTGLGEVADRRSLGDLEAQLGGQRAVALEQVADEGEEAGLGDRLRRDVDVAQAQLAHVCRAHLQVAEQQPEHVTIQRHRHAIALHCRHELSGQVQAAVGTAHAHQHFVVQVGRIAHAGDALRIQQHAVLGHRQADALQPLGFPAALLQRHAVLIETVHPVATGLLGGIAGAVGSTHEPVRIGGVGADFNHTDAAAQLRAALADRERGLAQVADHPLQHPLGLVLPGMGEEHGELVGAQAADPVTVTHCSHQIVGETAQHLVTGGVAEAVVDQLEVVQVDVAQRMRAAVAAHLQQRTFQQPLDLAPVDQAGQRIVAGVVFDLARQGM

SEQ ID NO: 191506 - protein, 337 aa, Glycine max
  Coding DNA Sequence Number=SeqID_74728
  Pfam annotation: Domain name=Zim; Domain location=277-312; Score =23.2; E_value=0.00092; Accession=PF06200.4; Description=ZIM motif
  Subcellular localization annotation: CTP_CleavageSite=26; ConfidenceScore=5.19e-01
MAQPHNGNTNNTSNQQLVLHDFLGMRPAADSPKTADVRLPEPSASASSTGGRGPFSATSDIASEKQVGNHLEGVPFYGPRSDFSGTEISNRLVGSKRSNSDSTFMGSSRDAFQLVPDSFQNSHLMKVLRNAAGGERPRRPNDDAVLLGMQSMKPSSSQIFQPPTSTKIDANKWERSILMNVGPSMQHPPRGVQLAPFVHQMASSKIRDTNAGPSFISQSAADEGSRTGIKGPGILSSAAATATEKSIPSAVMLGGSRPKPGTNVVESSTHPSSQHGLTSASRQMTIFYGGQAHVFDDVHPHKVWPLLVSMTYLFIAFSEITTTTTTTTTTMTIALSH

SEQ ID NO: 191507 - protein, 137 aa, Glycine max
  Coding DNA Sequence Number=SeqID_74729
  Gene Ontology: Mol. function=serine carboxypeptidase activity; Biological process=proteolysis
  Homolog annotation: Hit_ID=Q1EP77; Match level="QueryCoverage=48%, HitCoverage=13%, E-value=1e-17, Identity=71%"; Hit description =Serine carboxypeptidase (Carboxypeptidase D), putative
MALCSVFLNLHLLLFVCLTIEALGVAKPSVASYLSQEILAEQEADRVHGLLAQPPVKFNNMLVISLSMKHKEEHCSIGFSRPLTNQNKNPFSYGSMEAVAGLTQPNNPKPIADSIFSKAKLEDSLDSQFKPPEASQQ

SEQ ID NO: 191508 - protein, 167 aa, Glycine max
  Coding DNA Sequence Number=SeqID_74730
  Gene Ontology: Mol. function=protein tyrosine phosphatase activity; Cellular component=cytosol; Biological process=protein amino acid dephosphorylation
  Homolog annotation: Hit_ID=Q1RZ57; Match level="QueryCoverage=93%, HitCoverage=86%, E-value=4e-72, Identity=82%"; Hit description=Low molecular weight phosphotyrosine protein phosphatase
  Pfam annotation: Domain name=LMWPc; Domain location=14-165; Score =139.2; E_value=1.1e-38; Accession=PF01451.11; Description=Low molecular weight phosphotyrosine protein phosphatase
MASPSVTDTETKPFSVLFVCLGNICRSPAAEGVFTDLVNESGLNSKFKIDSAGTINYHEGNEADPRMRAASKRRGILITSISRPIKPSDFVDFDLILAMDKQNKEDILEAFNRWKGRHSLPDDSHKKVKLMCSYCKKHDESEVPDPYYGGHQGFEKVELRAETIPIA

SEQ ID NO: 191509 - protein, 396 aa, Glycine max
  Coding DNA Sequence Number=SeqID_74731
  Gene Ontology: Mol. function=histone deacetylase activity; Cellular component=nucleus; Biological process=histone deacetylation
  Homolog annotation: Hit_ID=Q8W508; Match level="QueryCoverage=90%, HitCoverage=67%, E-value=1e-129, Identity=84%"; Hit description =Histone deacetylase
  Pfam annotation: Domain name=Hist_deacetyl; Domain location=1-251; Score=364.8; E_value=1.4e-106; Accession=PF00850.10; Description =Histone deacetylase family
MFMANKLLRWGGRVALGISVEDNNLGEDCPVFDNLFEFCQIYAGGTIDAARRLNNQLCDIAINWAGGLHHAKKCEASGFCYINDLVLGILELLKYHARVLYIDIDVHHGDGVEEAFYFTDRVMTVSFHKYGDLFFPGTGDAKEIGEREGKFYAINVPLKDGIDDSSFTRLFKTIISKVLETYQPGAIVLQCGADSLAGDRLGCFNLSIDGHAECVSFVKRFNLPLLVTGGGGYTKENVARCWTVETGVLLDTELPNGMMEKTVIPKFSFGSIREVAIHYASCLAIFARKMIYPPNAFYLSFKLVLEVYVQIENSGNFLTCLFCLAEIPENDYIKYFAPEFSLKIPNGQIENLNSKSYLSTIKMQVLENLRCIQHAPSVQMQELVWITPCGSTMLFL

SEQ ID NO: 191510 - protein, 61 aa, Glycine max
  Coding DNA Sequence Number=SeqID_74732
MAKGVVGFRFLRVNNFAVYEEEEESFGFAVGFILILTHTTLSSNLTSEEQHYMLHPQPILV

SEQ ID NO: 191511 - protein, 220 aa, Glycine max
  Coding DNA Sequence Number=SeqID_74733
  Gene Ontology: Mol. function=protein binding; Cellular component =cytoplasm
  Homolog annotation: Hit_ID=Q9SJR4; Match level="QueryCoverage=70%, HitCoverage=80%, E-value=4e-51, Identity=66%"; Hit description =Expressed protein
  Pfam annotation: Domain name=DUF662; Domain location=57-219; Score =317.4; E_value=2.5e-92; Accession=PF04949.3; Description=Family of unknown function (DUF662)
MAASPVYKHPQEKESHHSKKKITRRKRTEKTGQGEEKSAVDFGAIMATPKQSYEQQQQQQPNVQRVRNSGMINSNQSPMRDDKEEEMSRSALAMFRAKEEEIERRKMEVRDKVHAYLGRVEEETKRLAEIREELEGLTDPLRKEVAIVRKKIDSVNKELKPLGQTCQRKEREYKEALEVFNEKNKEKAQLVTKLMELVTESEKLRMKKLEELSKNLDTLH

SEQ ID NO: 191512 - protein, 88 aa, Glycine max
  Coding DNA Sequence Number=SeqID_74734
  Homolog annotation: Hit_ID=Q2R441; Match level="QueryCoverage=93%, HitCoverage=32%, E-value=5e-12, Identity=51%"; Hit description =Uncharacterized plant-specific domain TIGR01627 family protein, expressed
  Subcellular localization annotation: CTP_CleavageSite=27; ConfidenceScore=5.34e-01
MGYVKQRGFSPRNAPNLRVLPRRHTCEATKPASWRRRIFPTSFTRQSGTPKGYLAEVPGRMAAVFSAAVMARNRKGSSVMHMFLHDVD

SEQ ID NO: 191513 - protein, 502 aa, Glycine max
  Coding DNA Sequence Number=SeqID_74735
  Gene Ontology: Mol. function=tRNA isopentenyltransferase activity; Cellular component=intracellular; Biological process=tRNA processing
  Homolog annotation: Hit_ID=Q1RZ48; Match level="QueryCoverage=97%, HitCoverage=97%, E-value=0.0, Identity=72%"; Hit description=TRNA isopentenyltransferase
  Pfam annotation: Domain name=IPPT; Domain location=56-334; Score =68.8; E_value=1.7e-17; Accession=PF01715.8; Description=IPP transferase
MAATESTVTSNPSNRERPKPKPKLLVITGPTASGKSKLAVDLASHFPVELINADSMQVYRGLDVLTNKLPLSHQNGTTLIFPHPNNLFPFLKSRFESVAGVPHHLLGTVSPNVEFTAKAFRDSAIPIIDDILARNHLPVIVGGTNYYIQALVSPFLLDDSAEDMDESCLGDPTGSGNNFIGENDCSNNSYDLLKDIDPVAANRIHPNNHRKINQYINLYNRTGVLPSNIFQGKAAEKWGQVDNLRYDCCFICVDASLPVLDRYVEQRVDCMMHEGLLNEVYDIYNLNAVYTRGLRQAIGVREFEPLLRTCVVKDMHERERELTEGSSIEKGETLFNHNLMELVRSSSNTESTILLEEAIEKVKLNTRRLIRRQKRMLSRLQTLFGWNIHYVDSTESISSKSEDVWTRQVVESAVKIVKSFLSENGTIFGTSNDTGMKIIQRDLWTQYICKACGDRVLRGFHEWEQHRQGRGHRKRISRLKRKAQVPGFVEEVKYSASEQLDI

SEQ ID NO: 191514 - protein, 254 aa, Glycine max
  Coding DNA Sequence Number=SeqID_74736
MSLHSSSSVNGEGSTPKDPLYKILDELRSLKLWKEKQERKEKGRHRSHLRPHSHRRENERKPQEVNIKLPYFHGKDNVEANIDWEIRVEQQLKRKSTSKSYGSHSYQKKDQGQGILGVRPSKPKDDKGKTIEKHPLKAKDTFTSQCPTTKTMIMRGQDIYSSQDEATTSPSSSESEKAKGEESSEEIYPQEEGQPLVVKEKCKEALASIATPLGLEFIPQVKKLLDEGLVRKSLNPCALLVPKIGIINMKIQKK

SEQ ID NO: 191515 - protein, 92 aa, Glycine max
  Coding DNA Sequence Number=SeqID_74737
MLEFTSNCPPKILASLHQLDFAPYVSGSYNAQWNAPELPYNKHMSRWGCIIWEIEVKGVFAGIMATIALFSRYGNVRQASFVAYLGVAFVDD

SEQ ID NO: 191516 - protein, 49 aa, Glycine max
  Coding DNA Sequence Number=SeqID_74738
MKLFGGPGESEASLGDLGSRKTKEKTLLSPFFCVQHRKSTSKDQKINER

SEQ ID NO: 191517 - protein, 69 aa, Glycine max
  Coding DNA Sequence Number=SeqID_74739
PSSPTTTISCPLRLVPFEAAADKDPWLLLVVFIVVYIVLGVYVGLVDEADLRAVSERLSGTACCHPSSV

SEQ ID NO: 191518 - protein, 99 aa, Glycine max
  Coding DNA Sequence Number=SeqID_74740
  Subcellular localization annotation: CTP_CleavageSite=65; ConfidenceScore=5.62e-01
AVHASSTFESGAPRSYCVALPAKLLRSAVRQFSILHFFRSPMNLLPSAVHVSSTFESGAPRSYCVALKKEGVEMRVVITERAGRTKSVSYLCFPLISDE

SEQ ID NO: 191519 - protein, 52 aa, Glycine max
  Coding DNA Sequence Number=SeqID_74741
MGAYAKDEKLLIHFFQESLTGVAVTCGVRTVKLCGFGLRQGKGGSGSGKRQI

SEQ ID NO: 191520 - protein, 88 aa, Glycine max
  Coding DNA Sequence Number=SeqID_74742
MTLISFERSGYSKLDARENKRSENRRKKKDIKIMTLSPMKNKGEDVESYGNIKARMWSPMKDKGKDIESYGSIKARMLSPMKDKDKGL

SEQ ID NO: 191521 - protein, 111 aa, Glycine max
  Coding DNA Sequence Number=SeqID_74743
  Gene Ontology: Mol. function=transition metal ion binding
MQSGSQCKSFDVEIGDRLEDMIRDLGHESFQPAHVPMYNTLQTHSKKPLYLGCKNSLTLLSTVLSLVNVKAIYGWSDTSFSSQLQVVNDMLPEANTLPKSYYQAKKILCPM

SEQ ID NO: 191522 - protein, 77 aa, Glycine max
  Coding DNA Sequence Number=SeqID_74744
  Homolog annotation: Hit_ID=Q5VR06; Match level="QueryCoverage=80%, HitCoverage=6%, E-value=8e-08, Identity=38%"; Hit description =Helicase-like protein
MPYPEGGNPASCLENSLILSELNYNNDEARLEFENLFLSMTGTGKTYIWRTLASSLRAKNPIVIMVASSGTASLLLP

SEQ ID NO: 191523 - protein, 146 aa, Glycine max
  Coding DNA Sequence Number=SeqID_74745
  Homolog annotation: Hit_ID=Q6CQF2; Match level="QueryCoverage=25%, HitCoverage=45%, E-value=3e-09, Identity=75%"; Hit description =Kluyveromyces lactis strain NRRL Y-1140 chromosome D of strain NRRL Y- 1140 of Kluyveromyces lactis
MVAQARAVDMLVETSSSRLWMAARALGVPRHLRAPGVGLWAPHSARLETRTKESDMCASQRASKPHTCRDPKDGELCLSGAKPEETLVEARSDTDVQIVRLTWNWRCGMNRKLGYGAQLRANLDPTKGVGRLRQQDGGHGSRNPLR

SEQ ID NO: 191524 - protein, 98 aa, Glycine max
  Coding DNA Sequence Number=SeqID_74746
  Gene Ontology: Mol. function=structural constituent of ribosome; Cellular component=ribonucleoprotein complex; Biological process =translation
  Homolog annotation: Hit_ID=Q2PMP7; Match level="QueryCoverage=92%, HitCoverage=42%, E-value=2e-38, Identity=88%"; Hit description =Chloroplast 30S ribosomal protein S3
  Pfam annotation: Domain name=Ribosomal_S3_C; Domain location=11-95; Score=144.0; E_value=3.9e-40; Accession=PF00189.10; Description =Ribosomal protein S3, C-terminal domain
MGFPKFLIEEFIAGQLKNRVSFRKAMKKAIELTEQGGYKREFKYKFAGRIDGKEIARVEWIREGRVPLQTIRAKIDYCCYTVRTIYGVLGIKVWIFSK

SEQ ID NO: 191525 - protein, 230 aa, Glycine max
  Coding DNA Sequence Number=SeqID_74747
MHKALRAKAPLPYPHLITLFLRHFQILLDDEPFVQVKRSFAIGAGAVTSFGYRKDRNGQWLKKDALPPQDERTPSPPPQREDSALMNEVLSELWGLRSYVGDRFDSLDSCFAGMDIRLTQLEEDVRYIRQSFDLPPPPPSSKILVSDYKSLISRVFWLVLYCHHQKGGDCRCKCLWCFDDDHDDMMQLMQMGFSRLNSRQCFKITSHNIKMITSKLGREFLIELAKGLAK

SEQ ID NO: 191526 - protein, 473 aa, Glycine max
  Coding DNA Sequence Number=SeqID_74748
  Gene Ontology: Mol. function=nucleoside-triphosphatase activity; Cellular component=chloroplast; Biological process=macromolecule biosynthetic process
  Homolog annotation: Hit_ID=Q2PMM5; Match level="QueryCoverage=100%, HitCoverage=20%, E-value=0.0, Identity=88%"; Hit description=Protein ycf2
MHGSDILWRMRQIPLCLPQWNLISEIWNLISEIPGNCLHNLLLSEEIIHRNNELLLISTHLRSLNVQEFFYSILFLLLVAGYLVRTHLLFVSRVYSELQTEFEKVKSLMIPSYMIELRKLLDRYPTSELNSFWLKNLFLVALEQLGDSLEEIRSFAFGGNMLWGGGPTYGVKSIRSKKKYLNLIDLISIIPNPINRIAFSRNTRHLSHPSKTIYSLIRKIKNVNGDWIDDKIESWVLNSNSIDDKEREFLVQFSTLTTEKRIDQILLSLTHSHHLSKNNSGYQMIEQPGAIYLRYLVDIHKKYLMIYEFNTSCLAERRIFLANYQTITYSQTLRGANSFHFPSHGKPFSLRLALPPPSRGILVIGSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLD

SEQ ID NO: 191527 - protein, 127 aa, Glycine max
  Coding DNA Sequence Number=SeqID_74749
MARRDQVWSFCTHDTRRYLTVICTPLLGRHSCVRWHAETKFGHSAHMIRGDPYGYLHPFARQTQLCPMARRDQVWSFCTHDTRRYLTVICTPLLGRHSCVRWHAETKFGHSAHMIRGDTLRLSAPLC

SEQ ID NO: 191528 - protein, 151 aa, Glycine max
  Coding DNA Sequence Number=SeqID_74750
MEAFKSDFTSKWALAADQDGVDDTDVRKKAQAIQKQNTAPHVLSRGGYEYLEQNLLVEKTKKKLEEAAQSGSVDGVIDPLSLVRCHMKWKMARTKKTGEMTTKAAKEIVEKIDSFKEQASQGSFVPHGRQDVLTAAIGCPEHPGRVRAAGA

SEQ ID NO: 191529 - protein, 69 aa, Glycine max
  Coding DNA Sequence Number=SeqID_74751
MDKSLKVGEDEWRERKRRSTKFCASNELWFNSLIQDQVQDSPPSVFRCHETCKTRRTCTKCDYMSGNGV

SEQ ID NO: 191530 - protein, 194 aa, Glycine max
  Coding DNA Sequence Number=SeqID_74752
  Homolog annotation: Hit_ID=Q1RWU1; Match level="QueryCoverage=78%, HitCoverage=39%, E-value=2e-09, Identity=34%"; Hit description =Resistance-like protein HAAS-2-related
DLAKAGGFAWGAVALVHMYEHLNDASQASTRAGYTSTFLQCIHPSFMMLMMRRAHGPAGGLRGVKGFDLISSYTGQLRWGQIVVYIRPEQVLRQFGYLQTVPLPPVCDSLTGDDIDDRWLHFSDHLVPSGELCVVPGQVAPDYMEWFFRILHPFVMWTEETATPRHPPPPHHEEFVEPPIPEVSVATDLPTHLV

SEQ ID NO: 191531 - protein, 159 aa, Glycine max
  Coding DNA Sequence Number=SeqID_74753
MTRSKTKQSMDTLQQMTYQGYPCGVYPDLSSFTGSGVIQISIACIKRSAPSQDHITPPRERTLREMAALDFTYESLCIQYPDQDVPYVLKTGLIHLLPKFRGLANEDPHKHLKEFHIVCSTMKPPDVQEDHIFLKAFPHSLEGVVKDWLYYLAPKSISS

SEQ ID NO: 191532 - protein, 105 aa, Glycine max
  Coding DNA Sequence Number=SeqID_74754
MAEQAKQVFYVQDPYDERWSVVLHGKTIGVNVEDDDSIVDTCLSPFSTQMSPNVNREEEIDDVHANRTWLHHPTLLLLFLSQQHICCLRRRRQEKQHSLDHWLLD

SEQ ID NO: 191533 - protein, 72 aa, Glycine max
  Coding DNA Sequence Number=SeqID_74755
  Subcellular localization annotation: CTP_CleavageSite=38; ConfidenceScore=5.37e-01
MPISPCGSISWSVPSRHRDHTHKTPSGPGKVQQGPGVSSSGYGPLSVLQGARTPPARSRHHRDRACKTPSGR

SEQ ID NO: 191534 - protein, 118 aa, Glycine max
  Coding DNA Sequence Number=SeqID_74756
MGEVEEIQEKMKANMEAIKEKMATMMEAMMSVKKIMEANAVAIAATSVVAKYGRQKNLGSRAAPIMYKFKNEHAFPPYGLPLNYTPPKVAYTPNKNVNNSTPIPIESQQPQTDHAHVS

SEQ ID NO: 191535 - protein, 86 aa, Glycine max
  Coding DNA Sequence Number=SeqID_74757
  Subcellular localization annotation: CTP_CleavageSite=36; ConfidenceScore=5.53e-01
MRVHCNQASRRPSMITDSPPLLMFPRTRSPVESPTVATYPSAGGRRVTRGMRVPRKEYARSRHQRLFEENVGKTGKDAIYELFSEK

SEQ ID NO: 191536 - protein, 113 aa, Glycine max
  Coding DNA Sequence Number=SeqID_74758
GRPGARLADGRVGATGPACRPGITDGAARSSGEAGASTDGVAGWGRRIGSLQAARITSSYSGGMAAILAHAPLVPARGARQGIGRQTPAAKEIRGPDIMIAPRQHPLNQASTP

SEQ ID NO: 191537 - protein, 127 aa, Glycine max
  Coding DNA Sequence Number=SeqID_74759
  Gene Ontology: Mol. function=hydrolase activity; Biological process =aromatic compound metabolic process
  Homolog annotation: Hit_ID=Q0BSY9; Match level="QueryCoverage=89%, HitCoverage=92%, E-value=6e-16, Identity=40%"; Hit description =Hypothetical cytosolic protein
MARSALACRQSRRQRRHVLQQPEHAAAVGLVGEVAQRLAGGQVRRDIAYHRAMQAVVDELLDQLAGDARFQPEEIGMHARGGQRQPLGLVFPGGADQVIGVLAGGQGRAGLAVLQNALAADVDEPGG

SEQ ID NO: 191538 - protein, 71 aa, Glycine max
  Coding DNA Sequence Number=SeqID_74760
MNQTYTEMRGILRSTEQTSILKVVRLYRRPFFVEFVGHHGQVNYNLSNAKPIKCECLVVLSSWYSTIILSR

SEQ ID NO: 191539 - protein, 109 aa, Glycine max
  Coding DNA Sequence Number=SeqID_74761
MTTSSMQKSHRSFFRSRLGRRTLIARHKEIQRLIEDRNQLPSEMLKKARQNRKRLFGERKRFSDEARKRRFSCPYFFQFIDAAQRPYNVCLARDYRGGWMRRCNAMAVV

SEQ ID NO: 191540 - protein, 154 aa, Glycine max
  Coding DNA Sequence Number=SeqID_74762
MERRGEEQPGNRPAPRITQGKKRCWIGSGSFSNSIGVETRLLTCESQIGFARYIRSDAFKINSLYFFFFSFFFPFFDTSSPPPSFLQLGDLEGVPHDVVLRRGRWPRHELAALRGLIAMKHGDSSPLSCSVSDTRPCSVRHQHDTHIMFYSLDL

SEQ ID NO: 191541 - protein, 189 aa, Glycine max
  Coding DNA Sequence Number=SeqID_74763
  Gene Ontology: Mol. function=manganese ion binding; Cellular component=integral to membrane; Biological process=acetyl-CoA catabolic process
  Homolog annotation: Hit_ID=P0A2K9; Match level="QueryCoverage=97%, HitCoverage=96%, E-value=2e-59, Identity=64%"; Hit description =Hypothetical nudix hydrolase yeaB
  Pfam annotation: Domain name=NUDIX; Domain location=28-155; Score =75.3; E_value=1.9e-19; Accession=PF00293.18; Description=NUDIX domain
MELTLAQFLSRFVLQPPLATAHSVISGRRAAVLVPVIDGDQPELLLTRRSALLRKHAGQVAFPGGMMDATDDSLIATALREAQEEVGIAPQQVRVVGVLPPVTSSTGFAVTPVVGIIPPHLPLRLNPDEVESAFSMPLAEALRLGRYSGLTLRRGHRQHQVWLSWYEDYFIWGMTAGILRALGQQIALP

SEQ ID NO: 191542 - protein, 139 aa, Glycine max
  Coding DNA Sequence Number=SeqID_74764
  Gene Ontology: Mol. function=2 iron, 2 sulfur cluster binding; Biological process=abscisic acid biosynthetic process
  Homolog annotation: Hit_ID=Q7G9P4; Match level="QueryCoverage=87%, HitCoverage=9%, E-value=7e-38, Identity=60%"; Hit description =Abscisic-aldehyde oxidase
  Pfam annotation: Domain name=Ald_Xan_dh_C; Domain location=1-109; Score=106.0; E_value=1.1e-28; Accession=PF01315.12; Description =Aldehyde oxidase and xanthine dehydrogenase, ab hammerhead domain
EVVFVDDIPSPSNCLHGAYIYSAKPLARVRSIKLTPELQLDGLRDIISIKDIPNGGENIGSKTIFGVEPLFAEEIARCVGERLAFVVADTQKLADMAANSAVVDYDTKNLEPPILSVEDAVERSSFFEVSSFFFIQTCW

SEQ ID NO: 191543 - protein, 111 aa, Glycine max
  Coding DNA Sequence Number=SeqID_74765
MEKSDKMNFKEKKEKKGYITWEDNVINYSSDSEKKIISLDIMMKDYENGEEQSRYIDSNFSKHMACIKQTKATFLPKKSEYVIYGDNKHRPLDQQPQQVISNDTNRSLVFD

SEQ ID NO: 191544 - protein, 243 aa, Glycine max
  Coding DNA Sequence Number=SeqID_74766
  Gene Ontology: Mol. function=sequence-specific DNA binding; Cellular component=intracellular; Biological process=regulation of transcription, DNA-dependent
  Homolog annotation: Hit_ID=Q3Q8T0; Match level="QueryCoverage=99%, HitCoverage=72%, E-value=6e-82, Identity=62%"; Hit description=Helix- turn-helix, AraC type:ThiJ/PfpI
  Pfam annotation: Domain name=DJ-1_PfpI; Domain location=42-179; Score= 29.6; E_value=7.3e-06; Accession=PF01965.14; Description=DJ-1PfpI family
METDMTLKIGIVVFNGIIPFHLSVPYAVFEKALTPQGEPLCQLVVCATTPGVLKTNAGFSIVVERGLDALAGMDMVIVPSWDVPEHAPEPELLQALQNAHAAGARIVGLCMGAFVVAAAGLMKNRPVTTHWRWAADFQRLYPCAQMNNDVLYIDDGDVVTSAGTAASIDCCLHLVRQAWGAEVANSVARLLVVPPHRQGGQRQYVELPVQNTRRGIISPTRWPGQRRTLRSPSRWTAWRKRPV

SEQ ID NO: 191545 - protein, 98 aa, Glycine max
  Coding DNA Sequence Number=SeqID_74767
  Gene Ontology: Mol. function=transferase activity, transferring glycosyl groups; Cellular component=cytoplasm; Biological process =lysine biosynthetic process via diaminopimelate
  Homolog annotation: Hit_ID=Q8PAU3; Match level="QueryCoverage=97%, HitCoverage=24%, E-value=2e-36, Identity=79%"; Hit description=2,3,4, 5-tetrahydropyridine-2-carboxylate N-succin
MPAAQQVVDAGLAAGLGINLLDDHRAVQRMGTVLARQRAGHHHAVRRDVAVGDFAGGTVVDAGALAEEHAHADHAVVTDHHAFHHLRTGTDEAVVLDD

SEQ ID NO: 191546 - protein, 278 aa, Glycine max
  Coding DNA Sequence Number=SeqID_74768
  Homolog annotation: Hit_ID=Q3BVJ4; Match level="QueryCoverage=20%, HitCoverage=47%, E-value=2e-19, Identity=73%"; Hit description=ArsC family protein
  Pfam annotation: Domain name=ArsC; Domain location=226-278; Score= -10.3; E_value=0.00046; Accession=PF03960.6; Description=ArsC family
MPAMVSDVRDVVYVSWWVDVRHAPSPPPGHHYVVHAGRTPYTILSYRHGHFGPALAGPLRSLMPSPRQSNWRWYLRRDDAPDGTPVVLFDRNVMDQLPFVAGARALSDAMQPHLSVRFEHVVRADGDEYTLIEGGQGSAPALHLQWRAAAGWEDEAWREGIGGRQALLRFLTCQDEAIARTSAAAGRRAAVPAPAGDGRGAARGAGLPAAKGAVPASQMAMSTTVYGLKNCDTCKKATRWLDRFGVPYTFVDYRDNKPSPETLLAWAEQLGGLAAMVN

SEQ ID NO: 191547 - protein, 91 aa, Glycine max
  Coding DNA Sequence Number=SeqID_74769
  Gene Ontology: Mol. function=protein disulfide oxidoreductase activity; Cellular component=chloroplast; Biological process =glycerol ether metabolic process
  Homolog annotation: Hit_ID=Q6CZE0; Match level="QueryCoverage=98%, HitCoverage=84%, E-value=2e-42, Identity=90%"; Hit description =Thioredoxin
  Pfam annotation: Domain name=Thioredoxin; Domain location=1-90; Score= 124.4; E_value=3.3e-34; Accession=PF00085.10; Description=Thioredoxin
MKAEGPILVDFWDEWCGPCKMIAPILDEIAEEFEGKLTITKLNIDQNPATAPKYGIRGIPTLLLFKNGEVAATKVGALSKGQLKDFLNANL

SEQ ID NO: 191548 - protein, 81 aa, Glycine max
  Coding DNA Sequence Number=SeqID_74770
MSAVHGSLPSLATINFMALQLLLAWQAINSNHHKVGTWQSRNLILFGLAPSSLTLEEVVSVWIACEIYKWRLLFERVPTSF

SEQ ID NO: 191549 - protein, 241 aa, Glycine max
  Coding DNA Sequence Number=SeqID_74771
  Pfam annotation: Domain name=DUF1639; Domain location=183-232; Score =123.7; E_value=5.3e-34; Accession=PF07797.4; Description=Protein of unknown function (DUF1639)
  Subcellular localization annotation: CTP_CleavageSite=41; ConfidenceScore=5.43e-01
MATAPAPAPAPAPAPVKSQPLHNFALPFLKWGASGKNNTTNAAHHHRFRRPSDHASEPDSSDPDSRPHRLGSRTARNRFSLPLKPPPPPPPPQPPHDDDADDSVQKPWKLRPRKPALLPNKTALEIGTGPSRNHHHHHHHATNNGEFLDGGDNNPAPKSLRLRGFSDTQCSEKKEKRKFWIALSREEIEEDIFVMTGSRPARRPRKRPKNVQKQMDSVFPGLWLVGITADAYRVADTPTKA

SEQ ID NO: 191550 - protein, 257 aa, Glycine max
  Coding DNA Sequence Number=SeqID_74772
  Gene Ontology: Cellular component=integral to membrane
  Homolog annotation: Hit_ID=P45537; Match level="QueryCoverage=84%, HitCoverage=34%, E-value=9e-90, Identity=75%"; Hit description =Hypothetical protein yhfK
RDANQNHPSGDWSDRGLLTRNRGSYPENAGRSEPDLRTRSAVLVSARLLQHGGTGYAAQTLLQTPDCGWFAVCHRQFPDANPHRLPDTAAADFTGAAAADWRNRRNRPAARAPAARHTHRRHLYAQLSGTHADVGAAAALHWRHAVVRLVQLVLVLAVERAADARIAQSAVPRAGGLLRCQIYLTDAADRSGESAAAAAGAPAKGGRPHYHLLSANAYAEHISVSLHQPEEVQKLVEESHAEAVIRWNAKIISARLR

SEQ ID NO: 191551 - protein, 351 aa, Glycine max
  Coding DNA Sequence Number=SeqID_74773
  Gene Ontology: Mol. function=oxidoreductase activity; Cellular component=integral to membrane; Biological process=protein amino acid phosphorylation
  Homolog annotation: Hit_ID=Q1S1K8; Match level="QueryCoverage=77%, HitCoverage=80%, E-value=1e-104, Identity=69%"; Hit description =Oxidoreductase, 2OG-Fe(II) oxygenase family, putative
  Pfam annotation: Domain name=2OG-FeII_Oxy; Domain location=177-281; Score=105.0; E_value=2.2e-28; Accession=PF03171.10; Description=2OG -Fe(II) oxygenase superfamily
MVATLSLPIIDLSSPHRLSTANSIRQACVEYGFFYLVNHGVDTDFVSKVFDQSCKFFSLPVQRKMDLARKEYRGYTPLYAETLDPTSLSKGDPKETYYIGPIEDTSIAHLNQWPSEGHFRITAKLETYNEILILETTNLHILLIFPRAAGKSLLSLIALSLNLEEDYFEKIGALNKPASFLRLLHYPGELGSDEQICGASPHSDYGMITLLMTDGVPGLQICKDKVNQPQVWEDVPHVEGALIVNIGDMMERWTNCLYRSTLHRVMPTGKERYSVITNHFLSCFNLYGSSEFLDIGDRACDPHYLIHTQRGGVKNSHANSDDKKVAFFFDPASDCVVECFESCCSESSPPR

SEQ ID NO: 191552 - protein, 55 aa, Glycine max
  Coding DNA Sequence Number=SeqID_74774
MNKGKERVGDNSQPTRDMMRWTEEQHNRLLHAMMDEVRLGNRIDGSWTSQAYANM

SEQ ID NO: 191553 - protein, 254 aa, Glycine max
  Coding DNA Sequence Number=SeqID_74775
  Gene Ontology: Mol. function=RNA-directed DNA polymerase activity; Biological process=RNA-dependent DNA replication
MTYWKSSVLDKSPIPKVVSRSTIPWVWTCPPAKPIKGFGLGFIIFGEMSNLLKMDKKSISMKLPPSIRNFLTSQLAIPTVITIRSCFFGSTHTKSAFVNVIKGSDLLALVVGIWFTLLMAYKCLFRADFVLPLLAKPSIMDLITLCLPPSPTVEAVGEQPGLQCYDHGIQCDAGVEVLNFDGNYCYLSMNDLNNSSLAWRRLTKATEVAVNESIDRGGRRLYHVSVGLLREVGALKDGECGGVSGGGGWGRGGG

SEQ ID NO: 191554 - protein, 120 aa, Glycine max
  Coding DNA Sequence Number=SeqID_74776
MFFEFKTFLATPSILIWPTPKAELLLHLSISNSAISSALLQEEELTGRIVTWLIELSKFNLQFEPLGPIKEQYLANFIVVLPPTGDNNEGGWTLNVDGASSSKDNGSSVTFKGLDNISIQ

SEQ ID NO: 191555 - protein, 130 aa, Glycine max
  Coding DNA Sequence Number=SeqID_74777
  Gene Ontology: Mol. function=RNA-directed DNA polymerase activity; Cellular component=mitochondrion; Biological process=RNA-dependent DNA replication
MVGCLQYWTYSVNDALPQEVVEAKKVHREICEMHIRRRNMEIRVIRAGYYWPTLRTDCTKYVKKCKECQEFSNTHYAPPKELHNITSPWPFTMWGMDILMPFPTTKSQIKFLLTELRKKSVKDTQGVVGR

SEQ ID NO: 191556 - protein, 74 aa, Glycine max
  Coding DNA Sequence Number=SeqID_74778
MNILTAHDQGWEQELSPYNQYEEERTPNLESVFEEFMAYHASSKANQNSMKNHEIHFGKSYSIENFQGGPELQP

SEQ ID NO: 191557 - protein, 279 aa, Glycine max
  Coding DNA Sequence Number=SeqID_74779
  Homolog annotation: Hit_ID=Q84VH5; Match level="QueryCoverage=72%, HitCoverage=29%, E-value=1e-100, Identity=89%"; Hit description =Envelope-like protein
PTDGVIDIAVSEHQIAKEITAKQVQHWPKKGKLSAGKLSVKYAILHRIGAANWVPTNHTSTIATGLGKFLYAVGTKSKFNFGNYIFDQTVKHSESFAVKLPIAFPTVLCGIMLSQHPNMLNYTDSVMKRESPLSLHYKLFEGTHVPDIVSTSGKAAASGAVSKDALIAELKDTCKVLEATIKANTEKKMELERLIKRLSESGIDGEAAEEDGEAAEVEEEAAEEEEEAAEEEEEAAEKRKMQQKRQNQMMILKPPHDHQTLYVCFSLLLAKGACPLNNY

SEQ ID NO: 191558 - protein, 194 aa, Glycine max
  Coding DNA Sequence Number=SeqID_74780
MGINIFIVALITFEKEPNIVIVAIALAVVVIVAVVVIVAIIVFVDYKIPLKSSHHRAALSLMDARICSSQCSYRYNHRDLYCLLSLRVCEGSTIIHNVLLGNDQVKDGVEEVQDADARVPIPTQEDKQGAEGSTKLVDRLELDDNPLYQMTLTIPQLFLKPLQLSWDATMFPLQKKESISDGHNPSENSKIHHR

SEQ ID NO: 191559 - protein, 506 aa, Glycine max
  Coding DNA Sequence Number=SeqID_74781
  Gene Ontology: Mol. function=oxidoreductase activity; Cellular component=membrane; Biological process=electron transport
  Homolog annotation: Hit_ID=Q9SMP5; Match level="QueryCoverage=94%, HitCoverage=94%, E-value=1e-164, Identity=60%"; Hit description =Cytochrome P450-like protein
  Pfam annotation: Domain name=p450; Domain location=33-496; Score =138.4; E_value=2e-38; Accession=PF00067.12; Description=Cytochrome P450
  Subcellular localization annotation: CTP_CleavageSite=23; ConfidenceScore=5.11e-01
MSVFFFTLLVPFLGFLFFFKTTKQQQRSHNNNHAPLSHPIIGCLVSFYQNRHRLLDWYTEQLANSPTQTIVVRRLGARRTVVTANPRNVEYILKTNFGNFPKGKPFTEILGDFLGCGIFNVDGELWHTQRKLASNAFSTRSLKDFIVKTLQEEVQQRLVPLLEHAARENHVIDLQDVLSRLTFDTVCKVSLGYDPCCLDLSKPLPPLLTAFDTASEVSAARGSAPVFLVWKMKRMLNVGSEKALKEAVKLVHESVMNIIKLKKEEIRFNRKNGTDLLDRLLEACHEEIVVRDMVISMIMAGRDTTSAAMTWLFWLLSRHREQEASLVKEVYDENNQNQGLGLDYECLKEMKLLKACLCESMRLYPPVAWDSKHAGGADVLPDGTHVEKGDRVTYFPYGMGRMEALWGENCCEFKPQRWFHEENVDNGILKCVNPYMFPVFQAGPRVCLGREMAFIQMKYVVASILNRFVISPVSDEQPRFVPLLTAHMAGGFIVRVHKRNGTEIEK

SEQ ID NO: 191560 - protein, 51 aa, Glycine max
  Coding DNA Sequence Number=SeqID_74782
MAKFLTSSSIGMLATIGDGDVGGGDGVGATSESLIGIDIVDKDGVDDDRLS

SEQ ID NO: 191561 - protein, 181 aa, Glycine max
  Coding DNA Sequence Number=SeqID_74783
  Subcellular localization annotation: CTP_CleavageSite=25; ConfidenceScore=5.41e-01
MKAKILENVLIMSRLLRSSSRISFRSNSSSSSSSRNTNLLNDQDNQTQEVAPKHNLFDEEVRFEDINQNMDDWNIPEIPQDQLYVPETIKDKHNFDYIIKTVENNIPLGQDIGEEFHLLSKNSIYEHSRKYKYLHIGCVQVAIKPLIDMGIDAAVLMCLRDIRHNQFEDSLIGTVETSLGQ

SEQ ID NO: 191562 - protein, 386 aa, Glycine max
  Coding DNA Sequence Number=SeqID_74784
  Gene Ontology: Mol. function=receptor activity; Cellular component =outer membrane-bounded periplasmic space; Biological process =glycolysis
  Homolog annotation: Hit_ID=Q7W7L3; Match level="QueryCoverage=83%, HitCoverage=97%, E-value=1e-142, Identity=80%"; Hit description =Putative exported protein
  Subcellular localization annotation: CTP_CleavageSite=18; ConfidenceScore=5.48e-01
MGTLMSMASPHRSSTQVSSAVRRAPKSTAGAKSGGGWVIRIWGCCVRESETPARRADAAGAEDRSVDLHVGFFGDALVLGDLGRDLFGKRFGAVGGRLGAQRFQARLDVGFGADLLHGGVQLGQDRGGQLGRGDQAEPRGVVDGGQADFGEGGHVRQAGHALGRGDGHGDQAAGLHVRQGRGQVVVHDVDLAGQRIVQRRAHATVGHVHQVGARGHLEQFAHHVRDRAVAGRGVGQLARLALGQLDELGHVLGLHLRVDGHDVRHGGQVRDRREVLLAIERQVRVDGRIDAVRADGGDAQGVAVRRAAGHEGAADRAAGAAAVFHHHGLVQFLAELVGEQAADDVGGAAGRERHDQADRLARVGVFGMGDARGQRRGQGRGGDTET

SEQ ID NO: 191563 - protein, 209 aa, Glycine max
  Coding DNA Sequence Number=SeqID_74785
  Gene Ontology: Mol. function=oxidoreductase activity, acting on the CH-OH group of donors, NAD or NADP as acceptor; Cellular component =cytosol; Biological process=electron transport
  Homolog annotation: Hit_ID=Q97TZ4; Match level="QueryCoverage=100%, HitCoverage=60%, E-value=1e-111, Identity=90%"; Hit description =Sorbitol dehydrogenase
  Pfam annotation: Domain name=ADH_N; Domain location=30-132; Score =133.9; E_value=4.3e-37; Accession=PF08240.2; Description=Alcohol dehydrogenase GroES-like domain
MVEEFSHMKSVVIENGKVAIRELPLPKLQQGDVLVKMKACGLCGTDIEKICGQYTASQPILGHEPAGIIQESTVDWLKPGDRVFAHHHVPCYECYYCKKGSPTMCPYYRKTNLDPGGFSEYFRVPAWNVVRGGILKLPDNVSFEEGAFIEPLATVIRAQRRVMIDKDDIVFIVGVGPMGLLHAMMAKVNNAGVVIASDVSEFRVEFGYK

SEQ ID NO: 191564 - protein, 172 aa, Glycine max
  Coding DNA Sequence Number=SeqID_74786
MDAAERLRPFLLAMPAWGGGCRYTLNGTRPDMSVTYEAPVDFGLHRIRRNGREVALIYEGDAPEKPVPGSTPDLRFTDGGYVVSGYARAEGPSTRYDVYVRPGSSGAGSLHIRGSAATADELASLAAVVGGFRVCNFQQSRRAQTLTCPRRAEWGQRLSEWVMRASTSGKSN

SEQ ID NO: 191565 - protein, 123 aa, Glycine max
  Coding DNA Sequence Number=SeqID_74787
  Homolog annotation: Hit_ID=Q5GV52; Match level="QueryCoverage=51%, HitCoverage=8%, E-value=6e-12, Identity=71%"; Hit description =Isocitrate dehydrogenase
PGTATGCGRTARCHGFPPRCCGGGVGADDRQQRLGGQERGFVGQRVEDLGHGGLGLCSNAQGKAGASAGPRATVSLSPVAVRVGARRGNPCIVAFSAARGKATPYAPVLDRCVSSLARFRSGS

SEQ ID NO: 191566 - protein, 93 aa, Glycine max
  Coding DNA Sequence Number=SeqID_74788
  Gene Ontology: Mol. function=DNA binding; Biological process=DNA integration
MTWWMYLVERYMKILKGYTKNLHRPKASIVKRYIAKENIEFCSKYIEKKKLVGLPESQHDERLRVRHKSLVKESNPKMTKNMVLKEHNKTFLN

SEQ ID NO: 191567 - protein, 201 aa, Glycine max
  Coding DNA Sequence Number=SeqID_74789
  Gene Ontology: Mol. function=mannosyltransferase activity; Cellular component=membrane; Biological process=protein amino acid O-linked glycosylation
  Homolog annotation: Hit_ID=Q2U526; Match level="QueryCoverage=91%, HitCoverage=21%, E-value=2e-78, Identity=82%"; Hit description =Dolichyl-phosphate-mannose:protein O-mannosyl transferase
  Pfam annotation: Domain name=PMT; Domain location=62-200; Score=20.1; E_value=2.1e-06; Accession=PF02366.9; Description=Dolichyl-phosphate -mannose-protein mannosyltransferase
  Subcellular localization annotation: CTP_CleavageSite=19; ConfidenceScore=5.47e-01
MSPKSKNALEVQPPTKSTRSSSRSPRPTNRKKAPVETLNYGSDGVKDNSIFSLPTSDYKALVLVTLVATAVRLFRIYQPTSVVFDEVHFGGFASKYIKGRFFMDVHPPLAKLLITLAGWLAGFNGDFDFKEIGKDYLAAGVPYVAMRMLPAIMGVLTVSLMFLTLKASGCRTTTAVLGAGVVIFGGLIYFSQSGYPHTLTT

SEQ ID NO: 191568 - protein, 76 aa, Glycine max
  Coding DNA Sequence Number=SeqID_74790
MVILRPLSFRSSESSGGRRQIMAILNTFSPSRGDRVRWRAKTNYGHSTPFHPGPIMSDGSAGGEIDRPNGVSLERN

SEQ ID NO: 191569 - protein, 94 aa, Glycine max
  Coding DNA Sequence Number=SeqID_74791
MGAKYLEVVKRGSHPNNGWSPNEIRTRSSLGGKAQNDHNLSLYATRHDRLWLTKGATDDVSLYMPLDTTVYEWRKSVWNDHNLSLHIIGPPASG

SEQ ID NO: 191570 - protein, 134 aa, Glycine max
  Coding DNA Sequence Number=SeqID_74792
MHTLKHAYNIEEVYTRTQRKRGTDERENTTFAQKINRPNSLKTVPSGVVNCRNLSFGGRATWGSRVRLPGEEGARSRHQRLFEENVIKTGTCGLRTLSMKGSGVVFMHGEGCFPRSYVSSIAMRKSDLRSSFEN

SEQ ID NO: 191571 - protein, 83 aa, Glycine max
  Coding DNA Sequence Number=SeqID_74793
MPKSYPNMPVKQEVSTGVKPRLLCKQSMGQNTPNKIDDDGSNYHQGEKQGIQFTKCQETPISKTITHYLYITQNSKRNMQCCT

SEQ ID NO: 191572 - protein, 84 aa, Glycine max
  Coding DNA Sequence Number=SeqID_74794
MLHSEIHQGTDEMKRLQLSPSAVLDSGKYFLRNFSTTSSENENRLSLIASSMMQSYPARALARRLQVDWARDPRKGPRVLMSLR

SEQ ID NO: 191573 - protein, 52 aa, Glycine max
  Coding DNA Sequence Number=SeqID_74795
MRGYFMVTRTFRQPGANEPVDARRLTSSSAPFVVLTREVRNRSSGGKIRGLG

SEQ ID NO: 191574 - protein, 33 aa, Glycine max
  Coding DNA Sequence Number=SeqID_74796
ACWLRLTKGVEDDYDRNRGAADKSEALAPMYPQ

SEQ ID NO: 191575 - protein, 171 aa, Glycine max
  Coding DNA Sequence Number=SeqID_74797
  Gene Ontology: Mol. function=RNA-directed DNA polymerase activity; Cellular component=signal recognition particle, endoplasmic reticulum targeting; Biological process=RNA-dependent DNA replication
  Pfam annotation: Domain name=zf-CCHC; Domain location=108-125; Score =12.8; E_value=0.0076; Accession=PF00098.13; Description=Zinc knuckle
MIRANVELDQEATMERFIGGLKKAITNVVEFQHYAEMEDLLLKAIQVERQMKSKGPSRFASSSNSTWRSNWKNNKSDAIPKDDGKAKYSVVAPNDKIENNTFSRSCDIKCFRCQEVGRITSQCPNKRTMIVRDNGEIERDQVMMKCYHWRIVVTLKLLNMYMELYLLQDML

SEQ ID NO: 191576 - protein, 115 aa, Glycine max
  Coding DNA Sequence Number=SeqID_74798
MTKVIRPPITRTFIEKYCSPRQAQGDAPQNAANHRGQVQIHECLYRFSLSQQGKGFVPFVCPTPEQFGAEVAWPGGWPDAQAGEAPAGSPDDAEEARTDEEMMDLLGFLGGSGAT

SEQ ID NO: 191577 - protein, 61 aa, Glycine max
  Coding DNA Sequence Number=SeqID_74799
MVILRPLSFRGSESSDKRAETNYGHFAPFVIQGQSSKSSDKRAETNYGHFAPFVIQEQQVE

SEQ ID NO: 191578 - protein, 127 aa, Glycine max
  Coding DNA Sequence Number=SeqID_74800
  Gene Ontology: Mol. function=RNA-directed DNA polymerase activity; Biological process=RNA-dependent DNA replication
MEFTNVFLEYFPQGLPPLRGIEHQIDHIPGSPIPNRSTYRTSLEEQRKFKGKWMSYRKKDLEGRVLVHILFLRSWFQRKREHGAGLGSSSSMDSFASWKMNGSGMEKEEREETPLQGEDESRRSSPP

SEQ ID NO: 191579 - protein, 55 aa, Glycine max
  Coding DNA Sequence Number=SeqID_74801
MDFGKTNEASNSKLVHDFDLNIAYVEEFDHVNAENEFSSPILVNTTQQACKNSIE

SEQ ID NO: 191580 - protein, 41 aa, Glycine max
  Coding DNA Sequence Number=SeqID_74802
  Gene Ontology: Mol. function=translation initiation factor activity; Biological process=translational initiation
  Homolog annotation: Hit_ID=Q9AXQ5; Match level="QueryCoverage=100%, HitCoverage=25%, E-value=5e-12, Identity=82%"; Hit description =Eukaryotic translation initiation factor 5A-2
MSDEEHHFESKADASDSKTYPQQASTIHKNDYIVIKGRPYK

SEQ ID NO: 191581 - protein, 70 aa, Glycine max
  Coding DNA Sequence Number=SeqID_74803
MTETVCTDNRLGISVRHLTSRVRMTEGVKDDVTIAKGGVVDKSEAFAPTYPPFVMRNSDLRSSFFCDVRD

SEQ ID NO: 191582 - protein, 96 aa, Glycine max
  Coding DNA Sequence Number=SeqID_74804
MAEKTKKKLEEATQSRSTKGVIDPPSPIRRHVKWKMTCTKKIGQMTFDATKEISEKIDSLEEQASQGSFVPYGRQDLLTAAIWRPEHPSRVRAVGA

SEQ ID NO: 191583 - protein, 100 aa, Glycine max
  Coding DNA Sequence Number=SeqID_74805
MGSKIYLKVHENPRAFFNSSSPILLEPLAHGSGNWSLPREDCIRCFVVHGRRDVMATTIGQPELLGRVRAAGAGVMIKNYFGLALRGSHTSSSMAPNDLE

SEQ ID NO: 191584 - protein, 77 aa, Glycine max
  Coding DNA Sequence Number=SeqID_74806
MSFYIGREASKLWKRFCAETTTELNLLAENWKYLLAGIVFQEKHKELVTAALFVIFCNSEDVAFDACSKFDQLLRLK

SEQ ID NO: 191585 - protein, 58 aa, Glycine max
  Coding DNA Sequence Number=SeqID_74807
MVEVTDERRRGGKHDDGHKSHVVHQGPFYCNTRGPQESHDISGLRLSGQTFMQVRLKP

SEQ ID NO: 191586 - protein, 52 aa, Glycine max
  Coding DNA Sequence Number=SeqID_74808
TTTRQLAGYLTLLQCWIYEHFPSVHRVTPKAYTPKSPSGPLPPDLGPTQKTF

SEQ ID NO: 191587 - protein, 90 aa, Glycine max
  Coding DNA Sequence Number=SeqID_74809
  Homolog annotation: Hit_ID=Q1S7S0; Match level="QueryCoverage=39%, HitCoverage=2%, E-value=3e-11, Identity=72%"; Hit description =Integrase, catalytic region; Peptidase aspartic, catalytic
MAEGFELNVMVEERMEWMNGLGYDCWSWTNWARGLKCEVDGFGKTSREIGSNNPGKSTKIVNNCKKILVAMNGNFREWAPNIHVNEIQYF

SEQ ID NO: 191588 - protein, 87 aa, Glycine max
  Coding DNA Sequence Number=SeqID_74810
DAEIILHKVDANGDKSANVDAYDPMRGLIKYNFDIYDKPVEFKFDGSICMSGVKPWVKVPAMHSLSHSRWWFQRIHMANANNILKDG

SEQ ID NO: 191589 - protein, 44 aa, Glycine max
  Coding DNA Sequence Number=SeqID_74811
MTCEEVARGSVLRFLTARPPWLGCAERDNPDLDPRGRPKTQSLR

SEQ ID NO: 191590 - protein, 295 aa, Glycine max
  Coding DNA Sequence Number=SeqID_74812
  Subcellular localization annotation: CTP_CleavageSite=73; ConfidenceScore=5.25e-01
MTLAQVWSVLSYSNLAPTSHTSDLIVDRARMIFGLVSQMDMNVGALISSQITSMVQSNSSRLGFLALITALCKARRVNSDSLVFERLSLVINLAYIRKNCWNLDDLTVSIRGARRARTRPVEPPSTSTAPIPARTSSTSSIPASADFQRLETMLQRSIPSVEQFTEFVAWHGTQSSLRKEDEGPTTQVPQHVEDDSSKATIPEPFVRGMEAEETQEAAATPERSLEAASEPPAQGEDIPSPQPAADPSTLVLDLSEGQNAPVLTLNTSPPTTPVLHLTDEEDGQTQDTQDQSQEF

SEQ ID NO: 191591 - protein, 202 aa, Glycine max
  Coding DNA Sequence Number=SeqID_74813
MGYAGVRELSWRWATVDVVPGDMSRGSGDLGDVRRAPGSQQIKGTKTTKQGGLWWLASYEFCVIYGLWPLVIDYQGLENEVVEASGNRLPVCVINYTEEWGTGNRLPIVMAAQLIHDRVEMECLEGAWGTLEGNTRCRFRGTIRFTATSLVHPDEPARTLQRTVEWILPTPTPYRLVARGRWRSASASEADSTEDSGPGEMD

SEQ ID NO: 191592 - protein, 251 aa, Glycine max
  Coding DNA Sequence Number=SeqID_74814
MGEIEEVQEQMNANMEAMKELMATMMEAMMSMKKIMEVNRGAVAATSVATEHLMLRTLPMRKSITPLPYSLRAKNLNLIMHVPQPMGETHEVPHHNLADFKPRLGYATEGQAVGGVPLPNTLEGPQFRPQPQPLHFAVGRVPPAMVERGKFDHIEERLKAIEGGRDYVFADMAGLCLVPDIVIPLKFKVSDFDKYKGTTCPKNHLKIYYRKMGAYLKDEKLRMHFFQESLTGAVSPGILIWNLLESIHGRT

SEQ ID NO: 191593 - protein, 94 aa, Glycine max
  Coding DNA Sequence Number=SeqID_74815
MRLRMREQSIILWEVHKISYFPVQAVKKNIHGLDDLIKLADYVECAARFPRACTGTHAPFTFKNPISLRVGKNVIALLCLTVGLQLNEAYTQKE

SEQ ID NO: 191594 - protein, 168 aa, Glycine max
  Coding DNA Sequence Number=SeqID_74816
  Gene Ontology: Mol. function=RNA-directed DNA polymerase activity; Biological process=RNA-dependent DNA replication
  Homolog annotation: Hit_ID=Q2AA19; Match level="QueryCoverage=91%, HitCoverage=14%, E-value=4e-09, Identity=26%"; Hit description=RNase H family protein
MVGCDPKGTFSVGAKLSRSRIFFGFLSDSPYEVASLFVDDSPPSMGIMVFVPYAFRLVKSSTQGPENDSISCLCMSVSLRMFNRVTRCLIPILVRSLRELFHLAGRNFLKWSCFYPLGEVVNNDKRSAWNVCKLLTSSASLGKVEGVYPKCWLFVARSHRFSGQGASS

SEQ ID NO: 191595 - protein, 79 aa, Glycine max
  Coding DNA Sequence Number=SeqID_74817
MPLYHLTYKGATNIHGDGRRDSRRGRELHVVTTSKELQWSGEGRSCGSAGAILTTKMTKVVNNIAIISILNPNMTLAKT

SEQ ID NO: 191596 - protein, 100 aa, Glycine max
  Coding DNA Sequence Number=SeqID_74818
  Subcellular localization annotation: CTP_CleavageSite=24; ConfidenceScore=5.15e-01
MLCGLVLRRSLRSLSTSSSVKAVSDSAVRGMSRLVKKGVGVVVEVHEEEGNSGDEQGKALEGEVSMNIGTTQKKNVCQNEDKARVRENDTNFKEKLSLNT

SEQ ID NO: 191597 - protein, 152 aa, Glycine max
  Coding DNA Sequence Number=SeqID_74819
  Homolog annotation: Hit_ID=Q7EY72; Match level="QueryCoverage=39%, HitCoverage=12%, E-value=5e-12, Identity=57%"; Hit description =Putative myrosinase
MHIYNDDHMSVHELFEEILKKDPLRVEAFHDLIMETSKTNNPLKGLLKRVEEANKVCKKQKRDSDVREVYLRRLNCKNNGCVFKFEGIDGIILFFFPDDLHFSKKLFVIGLSEGLITFTRIFSLEVACDVIKVERHSYVFYKAKLDIWIVTV

SEQ ID NO: 191598 - protein, 49 aa, Glycine max
  Coding DNA Sequence Number=SeqID_74820
MQHPTESKKFCEELTNKVREKQTDFGDPEEDPKGDWARNSMQEGTKAEK

SEQ ID NO: 191599 - protein, 943 aa, Glycine max
  Coding DNA Sequence Number=SeqID_74821
  Homolog annotation: Hit_ID=Q10NJ8; Match level="QueryCoverage=92%, HitCoverage=91%, E-value=1e-37, Identity=29%"; Hit description =Expressed protein
MGFGLSLRKKSSKQQSRSKTDKESSDLPQPNPCSKDSLKLKSKSNVGQASSDSCHKAKHDVKGKVQHLDSAKGSSTQPDELVKYMSNLPSFLKRSDGGESIQGKALNVGVLDWSHLEKWKNKQTHTKAEASNFTSSNSSKEISSRAATTSSSATSGGHNKKLDGRKVSSSSRSKGPYKEGLPRRSKMSSQNVKHYQHSETETKTLGDELGMSPSEFGKTQSDTSLRRVKVNDYDEITSVVESSASKSRHNVVSLVPNENSSGRDVEEKKRMEGLQQHSLKKKERSLKSSSDKRFPSLESKTKGVSFDSQKKMISSSSEAKKKMDQWQESDIDAGYEQNHRMPNNIVLLRPPRVLQLKSEDYFQHSQSRTSSEEDFLESSWSSLSYMSIPEEVYTEDVHSKIPHSSVLPSVTELASSETLQHSINTDLDMDRSSVLSKKPACSNSISSLQSENTCIEKDVLDIKPKNQCAFSNVLKSLDHETAELTPQNPSSNCRLSLSLSLSRIGRSFSFKEGSISKLSSTYVGAKSGPVTPESYAYLNNHSEDMVKGHNRTMSSPFLKLLDPILKRKASNIQFSDEQSVTSKGSMDSISLRTINLSDEKSKESPTQALLQLTIRNGVPLFKFVLNSERKVLAATMKSLALPEKDDVDCYFTFYLVNEIKKKSGKWMNHRSKEKNCGYVYNIVGQMKVSSSKTTESSNENSKRESVVKEYVLMGVEVDQLDQEPPEFFMSKELAAVVIEIPCENVNHEGLSYSHNLLRKRCLKCLADEKCFCSSQENEIYGNITVILPGGVHSSPNTGQPSPLIHRWKLGGTCDCGGWDVGCKLLVLSNQNLSSNIPRSSKSYLERFHLFVQEGADQNTPLFTLVPLKDGFYSVEFSSEINHLRAFFMSVAVLSSHNLPSSLEINNMQEAINKEFSPKSNNELQGKAPLYYNPIPPYSPADRV

SEQ ID NO: 191600 - protein, 352 aa, Glycine max
  Coding DNA Sequence Number=SeqID_74822
  Homolog annotation: Hit_ID=Q1SKH2; Match level="QueryCoverage=95%, HitCoverage=30%, E-value=1e-51, Identity=39%"; Hit description =Calcium-binding EF-hand
PSNDAVESEAEPSQGAVDSEAEPSNGAVESEAKPSQGAVESEVEPSQDVVESEGELSNGAVNREAEITSGAVESEAKTSSGAVKTEVKPSHGVVESEANLQMTKNDVVNSEAETSSGALQSEKESCVVSEMKNNKVESEAQPSVDVNHKKTNAVDSETELLVKGGLSIESEGSNQGDEDSRPASDALDGHNVGTKAICKDFDQKFRAAIATHRAARDLLKSKCQEIDSVQSIINILNNVIFVGDIDGKIRSMEHMIEHETLPLNKEKQLIREIKQLKQNCEELSSNMKKQDQSQQSVDNKDDNIEEHFKLLKKEMEVLRNNVLKSDTKTKATKKKYNDECDTLNKFPFYYTH

SEQ ID NO: 191601 - protein, 156 aa, Glycine max
  Coding DNA Sequence Number=SeqID_74823
  Gene Ontology: Mol. function=structural constituent of ribosome; Cellular component=intracellular; Biological process=translation
  Homolog annotation: Hit_ID=Q9AVH1; Match level="QueryCoverage=80%, HitCoverage=56%, E-value=5e-31, Identity=46%"; Hit description =Putative senescence-associated protein
MDAPGHTQGYWRGLSVEPAESKRPFRALLDVGLIKTTTGNRVFGALKGALDGGLDIPHNDKRFAGFDKEKKELDVEALYKKVHAAIRADPTLKKSDKQPPKEHKRRMFLRVSASFCKYNLKKLTYEDRKANADVSNVVEIIYFYIGDYLSTDVKTQ

SEQ ID NO: 191602 - protein, 167 aa, Glycine max
  Coding DNA Sequence Number=SeqID_74824
  Gene Ontology: Mol. function=transporter activity; Cellular component= integral to membrane; Biological process=cell division
  Homolog annotation: Hit_ID=Q9M0R2; Match level="QueryCoverage=81%, HitCoverage=22%, E-value=4e-27, Identity=48%"; Hit description =Patellin-5
MYENIQTVTTNPNSNRVSDFKKNSIDELKKLLKEELEDEEVSIWGIPLLKDDRTDVSLLKFVRVRELKTLSDGGRTSTSTPFWMKIWVTTWRRWCSCTDTAERAILSVTTSTVSSKTRTSTTRPCPLRIIEKSFYDGIFSCWSAVFSTSRIMKKKLQCFTKRTLRFK

SEQ ID NO: 191603 - protein, 73 aa, Glycine max
  Coding DNA Sequence Number=SeqID_74825
  Gene Ontology: Mol. function=serine carboxypeptidase activity; Biological process=proteolysis
  Homolog annotation: Hit_ID=Q1EP77; Match level="QueryCoverage=87%, HitCoverage=13%, E-value=2e-15, Identity=68%"; Hit description =Serine carboxypeptidase (Carboxypeptidase D), putative
MKLHSLASYLSQEILAEQEVDRVHGLPAQHPVKFNNMVVISLSMKLKEEHCSIGFSRPLTNQNKTPFSYGSME

SEQ ID NO: 191604 - protein, 151 aa, Glycine max
  Coding DNA Sequence Number=SeqID_74826
  Homolog annotation: Hit_ID=Q9M5P9; Match level="QueryCoverage=38%, HitCoverage=37%, E-value=8e-21, Identity=82%"; Hit description =Translation initiation factor 5A
  Pfam annotation: Domain name=eIF-5a; Domain location=87-145; Score =63.4; E_value=7.5e-16; Accession=PF01287.10; Description=Eukaryotic initiation factor 5A hypusine, DNA-binding OB fold
QRHLLVLCKISATLKPAQDQKQEKHSKQTQQSKNPKIYVVRQCAYIHRKVQLLIITLIMKLQPLSKPPLTALHDQEYIYTLKASPRKKGYTLLSLLTKNGNTKDDLKLPTDESLLTQIKDGFVEGKDLVVSVMSAIGEEQTCALKDIGPKN

SEQ ID NO: 191605 - protein, 161 aa, Glycine max
  Coding DNA Sequence Number=SeqID_74827
  Gene Ontology: Mol. function=protein serine/threonine kinase activity; Biological process=protein amino acid phosphorylation
  Homolog annotation: Hit_ID=Q1S890; Match level="QueryCoverage=94%, HitCoverage=20%, E-value=3e-38, Identity=54%"; Hit description =Protein kinase; Hydroxymethylglutaryl-coenzyme A reductase
MACNILRNCNASKEHELECWNLENNKLQGPLPQSLNKETLEISPPIEAPQVTVVHQKKHNVHNHLAIILGIVGGATLAFLLMHISVLIYKTKQQYEASHTSRAEMDMRNWGAAKVFSYKEIKVATRNLKKSKEGAVLDLFILEKFQMKNLWLSKFGLTNLN

SEQ ID NO: 191606 - protein, 419 aa, Glycine max
  Coding DNA Sequence Number=SeqID_74828
  Gene Ontology: Cellular component=integral to membrane
  Homolog annotation: Hit_ID=Q8S8N9; Match level="QueryCoverage=96%, HitCoverage=58%, E-value=4e-60, Identity=39%"; Hit description =Golgin-84
MDSWLKAAEGLFEVVDRRAKAVASDLSEEQGDSKSPASNGQGSQGKRTKSKPKAQKALSDSPTIISDTTHEKSGSPSAPVDIATSIDKVDPEIDVSASTSTNQPKEPQPSDATSPLLGSSLSKILGDDVGKHDTDDAEALVNDADIGVATIAGNGDPVQESASDICEMDPPPAPKGIEGSSDEPTSTGQIIKSRDLDASKNVDIEKSDSVASDTAPNNDPILKDSDVKVESVVDEKSQEDHKADISPEKVQDQLDEAQGLLKTTKSTGQSKEARLARVCAGLSSRLQEYKSENAQLEELLTSERELSKSYEASIKQLQKDLSESKREVTRVESNMVEALAAKNAEIEALLSSMDAVKRQAALSEGNLASLQSVIYSYGLGNTIHILPGKYGINDEKSRTKRNKDDASLENREREKNIEK

SEQ ID NO: 191607 - protein, 56 aa, Glycine max
  Coding DNA Sequence Number=SeqID_74829
MSHVIFKVRECKKSGWAKPIQNQAAPNQNVLTNSSIPNSLAEEQKWGTLHYRRSKL

SEQ ID NO: 191608 - protein, 156 aa, Glycine max
  Coding DNA Sequence Number=SeqID_74830
  Homolog annotation: Hit_ID=Q8ZMB2; Match level="QueryCoverage=44%, HitCoverage=82%, E-value=5e-08, Identity=32%"; Hit description =Putative periplasmic protein
AIGLAYFRRGAISARSFIAADGAAVTGAGQPAVAGDESAAAISAGAGERRNPGDSRYGRRAVGAAVGQRGELAAAERCGRAALFSAWLERFLPVNGECVMPDAVARQRGFSLAESLLAMALLIMTIAALGARSPGTARARANKPLADIQAKLCQHH

SEQ ID NO: 191609 - protein, 363 aa, Glycine max
  Coding DNA Sequence Number=SeqID_74831
  Gene Ontology: Mol. function=transporter activity; Cellular component= membrane; Biological process=transport
  Homolog annotation: Hit_ID=Q2P483; Match level="QueryCoverage=99%, HitCoverage=72%, E-value=1e-108, Identity=59%"; Hit description =Outer membrane efflux protein
  Pfam annotation: Domain name=OEP; Domain location=155-341; Score =176.6; E_value=6.1e-50; Accession=PF02321.8; Description=Outer membrane efflux protein
IGGHYAGSSQVAFDFSYGVDLWGGKRAAWEAAVDGAHAATVEAQAARLNLSTGITQAYADLAYAWQLNDVAEEELSRSQKSLELTRQRRRAGIDSDLQVRQAEARVPAAQQQVQAAQQRIDAARTALAALVGKGPDRGLSIQRPRPLNPVALQLPGVLPSELLGRRPDIVAARWRVEAADKQIKVAKTKFYPSFNLTALAGVVAPNVGDLLKSSSTFAYIGPALSLPIFEGGKLRANLANTDAQYDLAVANYNQTVLDALRDVADQVNAVRSLAQQAHSQQQAVDTARSAFDLAQQRYRAGIGSYLDVLTAQSTLLQSQQQLAGLQSQQVQTSVRLSKALGGGFQPADADRAPIASHSDSSHS

SEQ ID NO: 191610 - protein, 292 aa, Glycine max
  Coding DNA Sequence Number=SeqID_74832
  Pfam annotation: Domain name=RRM_1; Domain location=66-136; Score =37.3; E_value=5.4e-08; Accession=PF00076.12; Description=RNA recognition motif. (a.k.a. RRM, R
MREGETERDSERDSGWERVRSRRERRENERTRGMKGPCLSIVRERKGGQQRRMRVNWRDHRNISSFYFTRFPEDATEDELWKIFRRAGDVREVFISNKRNRNGRRYGFVRFIGVDNVQQLERRLDNIVLGGLKLYVNIPKYERGRGRVQPQSTGGRDHTRHVEQGRRETYQAQKHTAMPGQIRGSFADVVARREPRIQQRRTSIVQNAKTNTSRSKVHLDSPMTAPKWLQDAWVGMLKNLALLDRVEENMLWDWGLDVVPKYIGDNMVLLPSLTEDKAKQMVEDGTAGRGGD

SEQ ID NO: 191611 - protein, 215 aa, Glycine max
  Coding DNA Sequence Number=SeqID_74833
MDTCSRQGQCGCTVCEKYDISKEKWAQFCQIRRDPSWENVQKKAQVIQKLNTAPHVLSRGGYEYLEQKVMVEKTKKKLEEAAQSGSTEAMIDPPSPIRRHVKWKMTCTKKTGQMTSEVAKEIAEKIKYICYVQDSLEEQASQGSFVLHGHEDVLTTAISRCDHQAILWIDSMDLPASSSMALEELEQLTQQIRDQLEESITEKVTQQLMASFSQM

SEQ ID NO: 191612 - protein, 65 aa, Glycine max
  Coding DNA Sequence Number=SeqID_74834
MELNFHELGLAAGCAKHQSPTVFDMLLDCALSLTSQAKRILQKNFVLQKVLSAACGTKPQIVYGI

SEQ ID NO: 191613 - protein, 290 aa, Glycine max
  Coding DNA Sequence Number=SeqID_74835
  Gene Ontology: Mol. function=signal transducer activity; Cellular component=membrane; Biological process=signal transduction
  Homolog annotation: Hit_ID=Q8UJN4; Match level="QueryCoverage=99%, HitCoverage=44%, E-value=2e-60, Identity=42%"; Hit description =Methyl-accepting chemotaxis protein
  Pfam annotation: Domain name=HAMP; Domain location=162-232; Score =45.6; E_value=1.7e-10; Accession=PF00672.15; Description=HAMP domain
MSDRYKHADTAYSDFIAKDNAALVELARANRNLQSMAYGAYQIMAYDANSPDFKIVTQEYAGDRAEVVSRLDVVKAIFPEETATLDRLLRDVKAIIAMTDKAVEFGSANRNQESAAELLKADVAMRATRADIANLLDKLAKGVVKGSDDLSDQTNSTILTSLMAVGVVFATGIILALFVASRGITTPIARLRERMVSLAAGETTAEIDGMARKDEVGQMAQAVQVFRENSIERIRLERETEANRSLSEQDRIEREQQKAKEVADVKFAVDNLATGLSKLSDGDVSYRIRE

SEQ ID NO: 191614 - protein, 54 aa, Glycine max
  Coding DNA Sequence Number=SeqID_74836
FHPSKVATKAVTLFIRQQSGHPWPTWGAIPKDCEELYFQHFKELGRSVYIDEVS

SEQ ID NO: 191615 - protein, 229 aa, Glycine max
  Coding DNA Sequence Number=SeqID_74837
  Gene Ontology: Mol. function=nucleic acid binding; Cellular component= intracellular; Biological process=DNA integration
  Homolog annotation: Hit_ID=Q1S9T9; Match level="QueryCoverage=89%, HitCoverage=24%, E-value=2e-34, Identity=62%"; Hit description =Peptidase S8 and S53, subtilisin, kexin, sedolisin; Integrase, catalytic region; Zinc finger, CCHC-type
MDQIDKLKAMFSFEFEMKELGKAKRIPRMDINITRSKGELFLSQQGYMKKVVEKFRMHESKLVSTPSGQHDKFSTKDAPNSDEEREKMALIPYSNGVGSIMYDMVYSKPDLAYAVNMLSRKLGGITQDNVIVFCDSQSGIDLSKHQVYHEMSKHIDVRLHFIQDVIETKEILVEKIPTEENHADDLTKFVPQSKFKHCLDLIGFYEEYKLWEEANCDLETRWRFVNMCL

SEQ ID NO: 191616 - protein, 430 aa, Glycine max
  Coding DNA Sequence Number=SeqID_74838
  Gene Ontology: Mol. function=nucleic acid binding; Cellular component= intracellular; Biological process=DNA integration
  Homolog annotation: Hit_ID=Q1S3Z1; Match level="QueryCoverage=89%, HitCoverage=51%, E-value=2e-68, Identity=38%"; Hit description =Integrase, catalytic region; Zinc finger, CCHC-type
  Pfam annotation: Domain name=rve; Domain location=234-379; Score= -13.9; E_value=0.086; Accession=PF00665.16; Description=Integrase core domain
MGSTKFDIENFSKNDFGLWRIKMQVILIHQGLGDALKDQIADFNKILDDLENLEVKMEDEDKALMLLNGFPSNCEQFKDAMLFGRDQTITLEEVQSSIQTKEMQRKQESKIDNNAKRLNVMRDKDSKKSQEPGDMNIAKAGGVVMLVNNKPCKVQGYIAQIEHGMMKIFNNSVMIAKGIKMNGLYILDGSTVIAQTTVASQNEHDKTSLWHMRLGHVSEKGKAKRASFGIGLHATTRPFEYVHSDLWSLARTMAHGGCSYFLSIIDDYSIRVWIFVLKSKSDTFGKFKEWYTQIQTQMETKNQGVQALEDGTKCIISRDVIFNETRMTMKAKDQQHDSSQGNNLDITEVEVELPKQINDYNLARDRVKRNIVPPRRYGQVDLIYFALTIAEEIQATEPRKFKEALNDKENEEEWITTIEEEILSLEKKKT

SEQ ID NO: 191617 - protein, 298 aa, Glycine max
  Coding DNA Sequence Number=SeqID_74839
  Gene Ontology: Cellular component=periplasmic space; Biological process=conjugation
  Homolog annotation: Hit_ID=Q8KNK3; Match level="QueryCoverage=55%, HitCoverage=82%, E-value=2e-74, Identity=81%"; Hit description=TrbB
  Pfam annotation: Domain name=TraH; Domain location=171-298; Score= -211.6; E_value=0.017; Accession=PF06122.2; Description=TraH protein
MAAMMSACLQAGTLDDIRALEAGKTGRSAPSMEALALPKNDTAPDRKRPAEDASSAWYPLSDGRKVKVQDWKVVLFMQSTCQYCRQFAPVLKAMSQQTGLEVFAISLDGKGDAEFPDVLPATPDVMVEYFQSGMPVATPTTFLTNVHTMETWPLLQGAAEAGKTMMRLKLPGLVLALGLCSAGAAEAALQDDMNRFFNDMSYASNATSAKAWQGQAARYVSGGSFYARTGNKNIQLISISLPSINAGCGGIDVYLGAFSFINSDQIAAFVKQTMANAAGYFFDLALETTVPELKAAKD

SEQ ID NO: 191618 - protein, 111 aa, Glycine max
  Coding DNA Sequence Number=SeqID_74840
MKLFITCIRRKLWLGRGEHCSSPKRLYPIQANLGSPWPGQIFNLLLRGCGKLVQKLASKATWYSLCLCLLHQNPGLSGFGGDWLMGFSGNCGFTTNMHVELLTIQHGLRVA

SEQ ID NO: 191619 - protein, 232 aa, Glycine max
  Coding DNA Sequence Number=SeqID_74841
  Gene Ontology: Mol. function=oligosaccharyl transferase activity; Cellular component=membrane; Biological process=protein amino acid glycosylation
  Homolog annotation: Hit_ID=Q1RX05; Match level="QueryCoverage=99%, HitCoverage=27%, E-value=1e-107, Identity=88%"; Hit description =Oligosaccharyl transferase, STT3 subunit
VHSVWAAAEAYSAPSIVLTSHSHDGIHVFDDFREAYAWLSHNTEIDDKVASWWDYGYQTTAMANRTVIVDNNTWNNTHIATVGTAMSSPEKAAWEIFHSLDVKYVLVVFGGLVGYPSDDINKFLWMVRIGGGVFPHIKEPDYLRDGQYRIDSMATPTMLNSLMYKLSYYRFVETDGKAFDRVRQTEIGKKHFKLTHFEECYSALFLPNLLCVYLTNAFRCSQLTIGWFGFTS

SEQ ID NO: 191620 - protein, 99 aa, Glycine max
  Coding DNA Sequence Number=SeqID_74842
MAHKLQFNATSKIYLVFQVIGECCWELQNWDGIAQNHEGLLYDMLIAVVVLPSRSVSEGDVMTQNESLGPKGQLLHQLAHGPKVWKVNTRKDKEGMAEF

SEQ ID NO: 191621 - protein, 498 aa, Glycine max
  Coding DNA Sequence Number=SeqID_74843
  Gene Ontology: Mol. function=hydrolase activity; Cellular component =membrane; Biological process=cell-cell signaling
  Homolog annotation: Hit_ID=Q1SEI2; Match level="QueryCoverage=95%, HitCoverage=63%, E-value=1e-180, Identity=65%"; Hit description =Nucleoside phosphatase GDA1/CD39
  Pfam annotation: Domain name=GDA1_CD39; Domain location=2-409; Score =5.1; E_value=4.2e-11; Accession=PF01150.8; Description=GDA1CD39 (nucleoside phosphatase) family
METEPGLDKLLHNRTGLKTALEPLLKWAQKQIPETSHKTTSLFLYATAGVRRLPFDDSKWLLDNAWSFLKSSSPFVCKRDWVKIISGTEEAYLGWIALNYDSGILGVKPRKETYGALDLGGSSLQVTFEGNRNKEQQNQQLLNSETSLYVRIGSMNHHLTAYSLAGYGLNEAFDKSVAYVFKKYGYGMEDVFKGNVEVNHPCLQSGYKERYSCSHCSNAVKKGGESPTVEGNGNVLGKKDGGLRTVVTLIGAPNWLECSALAKVAVNLSEWSDVRPGMDCEVHPCALRDNLPRPMGHFYVISGFFVVYRFFNLTAEATLEDVLEKGREFCEKRWDVARKSVAPQPFIEQYCFRAPYIASLLREGLHITDKHITVGSGSITWTLGVALLEAGKAYSVRFGLHGFDLLQMKMNPLILIPILILTFILLLCALSWVVNWMPRFFRRQYLPLFRHNSGSSASGINIASPFRFQRWSPMNSGVLNVFDTNISVTCVRHSLLGA

SEQ ID NO: 191622 - protein, 269 aa, Glycine max
  Coding DNA Sequence Number=SeqID_74844
MKWKLACTKKSGQMTYEATRQIVDKIDSLEDQSAKGNFVAHEHQDVLTIVIGRPEHPGRVRVAGVGVTIKQYFGPSSQSSHTSTSISLEELDGLKQNFKKELTQNIKTSCNSRSLKNTKGRYVDPSGQDPNIDISDRHRLYVDDIFSYLVALGRAYEGLPTIQHMSLANDMVKVGIEEVRDADARVPIPTKEVQLVGQDKQVLWDATMFGVYNDNIPLYIKHEDLREITHGGQCLNIVVLKFWIMHMNELSMQLGNGSMYGFLDKAITV

SEQ ID NO: 191623 - protein, 145 aa, Glycine max
  Coding DNA Sequence Number=SeqID_74845
MKTLPNQEHHVDTCPGAAAVENDVVFGGGVVGVESVEEKEEEEEKEEDEDQEEEEEEVFAANRIGKLNRFGFGETGGGEVGVVDVVVGSGAMAMFEVMAIGGEILEGGGDSEVVVVVLAKDHVEVGMDLVRLWSGSVHGVVASVI

SEQ ID NO: 191624 - protein, 925 aa, Glycine max
  Coding DNA Sequence Number=SeqID_74846
  Homolog annotation: Hit_ID=Q7XDI4; Match level="QueryCoverage=84%, HitCoverage=81%, E-value=1e-118, Identity=32%"; Hit description =Expressed protein
  Pfam annotation: Domain name=DUF810; Domain location=1-788; Score =1028.9; E_value=0; Accession=PF05664.2; Description=Protein of unknown function (DUF810)
MESVVLPLELIQLFRSSDFPSQQEYEAWLRRNLKVLEAGLLLHPHLPLDKSDPSAQSLRHIIRGAFEKPMDIGKNGESMQTFRTVVMSLSCRSSDGSISETCHWADGFPLNLWIYQTLLEACFDLHAESSVIEEVDEYLVTGQVENDLLFASSNLLAEVGKDTGGSKDPIYTKILRNTLSLILSWAEKRLLAYHHTFHNGNIESMESVISLAVLSAKILEDISHDYNRKKKDDVDYTRVGNYIRSSLRTVFIKASSIIQAPLNMNTLFQMKLEKLDLCKHPSRKQNKAFPILSVLARDIIELAINEKAIFSPKLKRWHPLATGVAVATLHVCYGNELKKYVKGINELTPDAIEVLIAADKLEKDLVQIAVEDSVDSEDGGKSIIREMQPYEAEAVIATLVKSWINIRVDRLGEWVDRNLRQEVWNPGANKEGFASSAVEVLRMIDDTLEAFFLLPIPMHADLLPGLMSGLDKSLQQYILKAKSGCGSHSSFIPTLPALTRCSTRSKNGVFRKNEKSQVTQRRKAHVGTTNGDNSVDKTQMCVCINTMQRIRMELGVLEKRIVANLSSSISTNEDIANGVSLKFKLSTSAAVEGIHQLCKCVAYKIVFHDLWHVLWDGLYVGEVASARIEPFLQELEQYLEIASSTVHDKVRTRVIIEVMQASFDGFLLVLLAGGPSRAFSLQDSVIIEEDFKFLTGLFWSNGDGLPAELIEKHSTTVKGVLPLFHADTEHIIQQFSQLTMEMYGSTAKSRLPLPPTADQWSPTEPNTLLRVLCNRNDEAAAKQPAMQCKGIIRQGGGGDRNSKYCQSCMNWRRRKSALRGLVVEGAWVDDPHDVKEGVEKFFQERFRETEENKPKLDEVEFKKLVVEDNILLLATFEECEVKTVVWECGDSKSPGPDGFNFKLIKGFWKLIKEDVLRFLQEYHVH

SEQ ID NO: 191625 - protein, 331 aa, Glycine max
  Coding DNA Sequence Number=SeqID_74847
  Gene Ontology: Mol. function=peptidase activity; Cellular component =cytoplasm; Biological process=response to oxidative stress
  Homolog annotation: Hit_ID=Q8LGH3; Match level="QueryCoverage=94%, HitCoverage=94%, E-value=9e-50, Identity=35%"; Hit description=4 -methyl-5(B-hydroxyethyl)-thiazole monophosphate biosynthesis protein, putative
  Pfam annotation: Domain name=DJ-1_PfpI; Domain location=173-310; Score=102.0; E_value=1.7e-27; Accession=PF01965.14; Description=DJ -1PfpI family
MHSINFKRQGGMPGSARLRDCDVLRKITCRQAEENSLYGAICAAPAVSLLPWGLLKKKKVSRGLTTSRGPGTSYQFALSLAEQLFGESVAKEVAELMLMRTDDDNAAKKEFNKVEWSVGHHTPSISAAYPSASMIFTHELIQYDVQVLVPIVHGSEEIEVVTVVDILRRAKAKVIVASVEKSLEVLASQGTKIVADILIGDAQESPYDLIILPGGTAGAQRLSKSRILKKLLKEQNSAKRIYGAVYSSLAILQKQGLLKDKRTTAHPSVLVKLKDEEINGAKVDIDGKLITSEVLATVTDFALAIVSKLFGNGRARSVAEGLVFEYPKECM

SEQ ID NO: 191626 - protein, 224 aa, Glycine max
  Coding DNA Sequence Number=SeqID_74848
MDAVNCHDAMVMAGAIPEMVDAAIKRQITHKQMALYLVVYLDDIIIIGNDEIRIRELKAQFQTKDLIAQKFFLGIGVVVFGRDDEHTAVEAFLGADCAGSPIDRRFTLAAGFLLEFDGVETPGAEVHKVDDALTGNCDQKRCRMCCHAPVGEAVWLKKMVHVKHHVDQFGVTWPDPVSGRRKSHQKVSQKSCRSCTGDHKMCKKQGKWPEKEKGSLESGKRSSE

SEQ ID NO: 191627 - protein, 246 aa, Glycine max
  Coding DNA Sequence Number=SeqID_74849
  Homolog annotation: Hit_ID=Q1SEI2; Match level="QueryCoverage=36%, HitCoverage=13%, E-value=2e-17, Identity=64%"; Hit description =Nucleoside phosphatase GDA1/CD39
MKNSGLLEIEISYSADASDFCGVTGMPLYYCCRTASALNCSRNNYEDSISWMLPLLSPRPCPRRNGLSCEPAIVGLSGVFILPSPAIPQVADQESEHSRSADLHDQRPGCGQVSKSAEDACKQLVYQKKHCQQAVVQGLFRVCIEPEESSDELKKKKIMTAYGLENFKKGAKMDTAQKHEVIGILIDIWSVEIAGQSFFILAWENPRATENTLGKLQAVTPARLHWESRGTRLFIFGQLRVAQYQI

SEQ ID NO: 191628 - protein, 326 aa, Glycine max
  Coding DNA Sequence Number=SeqID_74850
  Gene Ontology: Mol. function=nucleoside-triphosphatase activity; Cellular component=integral to membrane; Biological process=transport
  Homolog annotation: Hit_ID=Q9C6W5; Match level="QueryCoverage=97%, HitCoverage=49%, E-value=1e-116, Identity=69%"; Hit description =White-brown complex homolog protein 14
  Pfam annotation: Domain name=ABC_tran; Domain location=92-280; Score =153.4; E_value=5.7e-43; Accession=PF00005.17; Description=ABC transporter
MPENCIAPKPEHNNNNTTHPEEGPPEMTETVLPIKTNEQSFPKLAMFPITLKFEELVYNVKIEHKGGLCWGSTRSCKEKTILKGVTGMVSPGEIMAMLGPSGSGKTTLLTALGGRLSGKLSGKVTYNNQPFSGAMKRRTGFVAQDDVLYPHLTVFETLLFTALLRLPNSLTKEEKVHHVEHVISELGLSRCRGSMIGGPFFRGISGGERKRVSIGQEMLINPSLLLLDEPTSGLDSTTAQRIITTIKGLACGGRTVVTTIHQPSSRLYHMFDKVVLLSEGCPIYYGPASSAMDYFSSVGFSTSMIVNPADLMLDLANGNNISFFSI

SEQ ID NO: 191629 - protein, 465 aa, Glycine max
  Coding DNA Sequence Number=SeqID_74851
  Gene Ontology: Mol. function=protein dimerization activity; Cellular component=nucleus; Biological process=regulation of transcription, DNA-dependent
  Homolog annotation: Hit_ID=Q9M4H1; Match level="QueryCoverage=89%, HitCoverage=93%, E-value=2e-69, Identity=43%"; Hit description =Putative ripening-related bZIP protein
  Pfam annotation: Domain name=bZIP_1; Domain location=357-417; Score =44.5; E_value=3.7e-10; Accession=PF00170.11; Description=bZIP transcription factor
  Pfam annotation: Domain name=bZIP_2; Domain location=357-414; Score =37.5; E_value=4.6e-08; Accession=PF07716.5; Description=Basic region leucine zipper
  Pfam module annotation: Pfam domain module=bZIP_1::bZIP_2; Domain location=357-417::357-414
  Subcellular localization annotation: CTP_CleavageSite=23; ConfidenceScore=5.16e-01
MNFRNFGVGDNHPTWDAMHGKTPANNNVTSTTLLRQPSTIYSLTFDEFQSTMGGIGKDFGSMNMDELLKNIWTAEETQAMVFSAVAAAGGVEGHNNNSNNNPINCSGLQRQGSLTLPRTLSQKTVEEVWRDLIKESGGEANDGGSGGNGGSSNPQMQATLGEMTLEEFLVRAGVVREDVPQQQQNGKPNDNGWFGDFPRPNNNNTSLLLGFQQPNRSNGNGNLGENTNLVSKQQPPPLSLNSNHSQRQAQHQHQHQQHPPPLFPKPANVTFAGAPTHLLNNAHQHASPGRRGGLIGVAAEHSMNVGMVGLATANVTASPSSKISPDVITRSNNNVDNSPISPHYVINRGRKFSAIEKVVERRQRRMIKNRESAARSRARKQAYTFELEAEVAKLKELNRELQRKQEEIMEMKKNKDDKHVFQCTFNPTHVPRVIEMNIHLKYWNRKLNTPFLEFLAPNLDSDYLK

SEQ ID NO: 191630 - protein, 287 aa, Glycine max
  Coding DNA Sequence Number=SeqID_74852
  Homolog annotation: Hit_ID=Q47522; Match level="QueryCoverage=20%, HitCoverage=77%, E-value=5e-19, Identity=74%"; Hit description=LacZ protein
VPPVQLLTGWCVTAKAPPDISAGKCSGHAARRVPFAIQAAQLLGRAIGAGLFAITPAGERGMCCKAIKLGNARVFPEFDRRLLAHGGLDALRRGDPVREPGGPRNDDGDGLNDIHGWPASLGWEFGCAGRARCTTDGVTTTARASAYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 191631 - protein, 35 aa, Glycine max
  Coding DNA Sequence Number=SeqID_74853
MAWLEAQLPVERSHKVVPPEHVPARTIVPPGPIDR

SEQ ID NO: 191632 - protein, 120 aa, Glycine max
  Coding DNA Sequence Number=SeqID_74854
MQQPIPGCPSQPLNIHGITLKGKQDENCEQLFTPMIGQWNKQVDFRVDETLQYMVSPQGRNTWTVDDLVPYVEKITILLKEQERITEPVSHGPASEHQFPAQEFHILQSSVETQGIGRRR

SEQ ID NO: 191633 - protein, 232 aa, Glycine max
  Coding DNA Sequence Number=SeqID_74855
  Gene Ontology: Mol. function=nucleoside-triphosphatase activity; Cellular component=integral to membrane; Biological process=transport
  Homolog annotation: Hit_ID=Q9C6W5; Match level="QueryCoverage=80%, HitCoverage=28%, E-value=4e-71, Identity=70%"; Hit description=White- brown complex homolog protein 14
  Pfam annotation: Domain name=ABC2_membrane; Domain location=1-171; Score=93.0; E_value=9.3e-25; Accession=PF01061.14; Description=ABC-2 type transporter
  Subcellular localization annotation: CTP_CleavageSite=59; ConfidenceScore=5.07e-01
MKRISHGAGFVMQIALLFFFSVFWGFYPLYNAVFTFPQERRMLIKERSSGMYRLSSYFLARTVGDLPIELALPTAFAIIIYWMGGLKPHPVTFLLSLLVVLYSVLVSQSLGLAFGAILMEVKQATTLASVTTLVFLIAGGYYIQQIPPFIEWLKYLSYSYYCYKLLVGVQYNDDDHYECSKGVLCKVGEFPPIKSVGLNHLLPTNCIFSTTENEVELAKMCTLATELGRVLY

SEQ ID NO: 191634 - protein, 76 aa, Glycine max
  Coding DNA Sequence Number=SeqID_74856
  Homolog annotation: Hit_ID=Q1SJY4; Match level="QueryCoverage=96%, HitCoverage=15%, E-value=6e-08, Identity=37%"; Hit description=Zinc finger, CCHC-type
MELNTKAICTLTCALPKNECNKICRLRTTKETWDSLSINYECTKDVRLRKATTLTKHYESFIIKDEEFVDDMFRRI

SEQ ID NO: 191635 - protein, 44 aa, Glycine max
  Coding DNA Sequence Number=SeqID_74857
MARSSFVYSASVRVVFSSEAWWPCERCFLNDGLRPFLDNPPSFY

SEQ ID NO: 191636 - protein, 203 aa, Glycine max
  Coding DNA Sequence Number=SeqID_74858
SHGHGGMGAMLTGGAAAAAAAYGAHHVSHGSHGSYGQYAAHGAHMPHGKFKQHGKHGKFKHGKHGKFGKHGKHGKFGKHGGGFKKWKEEDEWHLLSLGSAEGLSVQVDRRIRVLPCMKDKLEAKLDAKNVVENVEAKKKQDNTVQAEGTPKVVDDAIVNDVLIDLTCQHDHACNGLHDVVVVYSINFGATPINYTAPTSLSED

SEQ ID NO: 191637 - protein, 700 aa, Glycine max
  Coding DNA Sequence Number=SeqID_74859
  Gene Ontology: Mol. function=ATPase activity, coupled to transmembrane movement of substances; Cellular component=integral to membrane; Biological process=transport
  Homolog annotation: Hit_ID=Q1RYK6; Match level="QueryCoverage=99%, HitCoverage=47%, E-value=0.0, Identity=77%"; Hit description=Cyclic peptide transporter
  Pfam annotation: Domain name=ABC_membrane; Domain location=308-577; Score=77.2; E_value=5.3e-20; Accession=PF00664.13; Description=ABC transporter transmembrane region
MAGFWSVFCGESGCSEAGRMPCSYDFRLLIDPSTCVNHLLNSCFDVLLLIMLACIMIQKSSLKPSRGLTQVQRYSYFQLVSAIANGALGLTLLCFGIWVLEEKLRKNQTALPLNWWLLEIFHGLTWLLVSLTITLKLKQLPKAWSRPFSVLIFLVSDFFCASSVFYAISSRELSLKISSDILSFLGAILLLLCTYKESKHRDTDSEIDENLYAPLNGESNKNDSIRYVTPFAKTGFFGRMTFWWLNPLMKMGKEKTLHDEDIPRLREEDRAESCYLLFLDQLNRQKLNDQSWQPSVLRTIILCHWKEILISGFFALLKVVALSSGPLLLNSFILVAEGNESFKYEGFVLAISLFFTKNIESLSQRQWYFRCRLIGLKVRSLLTAAIYRKQLRLSNSARLMHSSGEIMNYVTVDAYRIGEFPYWFHQTWTTSFQLCISLVILFRAVGWATIASLVVIVITVLCNTPLAKLQHKFQSKLMVTQDDRLKACSEALVNMKVLKLYAWETNFRSSIERLRNEELKWLSAVQLRKAYNTFLFWSSPVLVSAASFGACYFLNVPLHANNVFTFVATLRLVQDPIRTIPDVIGVVIQAKVAFARIVKFLEAPELQSVNITQRCLNENKRGSILIKSADFSWEDNVSKPTLRNINLEVRPGQKVAICGEVGSGKSTLLAAILREVLNTQGTTEVYGKFAYVSQTAWIQT

SEQ ID NO: 191638 - protein, 450 aa, Glycine max
  Coding DNA Sequence Number=SeqID_74860
  Gene Ontology: Mol. function=aminoacyl-tRNA ligase activity; Cellular component=endoplasmic reticulum; Biological process=translation
  Homolog annotation: Hit_ID=Q10HJ4; Match level="QueryCoverage=77%, HitCoverage=56%, E-value=1e-155, Identity=73%"; Hit description =Expressed protein
MAWRKGFEEVANSKPLFLTIYTVVIIGIVVSSFYVFSAIYSANPPSAQSSAWLSSISSDATHVTDQTLNVSQSAAVHTVPPPSPRPRNESPRSIWDDPPPNKKMPPLKDFRLTKELVRQRVKDNAIIVTFGNYAFMDFILTWVKQLTDLGVSNFLVGAMDTKLLEALYWKGIPVFDMGSHMSTVDVGWGSPTFHKMGREKVILIDSILPFGFELLMCDTDMVWLKNPLPYLARYPEADVLTSSDQVIPTVVDDSLENWPEVSGAYNIGIFHWRPTESAKKLAKQWKEMLLADDQIWDQNGFNDIVHRQLGPSVDDESGLVFVFDGKLKLGILPASIFCSGHTYFIQAMYQQLRLEPYAVHTTFQYGGTEGKRHRLREAMHFLDPPEYYNPLGGFLSFKPHIPKNLLLSGEHNVESHFTLVNYQIKQIRAALAIASLLNRTLLCSVIMLFA

SEQ ID NO: 191639 - protein, 125 aa, Glycine max
  Coding DNA Sequence Number=SeqID_74861
MTQARNNNKKYTCLPYSVSLLPALFLLGGSGPLSPVHGPAFLVWKIMLNRLPTKINLRARNILVDEEELRLMEIWKACYVWLHVSKIIPNSSEQHFWQHAHFVQTKLEQDMWQVVWVAAVSNIWV

SEQ ID NO: 191640 - protein, 356 aa, Glycine max
  Coding DNA Sequence Number=SeqID_74862
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=96%, HitCoverage=21%, E-value=6e-78, Identity=45%"; Hit description=Chromo
  Pfam annotation: Domain name=RnaseH; Domain location=131-248; Score= -31.8; E_value=0.053; Accession=PF00075.14; Description=RNase H
MRVGTRAWKNHVLLDNHFVLKLSKCFFTQSQVEYLGHLVSARGVEPVAAKVAAVSQWPIPRLTKALRSFLGLAGFYRRFIKGYAMIDDTLVKATTMDPFRWTPDAQAAFDHLKQALSTAPVLVLPNFQLPFTVETDASGIGVRAMLSQQGHPFVYFSKPFPPKLLRASTYVRELFAITSAVKKWRQYLLGRPFTIITDHRSLKELLTQVIQTPEQHTYLVRLLGYDYVIHYRSGSHNQAADALSRRPDHSASLTLILSVPWLTFLEELRQQLRQHPQYIHKHQLLTQSPADHPGFTIANDLIMKEGRIWLPRDLPLIQTLLTEYHASTIGGHMGVAKTVARISENFQWQGLREDVA

SEQ ID NO: 191641 - protein, 60 aa, Glycine max
  Coding DNA Sequence Number=SeqID_74863
MIRGRLKRMLEEIIKGDLRKLFVSTVATEAFQRHWFFAPNVWLMRCIGETRECSLIVGFG

SEQ ID NO: 191642 - protein, 211 aa, Glycine max
  Coding DNA Sequence Number=SeqID_74864
  Gene Ontology: Mol. function=zinc ion binding
  Homolog annotation: Hit_ID=Q2QXC7; Match level="QueryCoverage=70%, HitCoverage=17%, E-value=2e-22, Identity=37%"; Hit description =Expressed protein
MKDECGPAPRDVANFDVGEEESVARDLANSDEGFKSVPVSQGATDNDSGCVELDGHVYAHPTIDPIWRGSMYFCNETNGTVNGVLAHMSNLACSKVAEETGHFPEVLHAELLPRDKVWPESFKSRRPTDQDIALFIFPDTEGSEKDFDKLVEDIMINEHVIRIVAKKAELLIFHSIELPIQYWRFEAKYYLWGVFRRKQTSEETNDAVYRD

SEQ ID NO: 191643 - protein, 74 aa, Glycine max
  Coding DNA Sequence Number=SeqID_74865
  Homolog annotation: Hit_ID=Q9FHX3; Match level="QueryCoverage=88%, HitCoverage=8%, E-value=4e-08, Identity=45%"; Hit description =Receptor lectin kinase-like protein
MEKMLQVGLPCVLSDYEKRPSVRDATRILVKEAPFPFLPTSKPRMRIRPLCPDDTPETQNVVADWLSTDEALEA

SEQ ID NO: 191644 - protein, 685 aa, Glycine max
  Coding DNA Sequence Number=SeqID_74866
  Gene Ontology: Mol. function=protein serine/threonine kinase activity; Cellular component=cell surface; Biological process =protein amino acid phosphorylation
  Homolog annotation: Hit_ID=Q9FHX3; Match level="QueryCoverage=95%, HitCoverage=95%, E-value=0.0, Identity=52%"; Hit description =Receptor lectin kinase-like protein
  Pfam annotation: Domain name=Lectin_legB; Domain location=9-243; Score=223.3; E_value=5.3e-64; Accession=PF00139.10; Description =Legume lectin domain
  Pfam annotation: Domain name=Pkinase; Domain location=361-632; Score =127.9; E_value=2.8e-35; Accession=PF00069.15; Description=Protein kinase domain
  Pfam annotation: Domain name=Pkinase_Tyr; Domain location=361-632; Score=77.7; E_value=3.8e-20; Accession=PF07714.7; Description =Protein tyrosine kinase
  Pfam module annotation: Pfam domain module=Lectin_legB::Pkinase::Pkina se_Tyr; Domain location=9-243::361-632::361-632
  Subcellular localization annotation: CTP_CleavageSite=33; ConfidenceScore=5.06e-01
MLCLFLLLLLLLFTFPSLVLTLPFFPSDNLTLYGDAFFTRNAITLTTQHSKCSSSSIGRAFFIYPVRFLDPQTNSTASFSCRFSFSILSSPSCPSADGLAFLIASSTHFPTLSSGYMGLPSSSFSSFFAVEFDTAFHPFLGDINDNHVAVDVNSLASSFASVDAASRGVDLKSGKIITAWVEYRHAMRMVRVWIGYSSTRPPTPILATQIDLSERLEDFMHVGFTASNGEGSSVHLVHHWQFKTFGYDDDSRSMDVVEEGDCFLCYEGDSTGKREGSSMSNKDDIERRKKIGEMALGLAGLTAFVVSGLAAMVVVCVFLTKNKACIRKKNKEEQGQSCRFQTSKVPTRLSLSDIKSATMGFNRDRLVGEGASAKVYKGYLPFGGDVAVKRFERDNGLDCLHNPFATEFATMVGYLRHKNLVQLKGWCCEGNELVLVYEFLPNGSLNKVLHRNFNSSIVLSWQQRLNIVLGVASALTYLHEECERQIIHRDVKTCNIMLDADFTAKLGDFGLAEVYEHSSSTRDATIPAGTMGYLAPEYVYSGVPTVKTDVYSFGVVVLEVATGRKPVEDDGTVVVDFVWGLWGKRKLIEAADPRLMGKFDEKEMERMLLVGLLCVHPDYEKRPRVREATRILKKEAPLPLLPTSKPRVRIRPICPDDDTSEAQSVVADWLSTDDAPYLTPRSQFY

SEQ ID NO: 191645 - protein, 56 aa, Glycine max
  Coding DNA Sequence Number=SeqID_74867
MILAFGMDNPKNKKKNSLKGAESYLEVQEATTRKLEYQSYPHCPWITKVRTVPLRS

SEQ ID NO: 191646 - protein, 188 aa, Glycine max
  Coding DNA Sequence Number=SeqID_74868
  Gene Ontology: Mol. function=tetrahydrofolylpolyglutamate synthase activity; Cellular component=extracellular space; Biological process= folic acid and derivative biosynthetic process
  Homolog annotation: Hit_ID=Q10SU1; Match level="QueryCoverage=86%, HitCoverage=29%, E-value=1e-50, Identity=60%"; Hit description=FolC bifunctional protein, expressed
  Pfam annotation: Domain name=Mur_ligase_M; Domain location=1-153; Score=-43.5; E_value=0.0066; Accession=PF08245.2; Description=Mur ligase middle domain
MALLNNMEKTDDNIPMPTYFRFLALLAFKIFAAEQVDVAIMEVGLGGKYDATNVVQAPIVCGITSLGYDHMEILGNTLGEIAGEKAGIFKNRIPAFTVPQPDEAMHVLEEKASQLNVPLQVLTPLDAKLLNGLRLGLEGEHQYLNAGLAIALCFTWLKRTGHVGDINLEQTMGLIVLKAWKCVQGGFL

SEQ ID NO: 191647 - protein, 144 aa, Glycine max
  Coding DNA Sequence Number=SeqID_74869
  Homolog annotation: Hit_ID=Q60EM1; Match level="QueryCoverage=78%, HitCoverage=43%, E-value=2e-21, Identity=47%"; Hit description =Unknow protein
MEESSYTGLPTSHLLGSVPAVITEENNATKHVATGANMQTFPPNNGGDRGPGHQTLGSPTEAFEQQPANNWRGIFSMSSYSEYFNVDTDVVLIRLISSLNPVAADFFSKIDANPDLCVIFLCPCAFILPIIKIEILIWITIEMW

SEQ ID NO: 191648 - protein, 103 aa, Glycine max
  Coding DNA Sequence Number=SeqID_74870
  Gene Ontology: Mol. function=transferase activity; Cellular component= membrane
  Homolog annotation: Hit_ID=Q6ZIF8; Match level="QueryCoverage=85%, HitCoverage=27%, E-value=1e-09, Identity=39%"; Hit description =Putative pectin-glucuronyltransferase
MTKAPARTRLAHAWGLGSGGSVTSLCGEARDLNGVFLQFYQVPVRLEGDSVAGKVEVVGAEGAVPVREVVADACKDTRGEVWGERVEEKVRFLGILGEVGAVL

SEQ ID NO: 191649 - protein, 296 aa, Glycine max
  Coding DNA Sequence Number=SeqID_74871
  Gene Ontology: Mol. function=glutamate-5-semialdehyde dehydrogenase activity; Cellular component=cytoplasm; Biological process=amino acid biosynthetic process
  Homolog annotation: Hit_ID=Q6RUF7; Match level="QueryCoverage=99%, HitCoverage=46%, E-value=1e-133, Identity=74%"; Hit description =Delta-pyrroline-5-carboxylate synthetase
MEDPIGQVLKRTELSDGLILEKTSSPLGVLLIVFESRPDALVQVITEAIPDTVGGKLIGLVTSREEIPELLKLDDVIDLVIPRGSNKLVSQIKSSTKIPVLGHADGVCHVYVDKSANVEMARRIVLDAKIDYPAACNAMETLLVHKDLIEKGWLNDIVVDLRTEGVKLYGGPRASSLLNIPQAQTFHHEYSSLACTVEIVDDVAHTDSIVAEDKEVANVFLRQVDSAAVFHNASTRFSDGARFGLGAEVGISTSRIHARGPVGVEGLLTTRWILKGSGQVVDGDKGIVYTHKDIAT

SEQ ID NO: 191650 - protein, 381 aa, Glycine max
  Coding DNA Sequence Number=SeqID_74872
  Gene Ontology: Mol. function=mannose-1-phosphate guanylyltransferase (GDP) activity; Cellular component=cytoplasm; Biological process =biosynthetic process
  Homolog annotation: Hit_ID=Q6J1L7; Match level="QueryCoverage=94%, HitCoverage=100%, E-value=1e-179, Identity=85%"; Hit description=GDP- mannose pyrophosphorylase
  Pfam annotation: Domain name=Hexapep; Domain location=254-271; Score =10.4; E_value=6.5; Accession=PF00132.14; Description=Bacterial transferase hexapeptide (three rep
  Pfam annotation: Domain name=Hexapep; Domain location=272-289; Score =13.7; E_value=0.68; Accession=PF00132.14; Description=Bacterial transferase hexapeptide (three rep
  Pfam annotation: Domain name=Hexapep; Domain location=306-323; Score =5.2; E_value=33; Accession=PF00132.14; Description=Bacterial transferase hexapeptide (three rep
  Pfam annotation: Domain name=NTP_transferase; Domain location=2-236; Score=252.8; E_value=7.2e-73; Accession=PF00483.13; Description =Nucleotidyl transferase
  Pfam module annotation: Pfam domain module=Hexapep::Hexapep::Hexapep:: NTP_transferase; Domain location=254-271::272-289::306-323::2-236
MKALILVGGFGTRLRPLTLSFPKPLVDFANKPMILHQIEALKAIGVTEVVLAINYQPEVMLNFLKDFESKLGIKITCSQETEPLGTAGPLALARDKLIDDSGEPFFVLNSDVISEYPLKEMIEFHKSHGGEASIMVTKVDEPSKYGVVVMEESTGQVDKFVEKPKLFVGNKINAGIYLLNPSVLDRIELRPTSIEKEVFPKIAAEKKLFAMVLPGFWMDIGQPRDYISGLRLYLDSLKKKSSSKLASGSQFVGNVIVDETAKIGEGCLIGPDVAIGPGCIIEQGVRLKSCTIMRGVRVKKHACVSSSIVGWHSTVGQWARVDNMTILGEDVHVCDEIYSNGGVVLPHKEIKSNILKPEIVMSVFWIRMSDAIALMKRSASL

SEQ ID NO: 191651 - protein, 473 aa, Glycine max
  Coding DNA Sequence Number=SeqID_74873
  Gene Ontology: Mol. function=histone acetyltransferase activity; Cellular component=nucleus; Biological process=metabolic process
  Homolog annotation: Hit_ID=Q9FJT8; Match level="QueryCoverage=97%, HitCoverage=98%, E-value=1e-143, Identity=55%"; Hit description =Histone acetyltransferase type B catalytic subunit
  Pfam annotation: Domain name=Acetyltransf_1; Domain location=223-312; Score=12.1; E_value=0.093; Accession=PF00583.14; Description =Acetyltransferase (GNAT) family
  Pfam annotation: Domain name=MOZ_SAS; Domain location=174-338; Score=- 105.5; E_value=0.012; Accession=PF01853.9; Description=MOZSAS family
  Pfam module annotation: Pfam domain module=Acetyltransf_1::MOZ_SAS; Domain location=223-312::174-338
MGQKQRSSSEADNEVKKRRRVGFSGVDSGVEAKDCITIYLVSSKEEFDAPESFVIHPVDLNSFFDDDGKIYGYEGLKITIWISSISFYAYADITFQSSSDRGKGVTDLKSALQTIFAETLVDSKDEFLQKYLADNDFVRTNISNGETLKHKAFKENICDSNQLTDSSTSTVEVVRLVAGNMATGQLYSHLIPLTLLLVDGSSPIDVTDSQWELYIVCQKKTDQQGEIQYRLTGFTAVYRFYHYPDDSRLRLSQILVLPPYQHKGYGRFLLEVLYDVAISENVFDFTVEEPLDHFQRVRTCVDALRLLRFGPIQNIVTKAVSLLKQEKLSKKAHCPRLLPPPSAIEDVRKSLKINKQQFLQCWEVLIYIGLNPVDKNMENFVSIILNRVKYDILGKDSGTSGKQLIEVPSDVDQEMSFVMFRSEANEASTVQMDDNQANQEEQLQKLVQERVKEIQLIAEKVTLHLGSSGLVVN

SEQ ID NO: 191652 - protein, 404 aa, Glycine max
  Coding DNA Sequence Number=SeqID_74874
  Gene Ontology: Mol. function=zinc ion binding; Cellular component =cell surface; Biological process=protein modification process
  Homolog annotation: Hit_ID=Q0WWY1; Match level="QueryCoverage=95%, HitCoverage=75%, E-value=1e-136, Identity=61%"; Hit description =Regulator of chromosome condensation-like protein
  Pfam annotation: Domain name=RCC1; Domain location=245-294; Score =7.9; E_value=0.1; Accession=PF00415.9; Description=Regulator of chromosome condensation (RCC1)
  Pfam annotation: Domain name=RCC1; Domain location=297-348; Score =31.2; E_value=3.5e-06; Accession=PF00415.9; Description=Regulator of chromosome condensation (RCC1)
  Pfam annotation: Domain name=RCC1; Domain location=351-399; Score =26.2; E_value=0.00011; Accession=PF00415.9; Description=Regulator of chromosome condensation (RCC1)
  Pfam module annotation: Pfam domain module=RCC1::RCC1::RCC1; Domain location=245-294::297-348::351-399
ETPEPFPLPTETSIVKAAAGWAHCVAVTEHGEVYTWGWKECIPSGKVFGESSTGVSLEKDVPGRHTPLFTEQVSPRSQGSRSTGGTASSNSGEESTKRRRVSSAKQTAESSSSSDDSLTAFPCLVTLNPGIRIASVAAGGRHTLALSDTGLVWAWGYGGEGQLGLGSRIRMVSTPHLVPCIDSSYYVKDRSATLARGNMGSEGQTFRIPGSYIKRIACGGRHSAVITVNSYVLILEYLSVELTDAGALLTFGWGLYGQCGQGITDDELSPTCVSSLLGIHIEGIAAGLWHTVCTSADGDVYAFGGNQFGQLGTGADQAETLPRLVDSPSLKNLHAKNISCGARHTALVTEGGKVFCWGWNKYGQLGLGDVIDRNIPSEVTIEGCVPKNVACGWWHTLLLAESHT

SEQ ID NO: 191653 - protein, 117 aa, Glycine max
  Coding DNA Sequence Number=SeqID_74875
MVIQVDSSWGDFFGKDGAGFGSKRKYMFRKVTIQLKLVKGDSAGTGPFLSQCIELFSSADNPICINELNITGLGIMEIPICLGGSISSTGSTLYVLMFSCFYKIECLLDSNIYVLTS

SEQ ID NO: 191654 - protein, 63 aa, Glycine max
  Coding DNA Sequence Number=SeqID_74876
MHARVELMQDVFGVHSVISLILAFILDRAAHHHRPDNYLKGIINSALKGLDDTPQPKSKATAR

SEQ ID NO: 191655 - protein, 77 aa, Glycine max
  Coding DNA Sequence Number=SeqID_74877
  Gene Ontology: Mol. function=pyridoxal phosphate binding; Biological process=carboxylic acid metabolic process
  Homolog annotation: Hit_ID=Q4H1G0; Match level="QueryCoverage=79%, HitCoverage=12%, E-value=2e-15, Identity=65%"; Hit description =Putative serine decarboxylase
MYSSSSFLGNWVVQNGTKNGERKIVLGRNIHTTCLEVTEPGIDDEVIGEREAYMAGMLAKYKKSLKGPTIIQDTPII

SEQ ID NO: 191656 - protein, 111 aa, Glycine max
  Coding DNA Sequence Number=SeqID_74878
  Homolog annotation: Hit_ID=Q0WWY1; Match level="QueryCoverage=66%, HitCoverage=13%, E-value=1e-14, Identity=52%"; Hit description =Regulator of chromosome condensation-like protein
  Subcellular localization annotation: CTP_CleavageSite=37; ConfidenceScore=5.11e-01
MAEASSGQHEATWKRNHVGVRRGTLVPLKMIRSFYALATPKSKVTNRRTFSLFSEKKPPENKRVLYMWGYLPGALPQRTPLLTPVAVRVPPCDYSWNDVCGGGCGFAIAIS

SEQ ID NO: 191657 - protein, 60 aa, Glycine max
  Coding DNA Sequence Number=SeqID_74879
MLGYKCEVKSHIGSPYVVACGPQVYPSNLPNNWYQSRWFKLMTGSDEYASTTGGHGYTRG

SEQ ID NO: 191658 - protein, 146 aa, Glycine max
  Coding DNA Sequence Number=SeqID_74880
MGLLIISCSWTHDKAVGNCFNVVYQEQSREIAFNMAPLHVIPRLNFVPLDNNGVFGTIRKSMVTVKRATVASIKARSTAGPHWPQMLLINAKSSSSEVKYDLIFSPNQLSEKFLRVSKLGADMPMDTPKDSCSAAHVFIIPHFISI

SEQ ID NO: 191659 - protein, 82 aa, Glycine max
  Coding DNA Sequence Number=SeqID_74881
  Subcellular localization annotation: CTP_CleavageSite=56; ConfidenceScore=5.17e-01
MAPILMAPSSWTRHVATETPLSAAFSLLLSCLWKRQQQWRLGPRSFGSASSSGDCCADPRSLLQLQLQRLAGKRQSLLRFHF

SEQ ID NO: 191660 - protein, 310 aa, Glycine max
  Coding DNA Sequence Number=SeqID_74882
  Gene Ontology: Mol. function=methyltransferase activity; Cellular component=nucleus; Biological process=protein kinase C activation
  Homolog annotation: Hit_ID=Q2HS18; Match level="QueryCoverage=99%, HitCoverage=83%, E-value=1e-148, Identity=51%"; Hit description =Tetratricopeptide-like helical
  Pfam annotation: Domain name=PPR; Domain location=125-159; Score =11.3; E_value=0.34; Accession=PF01535.11; Description=PPR repeat
  Pfam annotation: Domain name=PPR; Domain location=161-195; Score =20.9; E_value=0.0045; Accession=PF01535.11; Description=PPR repeat
  Pfam annotation: Domain name=PPR; Domain location=88-122; Score=31.6; E_value=2.8e-06; Accession=PF01535.11; Description=PPR repeat
  Pfam module annotation: Pfam domain module=PPR::PPR::PPR; Domain location=125-159::161-195::88-122
MADEAILLFHGMKEDCVTANKITLTAVLSACATIGALDLGKQIDEYASQRGFQHDIFVATALIDMYAKSGSLDNAQRVFKDMPQKNEASWNAMISALAAHGKAKEALSLFQHMSDEGGGARPNDITFVGLLSACVHAGLVDEGYRLFDMMSTLFGLVPKIEHYSCMVDLLARAGHLYEAWDLIRKMPEKPDKVTLGALLGACRSKKNVDIGERVMRMILEVDPSNSGNYIISSKIYANLNMWEDSARMRLLMRQKGITKTPGCSWIEVENHLHEFHAGDGLCLDSIDLSNIIDLLYEELKREGYVPKVVE

SEQ ID NO: 191661 - protein, 249 aa, Glycine max
  Coding DNA Sequence Number=SeqID_74883
  Gene Ontology: Mol. function=metal ion binding; Cellular component =intracellular; Biological process=protein kinase C activation
  Homolog annotation: Hit_ID=Q2HS18; Match level="QueryCoverage=99%, HitCoverage=74%, E-value=8e-91, Identity=48%"; Hit description =Tetratricopeptide-like helical
  Subcellular localization annotation: CTP_CleavageSite=51; ConfidenceScore=5.05e-01
HAIKDPSSRLQFPTFSIHTNQSRTYIGVKSHATFHNKPLHPPPQLQVPQLPASPEQTHQTHLVRLKPVPPPHLPKHLHSLPGTTRLGVPGDHGVPRHRVPVGNFIEHLARGRDEAASRVRGDEGVGGVGVGVEGELEEEGVGGAGVGEGSEVGAGEEEEGEGEVVWCEGEGHHAMEEGEGERVVVPRGGEGADHDVEGVVVGVGSDVGEEKGGVGEVLEVYGFGEKVVVGGVDGGVHHHLGVNLLERLR

SEQ ID NO: 191662 - protein, 79 aa, Glycine max
  Coding DNA Sequence Number=SeqID_74884
MVSKGWSFDGASMVEEEGRKSNVREREKLLHFWLIPRVSLHPSGPVFESKQYIYQNAQTETPSVVQRLVLLNFKLHAKR

SEQ ID NO: 191663 - protein, 125 aa, Glycine max
  Coding DNA Sequence Number=SeqID_74885
  Subcellular localization annotation: CTP_CleavageSite=73; ConfidenceScore=5.55e-01
MDLMHFRSEFLPTTLNPSSTYLQFSPLKPFQKTLNLKFRSQKRFAVVSFSQSHKPISEFSILGRNSRCTRDLRSYAARSKKSGGDGSPSGRIEGNAEFWRRLKRNDRARSKKYAEKPEGRWKLSR

SEQ ID NO: 191664 - protein, 66 aa, Glycine max
  Coding DNA Sequence Number=SeqID_74886
METPQKNNSVGFFQMPLHYPRYTQKDYQDMPEWKLDRLLKEYGLPTHGDLAYKREFAMGAFLWPKY

SEQ ID NO: 191665 - protein, 486 aa, Glycine max
  Coding DNA Sequence Number=SeqID_74887
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q71QD5; Match level="QueryCoverage=72%, HitCoverage=89%, E-value=1e-115, Identity=59%"; Hit description =Protein phosphatase 2C
  Pfam annotation: Domain name=PP2C; Domain location=182-464; Score =275.9; E_value=7.7e-80; Accession=PF00481.12; Description=Protein phosphatase 2C
MGDQNQTRISYSTMSPRARILRLDHMRVRKGTSFDLPCVLPIGPRVGSEKKGWDCIWVLNGSTSFQLYMSGGARDGDGQVVWPPVVGESGETSSSSIEPTSRPSARRSLDLLPLRYIAADVSVPAPENSRKRQKLDRCVSSARECENAVQSSKSKVAKAVRNRSSKILTLDSTSPTVYEGCLRYGVTSVCGRRRDMEDAVSVRPSFCQENLSQDDKKEFHFFAVFDGHGCSHVATMCKERLHEIVKEEIHKAKENLEWESTMKKCFARMDEEVLRWSQNNETPNCRCELQTPHCDAVGSTAVVAVVTPEKIIVANCGDSRAVLCRNKVAVPLSDDHKPDRPDELLRIQAAGGRVIYWDRPRVLGVLAMSRAIGDNYLKPYVISEPEVTVTERSDKDECLILGSDGLWDTVQNDTACKVVRMCLNAQKPASPVKEMAVDCSDKSCSDASILLTKLALVRQSSDNVSVVVGGDGRFYCGGIIQGDEKI

SEQ ID NO: 191666 - protein, 321 aa, Glycine max
  Coding DNA Sequence Number=SeqID_74888
  Homolog annotation: Hit_ID=Q9LKB4; Match level="QueryCoverage=87%, HitCoverage=45%, E-value=1e-68, Identity=49%"; Hit description =Arabidopsis thaliana genomic DNA, chromosome 3, TAC clone:K15M2
MGRLGNKARSSIGQCAAWMRPDIVYVKKPVFQCRFEPQDDFFKPIIPFLNPKTEQDFLFELENDDGSVELCTYFGGLCKIVKVNQKALVNDVVNAYQKLSDEKMSKCLEFLLNHPVELLHPYTKEWKAKLDEMELGCDAPDEEDDATFDDPDETEILDWIEDEGSDGDANITDEDEDEEDLIDDYGDEDQDLVMDMEESKDGKFHAMEEDTLSDEDEKDFNWNEEFQKALSSGEAMENLAKKTLEFNKKLSKKQFMMNKEEEETAHSVDGDETDLRGKQAKVNLNFQCISTMKAQKTLQTGTVRWAPTFPSCDLKANLSLN

SEQ ID NO: 191667 - protein, 100 aa, Glycine max
  Coding DNA Sequence Number=SeqID_74889
MNHIHFTYELCNSHDYSIVFKIILTRRVPTVDPITILIALKGSYNCVIAQFIAHVITYPSAGGRRGAHWCVFQGRKMHGVATNVYSRKMSKKPKRVVYEL

SEQ ID NO: 191668 - protein, 403 aa, Glycine max
  Coding DNA Sequence Number=SeqID_74890
  Gene Ontology: Mol. function=binding; Cellular component=outer membrane
  Homolog annotation: Hit_ID=UPI00005F7198; Match level="QueryCoverage =93%, HitCoverage=45%, E-value=1e-99, Identity=46%"; Hit description =COG0457: FOG: TPR repeat
LAQQNVEAALAIARQHPLYRPDPQDDRHELFYALLDSGQYQAARDYLATVTNGVPYTRRLYGSPTPQPNDPWLNAQSLKVQYLLNTNALPEAEQLSGRLAATAPGNQGLRIDYAAILQARGLPRAAERELKAAEALEPSNIPLERQQAYVAMDLQEWRQMELLTDDLLARSPEDLSTQKLVRAREVHHMSELRLNSTQGIHSDNPVSGSHDFSWDAAIYGPPIADNWRLFAGNRFAKGNFDEGKGSSRQLFGGIEWRPRDAWAELEISNNNFAGDNKPGARLSAWQSFNDRWQIGGEVERLSRQTPLRALRNGISANRGEGWVRWYQNERREYRFSAAASRFSDHNRRQEYTFSGKERLWQSPTITLDLEPGLSASANSRADTLYYNPKRDFAATSALVADHV

SEQ ID NO: 191669 - protein, 780 aa, Glycine max
  Coding DNA Sequence Number=SeqID_74891
  Gene Ontology: Mol. function=RNA-directed DNA polymerase activity; Cellular component=chromatin; Biological process=chromatin assembly or disassembly
  Pfam annotation: Domain name=RVP_2; Domain location=102-228; Score= -19.5; E_value=3.3e-05; Accession=PF08284.2; Description=Retroviral aspartyl protease
  Pfam annotation: Domain name=RnaseH; Domain location=599-715; Score= -13.5; E_value=0.0011; Accession=PF00075.14; Description=RNase H
  Pfam module annotation: Pfam domain module=RVP_2::RVT_1::RnaseH; Domain location=102-228::336-505::599-715
MELMGQAQMQGEMVLKNKQGQRDRGAKHLAYQDLVDRQKKGLCFKYGGPYGPLHQCPVKQLRLILADDELQVECEEEDAFKDAQEEGYVILDGECRALSLQGMDNGKMGSHSTMKLQEKISGIPILLLVDNGATHNFISRKLVEALGWTWEEAKSMNILMGDDHTTETRGMCKEIKIETEAGKFTLDAVLFDLEDIDVILGMSWLKTLGVMMVDWNTQIIKFETKLGTKTLRGVNQEDPLFATVCGVLDERQERKENGLSGEQQRDLRDILTSFDDVFVEPKGLPPVRVKEHAINLKPGHDPINVRPYRYPYHQKNEIERQVKDLLKIGHVRPSQSEYSSPVILDKKKNNKWRMCVDYRALNKATIPDKFSIPMIEELLDELHGSTYFSKLDLRSEYHQVRMKKDDIHKTAFRTHKIHYEYLVMPFGLMNTPSTFQSLMNEVFRKFIRRGVLVFFDDILVYNKEWEDHMEQLKGVLEVLRKQHLYANKEKCNFGQRSIEYLGHVVSKQGVKVDPNIVKSMLDWPVPTNVKGVHGYLGITSYHRKFIKDYGKIARPLTELTKKDGFGWNDHAQKAFEELKKKITSALVLTLPNFEQEFELEYDASGLGIGAILMQNRKSVAYFSKALSSRNVTKSAYKRELMAVALAIQHWRPYLLGRKFTVYSNQKSLKQLLQQRITTGSQQNWLAKLLGYNFEIAYKPGLENMGADALLRSMGEMELNSLAYIPVWLDCQNLITEVHESSTWRKVIENLKQGQGKHLSFEYKQGVLFFKDRLVVVETSS

SEQ ID NO: 191670 - protein, 159 aa, Glycine max
  Coding DNA Sequence Number=SeqID_74892
ELAMDARMEKVEGDLEMMKSMMEAIQAKAKEAKENQSKILELVTKSLMMNVNNEEEGEGSHGGGRKAKTNREHDGKRPNPSRAGAGNERRGEGEAHLGIQGREQRMSNYRRCSRLGALMTTFHGGNSSSFEELACCQSVDKKTFDEYSKGRQNGDGKQK

SEQ ID NO: 191671 - protein, 116 aa, Glycine max
  Coding DNA Sequence Number=SeqID_74893
MVKHCYNHKKPVTQHTPSLIQMSPESRTPSNTNLEYVDLVGSNQWWHNGGLVTLKSKEKRRSFVFKATLLRQYGSCWDEVEGRWKFDCVDDFTYLVFHIKIVFGKGNVPSCEVASL

SEQ ID NO: 191672 - protein, 76 aa, Glycine max
  Coding DNA Sequence Number=SeqID_74894
  Homolog annotation: Hit_ID=Q851M9; Match level="QueryCoverage=37%, HitCoverage=6%, E-value=2e-07, Identity=79%"; Hit description =Putative ammonium transporter
MDEQRRQCMAATVGKPGVALDEKFLLGLIPNATMVFAGITLILIAELWRRPALDGLEWVQRWRSVRGEHGGISGRP

SEQ ID NO: 191673 - protein, 575 aa, Glycine max
  Coding DNA Sequence Number=SeqID_74895
  Homolog annotation: Hit_ID=P11143; Match level="QueryCoverage=23%, HitCoverage=21%, E-value=2e-34, Identity=59%"; Hit description=Heat shock 70 kDa protein
  Pfam annotation: Domain name=HSP70; Domain location=238-567; Score= -330.5; E_value=0.0015; Accession=PF00012.10; Description=Hsp70 protein
MVAELVRSRENPSFISATTIPSFHGCRPWLLLAVRSSHDRLQLLPLTIRHFHDCLPDEDMTKSKGKDPLEGLGGPMTRARARKAKEALQHVLSILFEYKPKFQGEKSKVTILSQPLCHVGSYHYHHPHNSSSATEDRLEAALAKLEAVTRRLDAQLDALLLRLPRRPGPLPRIPLPPPPLPTPPPLTPPTPPSLPPPPPVKHLTPEELSSRRERGLCLTCDEKYHTGHHCTSRFLLLIAEADEPSWVNIEPDDLNPAPDPPDSPTQYQAQINLNSLSGQYLKCTSLCKVVPMSAYSNASRGHASKDDGVNSRLNVIRIINEPFAAAIAYGLEEKAISSGAKSALIFYLGGGSFDVSLLTIEEGNFKVKATATNTHLGGDEFDNSVVTQIVQKFNGKHKLTINGNVRASNNKSGMLTQYGAANIARVVFEKMPNRDKSSGPAMISVMVINLPKVATQTGLHSYAIVANLLINKEMLGSLNPTFVIPVCVLSAYNSIGSFDMWKRSPSSLAHPVTHFNLGSQFKFWSHGSVREVIRSNKRHTQGERTKGASRGANSEAQEKGHKPAYLKEIGYVRLV

SEQ ID NO: 191674 - protein, 475 aa, Glycine max
  Coding DNA Sequence Number=SeqID_74896
  Gene Ontology: Mol. function=monooxygenase activity; Cellular component=membrane; Biological process=electron transport
  Homolog annotation: Hit_ID=Q0H212; Match level="QueryCoverage=87%, HitCoverage=94%, E-value=0.0, Identity=81%"; Hit description =Abscisic acid 8'-hydroxylase
  Pfam annotation: Domain name=p450; Domain location=20-451; Score =134.1; E_value=3.9e-37; Accession=PF00067.12; Description=Cytochrome P450
MELSTIMLCLFASFLSILLFKSLIKPFFFSSKGRQLPLPPGTMGLPYIGETFQMYGSMFKSHILGYPCVMISDPEAAKFVLNKAQLFKPTFPASKERMLGKQAIFFHQGAYHANLRKLVLRTFMPEAIKDKVSNIESIALSCLKSWEGKMITTFLEMKTFTFNVALLSIFGKDENLYGEALKRCYCTLERGYNSMPINLPGTLFHKAMKARKELAQILAQIISTRRNMKQDHNNNDLLGSFMSEKAGLTDEQIADNIIGAIFAARDTTATVLTWIVKYLGENPSVLEAVTEEQESLLRGKEESGEKMGLNWSDTKNMPVTSRVIQETLRIASILSFTFREAVEDVEFQGYLIPKRWKVLPLFRNIHHSPDNFKEPEKFDPSRFEVAPKPNTFMPFGNGTRACPGNELANLEILVVFDGCKKWDSIWPFCHSTEWIAHNTISQIKSGGTLIKAWKQLAKYGKITLPKIFEFVNQRK

SEQ ID NO: 191675 - protein, 106 aa, Glycine max
  Coding DNA Sequence Number=SeqID_74897
MLGSGNRVSFGFAAILLIAATSMNRKQPYRVGWLKGECYLVKGGTYVGSAILVLVTKKVLERGEIINYTRRQQVVEAKFKVLSNSAGRQGIIISPRKIDIIQGTNS

SEQ ID NO: 191676 - protein, 989 aa, Glycine max
  Coding DNA Sequence Number=SeqID_74898
  Gene Ontology: Mol. function=binding; Cellular component=COPI vesicle coat; Biological process=protein transport
  Homolog annotation: Hit_ID=Q8RZX0; Match level="QueryCoverage=97%, HitCoverage=98%, E-value=0.0, Identity=64%"; Hit description =Putative adapter-related protein complex 4 epsilon 1 subunit
  Pfam annotation: Domain name=Adaptin_N; Domain location=41-597; Score= 214.0; E_value=3.4e-61; Accession=PF01602.10; Description=Adaptin N terminal region
  Pfam annotation: Domain name=HEAT; Domain location=118-153; Score =9.6; E_value=2.9; Accession=PF02985.12; Description=HEAT repeat
  Pfam annotation: Domain name=HEAT; Domain location=156-188; Score =12.0; E_value=1.5; Accession=PF02985.12; Description=HEAT repeat
  Pfam annotation: Domain name=HEAT; Domain location=361-393; Score =6.9; E_value=6.1; Accession=PF02985.12; Description=HEAT repeat
  Pfam module annotation: Pfam domain module=Adaptin_N::HEAT::HEAT::HEAT ; Domain location=41-597::118-153::156-188::361-393
MEQLKTIGRELAMGSQGGFGQSKEFLELVKSIGESRSKAEEDRIVLREIETLKRRIAEPDIPKRKMKEYIIRLLYVEMLGHDASFGHIHAVKMTHDDSLLLKRTGYLAVTLLLNDDDDLIILIVNTIQKDLKSDNYLVVCAALNAVCRLISEETIPAVLPSVVDLLAHPKDAVRKKAVMALHRFHHKSPSSVSHLISNFRKKLCDNDPGVMGATLCPLFDLIAVDPSPYKDLVVSFVSILKQVAEHRLPKSYDYHQMPVPFIQIKLLKILALLGSGDKQASEQMYTVIGEIIRKGDSSSNIGNAILYGCICCVSSIYPNAKLLEAAADVNAKFLKSDSHNLKYMGIDALGRLIKISPHVAEQHQLAVIDCLEDPDDSLKRKTFELLYKMTKSSNVEVIVDRMIDYMISISDDHYKTYIASRCVELAEQFAPSNYWFIQTMNKVFEHAGDLVNIKVAHNLMRLIGEGFEEDDNAAYSQLRSSAVESYLRIIGEPKLPSAFLQVICWVLGEYGTADGKYSASYITGKLCDVAEAYSNDETVKAYAVSALTKIYAFEIAAGRKVDLLSECLSFIEELLASHSTDLQQRAYELQALIGLDAQAVETIMPQDASGEDIEVDKNLAFLNQYVQQSLERGALPYIPEDERNGTVNVSNFRSQDQHESAQHGLRFEAYEVPKPPMPSKVAPVSLSSSTDLVPVPEPLYSMETHPMSSVGASETGSSGLKLKLDGVQKKWGRPTYSSPTSSSSTSTSQNSVNGVTQMDVATAVNSKARDNYDTRKQRIEISPEKQKLADKLFGGSTKTDKRSSTSNKVPKASTSAADRTQELKAAAVPSEVAREKTNQQSPPPDLLDLGEPTVTVAPPSVDPFKQLEGLLDPNLSSTTNHSGAAVTNAPDIMALYAETPASRETESGGYSIPVTGDNVNILSELSNAAARGTTGETTATPLSQSVKGPNVKDSLQKDAKVRQMGVTPSATQNGVIPLPGMSKPGKDLF

SEQ ID NO: 191677 - protein, 138 aa, Glycine max
  Coding DNA Sequence Number=SeqID_74899
MAMLQRELEVEGVNKLRWGCNTGGGDQQRKGKEGETTYAHIYGTKTLKGNQEYGKIKLCKIAIETVLAQSRISEQEDEGHHIGHGDKSGRTKGRDLGELASGDYLAFDALIWCGELTCFTLLFLYASKTMLFELGTGD

SEQ ID NO: 191678 - protein, 103 aa, Glycine max
  Coding DNA Sequence Number=SeqID_74900
  Subcellular localization annotation: CTP_CleavageSite=64; ConfidenceScore=5.10e-01
MPKLGVIDVGGGDIVGRWAFILTNYQVKKAFLQVSQTNRLQRAFVLYFTRNFRKITRKGLPLQRCSPAPPLEEVVPAPEADLLFKRCGRPGYFKCPGGYPNLE

SEQ ID NO: 191679 - protein, 890 aa, Glycine max
  Coding DNA Sequence Number=SeqID_74901
  Gene Ontology: Mol. function=oxidoreductase activity, acting on CH-OH group of donors; Biological process=electron transport
  Homolog annotation: Hit_ID=UPI000034F0B9; Match level="QueryCoverage =91%, HitCoverage=100%, E-value=0.0, Identity=53%"; Hit description =electron carrier
  Pfam annotation: Domain name=GMC_oxred_C; Domain location=727-881; Score=-43.9; E_value=0.0042; Accession=PF05199.4; Description=GMC oxidoreductase
  Pfam annotation: Domain name=GMC_oxred_N; Domain location=427-660; Score=296.4; E_value=5.4e-86; Accession=PF00732.10; Description=GMC oxidoreductase
  Pfam module annotation: Pfam domain module=GMC_oxred_C::GMC_oxred_N; Domain location=727-881::427-660
MESNGESHSSRSGSFREGFGLAPNEAKVHTLVELGSVDYTHTTTTTSLLQDGDDDDVGEEREKEQRKPLTNSLSPRQMKSLVALCDTLLPSINNNNVVWGSDDESVANFYKTSASMAGTPEHLGILISEKLKHPSTWLLLLTLWLLSTWFGTFILCGTLSLSTKFPFFHSYPELSLLKRQKVMQSWSLSYLRPLRMFFRTIKLLTLLVFFTQHKGSKSFVEEEWRKIHVKGWAVYILKERLKILKGKLEEWNKVVFGDIHQKRENSLMGLMEDGCWNEEPSELDEAEDNPSWKAIGYCGPDPEFKSQLKNHFFTKQRGQEEKEDDGTEDVRGPLYKGLIRINNPRDIITDSLRRVGFSVSATPKKTKASTLSSPSLVIKCDAVVVGSGSGGGVVAGVLANAGYKVLVLEKGSYSARNNLSLLEGPSMDQMYLSNGLVATNDMSVLILAGSTVGGGSAINWSASIRTPQHVCKEWCDRHELELFESMLYKEALDVVCEKMGVQSEIDDEGFNNAVLRRGCVEMGYPVCNIPRNATSDHYCGWCCLGCKDGRKKGTLETWLVDLVKSGNGAIIPSCEAIQVLHKKKKGRHRKIARGVAFAIEYKGKKDICVVESKVTIVACGALSTPALLKRSGLKNENIGRNLHLHPVAMAWGYFPDSPSPELWPEKHKKSYEGGIMTAMSTVVAQFDKSGYGTVIQTPALHPGMFSILMPWTSGADIKDRMRKFSRTAHVFALARDQGSGTVNSPSCISYQLKDIDKENLKVGLEKVLRILAAAGAEEIGTHNNKGRRINVKQVSYHEFEKFVKEESSMSLTDISTPLCSAHQMGSCKMGTNPRESVVNQMGETWEVEGLYLADSSVFPTALGVNPMVTVQAISYCTAQYVLEVLRRKRK

SEQ ID NO: 191680 - protein, 36 aa, Glycine max
  Coding DNA Sequence Number=SeqID_74902
MGLGDLRRNTIGSEFEEGKVSEFFLIQKLLQILVVL

SEQ ID NO: 191681 - protein, 85 aa, Glycine max
  Coding DNA Sequence Number=SeqID_74903
MKVEQRPIDVVVVSGLPSPVISLKPLQNLKTRKSPDPDPGSERCGGGTTYMLPRHELSENLSQLQWFQKLRSRKGGKSEEEKAKP

SEQ ID NO: 191682 - protein, 111 aa, Glycine max
  Coding DNA Sequence Number=SeqID_74904
PPPCAPQPTPSCLVADQTRPVELAGNFAQKGLRIRPWPSISDLRDPSSAPSQGQDPVICGSTKLGRVAIVTIWEGVLGDIGGFSEMTGDGNPETTTTSIGLLHLIDVLGLS

SEQ ID NO: 191683 - protein, 92 aa, Glycine max
  Coding DNA Sequence Number=SeqID_74905
MPKIARNKSVEVLCLCKISIDSLSAGDSLSEHSVTFEFFRILTRALSGTGLLSPIQKLENPRRFWAQCTGARFVSYAALIGLQLPLSGTWPT

SEQ ID NO: 191684 - protein, 243 aa, Glycine max
  Coding DNA Sequence Number=SeqID_74906
  Gene Ontology: Mol. function=zinc ion binding
  Homolog annotation: Hit_ID=Q6Z1H3; Match level="QueryCoverage=68%, HitCoverage=42%, E-value=2e-43, Identity=57%"; Hit description =Putative DHHC-type zinc finger domain-containing protein
MASEETTIWKAMIKTPASIVLIIYTFISMWFVGGLTAFHLYLISTNQTTYENFRYRYDRRANPYNEGVLNNFKEIFCISIPLSKNNFRAMVPREPALPTRSVGGGFMNQNMRKAGEDIEMGRKTVWDMGAGIDDTEAQINNERVTIKDGELSPEIRTTVDDSDRAGMHPRRSSWGRKSGSWEMSPEVLALAARVGEPNRVGGGGSSSSLAHENRHQNYVQYGGCRHLQGVSFAPVEVAAALSG

SEQ ID NO: 191685 - protein, 112 aa, Glycine max
  Coding DNA Sequence Number=SeqID_74907
MSHSVSWLAYTYSIKCNFREVFGLSAIVSLSETPSANGWGLERKSWVADEDMTKSKGKDPLEGLGRPITRARARKAKEALQQVLSILFEYKPKFQGEKSKVVSCIMAQMEED

SEQ ID NO: 191686 - protein, 253 aa, Glycine max
  Coding DNA Sequence Number=SeqID_74908
  Homolog annotation: Hit_ID=Q6Z1H3; Match level="QueryCoverage=36%, HitCoverage=22%, E-value=4e-42, Identity=81%"; Hit description =Putative DHHC-type zinc finger domain-containing protein
  Pfam annotation: Domain name=zf-DHHC; Domain location=147-227; Score =66.3; E_value=9.7e-17; Accession=PF01529.11; Description=DHHC zinc finger domain
MACLYGGISAFRHVPPSAIDELIRTYPPRSINATHSIIHAPSSIVLGMRGCIVEVSSLTSTKDSAKIEYRSISPIYHAMHPKDILSNPMLMLQSFQVLVLLLLTSGRDPGIIPRNAHPPEPEGLDSNLDVGAGQTPQLRLPRFKEVEVNGIPVKVKYCDTCMLYRPPRCSHCSICNNCVERFDHHCPWVGQCIGLVFKRPGSSIEFPNPKTYPRYQPYLFIGNSSLTITLSNSILLTYSNSLGYKLISILTVL

SEQ ID NO: 191687 - protein, 83 aa, Glycine max
  Coding DNA Sequence Number=SeqID_74909
MEIVYPIAQRLFAMRRGHANLLCIVPILSDVPEGTIHVVAHFIINKNTVLGLLSYFRVAAQLFQGCSKVAAGAAVESQAPLAI

SEQ ID NO: 191688 - protein, 111 aa, Glycine max
  Coding DNA Sequence Number=SeqID_74910
MVPKIPNLEIVSPLSICRENECPIRKKVIWLRKIIKLIIRDRGKIPLRVDQALWIKGREVLFWFSTYIDVCNTLYITIVLIHEINRTLHKAGNMEMLEEEMESPNLKVVEE

SEQ ID NO: 191689 - protein, 38 aa, Glycine max
  Coding DNA Sequence Number=SeqID_74911
MERHCCVAAGEFTFFCLGSHADWEIGIVMVLITEMGKA

SEQ ID NO: 191690 - protein, 48 aa, Glycine max
  Coding DNA Sequence Number=SeqID_74912
MAVMKGGVVRGGAGDGVWKGWVGFGTGISWYKAKMLLPLDPEDDIGTT

SEQ ID NO: 191691 - protein, 279 aa, Glycine max
  Coding DNA Sequence Number=SeqID_74913
  Gene Ontology: Mol. function=nucleic acid binding; Cellular component= intracellular
  Homolog annotation: Hit_ID=Q3YK12; Match level="QueryCoverage=33%, HitCoverage=40%, E-value=4e-23, Identity=52%"; Hit description =SUPERMAN-like zinc finger protein
  Pfam annotation: Domain name=zf-C2H2; Domain location=51-73; Score =20.3; E_value=0.0069; Accession=PF00096.16; Description=Zinc finger, C2H2 type
MERSHSQTQYRMYVKREQHSHLGDYSSWEERAFAEDAARILGGNMWPQRSYSCTFCTRDFKSAQALGGHMNIHQRDRARLKQQNHLSPHHKNHHFIIKSLLGNNKLHFSSAPEISTQLDCGLTHHACYSSSPATTITTTRLFSCISSTQDQNCGHHNFSPSSSNSCSSSIILGHVGSPNSEQEGVVKARDYKFNGLGCSNYVETSLSVGLTSMFGQNSSSPTTVPCGDRSNNSCKRLRSSIVSSLPLFPKPCSNDKSSAFQPVVHGTVEDLDLELRLGK

SEQ ID NO: 191692 - protein, 177 aa, Glycine max
  Coding DNA Sequence Number=SeqID_74914
  Gene Ontology: Mol. function=oxidoreductase activity; Cellular component=membrane; Biological process=potassium ion transport
  Homolog annotation: Hit_ID=Q39224; Match level="QueryCoverage=84%, HitCoverage=42%, E-value=6e-31, Identity=46%"; Hit description=SRG1 protein
MASSINSASCESSEALLSVQELIKKPLTSVPQRYITRLHNHEPSSVQDETLSHAIPTISLKKLIHGGATKTEQEKLNSACKDWGFFQLVEHGISPQVLKTLKDEIEGFFGLPLEEKMKYKIRPDDVEGYGAVIRSEDQKLDWGDRLYMITNPLGRRKPYLLPELPSSLRFVCILSKF

SEQ ID NO: 191693 - protein, 99 aa, Glycine max
  Coding DNA Sequence Number=SeqID_74915
MVWCLQSSFFLLHSAAIDLQEAKDSIDEEDPRPTSSTRSYITIYLRKQHVKKKGKQDRKSKKAYIAWEDNVSTSFDSYSEKEVENVCLMAYSRYDSLTI

SEQ ID NO: 191694 - protein, 1203 aa, Glycine max
  Coding DNA Sequence Number=SeqID_74916
  Gene Ontology: Mol. function=ARF guanyl-nucleotide exchange factor activity; Cellular component=intracellular; Biological process =regulation of ARF protein signal transduction
  Homolog annotation: Hit_ID=Q42510; Match level="QueryCoverage=97%, HitCoverage=80%, E-value=0.0, Identity=72%"; Hit description=Pattern formation protein EMB30
  Pfam annotation: Domain name=Sec7; Domain location=294-481; Score =381.9; E_value=9.6e-112; Accession=PF01369.11; Description=Sec7 domain
MMVDPLSTGIASSTVSDVAATLVDEDTAIASIGKETDLNELQLMNEPYGIPCMVEIFHFLCSLLNVVEHMGMSPQSNTIAFDEDVPLFALTLINSAIELGGPSFHRHPRLLSLIQDELFRNLMQFGLSMSPLVLSMVCSIVLNLYHHLRTELKLQLEAFFSCVILRLAQSKHGASYQQQEVAMEALVDFCRQKTFMVEMYANFDCDITCSNVFEDIANLLSKSAFPVNSLLSSMHILALDGLIAVMQGMAARIGNGSLGSEQFPMNLEEYTPFWQEKCENFSDPNNWVPFVCRRKYFKKRLMIGADHFNRDTKKGLEFLQGAHLLPDKLDPQSVACFFRYTAGLDKNLIGDFLGNHDEFCVQVLHEFARTFDFKDMMLDTALRLFLEAFRLPGESQKIQRVLEAFSERYYDQAQNILANKDAALLLSYSIIMLNTDQHNSQVKKKMTEEDFIRNNRRINGGNDLPRQFLSELYHSICKNEIRTTPKQGSGFPEMTPSRWIYLMHKSEKSAPFIVSDSKAYLDYDMFSILSGPTIAAISVVFDNAENAEVYQTCMDGFLAVAKISAYYHLENILDDLVVSLCKFVTVFDPLSVEESILAFGDDTKARMATETVFTIANRYGDYIRTGWRNILDCILKFHKLGLLPARMASDAAEESELSTETEDGGKRNTNSLSLSRLPSANTPKRSSGLMSRFSQLLYLGAEEPRSEPTEEQLAAQQCTLQTIQKCHIDSIFTESKFLQAKSLLELAKALTSAGVRPKKGNSTSEDEDTSVFCLELLVAITLNNRDRIELLWQGVYEHISNIVQSTVMPCALVEKAVFGLLRICHRLLPYKENITDELLRSLQLVLKLDARVADAYYEQITQEVSHLMKANASHIRSHLGWRTITSLLSITARHLEAAEAGFDALLFIMSDQAHLLPANYVLCVDAAKQFAESRVGQVERSVMALDLMTGSVGCLEKWTNDAKQAAEEEEVAKMLHNIGDMWLRLIHGLKKLCLDQREEVRNHALLSLQNCLTGSVGINLPHSLWLQCFDQVIFSVLDDLLEISQTHSQKDFRNIEGTLVLAMKLLCKVFLQLIQDLSPLPGFNKLWLAVLSRLEIYMKVKVRGRRSEKLQELVPELLKNTLLVMKAGRVLVRSSSVDGSSLWELTWLHIDNFAPLLQSEVFPEQDSEHLQHKQTEKVEGLGADESNSVSSNVTAGKDDPGIG

SEQ ID NO: 191695 - protein, 124 aa, Glycine max
  Coding DNA Sequence Number=SeqID_74917
  Gene Ontology: Mol. function=oxidoreductase activity; Cellular component=proton-transporting two-sector ATPase complex; Biological process=gibberellin biosynthetic process
  Homolog annotation: Hit_ID=Q39224; Match level="QueryCoverage=84%, HitCoverage=30%, E-value=5e-26, Identity=52%"; Hit description=SRG1 protein
  Pfam annotation: Domain name=2OG-FeII_Oxy; Domain location=38-121; Score=61.0; E_value=3.8e-15; Accession=PF03171.10; Description=2OG -Fe(II) oxygenase superfamily
RILEVYIVELQNLAMTFLGLLGKALKIEKREWEVFEDGMQSVRMTYYPPCPQPERVMGLTAHSDATGITILNQVNGVHGLQIKKHGIWIPVNVASDALILNIGDILEVSYLPIIHISFYIHIHA

SEQ ID NO: 191696 - protein, 56 aa, Glycine max
  Coding DNA Sequence Number=SeqID_74918
MHDAIKEQARGLLATMHHQKRKTLDEVSLLSSESETQHDHRLTSTPYGSHRLGYKA

SEQ ID NO: 191697 - protein, 247 aa, Glycine max
  Coding DNA Sequence Number=SeqID_74919
  Gene Ontology: Mol. function=ARF guanyl-nucleotide exchange factor activity; Cellular component=intracellular; Biological process =regulation of ARF protein signal transduction
  Homolog annotation: Hit_ID=Q1SZ26; Match level="QueryCoverage=100%, HitCoverage=99%, E-value=1e-122, Identity=89%"; Hit description =Pattern formation protein emb30-related
MGHVKLQTQTGINAIEEGSGQCKAEYPNKTTVACMINAEIGAVLAVMRRNVRWGVHYMSDDDQLEHSLVQSLKALRRQIFSWQNQWHVISPALYFQPFLDVIQSDETGAPITGVALSSVYKILTLDVIDQNTVNVGDAMHLVVDAVTSCRFEVTDPGSEEVVLMKILQVLLACVKSKASMMLSNQHICTIVNTCFRIVHQAGTKSELLQRIARYTMHELVRCIFSHLQDIDNTELALVNGSTALKEE

SEQ ID NO: 191698 - protein, 306 aa, Glycine max
  Coding DNA Sequence Number=SeqID_74920
  Gene Ontology: Mol. function=hydrolase activity; Cellular component =cytosol
  Homolog annotation: Hit_ID=UPI00006DBC1C; Match level="QueryCoverage =63%, HitCoverage=43%, E-value=7e-38, Identity=41%"; Hit description =COG0402: Cytosine deaminase and related metal-dependent hydrolases
  Pfam annotation: Domain name=DUF606; Domain location=187-299; Score= -17.7; E_value=0.00016; Accession=PF04657.4; Description=Protein of unknown function, DUF606
GWEILREAGVRVNVCPRSDSHYGIESGMFAIEAAQRHGITPGLSVDNETSYSTDMFMEMRVAFYLQRVMGMHKQHCCDSDHSLTTIPAAQLLKSATVDGAFCAGLQDKVGSLTPGKQADLILINAADLNLYPNGNAFGTVVHAAERSNIDTVMIGGRIVKQNGKVLGVDSERLRAAIDESREHLFAAAGYEPDIFAEKFLPLTTLNSQLAKGLGGDPVTAALFSFTAGAFGLGIYSLLRGGLFTSLAAIPSQPVWSLAGGLIGACALFSYVVLAPKIATLITGDRQFWPAGRDKAASLVAEAGRNA

SEQ ID NO: 191699 - protein, 192 aa, Glycine max
  Coding DNA Sequence Number=SeqID_74921
  Homolog annotation: Hit_ID=Q1SDG1; Match level="QueryCoverage=47%, HitCoverage=10%, E-value=1e-10, Identity=32%"; Hit description =Integrase, catalytic region; Zinc finger, CCHC-type
MEEGYSTNKPSLLRGIKYDYCKERVTTHFESIHIDLWEVVENDNYISYDVELNEILRKEYTKVHSFRSAKQMWNTLAITYKGSSQVHEQELQQDEEIKKGKSLALNAQKAKKSSSPKESTSRPSIKGSIKALNVDDSSQGEYEDDKLEKYDQLAFISKKIRRMWKKKGGSNWKGSFKKKSRDMKDRENSSMI

SEQ ID NO: 191700 - protein, 72 aa, Glycine max
  Coding DNA Sequence Number=SeqID_74922
MVKGSIEGFNRRSQGCLLGSMLETETANTLRASENGEGFNRRSQGCLQGSMLKGTMLGLSAVYWGSKEKTIR

SEQ ID NO: 191701 - protein, 792 aa, Glycine max
  Coding DNA Sequence Number=SeqID_74923
  Gene Ontology: Mol. function=microtubule motor activity; Cellular component=microtubule associated complex; Biological process =microtubule-based movement
  Homolog annotation: Hit_ID=Q2HVA4; Match level="QueryCoverage=64%, HitCoverage=56%, E-value=1e-154, Identity=58%"; Hit description =Putative centromere protein
  Pfam annotation: Domain name=Hexokinase_2; Domain location=594-777; Score=-70.8; E_value=1e-07; Accession=PF03727.6; Description =Hexokinase
  Pfam annotation: Domain name=Kinesin; Domain location=1-134; Score= -35.7; E_value=6.2e-12; Accession=PF00225.13; Description=Kinesin motor domain
  Pfam module annotation: Pfam domain module=Hexokinase_2::Kinesin; Domain location=594-777::1-134
MVVRELERKIVQLEQDNKELGDLLKELREAQINNGETGNSQQKTSGAEGERLKEAANINKSLSTLGHVIMILVDVANGKQRHIPYRDSRLTFLLQDSLGGNSKTMIIANVSPSICCAAETLNTLKFAQRAKLIQNNAVVNEDSTGDVIALQHQIRLLKSTLTNKEQEIRELQMELENCYYAIEENHLGLLIFKSELAEAYSKSFRGRADPDKAFDIKENEDMVLISAEQLRVKDKSLKTMAQAAQQHSLLEEELKQQKKNLEESSEGQLILEEQLLQMEYTLQYERSAAFEALEVLEHEIASKNDEICRLNCEVQDWKSTAETLKVSYEEIQGTSKKMKASLLSHIKNEQALKQANENLVCIVKDQERKTEDLLLQIGLLERCNAEKMKEAERCKQEKEGLIQIVEERECCIKDLHKDIAISCLKQESKEKELEDAIHAQLDAEKALKQEKEILLKIKDVKDRTIEHFQWLAIASEQDLLGARCFSFSKQVEKWIEVSVLRDALKNAQYLAKLEIEEKNTRIVKSEESIFHLKQEAEQLQASLEALKFENEKLMDKQQAMEFMITKLKFENGNLLQDIMNLSTEREDMLVHFEVIFGRIGELSSGDMQLMEMLGNVLNTSEDENEIAMGSVVCDKPHESARDSANDLLFPPTTKKTEENIDGRSPLREVESNLSERKTVLEVCETIVKRGGSLAGAGIVGIVQKMEEDQRGLVFGNGKRSVVAIDGGIYENYPQYRAYLQDSVIELLGTEKSNNVVIEHTKDGSGIGAAVLAASNSIGKGDLMEVQDYFFSS

SEQ ID NO: 191702 - protein, 320 aa, Glycine max
  Coding DNA Sequence Number=SeqID_74924
  Gene Ontology: Mol. function=nucleic acid binding; Biological process= DNA integration
MASNNVPLLAPPVFTGKNDEIWVVKMRRQLKAFDLWEAMETTEPPALEENPTVAQIRFLSKQVAKRAKALTILHSVVDDDVFMRISNLDTAREIWEKLQEEFFGNERTKKMEFEALKMNEAKSIKDFMTIMMKVVNQIKLLAEKFLYSRIVEKVFVLLAEKFEPTSFEKASKFEQWNHSMKEMTTIEDNNTWQLVDKLEDKNSIGVKWVYKVKLNLNGSINKYKTKLVVKGYAQQPGIDYVETFSPKQAPRAWYNNIDAYFSSQGFRSENEATLYVKRLLDGGSLIVYVYVDDFLMTSNNQQEVQQLIVEMQNQFQISNL

SEQ ID NO: 191703 - protein, 142 aa, Glycine max
  Coding DNA Sequence Number=SeqID_74925
MRFKVLGSNCQFVKNNIDLTSKKPGKTRAAHRVVVEEVGTLFTGLQTDNIPYPNYLTNKKGNLSLKLSVSKKFHELTAQVSAETDPVSLFPKVVSLLYIQVYHKALQAPGRAISIGISHLKPAGVSHPDFLSIMIAYHTDRT

SEQ ID NO: 191704 - protein, 320 aa, Glycine max
  Coding DNA Sequence Number=SeqID_74926
  Gene Ontology: Mol. function=transaldolase activity; Cellular component=cytoplasm; Biological process=carbohydrate metabolic process
  Homolog annotation: Hit_ID=Q7XJH9; Match level="QueryCoverage=92%, HitCoverage=68%, E-value=1e-116, Identity=68%"; Hit description =Transaldolase
  Pfam annotation: Domain name=Transaldolase; Domain location=14-306; Score=63.8; E_value=5.4e-16; Accession=PF00923.9; Description =Transaldolase
MELKNLSPCLSSRELVEAGKDIESAYWELVVKDIQDTCKLLELIYNETDGEDGHVSLAVSPKLANDTKGTIEAAKWLHNMVGSPCVYMKIPATDESISSMKEVISLGISVNATLIFCLPKYEAVIDAYLDGLESCGMTDLSKVSSAAAFYISRVDVTLDKKLEQIGTTEALDLKGKGAVAQAVLAYQLYQKKFSGPRWERLENRGAKKQRLMWASTNVKNPSYPDTFYVNSLIGPDTISTLPVQVLQAFMDHGILSRTLDAKVSEAQDIYNAIEKLGIDWSSVGSELEHEVLDSFTKSFDNVLECMQKKAMNIYSFQKHV

SEQ ID NO: 191705 - protein, 88 aa, Glycine max
  Coding DNA Sequence Number=SeqID_74927
MMHCYLSMIDPAVVVIGTEHLSSDCSHIHRFHLVYLKTNAKCCRNFIKSLERDFTWPHLQCKKVSFACITDNLLIVMNSKDETWIEVG

SEQ ID NO: 191706 - protein, 130 aa, Glycine max
  Coding DNA Sequence Number=SeqID_74928
MVVSLFLTHLLEVASPITFPASLSAAIDLQEANDSIDEEDPRPTSSTMEPHYQGTSSPNGLISTWEGLKDISSFEENEEANFYPMADRVSEESESDQDDEENLEDPKSPKKAYHELLWNLSILSKAYKNL

SEQ ID NO: 191707 - protein, 145 aa, Glycine max
  Coding DNA Sequence Number=SeqID_74929
MKGTFYPKLVKVFYTCARADMEVWKAVAKLDMVGVQKFEESANGYSKMQTYKGMLIDPTTTLRNHLGVGGLTVEDRMHIVDFTKGSNEITERNLKKLRMRFIEHKWIMTGESPAAANIDQMEEEAKDEAQQEPAHQWSPFESLMI

SEQ ID NO: 191708 - protein, 122 aa, Glycine max
  Coding DNA Sequence Number=SeqID_74930
GHWQLVVLCPATNVVAWFCSLHVDHAIIISSAMKSTNTTADGTNNPATPKWIEVKSHVQSGGYECGYYVMHWMWNIVSGGLKNDWSMWFLDGTVLDNETITTIHQKWAAYFLKVQSNQCTKS

SEQ ID NO: 191709 - protein, 82 aa, Glycine max
  Coding DNA Sequence Number=SeqID_74931
IIVAITCSSAVVKLGAWRICCPLLVLSLEDILVKLMDFSLNLAPVDKLHRLATEAGFELNFLSHFGGNVFPNEKTEDLEFLI

SEQ ID NO: 191710 - protein, 126 aa, Glycine max
  Coding DNA Sequence Number=SeqID_74932
  Gene Ontology: Mol. function=DNA binding; Cellular component=nuclear origin of replication recognition complex; Biological process=DNA replication
  Homolog annotation: Hit_ID=Q852Q8; Match level="QueryCoverage=38%, HitCoverage=6%, E-value=2e-09, Identity=55%"; Hit description=Origin recognition complex3
MSEGLSELVTVQKLWSTAVLCLYEAGKYCRVRLLDLFCEALSQHLYLSRVSDCDVGDEKDCDLSSTNDPRQQYSIMKSGGIIGKIVCKVRDLPTGMLYQLIESWEKLTADVSEWLPTEGQQAKCTH

SEQ ID NO: 191711 - protein, 316 aa, Glycine max
  Coding DNA Sequence Number=SeqID_74933
  Gene Ontology: Mol. function=RNA-directed DNA polymerase activity; Cellular component=chromatin; Biological process=chromatin assembly or disassembly
MAKQRILNHVETRTRLGSGQIAILLRYNKRWAKDRNGQMLERMCPRSTTTKITTKSLEGGKHVTKSRERSSQTDEGRNELGIQGKPDFAFVKDEIALECIIRVGVGIMAKLLSLDRYTCYSKCLNYLSHQILQASMIRKDDEWTAQKVVTPFSNYGGDGVETTLMAVPQASVSKVNKIEKLGVAKTEVVVMKCFNLSKACCAAEFHLADIGHGKAILHHNGVKGPVIYAAPPTSIFLFDEKDKGEKYAKEMDMVGNCSIRGKGIGFTKDVCEVVKDRGDGGEEVGWADIGAIWNRDDILYVWAKRLSCWVLVVIYD

SEQ ID NO: 191712 - protein, 220 aa, Glycine max
  Coding DNA Sequence Number=SeqID_74934
  Gene Ontology: Mol. function=kinase activity
  Homolog annotation: Hit_ID=Q5DK69; Match level="QueryCoverage=52%, HitCoverage=23%, E-value=3e-34, Identity=60%"; Hit description =Pollen-specific kinase partner protein
  Pfam annotation: Domain name=DUF315; Domain location=5-220; Score= -18.2; E_value=1.8e-12; Accession=PF03759.4; Description=Domain of unknown function (DUF315)
MVSGIMTYNGLDNCIPDNRSYGDESRTSRGDGCITDSFNDDDDSSSSSSKDAFGSFSSKCFAMKRDEQELEEWEIAESPQHFYVKDKSAFDVANCSDVEAMKEKFAKLLLGGDVTGGAKGLNTALALSTAITNLAVTVFGELWKLEPLSEERKSKWRREMGWLLSPTNYMVQLVPAKQNGANGGIFEIMTPKARADIQMNLPALQKLDSMLIVGHLFVLI

SEQ ID NO: 191713 - protein, 191 aa, Glycine max
  Coding DNA Sequence Number=SeqID_74935
MRATTIYQDNNAVVAKGSENAKGFRCRRPRQSIETDLRKSVRGRFNGREDVGISVRNKRPLSLCTVISSEVNRLKGILGCGFPPKGGEGRVRMERQGKAENPISQAFKVRKMDEANQDSRAWSIMGHEVKKPLRYIYWYHYKGSRPPKQGTSNLMGGREGNGDGGSLGEVGVGVMVVRRSRMESIFDFSTV

SEQ ID NO: 191714 - protein, 218 aa, Glycine max
  Coding DNA Sequence Number=SeqID_74936
MVIDYQRLISRYHPRYIVGQPPHKPPCFVDFVLLLVDCQELACLGTSQVLTDWLCPSWVGISQAWFWAIVPHLTSPRSPDPRDISPGTTLWSTNKSRKTDSTMLSHIKLIGLWAPIICGTRWRSGDGTNQLSHFYKPGISTPSPVAHLYIELTHSYVALILVPLSTGSPSTPPSFHNIQKIQFHLSRNYPKPRKTEWRQKTLHKAHSNSIVFPTHMPQ

SEQ ID NO: 191715 - protein, 87 aa, Glycine max
  Coding DNA Sequence Number=SeqID_74937
MVVDESEDDDDSNDDGPVEWASYWKPNITINLVADFTHILAFGMLLFFLFTLFEFLTMSLFNRVVYEELGKYGDLDNQVLCVSELRN

SEQ ID NO: 191716 - protein, 232 aa, Glycine max
  Coding DNA Sequence Number=SeqID_74938
  Gene Ontology: Mol. function=guanyl-nucleotide exchange factor activity
  Homolog annotation: Hit_ID=Q93ZY2; Match level="QueryCoverage=75%, HitCoverage=35%, E-value=2e-25, Identity=38%"; Hit description=Rop guanine nucleotide exchange factor 1
  Pfam annotation: Domain name=DUF315; Domain location=1-156; Score= -150.0; E_value=2.3e-07; Accession=PF03759.4; Description=Domain of unknown function (DUF315)
MPMPTIIKDALLKSGKASLGEELHKVLMAESSSGEEMLKALNLSSEHTALETINRLEAATFSWKERIIQENSGKSPVRTSWSFMKDPMAETLLSMLKARYPNLPQTFLDAAKVQFGKDIGHSILEAYSRVLGSLAFSILSRIADILQEDSLSNPNTPISASCSPGINLYEAWVVGSRVRHSLIDKMNEVDGQYCASSCGSTSDIEFSSTHANASNSVPAMPSRGRLWCIGRG

SEQ ID NO: 191717 - protein, 171 aa, Glycine max
  Coding DNA Sequence Number=SeqID_74939
MEQKKRHDGGVDGFDGVEGLEGGGEENDLESHQPHFLSRGGNQTRRGSGVHAPIPRLMWRVDTCLGVPLSKEIVPCQGKLSDVRAASVKLSVMDMPLILQAKCDMSAQKSRTLHVNKDDDFKNQGMSSRMNQEHFKVQKEIRFQESSFKIQVPRIKIQDSRFKNQEKTQSR

SEQ ID NO: 191718 - protein, 759 aa, Glycine max
  Coding DNA Sequence Number=SeqID_74940
  Homolog annotation: Hit_ID=Q41695; Match level="QueryCoverage=26%, HitCoverage=51%, E-value=6e-75, Identity=66%"; Hit description =Pectinacetylesterase precursor
  Pfam annotation: Domain name=PAE; Domain location=11-280; Score =305.4; E_value=1e-88; Accession=PF03283.4; Description =Pectinacetylesterase
MESARISQWLNLLVCVLLLLKAEGSSVPLTLVENAESKGAVCLDGSPPAYHFDKGFGEGIDNWIVHIEGGGWCNNVESCLERKNTRLGSSKQMKDIYFSAILSNEQQFNPDFYNWNRVKVRYCDGSSFTGDVEEVDPTTNLHFRGARIFSAVMEELLAKGMKNAILSGCSAGGLTTILHCDSFKALLPSGANVKCVPDAGADASVVLLRCRSDPCGDTRKRKDFDFWVLFFGALGHWKSGEIVVGVMGSNGSKATSSYLSSSSSSSSGSLRKGRSKGLKVFQSCCLGTTSGSHDSDNEDQVCDQNKVNGSDATYADGNGTDSDEVKAESFRKVKPGAMTCMPSNIGLDGWGETSIPNTSSRTGSSSIHTSSTHSLNPTSHCLSRFSLIPGNVSFRLSRTTSLGSSSPRPVSSANLSIFDNEDEHNLHPGSPGCLINRSVTQQRSNLLPASFFNQIHAQCHEDASNNSRSNVPTSGILGNLQSNSTDGVCTREGPDVNLLSPRSQTATENVDNDTTHIDQRNGAREPVERNFHFSRTLSVGRLRDRVLRRSTLSDLTFFPLQQETELRDASLPSQDMDRQAVEGNSRVSPSDHSTINSSTNRYPPSSMSNSMFSIQDYEGETSGLREGRYQDLLEHRSNFLERRRRIRSQRLGSRFENLSGHDRSCILSGQHRNGHCTCRINNRNTNSNDDTGARASISRIVMLAEALFEVLDEIHHQSVVLSSRPSVSSIGSVPAPNDVVDSLPVKLYEKLHKHQEDAA

SEQ ID NO: 191719 - protein, 257 aa, Glycine max
  Coding DNA Sequence Number=SeqID_74941
MSSFLSDSAIAMGDSDSGGLIQQPLMDWEVIPLTVLPQKILVVVSPTMSPPHRIDTAFHCFQGVCPSYCDPPPSTSEGVGRDSGRGDVKVRDDVLKYKSSLTFAVSIIGLQHQVKLARLEDSCKIFVQACGSDDFPFLRATPSSPPFFFMYRCLFEVLWVTSLGGHLQIRMDLLVVLCHHLLLLLLLEKGVNLLRSSLLKAPLSLRVVRQAVGLTPDVGHRSCVQDMPQAPVAIKAPATNVVVTVTATPPPPPAVPC

SEQ ID NO: 191720 - protein, 728 aa, Glycine max
  Coding DNA Sequence Number=SeqID_74942
  Gene Ontology: Mol. function=transferase activity; Biological process= DNA integration
  Homolog annotation: Hit_ID=Q5Z9R9; Match level="QueryCoverage=38%, HitCoverage=56%, E-value=1e-76, Identity=50%"; Hit description =Putative amino acid transporter
  Pfam annotation: Domain name=Aa_trans; Domain location=319-716; Score= 64.3; E_value=3.9e-16; Accession=PF01490.8; Description=Transmembrane amino acid transporter protein
  Pfam module annotation: Pfam domain module=Aa_trans::RVT_2; Domain location=319-716::236-434
MTPRFDHIVVAIEESKDVEPMMIEELHGSLKANELRLDEMSNEKSVDQALWSQATKKGSAKFSASIVKNGDTLLMTVGMEKASRKEQMIMKAHVVQEDLDSDIVLLMVTNNDDVVQNESWYLDTGCLNHMTNHKEWLTDLDTSRKSKSIKILRTDRGGEYNSNEFDEFYTRNVILHERRPYHNHCRGKAISIVAYLLNKCPTKKLKEKVPKDIWTGRKPIVSHLRIFGSLFFKHGPGQRRRNLEDKNQPIKHKERLVVKGFLQRASLDHSKFVFLNGPLKEEVYVIQPPGFEIKGREDMVYKLKKALYGLKQAPRAWNKRIDAFLVQQYFSKCYIGHGVYVRLQNGGLDQVIICLYVDDLLVIGNNLKEIDDFKFDMMFEFEMIDLGRLSYFLGIEFTNASTRTILHQKKYALEILKRFNMTNCNLVVTPMDANAKLMKGNDDESVNNTLFKQIVGSLRIYIWVEAGKGKSTSLMGGNNIQSSADHNLWNMLIALGNIALASCYSQIAVDIQDTLRSSPPENKVMKKANMIGISTMTVFFQLCACSGYAAFGSETPGNILLSSGFKEPFWLIDIANVFIVVHLVGAYQVIVQPIFGAVETWARERWPSSSFINREYPLIIGRMKFCLSFFRLVWRTIFVAAVTILAMAMPFFNEMLALLGAIGFWPITVYFPVEMYIARKKIKKGAMRWLGLKTLSLVFMLLSLAIAIAAIHGMNQALRKYKPFKYKA

SEQ ID NO: 191721 - protein, 579 aa, Glycine max
  Coding DNA Sequence Number=SeqID_74943
  Homolog annotation: Hit_ID=Q2QYU1; Match level="QueryCoverage=90%, HitCoverage=87%, E-value=1e-115, Identity=45%"; Hit description =Nodulin-like family protein, expressed
  Pfam annotation: Domain name=MFS_1; Domain location=14-504; Score= -11.8; E_value=0.0011; Accession=PF07690.6; Description=Major Facilitator Superfamily
  Pfam annotation: Domain name=Nodulin-like; Domain location=7-253; Score=388.1; E_value=1.3e-113; Accession=PF06813.4; Description =Nodulin-like
  Pfam module annotation: Pfam domain module=MFS_1::Nodulin-like; Domain location=14-504::7-253
  Subcellular localization annotation: CTP_CleavageSite=72; ConfidenceScore=5.28e-01
MAGQSRKWMILVATIWIQAFTGTNFDFSQYSSSLKSALNVSQVQLNYLATANDMGKVFGWSSGIALMHLPVSVVMFVAAFMGFFGYGLQWLLITGVVDLPYFLVFLLCLLGGCSICWFNTVCFVLCIRNFPVNRALALSLTVSFNGISAALYTLVANSIDPSSDALYLLLNALVPLLICIAVLVPILRQPALDPLPPDAVNQDSMIFLILNFIALLTGLYLLLFGSSASGVTSAQLYFGGATLLLIFPLCIPGIVYARAWFRRTIHSSFQMGSSSFILVHDDDLEMHRELHSCHNSIVRNGDTYSLLSDNGYMFGSQREKDSDMCCETMIVQDHLTVLGEEHPVAVVVRRLDFWLYYATYLCGGTLGLVYSNNLGQIAQSLGQRSNTSTLVTLYATFSFFGRLLSAGPDYIRNKIYFARTGWLSISLIPTPVAFFLLAASDSLLTLQTGTALIGLSSGFIFAAAVSVTSELFGPNSVGINHNILISNIPIGSLLYGFLAALVYDANAHSIPGNLITSDSVVCMGRQCYFWTFVCSAVEAGAMLCPGVGSKDAATIYFSVAFGKSSFNKVRHDILKALVI

SEQ ID NO: 191722 - protein, 490 aa, Glycine max
  Coding DNA Sequence Number=SeqID_74944
  Gene Ontology: Mol. function=transferase activity; Biological process= biosynthetic process
  Homolog annotation: Hit_ID=Q5VPB6; Match level="QueryCoverage=93%, HitCoverage=88%, E-value=1e-160, Identity=60%"; Hit description =Glycosyl transferase family 1 protein-like
  Pfam annotation: Domain name=Glycos_transf_1; Domain location=295 -460; Score=74.8; E_value=2.8e-19; Accession=PF00534.10; Description =Glycosyl transferases group 1
  Subcellular localization annotation: CTP_CleavageSite=47; ConfidenceScore=5.37e-01
MALNTTKSKNSTSPSNFYLCTTLFFIVLFTIPVLFLLHAPTTTISICTNPAKTWSGDLQLVEFAWNRLSFFEHKPPPFALKVAVFSRKWPIGTTPGGMERHAHTLHTALARRGHQIHVFTSPPDQDESISISSFSEVNKNNHQSSPYIHFHEGEPGRWHYNKAWEQFVEENKPEPFDVVHSESVALPHWLARNMSNLAVSWHGIALESLQSSIFQDLTRRPDEPMSPLFNKSIQGVVPKVLNEIRFFRNYAHHVAISDSCGEMLRDVYQIPNTRVHVILNGVDEDDFGEDVELGREFRTKIGIPGNASLVIGVAGRLVKDKGHPLLHEAYSRLIAKHPNVYLIVAGSGPWENRYRDLGSQVLVLGSMSPSMLRAFYNAIDIFVNPTLRPQGLDLTLMEAMMSGKPLLASRFPSIKGTIVVDDEYGYMFSPNVESLLEALEAVVKEGPQRLAMQGKASREYAAKMFTARKMALAYERLFLCIKDRTFCTYP

SEQ ID NO: 191723 - protein, 404 aa, Glycine max
  Coding DNA Sequence Number=SeqID_74945
  Gene Ontology: Cellular component=cellulose and pectin-containing cell wall; Biological process=negative regulation of Wnt receptor signaling pathway
  Homolog annotation: Hit_ID=Q41695; Match level="QueryCoverage=99%, HitCoverage=100%, E-value=1e-156, Identity=62%"; Hit description =Pectinacetylesterase precursor
  Pfam annotation: Domain name=PAE; Domain location=11-381; Score =807.0; E_value=1.1e-239; Accession=PF03283.4; Description =Pectinacetylesterase
MESARISHWLNLLVCVLLLLKAEGSSVPLTLVKNSETKGAVCLDGSPPAYHFDKGFGKGINNWIVHIEGGGWCNNVTSCLDRKNTTLGSSNHMSDISFYAILSNQQQFNPDFYNWNRVKVRYCDGSSFTGDVEEVDPTTNLHFRGARIFSAVMEELLAKGMKNAKNAILSGCSAGGLTTILHCDSFKALLPSRANVKCVPDAGYFVNVEDISGAHSFQEFYSEVVSIHGSAKNLPTSCTSKHNPALCFFPQYVASHISTPIFVVNSAYDWWQILLLIQIGNIFVPSSADPSNSWHSCKLNLSNCSPDQLSKLQGFKSEFQRALSEVGDSPSKGMFIDSCYAHCQTETQETWFKSGSQLLANKTIAKAVGDWFYGRSPFHHIDCNFPCNPTCHNRVFQVKDYPGI

SEQ ID NO: 191724 - protein, 133 aa, Glycine max
  Coding DNA Sequence Number=SeqID_74946
  Gene Ontology: Mol. function=RNA-directed DNA polymerase activity; Cellular component=intracellular; Biological process=RNA-dependent DNA replication
  Homolog annotation: Hit_ID=Q1SAS4; Match level="QueryCoverage=99%, HitCoverage=5%, E-value=5e-49, Identity=61%"; Hit description=RNase H, putative
MLEQEDKGLKPHQEETKVVNLGIGEERKKVKVGMGMSTNIRDELVALLRDYQDIFAWSYQDMPGLSSDIVQHRLPLNPECPPIKQKLRRMKPEMSLKIKEEVKKQFEASFLVVAQYPEWVANIVPVPKKDGKV

SEQ ID NO: 191725 - protein, 157 aa, Glycine max
  Coding DNA Sequence Number=SeqID_74947
MFTVIGFSEHLGMKILVVLKRSTGRHKKTPMPMVIVVMSVWKWPLMWKEMKARIGTARVRPPPHAIDVHSKEEKLELLTDMVGVERQIDEPTLQSIIMATIMSHGGKCDEPVAAKASYFEYDHHWIVKKSSMQWESSLKGCLLKPKKKFNMLCIGIM

SEQ ID NO: 191726 - protein, 43 aa, Glycine max
  Coding DNA Sequence Number=SeqID_74948
MESSTTNGKDKERVCSCAGRAVLALSGFPHLVSVAREPSDCTS

SEQ ID NO: 191727 - protein, 164 aa, Glycine max
  Coding DNA Sequence Number=SeqID_74949
  Subcellular localization annotation: CTP_CleavageSite=34; ConfidenceScore=5.30e-01
MARAFLGPTRQTLKKKITLFSSTKQGVSSWLSLYATIVGCLGSSIVSSFTYQMLREPNDILGLGSTSVTIIGSDGTCWWLGPFKAHQVGWCTLLEGVHVALVVPRKVKTSFGAVFCSGIVGIVVLLFGKVGDFGGVVRKGSETRSHDHLVGALDYHEHISVWKS

SEQ ID NO: 191728 - protein, 56 aa, Glycine max
  Coding DNA Sequence Number=SeqID_74950
MSETLVHPGWQQALIYEMHTIKHSEKEIYMEQPPRFVAQGQSGLVCRLKRSFYGLK

SEQ ID NO: 191729 - protein, 78 aa, Glycine max
  Coding DNA Sequence Number=SeqID_74951
MTAAARPCEAATNSVAATNSTTNDGDEQQRHTTARTAVTHSANVVDDDMSEIFRVLVEEPILHLGDLWCLFIGRSTQG

SEQ ID NO: 191730 - protein, 140 aa, Glycine max
  Coding DNA Sequence Number=SeqID_74952
  Subcellular localization annotation: CTP_CleavageSite=52; ConfidenceScore=5.58e-01
MGVKQQKKTNRKNAPSSTTFALCVTAVRAVVCRCCSSPSFVVLLVAATLLVAASQGRAAAVIAAGSGGCWCWVGSGQPNTYRKKTKRPLFRLSRYSAMTCHGYGGRHGTAISNPPRHCYLVTFFQNFITLFRHGAAMAAI

SEQ ID NO: 191731 - protein, 298 aa, Glycine max
  Coding DNA Sequence Number=SeqID_74953
  Gene Ontology: Mol. function=transporter activity; Cellular component= outer membrane-bounded periplasmic space; Biological process=transport
  Homolog annotation: Hit_ID=Q110R7; Match level="QueryCoverage=75%, HitCoverage=56%, E-value=3e-42, Identity=39%"; Hit description =Periplasmic polyamine-binding protein of ABC transporter precursor
MVHALTKFQVYLRRNCEGEIDPKGDIWASPYRWGCMVIAYKTNKFQKHKLAPVEDWADLWRPDLAGRILMVDSPREVVGAVLKYMGASYNTNDINAEVNGGRDVVKHNLALLAKQVRLFDSSNYLKAFGVGDAWVAVGWSSDIIPAAKRMSNVAVVVPKSGVSLWADLWAIPAASRIQTNRIGGRIRGPSPLIHQWIEFCLQSARALPFKQEVIPGASPSHLQGHSANVPVELTKGGPRINGNLVDGAPPPDILERKLLVQINIKRLFGSKEGREGKEGILIKHIVWLRGGLEKGGSP

SEQ ID NO: 191732 - protein, 227 aa, Glycine max
  Coding DNA Sequence Number=SeqID_74954
  Gene Ontology: Mol. function=transporter activity; Cellular component= outer membrane-bounded periplasmic space; Biological process=transport
  Homolog annotation: Hit_ID=Q00SQ2; Match level="QueryCoverage=47%, HitCoverage=24%, E-value=2e-08, Identity=33%"; Hit description =Homology to unknown gene
  Subcellular localization annotation: CTP_CleavageSite=54; ConfidenceScore=5.66e-01
MPQLHYPVTGLCRHPQPSLPTATRFRNQPLPLKVFTRVAVSTVLFLCFGVRMCLASSPPAAAALPTVQDEQTVQDDQDGRKQDNKETVVDKELEEAFNAWKSKTFALTVPLKVVALRGSIPPSWIKDFINSQGRRMKFNVKYYASLENMFSDPSIPFTKGKIGPASALAADIVGIGDSWLKFAINKGIIEPIRDVEDQEWFKSLDDKWKETVPKKDAQYYHIEALLG

SEQ ID NO: 191733 - protein, 80 aa, Glycine max
  Coding DNA Sequence Number=SeqID_74955
MPWIQGQGGFGLLSVGESRRRRRRRGQAHANAEAEKQHGGDGDARKNLEGKGLVPEARGGRKRRLGVATESGDRIMQLRH

SEQ ID NO: 191734 - protein, 132 aa, Glycine max
  Coding DNA Sequence Number=SeqID_74956
  Gene Ontology: Mol. function=hydrolase activity; Cellular component =membrane; Biological process=metabolic process
  Homolog annotation: Hit_ID=UPI00005F7245; Match level="QueryCoverage =69%, HitCoverage=66%, E-value=5e-28, Identity=64%"; Hit description =COG2050: Uncharacterized protein, possibly involved in aromatic compounds catabolism
MAIWKRTVDLATLNQLGDNSLVAHLGIVFTAIGADYLEATMPVDSRTQQPFGLLHGGASVVLAESMGSIAGYLSVEEGKSVVGIEVSASHHRAVSSGEFAADGGGAGVGLGPLRPDALTLPSPTGRGNACAA

SEQ ID NO: 191735 - protein, 96 aa, Glycine max
  Coding DNA Sequence Number=SeqID_74957
FLSGFLVEPITLTYLPSLEVASILTYLPSPEVASNLTYLPLLEVASTQTYLPSPEVASTLTYLPSPEVASSKTSVACIKRSAPTQVHIIWYQSFGS

SEQ ID NO: 191736 - protein, 81 aa, Glycine max
  Coding DNA Sequence Number=SeqID_74958
MVRAGSTKHKHPQDGPKTLVHPPTLDGSECSRRNNQHNAHHCAPITSYLLNQKLESQPHTWHKIPKMHTPLSISYFTFLSR

SEQ ID NO: 191737 - protein, 170 aa, Glycine max
  Coding DNA Sequence Number=SeqID_74959
  Pfam annotation: Domain name=zf-CCHC; Domain location=101-118; Score =12.5; E_value=0.0084; Accession=PF00098.13; Description=Zinc knuckle
FLRPLDQQAQQVVSEPGLSLFENLNADLYVIDLNIWEAIEFDLFIPTMVEKNATIEKHREEDDNDFRFFVKRFNKFLRNKRNQRKSNINPKKKEEDSSLAPKCYEYDQPGHMRFECLVFKRRMEKSDKRNFKEKKACITWEDNNINSSSDSENKIINLGLMGKEYESGEE

SEQ ID NO: 191738 - protein, 104 aa, Glycine max
  Coding DNA Sequence Number=SeqID_74960
MAFMDNWLVGKEEVCYWLSNDIVGPTSILSLAKTKSTKRLSYPNFVRGPLLDDMRPLFGPCKGEDKVEAHAVTAIPIWPSFQPIQQCHYSTDNNPSPYPPRSYP

SEQ ID NO: 191739 - protein, 137 aa, Glycine max
  Coding DNA Sequence Number=SeqID_74961
  Gene Ontology: Mol. function=DNA binding; Biological process=DNA integration
  Homolog annotation: Hit_ID=Q1SIT1; Match level="QueryCoverage=99%, HitCoverage=41%, E-value=1e-31, Identity=49%"; Hit description =Integrase, catalytic region
MSPYRVVFGKACHLLVEIEHKAYSAVKTCNFFMDQASEERKLQLSELDEICLEAYENAKFYKEKTKKSHDSMIIKKDFMVGQKVLLSKWIGPFIVTNVFPYGTVEIKSDSTNKSFKVNGHRLKSFLTNPPLVDVVVE

SEQ ID NO: 191740 - protein, 140 aa, Glycine max
  Coding DNA Sequence Number=SeqID_74962
MHKALRLNAPLPYPQLVTLFFRHFQIPLDSEPYVPIKRSFLIGAAMIASFGYHKERDGSWVKKGVPPADDEGHIPVEDNSTLLQRLMDKFDAMELQVDMRFDAMESRITRVEEDVSFIRTCFDPPPPPPHPLRLYVIILT

SEQ ID NO: 191741 - protein, 48 aa, Glycine max
  Coding DNA Sequence Number=SeqID_74963
MASPKSDKCKCTCRQQTTWVLPQVTLITTQPLINVGIIFLELLLFVLT

SEQ ID NO: 191742 - protein, 93 aa, Glycine max
  Coding DNA Sequence Number=SeqID_74964
MDEYEWIYENIIFEEINMKEDMIEEPIVGENIDCFNAFNTSHVSCVDMILYLVKVFAILEDVLQWACTIAYDIGFVTVTMRSDTSSRKRGMTL

SEQ ID NO: 191743 - protein, 55 aa, Glycine max
  Coding DNA Sequence Number=SeqID_74965
MGFLRQVLTEENFHGLLFNEMTRSKRLLEIQQLREHNKEYDLKNNAAKQQGVKKA

SEQ ID NO: 191744 - protein, 58 aa, Glycine max
  Coding DNA Sequence Number=SeqID_74966
MEIVEGKASGFEEAGEELEMYHEGSTEGADSDLLPMDLLILQQKRRKLIVYRCLLRYL

SEQ ID NO: 191745 - protein, 79 aa, Glycine max
  Coding DNA Sequence Number=SeqID_74967
MSGAKGKKKGASLLSIARRERDTFQKIAQLRNPAYSCSPQPHFLHTETSRNPLRLLALTTSLLGVGLSTKKYNFVAYPN

SEQ ID NO: 191746 - protein, 42 aa, Glycine max
  Coding DNA Sequence Number=SeqID_74968
MAEEVHGKAREIDTMCSIKYPLFWKDLEQHGQILLTSVLYLV

SEQ ID NO: 191747 - protein, 62 aa, Glycine max
  Coding DNA Sequence Number=SeqID_74969
MQFGYMTAQEAYQHNTSHRVISCELALLLSMTYPGLAFKWKWATCQRGYVNTRWNQNCISIA

SEQ ID NO: 191748 - protein, 129 aa, Glycine max
  Coding DNA Sequence Number=SeqID_74970
  Pfam annotation: Domain name=bZIP_1; Domain location=47-107; Score =22.6; E_value=0.00051; Accession=PF00170.11; Description=bZIP transcription factor
  Pfam annotation: Domain name=bZIP_2; Domain location=48-101; Score =21.0; E_value=0.0044; Accession=PF07716.5; Description=Basic region leucine zipper
  Pfam module annotation: Pfam domain module=bZIP_1::bZIP_2; Domain location=47-107::48-101
MENPKENNKVENHHTVNAILSPTFVFSATKLADQFGYAEGNPTPEQQILDPKLRRIFSNRFAAQRSREKKKNHLANLEIQKKTFENEIAQKQQLQDLYENKRQTQIVEEETMYQEIDILKNYSMFKDGN

SEQ ID NO: 191749 - protein, 523 aa, Glycine max
  Coding DNA Sequence Number=SeqID_74971
  Gene Ontology: Mol. function=gamma-glutamyltransferase activity; Cellular component=integral to membrane; Biological process =glutathione biosynthetic process
  Homolog annotation: Hit_ID=Q6D1F1; Match level="QueryCoverage=99%, HitCoverage=98%, E-value=0.0, Identity=70%"; Hit description =Putative gamma-glutamyltranspeptidase
  Pfam annotation: Domain name=G_glu_transpept; Domain location=19-518; Score=538.2; E_value=8.8e-159; Accession=PF01019.11; Description =Gamma-glutamyltranspeptidase
MAPMGMAVTPHHLASESALAVLREGGNALEAMVAAAATIAVVYPHMNGLGGDGFWLVVPPSGDPVAIDASGAAGSLAHPDFYHGESHIPHRGPKAALTVAGTVSGWQEALTLAQELGATPLPLSRLLRDAIRYAADGIPVTASQAAATAAKQHELQHQPGFAATFLPDGAPPTAGSRFTQPALAQTLSVLSEQGLESFYRGELAHHLAREMGALGMPITLDDLHRQRARRCTPLHLAHSEGDIWNMTPPTQGLVSLAILGITDRLAMADASEAQTVHRIVEATKQAFALRDQHITDPRHMAIDVQSLLNADHLGTLAAQVQDDRAAPWGTGRGPGDTVWMGVMDSSGLAVSFIQSIYHEFGSGVVLPGTGITWQNRGAAFSLQPDHLLTLAPGKQPFHTLNPAAARLKDGRTLVYGSMGGDGQPQTQAAIFTRYVIQGQPLQQAVSAPRWLLGRTWGQSSDSLKLEARIAPETVQQLRALGHEVELLAEYSEVVGHAGAIVRHNNGMLEGAFDPRSNGSAAGF

SEQ ID NO: 191750 - protein, 235 aa, Glycine max
  Coding DNA Sequence Number=SeqID_74972
  Gene Ontology: Mol. function=transcription factor activity; Cellular component=intracellular; Biological process=regulation of transcription, DNA-dependent
  Homolog annotation: Hit_ID=Q6D1F2; Match level="QueryCoverage=87%, HitCoverage=73%, E-value=1e-76, Identity=69%"; Hit description =Putative transcriptional regulator
  Pfam annotation: Domain name=HTH_6; Domain location=33-155; Score =27.3; E_value=4e-06; Accession=PF01418.8; Description=Helix-turn -helix domain, rpiR family
  Pfam annotation: Domain name=LacI; Domain location=70-92; Score=15.0; E_value=0.086; Accession=PF00356.11; Description=Bacterial regulatory proteins, lacI f
  Pfam module annotation: Pfam domain module=HTH_6::LacI; Domain location=33-155::70-92
MVKQEPFQFWCYASLDRFMLACDETKVTGPMMKQLDERLRSHYPQLSPQEQRIADFVFDHFDDLISYNSAELARLSGVSKATVSRLFKRLGYEKYKDMRDELRTLRQSGMPLTDNRDAVQGNTLLSRHYKQEMANLTQWVNSIDARQFSEVIAALGTARRVFIIGMRNAYPVALHLRQQLLQARAQVQVLPQPGQTLGEELVDMTPEDVVVVMASRRRPRIIRPLMQQLQQSGIP

SEQ ID NO: 191751 - protein, 104 aa, Glycine max
  Coding DNA Sequence Number=SeqID_74973
MHACLYKTNEVQRPYICSTLHNRLISLVVGQAQIGFELMNPQVFQMISRKDGLESILLNMVYDTWFKITRASSWHGNEIIETENIAVLMLAEGVNSGHILGLLL

SEQ ID NO: 191752 - protein, 197 aa, Glycine max
  Coding DNA Sequence Number=SeqID_74974
  Gene Ontology: Mol. function=hydrolase activity, acting on carbon -nitrogen (but not peptide) bonds, in linear amidines; Cellular component=nucleus; Biological process=metabolic process
  Homolog annotation: Hit_ID=UPI00005F9A02; Match level="QueryCoverage =100%, HitCoverage=47%, E-value=2e-78, Identity=70%"; Hit description= COG0624: Acetylornithine deacetylase/Succinyl-diaminopimelate desuccinylase and related deacylases
  Pfam annotation: Domain name=Peptidase_M20; Domain location=67-195; Score=1.8; E_value=0.0012; Accession=PF01546.18; Description =Peptidase family M20M25M40
MARCDALAAISESEEGLTRVYLSPEQVRANARVAEWMQAAGMHTWQDAVGNICGRYEATEPGAPALLLGSHLDTVRNAGRYDGMLGVLSAIETVQWLHDHQQRLPLAIEIVGFGDEEGTRFGITLLGSRGLTGSWPESWVSHPDGNGITVAQAMQDLGLDAALIPQAAREVSDIVAYLELHIEQGPCLEQDDLALGV

SEQ ID NO: 191753 - protein, 577 aa, Glycine max
  Coding DNA Sequence Number=SeqID_74975
  Gene Ontology: Mol. function=nucleoside-triphosphatase activity; Cellular component=1-2nm peptidoglycan-based cell wall; Biological process=transport
  Homolog annotation: Hit_ID=Q6D1F6; Match level="QueryCoverage=40%, HitCoverage=95%, E-value=1e-110, Identity=86%"; Hit description =Putative amino acid ABC transporter, ATP-binding protein
  Pfam annotation: Domain name=ABC_tran; Domain location=363-548; Score= 230.0; E_value=5.1e-66; Accession=PF00005.17; Description=ABC transporter
  Pfam annotation: Domain name=BPD_transp_1; Domain location=17-225; Score=71.8; E_value=2.2e-18; Accession=PF00528.12; Description =Binding-protein-dependent transport s
  Pfam annotation: Domain name=SMC_N; Domain location=353-552; Score= -100.0; E_value=0.00026; Accession=PF02463.9; Description=RecFRecNSMC N terminal domain
  Pfam module annotation: Pfam domain module=ABC_tran::BPD_transp _1::SMC_N; Domain location=363-548::17-225::353-552
MIGQLNFADLWPHWPELLAGLWVTVQLTVLATVGGVGLGILGAALRSGKPGWASRLWGIYVELIRNTPFVVQLFFIVFGLPNLGLKLTAGEAALLAMLINLGAYSTEIIRAGIQVTPRGQWEAGRVLGLSRTQTFIRVVLPPSLQRIYPALVSQCIIVMLGSSVVSQVSYEELTLSGDHADLSGVVDCHATAAAGAGSQMVWSAAGMTTFTDWDILRNLLLAARWTILLSLVAFFGGTLVTLPLLFLRLLQRHAAADAAVSCLLRRRPVRHRCRALDGSVAGADAVYQRVFTGYLAIRIAIAPTVGFAVQVIKGTALASIIGFVELTKAGTILNNVTYQPFKVQKYYGDNHVLKGVDLDIDNGEVISIIGRSGSGKSTLLRCMNGLEGYQEGSIKLGGMTITDRESQAREISRSVGMVFQNFNLFPHMTALENVMLAPRRVLKKSEAECRTLATQMLEKVGLGERLHYYPANLSGGQQQRVAIARALAMQPKVLLCDEITSALDPELVGEVLKVLEQLAAEGMTLILVTHEMNFARDVGDRVVFMHQGRVWEQGDSKTLFANPQTAELKQFISTVRL

SEQ ID NO: 191754 - protein, 226 aa, Glycine max
  Coding DNA Sequence Number=SeqID_74976
  Gene Ontology: Mol. function=sequence-specific DNA binding; Biological process=regulation of transcription, DNA-dependent
  Homolog annotation: Hit_ID=Q6DA88; Match level="QueryCoverage=56%, HitCoverage=92%, E-value=3e-28, Identity=53%"; Hit description =Putative DNA-binding protein
  Pfam annotation: Domain name=HTH_3; Domain location=170-223; Score =26.1; E_value=0.00012; Accession=PF01381.12; Description=Helix-turn -helix
MMHIISRKVFNEATQRFPNDAAALDATYRLLSGHDFADPQALKAWFPSLDRMKYRAKWWVINVGGNNLRLMFFADFVAKRVFVKHIVTHAEYDKLASNNLIKAVPLLGGSQSRADYEQALELVEYLVEHQPGHPLIEMLAVKVAKYEETAAEFAAFNARTQALPGGVALLRVLMDQHGLNQSSFVAEIGQRSYVNRILKGERRLTDKHKAALARRFNLPFEAFREA

SEQ ID NO: 191755 - protein, 60 aa, Glycine max
  Coding DNA Sequence Number=SeqID_74977
  Subcellular localization annotation: CTP_CleavageSite=48; ConfidenceScore=5.50e-01
MRSRLGNQAFNACGSAKSWPLNSRKQQGRRRCGSRIAGMRLKDYFSVYSSASRQAGKRSR

SEQ ID NO: 191756 - protein, 148 aa, Glycine max
  Coding DNA Sequence Number=SeqID_74978
MENPKENNKVENHHTVNAVLSLAFVFSATKLADEFGDAEAEIEKNKGEVIRERELQVIEQQEELQAHLVNLNIGPQEPVSNYPTSNYYANSYPANEVVPLESYIPPEPSEMQFLAVPNLHEMNFSLPNNMGLMDLTNLTRGTAPNHKP

SEQ ID NO: 191757 - protein, 236 aa, Glycine max
  Coding DNA Sequence Number=SeqID_74979
MKNAFEKKQVRVQLEEEQGRRDFARTAAGRRVRIMRTSMTTLTQTWMTLQLGNVLPRDHNSDLPLPKCQLVYAILTRMSAHVAQVIANAIYLSAGMPPTRHPLDPNKSNRALGFPALITGLCQSFGVPVTPTKEQGDAPQATDAPPPPHQADAAGSLCMERYLQHLVRQQAANHRGQVQIHECLYRFSLSQQGQGFAPFACPTPEQFGAEVAWPGDWPEAQAGEEPAGSPGEAEEA

SEQ ID NO: 191758 - protein, 79 aa, Glycine max
  Coding DNA Sequence Number=SeqID_74980
MKGTKVVIGASSDFSHIKALLLSYYKVKNKSNDLDKSKAEIKSTQRKLKSVGKKKTNTRFLLVRQQPVPTSSPQATTGS

SEQ ID NO: 191759 - protein, 193 aa, Glycine max
  Coding DNA Sequence Number=SeqID_74981
  Gene Ontology: Mol. function=GTP binding; Cellular component=signal recognition particle, endoplasmic reticulum targeting; Biological process=SRP-dependent cotranslational protein targeting to membrane
  Homolog annotation: Hit_ID=Q2Y8Y2; Match level="QueryCoverage=83%, HitCoverage=94%, E-value=2e-34, Identity=50%"; Hit description =Hemerythrin HHE cation binding region
  Pfam annotation: Domain name=Hemerythrin; Domain location=26-81; Score=20.9; E_value=0.0045; Accession=PF01814.13; Description =Hemerythrin
  Pfam annotation: Domain name=Hemerythrin; Domain location=91-144; Score=26.7; E_value=8.1e-05; Accession=PF01814.13; Description =Hemerythrin
  Pfam module annotation: Pfam domain module=Hemerythrin::Hemerythrin; Domain location=26-81::91-144
MRTEATIKSHKQPSATKQSRPVKHDAIVLLKQDHDEVKKMFKQYQKLAQKGDTDGKVLIANKICAELIAHTIAEEEIFYPAARQAIHEDGMFNEAKVEHDSAKDLIAQIQSMTPEDPMYDAKVTVLGEYIEHHVEEEESEMFPMVRKSKKVDLRQMGSLLASRKEEVMQELCDMQGEIDTQQLQAKLGMKAKH

SEQ ID NO: 191760 - protein, 183 aa, Glycine max
  Coding DNA Sequence Number=SeqID_74982
  Gene Ontology: Mol. function=zinc ion binding; Cellular component =integral to membrane
  Homolog annotation: Hit_ID=Q1ZW29; Match level="QueryCoverage=80%, HitCoverage=41%, E-value=1e-26, Identity=33%"; Hit description =Putative paraquat-inducible protein A
STLEDPTHQQQYCKYTIGPKRGAQTDFTDFGQLHQADQGGNHKHIGHHPGMQARKQAGDHDGRATDNQRDNWLVNVHQGDGRLRQFNLRVQPIGIHADKRKGHRNQQAQQCTGRQRNTALYRMQMPPGQHVTTARTAGMFARAQHGNRTDHVASTAGTQEKFHSLPTSEADQSKHLKLAFTRL

SEQ ID NO: 191761 - protein, 234 aa, Glycine max
  Coding DNA Sequence Number=SeqID_74983
  Gene Ontology: Mol. function=sequence-specific DNA binding; Cellular component=intracellular; Biological process=regulation of transcription, DNA-dependent
  Homolog annotation: Hit_ID=P0ACH5; Match level="QueryCoverage=47%, HitCoverage=86%, E-value=6e-26, Identity=52%"; Hit description =Multiple antibiotic resistance protein marA
  Pfam annotation: Domain name=HTH_1; Domain location=131-190; Score =67.8; E_value=3.6e-17; Accession=PF00126.17; Description=Bacterial regulatory helix-turn-helix protein, lysR family
  Pfam annotation: Domain name=HTH_AraC; Domain location=62-105; Score =34.6; E_value=3.5e-07; Accession=PF00165.13; Description=Bacterial regulatory helix-turn-helix proteins, araC family
  Pfam annotation: Domain name=HTH_AraC; Domain location=9-55; Score =53.3; E_value=8.2e-13; Accession=PF00165.13; Description=Bacterial regulatory helix-turn-helix proteins, araC family
  Pfam module annotation: Pfam domain module=HTH_1::HTH_AraC::HTH_AraC; Domain location=131-190::62-105::9-55
MNQREFIRSLLEWIEKNLGHDLHLDEVARRSGYSRWHLQRLFRQHTGFSLAEYIRQRRLTESALTLINSDEAILQVAMSYGFDTQQAYTRTFKNYFRVTPGQLRRQRRVEPDRLLFPLAVAPENMDNSDNLTAMMLFARVVERQSFSEAARMLGVSKSHVSREIARLEVRLGIKLLQRTTRKVVLTELGQAYYPFCTRMLEEMHRADAFVQQVHQQPAGNVRLQAPITFGCQCV

SEQ ID NO: 191762 - protein, 219 aa, Glycine max
  Coding DNA Sequence Number=SeqID_74984
  Gene Ontology: Mol. function=two-component response regulator activity; Cellular component=membrane; Biological process=two -component signal transduction system (phosphorelay)
  Homolog annotation: Hit_ID=Q1LCE1; Match level="QueryCoverage=98%, HitCoverage=98%, E-value=1e-62, Identity=58%"; Hit description=Two component transcriptional regulator, winged helix family
  Pfam annotation: Domain name=Response_reg; Domain location=1-113; Score=111.9; E_value=1.8e-30; Accession=PF00072.14; Description =Response regulator receiver domain
  Pfam annotation: Domain name=Trans_reg_C; Domain location=145-216; Score=69.0; E_value=1.5e-17; Accession=PF00486.18; Description =Transcriptional regulatory protein, C
  Pfam module annotation: Pfam domain module=Response_reg::Trans_reg_C; Domain location=1-113::145-216
MRVLLVEDDEMIGANLQQALEAAGWSVDWVRDGVFASNAWQEGGYTCVLLDLGLPREDGINVLRRARTRGDMTPVLVLTARDTVQQRIQGLDSGADDYLLKPFDLQEVLARMRAITRRRHGAADSLLGNGDVQLDMMTREVLYKGQREQLTAREYALLYALLERPGAILSREQLENRIYGWGEEVTSNAVDVLIHGMRRKLDNEVIRNVRGLGWRVPAI

SEQ ID NO: 191763 - protein, 68 aa, Glycine max
  Coding DNA Sequence Number=SeqID_74985
MVAVLSPSHKVGPQHIMKWLLGLDMLVARKGDNLHIVTLGDDMKVMTRKNMDDPSEPPGLCSMLQRLF

SEQ ID NO: 191764 - protein, 97 aa, Glycine max
  Coding DNA Sequence Number=SeqID_74986
  Gene Ontology: Mol. function=oxidoreductase activity; Biological process=metabolic process
  Homolog annotation: Hit_ID=Q1S775; Match level="QueryCoverage=63%, HitCoverage=12%, E-value=2e-10, Identity=55%"; Hit description =Aldehyde dehydrogenase
MALPLLSAVMHYPFLYVLVWFHVIDLIVVAAKVALSRNKGADWASTSGFVRACYIHAIAAKKKLELAKLKVIDCGKPVDEAAWDIVTSHIPKLLTKP

SEQ ID NO: 191765 - protein, 48 aa, Glycine max
  Coding DNA Sequence Number=SeqID_74987
MSTVQRQMMHKLFIKEIATWRREGDTFGSDPLGMTLGEIEDYKLFMID

SEQ ID NO: 191766 - protein, 59 aa, Glycine max
  Coding DNA Sequence Number=SeqID_74988
MTLSLAHQWAKHVSIAKRRFSATEDLVEHQYQGRALSTVVVFSQAQRTTGAKLKSTYSC

SEQ ID NO: 191767 - protein, 75 aa, Glycine max
  Coding DNA Sequence Number=SeqID_74989
ANRISCARKKRRRHSSDYATNTIEENDDNDVEYHSKELESEPESDEEGNVIEKEKFPPFVPQSSMAIKMGCWFII

SEQ ID NO: 191768 - protein, 198 aa, Glycine max
  Coding DNA Sequence Number=SeqID_74990
  Gene Ontology: Mol. function=oxidoreductase activity; Cellular component=integral to membrane; Biological process=electron transport
  Homolog annotation: Hit_ID=Q9SSX5; Match level="QueryCoverage=97%, HitCoverage=36%, E-value=1e-63, Identity=60%"; Hit description =Cytochrome P450
  Pfam annotation: Domain name=p450; Domain location=1-177; Score= -195.3; E_value=0.044; Accession=PF00067.12; Description=Cytochrome P450
ELVNNPKVLKKAQEEVEKVTGNKRLVCEADISNLPYIHAIIKETMRLHPPIPMITRKGIEDCVVNGNMIPKGSIVCVNIWAMGRDPNIWKNPLEFMPERFLEGEGSAIDTKGHHFELLPFGSGRRGCPGMPLAMRELPTFIGALILCFEWKMFGSQGEILDHGKSLINMDERPGLTAPRANDLIGIPVARLNPTSFPQ

SEQ ID NO: 191769 - protein, 75 aa, Glycine max
  Coding DNA Sequence Number=SeqID_74991
  Gene Ontology: Mol. function=structural constituent of ribosome; Cellular component=ribonucleoprotein complex; Biological process =translation
  Homolog annotation: Hit_ID=Q4WP20; Match level="QueryCoverage=53%, HitCoverage=23%, E-value=3e-13, Identity=90%"; Hit description =Cytosolic large ribosomal subunit L11, putative
  Pfam annotation: Domain name=Ribosomal_L5; Domain location=1-53; Score=44.2; E_value=4.5e-10; Accession=PF00281.9; Description =Ribosomal protein L5
MREMKVQKLVLNISVGESGDRLTRAAKVLEQLSGQTPVFSKVVVGLMNAFKCQIFFRNLMQRFMEELKMRILISV

SEQ ID NO: 191770 - protein, 106 aa, Glycine max
  Coding DNA Sequence Number=SeqID_74992
  Gene Ontology: Mol. function=structural constituent of ribosome; Cellular component=ribonucleoprotein complex; Biological process =translation
  Homolog annotation: Hit_ID=P42795; Match level="QueryCoverage=97%, HitCoverage=48%, E-value=2e-28, Identity=74%"; Hit description=60S ribosomal protein L11-1
  Pfam annotation: Domain name=Ribosomal_L5_C; Domain location=6-90; Score=56.7; E_value=7.4e-14; Accession=PF00673.11; Description =ribosomal L5P family C-terminus
MNFSEGTSVILVASALVFRSISIWESNFNLHILVLERLLCFRYDPSTGIYGMDFFVVLERPGYRVGRRRRCKSRVGIQHRVTKEDAMKWFQVKYEGVILNKSQAIF

SEQ ID NO: 191771 - protein, 108 aa, Glycine max
  Coding DNA Sequence Number=SeqID_74993
MFKEDCKEVSVSSKRLAKKESHFEIKTNIKETSPLRQPPHLLLCKKTLVSTATSLGLEVIPQVKELLDEGLVRKSLNPCALLVPKIGIIRRIISNWAWIRNWAELAWT

SEQ ID NO: 191772 - protein, 84 aa, Glycine max
  Coding DNA Sequence Number=SeqID_74994
  Homolog annotation: Hit_ID=Q1T1Y0; Match level="QueryCoverage=47%, HitCoverage=9%, E-value=6e-08, Identity=67%"; Hit description=Ankyrin
  Pfam annotation: Domain name=DUF1723; Domain location=17-66; Score =46.9; E_value=6.9e-11; Accession=PF08330.1; Description=Protein of unknown function (DUF1723)
MAKFVRPALEIECLVATNGLRLMSAFVERWHKETSSFHLPVGGVTITLDDVALLLHLPNVGAFCRSKLHDDEPNNFDDAKSPSN

SEQ ID NO: 191773 - protein, 73 aa, Glycine max
  Coding DNA Sequence Number=SeqID_74995
MEKCLVKLQTKFRKDPTVNEVWAAFLPRQLHTKFREDPTVNEGWAAFLPRQLHVAFSRSFIKRLPLEASSWLL

SEQ ID NO: 191774 - protein, 53 aa, Glycine max
  Coding DNA Sequence Number=SeqID_74996
MNKGVRVIHLFIVKQVLWACFDRLELGPSSFKNVLLLGYSNGFQVLDVEDASN

SEQ ID NO: 191775 - protein, 90 aa, Glycine max
  Coding DNA Sequence Number=SeqID_74997
MKSANTTAKGTNNPATPKWIEVKSHVQSGGYECGYYVMHWMWNIVSGGLKNDWSMWFLDGTALDNETITTIRQKWVAYFLKVQSNQCTKS

SEQ ID NO: 191776 - protein, 137 aa, Glycine max
  Coding DNA Sequence Number=SeqID_74998
  Homolog annotation: Hit_ID=UPI0000E69BA6; Match level="QueryCoverage =84%, HitCoverage=2%, E-value=6e-22, Identity=47%"; Hit description =flagellin hook IN motif family
IPKLVGYTGPLNGEGYNAIVEVQLISPNESGKGDWTYELTLKAPVNHPVKGVEHSLLVQLDVIVSDGKTTTETKLNVTIEDDAPIAVDMEPVNSILPITAVTNLLLMEVSLPSPQKVLNLRTLLNWLMHMSMVALRG

SEQ ID NO: 191777 - protein, 250 aa, Glycine max
  Coding DNA Sequence Number=SeqID_74999
NQSGPERRWFNPVADVSGSSPLISKRVNLVDTKLYDSTSIFPIRQFDLCYDLSFMDVDKILPSSSTLGWHSLKVNGEVQTKKGLWWIPRHPETRKGVVSDEMLRGVENKRRSGDSRYRSTFRTAAESTGRQETTCRECCTLDGESPVAESITSLRSDPSSMGHVESRVNQQGPPCKAKYSWVTDSEVVPETTGAVAKASLHRAIVTAYGPEPGSEPTDVEESADELWLGVKCHSNPELAGSPRNALRRSS

SEQ ID NO: 191778 - protein, 61 aa, Glycine max
  Coding DNA Sequence Number=SeqID_75000
ENEGGACHLARPGELGCFLQKQPPSGGTSWKAQNLTDCVTMLPFDFRHVMELHRSCNNALV

SEQ ID NO: 191779 - protein, 235 aa, Glycine max
  Coding DNA Sequence Number=SeqID_75001
  Gene Ontology: Mol. function=nucleic acid binding; Cellular component= chromatin; Biological process=DNA integration
  Homolog annotation: Hit_ID=Q1RWN2; Match level="QueryCoverage=98%, HitCoverage=25%, E-value=5e-45, Identity=50%"; Hit description =Peptidase S8 and S53, subtilisin, kexin, sedolisin; Integrase, catalytic region; Zinc finger, CCHC-type
MATIEKNSTWELIDWPKGAKVVGVKWVTRLNSMKREKLTRLKQGCSYGDCTVGNCVRSTKRAPHAWYNRIEAYFVKEGNDESMFTEFKNSIMLEFDMTDLGKMKYFLGLEVLQKSGGIFICQKKYVEEMLQRFGMKQNNSVQTPIVPGFKICKDEGGKQVDKMCFMQMVGCLMYLASTCPDLMFAISLLSRYLEHSTQLHLHLANRVLRYIQGTTEFGIFYKGGSDKLIAYTDSD

SEQ ID NO: 191780 - protein, 151 aa, Glycine max
  Coding DNA Sequence Number=SeqID_75002
  Homolog annotation: Hit_ID=Q1T493; Match level="QueryCoverage=82%, HitCoverage=23%, E-value=2e-12, Identity=27%"; Hit description =Nucleic acid-binding, OB-fold, subgroup
LAELGIEARSGFKSHGEGSTQLLGSIQLSSKESFFGNAEAKTIVEINTISEEIVCVTVDTITRIQLDNHSWCYTACIQCHKKSDAEMAPFTCACGKYNKEVVLRYRLEVMINQGNESTKFLLWDRECSELIGQSADAVNKLKIEVCFWIQP

SEQ ID NO: 191781 - protein, 276 aa, Glycine max
  Coding DNA Sequence Number=SeqID_75003
  Gene Ontology: Mol. function=oxidoreductase activity; Biological process=electron transport
  Subcellular localization annotation: CTP_CleavageSite=63; ConfidenceScore=5.08e-01
TARTFQRQQLAHPAGAAQISASSTFALHALPADGGWHALTSRCALLLPLKAGERLPALTVRLRASSAQTLQVSLLTSDNPANTCGDRLLATHSLQIDAEEAYSLPFDYRAECDRYLFIAFEENPAVEVALTRQRLPGIMMVFNSLNPRVAKRTRQINDGDYGVEEFDFWLPRRAPNQILIAFSLTTPLRLWHCDYLLNGKLRPESHTNGWLPAADDRQPWVCWQWPDAQRASQITLLFDNDFDHAMETVQMGHAQAVTPHCTTHYRLWLDDTLLAE

SEQ ID NO: 191782 - protein, 120 aa, Glycine max
  Coding DNA Sequence Number=SeqID_75004
  Homolog annotation: Hit_ID=Q1RUD8; Match level="QueryCoverage=77%, HitCoverage=20%, E-value=4e-07, Identity=28%"; Hit description=IMP dehydrogenase/GMP reductase
MVSIWDLARVEVSMEPIASLAQYYDQPLRCFIFGDFQLSPMVEEFEEILGCPLGGRKPYLFSGFYPSLARISKKVQILAQELDRQRQVENGVVGIPRKYLERSTFFWPIITTRKVRLSQC

SEQ ID NO: 191783 - protein, 122 aa, Glycine max
  Coding DNA Sequence Number=SeqID_75005
  Gene Ontology: Mol. function=argininosuccinate lyase activity; Cellular component=cytoplasm; Biological process=arginine biosynthetic process via ornithine
  Homolog annotation: Hit_ID=Q2K3P2; Match level="QueryCoverage=100%, HitCoverage=26%, E-value=3e-61, Identity=96%"; Hit description =Argininosuccinate lyase
MADGNTDTKSSNQMWGGRFASGPDAIMEEINASIGFDKKLFAQDIRGSIAHATMLAHQGIISGDDKDKIVHGLNTILSEIESGNFEFSRQLEDIHMNVEARLATLIGSAAGRLHTARSRNDQ

SEQ ID NO: 191784 - protein, 184 aa, Glycine max
  Coding DNA Sequence Number=SeqID_75006
  Gene Ontology: Mol. function=electron carrier activity; Cellular component=integral to membrane; Biological process=cell redox homeostasis
  Homolog annotation: Hit_ID=Q2K3P3; Match level="QueryCoverage=100%, HitCoverage=83%, E-value=3e-64, Identity=67%"; Hit description =Thiol:disulfide interchange protein
  Pfam annotation: Domain name=AhpC-TSA; Domain location=73-183; Score =21.9; E_value=7.7e-06; Accession=PF00578.11; Description=AhpCTSA family
  Pfam annotation: Domain name=Redoxin; Domain location=66-183; Score =6.2; E_value=0.0014; Accession=PF08534.1; Description=Redoxin
  Pfam annotation: Domain name=Thioredoxin; Domain location=75-177; Score=-29.8; E_value=0.045; Accession=PF00085.10; Description =Thioredoxin
  Pfam module annotation: Pfam domain module=AhpC-TSA::Redoxin::Thioredo xin; Domain location=73-183::66-183::75-177
MTTRKPLGLPSLKLISIAAVAGIIAGAAAVYIKETGSGNGGGETASGQCAAAKDLAQKITPLAKGQVAAMVAANEPRKLTTVAFNDADNKPVTLDSFAGKTVLLNLWATWCVPCREEMPALNALEKDMGSDKFQVVAVNIDTGDDEKPKAFLSETGVDSLKLYRDNTIGVFNNLKKEGLAFGLP

SEQ ID NO: 191785 - protein, 187 aa, Glycine max
  Coding DNA Sequence Number=SeqID_75007
  Gene Ontology: Mol. function=ribonuclease H activity; Cellular component=mitochondrion; Biological process=DNA integration
  Pfam annotation: Domain name=rve; Domain location=9-165; Score=49.0; E_value=1.6e-11; Accession=PF00665.16; Description=Integrase core domain
AKAKSGRASASRPHAKQEINVLSAAGRKSNFCRDTYSNGHYFILVTIDYFTKWVEAASYASVTKSVVVRFIKKEIICRNGLPKKIITNNATNLNNKMMKEMCEDFKIQHHNSTPYRPNMNGAVEAANKNIKKIVQKITVSYKDWHEILPFASDLDTHINWGNLVLFGIQDGGCASIRSRGSFIEDSS

SEQ ID NO: 191786 - protein, 203 aa, Glycine max
  Coding DNA Sequence Number=SeqID_75008
  Gene Ontology: Mol. function=identical protein binding; Cellular component=cytoplasm; Biological process=negative regulation of enzyme activity
  Homolog annotation: Hit_ID=O82007; Match level="QueryCoverage=97%, HitCoverage=26%, E-value=2e-64, Identity=60%"; Hit description =Serine protease
MSCPHLSGIAALLKSSHPHWSPAAIKSAIMTSADIINFERKLIVDETLHPADVFATGSGHVNPSRANDPGLVYDIQPDDYIPYLCGLGYSDTQVGIIAHKTIKCSETSSIPEGELNYPSFSVVLGSPQTFTRTVTNVGEANSSYVVMVMAPEGVEVRIQPNKLTFSGENQKEIYSVSFSRIESGNETAEYAQGFLQWSQPNTV

SEQ ID NO: 191787 - protein, 173 aa, Glycine max
  Coding DNA Sequence Number=SeqID_75009
VAEGDTEGPPKGFVGVYHQLLALQWHIRGKAQSRLDCGGEFHASPPRSGVIDILIGSVCHIGWRIVERQAIWREGVLVLNLHIMGAARTSQIFAYHILGWMIHLVDAGWGHQVHLSNNTGCGNCNRIGFHYLLHAHHGLHHCGHLLFHGLHVSLHLLFHTHYSSSSTGSVRAP

SEQ ID NO: 191788 - protein, 105 aa, Glycine max
  Coding DNA Sequence Number=SeqID_75010
MGGEYFRSRVASGGSNPDRLGELGGNLLSLFLINRRKGDVLNIHYPFGYAFQPFWVKKNCFREENPSRGASVTLLRCFRERIREGFSLFFTVLHPFFVRSLFFSG

SEQ ID NO: 191789 - protein, 170 aa, Glycine max
  Coding DNA Sequence Number=SeqID_75011
  Gene Ontology: Mol. function=endonuclease activity; Biological process=regulation of transcription, DNA-dependent
  Homolog annotation: Hit_ID=Q94MV4; Match level="QueryCoverage=61%, HitCoverage=81%, E-value=5e-13, Identity=40%"; Hit description=P15
  Pfam annotation: Domain name=HNH; Domain location=55-105; Score=17.7; E_value=0.041; Accession=PF01844.13; Description=HNH endonuclease
  Pfam annotation: Domain name=NUMOD4; Domain location=2-44; Score=1.4; E_value=0.1; Accession=PF07463.2; Description=NUMOD4 motif
  Pfam module annotation: Pfam domain module=HNH::NUMOD4; Domain location=55-105::2-44
MREIPGFVGYWATEDGQILSRRDGVRELQQRSVDGYMHVTLGVRVRGKKARRRYPVHRLVCLAFHGHPEDGANVTRHLNGVSRDNRAANLKWGTHADNAQDAIRHGTLGEGMRAHRRKLSEVQVREICARYTAGESGRTLAAEFGVHIYYPSQLVRGKTWKHLNRSTGCV

SEQ ID NO: 191790 - protein, 354 aa, Glycine max
  Coding DNA Sequence Number=SeqID_75012
  Gene Ontology: Mol. function=helicase activity; Biological process =protein amino acid phosphorylation
  Homolog annotation: Hit_ID=Q9LTU4; Match level="QueryCoverage=89%, HitCoverage=23%, E-value=4e-74, Identity=47%"; Hit description =Helicase-like protein
  Pfam annotation: Domain name=DUF889; Domain location=124-350; Score =331.7; E_value=1.2e-96; Accession=PF05970.5; Description=Eukaryotic protein of unknown function (DUF889)
MAYDKEMLVEQYNTAYQLLTVNTQSAAVYFMDMVELAKHLFGQPYHLVYAPMVELFVQLLQVELLHCSCLVVGPHIPNFLVPATQNSTCNIHQGSELDELLKALDKSLKDIMQNNLPFGGKIIIFGGDFRQILPIVPKGNRSDIVHATINASYIWDHCQILKLTKNMRLLSNAPQQPNNEELKQFSHWLLDIGDGKIGQYNDGFSEITIPDEFLIKNYDDPIHAIVEATYPSLIDNYSDTDYLQKRAVLASKKEIVEKINDYVLSLIPNHEKEYCSADSIDKSDELLNPAFALLPPEFLYSLQTSGIPNHKLKLKVGTPIMLLRNLDQTDGRCNGTRLIITKLGSNEIGHTYPE

SEQ ID NO: 191791 - protein, 137 aa, Glycine max
  Coding DNA Sequence Number=SeqID_75013
MRSTGRLSKWTNGLHSILVKVENPDESLETSNNSFQNLPHVWHLLLMSVFTCDSPQISASPQQLDLAPYASGPYNAQWNAPGLLHDKHTLRSSRILGEIEVDEPWLGLRLPLNYQVDMGVIEAVPESNKHENAVTKK

SEQ ID NO: 191792 - protein, 73 aa, Glycine max
  Coding DNA Sequence Number=SeqID_75014
MFNDIKEERCLRRRRTRKGGGGNWLNNTNECKWQWRHIRKQKTKVEERRRNTMLLYVVPQTDPILLLDRVTSK

SEQ ID NO: 191793 - protein, 50 aa, Glycine max
  Coding DNA Sequence Number=SeqID_75015
MAIRRTLVREVSHDLNKAPQRQLPTTSARRQQEVAFVVEDIQHVDHAADK

SEQ ID NO: 191794 - protein, 302 aa, Glycine max
  Coding DNA Sequence Number=SeqID_75016
MNILTAHDQEWEQELSSYDQYEEERTPNLETVFEEFMAYHASSKANQSSMKNHEIHFGKSYSIENFHAGPKLQPYYQNEAERGSNMDKLLMKFMETTKSTQQALQSVEIQVGELAEAVTQFMSRREKSFVEAEAQEKSPIKEHESREKDEEKDEEQTQQQWEKYSTVENQQGNILQSNNLPHQLIDKKGRQGEHEETLSAIISLITNTFLEMNWNVLPDYMKFMEFLAKRRNFKEDGFNYLEKGLKNNLEKYFLKNSPFAKRKPRAKRISVHMLSCESQALSTQPLHLRLIWSPKLAKVELS

SEQ ID NO: 191795 - protein, 60 aa, Glycine max
  Coding DNA Sequence Number=SeqID_75017
MEIFLEVMNLDFWRSTFKPKNSNKATGGGALESTKNATVANKEHLNDYLEVRDELLTLGY

SEQ ID NO: 191796 - protein, 273 aa, Glycine max
  Coding DNA Sequence Number=SeqID_75018
  Gene Ontology: Mol. function=protein binding; Cellular component =integral to membrane; Biological process=xylan catabolic process
  Homolog annotation: Hit_ID=Q1SWI7; Match level="QueryCoverage=84%, HitCoverage=90%, E-value=1e-71, Identity=34%"; Hit description =Leucine-rich repeat
  Pfam annotation: Domain name=LRR_1; Domain location=104-126; Score =7.5; E_value=11; Accession=PF00560.23; Description=Leucine Rich Repeat
  Pfam annotation: Domain name=LRR_1; Domain location=128-150; Score =10.5; E_value=3.2; Accession=PF00560.23; Description=Leucine Rich Repeat
  Pfam annotation: Domain name=LRR_1; Domain location=152-175; Score =13.3; E_value=0.88; Accession=PF00560.23; Description=Leucine Rich Repeat
  Pfam annotation: Domain name=LRR_1; Domain location=177-199; Score =10.8; E_value=2.8; Accession=PF00560.23; Description=Leucine Rich Repeat
  Pfam annotation: Domain name=LRR_1; Domain location=201-223; Score =14.5; E_value=0.4; Accession=PF00560.23; Description=Leucine Rich Repeat
  Pfam annotation: Domain name=LRR_1; Domain location=31-54; Score=3.2; E_value=71; Accession=PF00560.23; Description=Leucine Rich Repeat
  Pfam annotation: Domain name=LRR_1; Domain location=7-29; Score=6.8; E_value=15; Accession=PF00560.23; Description=Leucine Rich Repeat
  Pfam annotation: Domain name=LRR_1; Domain location=80-101; Score =9.3; E_value=5.1; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=104-126::128-150::152- 175::177-199::201-223::31-54::7-29::80-101
MWEALSQVLYLNLSRNHIHGEIGTTLKNPISIPTIDLSSNHLCGKLPYLSSDVFQLDLSSNSFSESMNDFLCNDQDKPMLLEFLNLASNNLSGEIPDCWMNWTSLVDVNLQSNHFVGNLPQSMGSLADLQSLQIRNNTLSGIFPTSLKKNNQLISLDLGENNLSGTIPTWVGENLLNVKILRLRSNSFAGHIPSEICQMSHLQVLDLAQNNLSGNIRSCFSNLSAMTLMNQSTDPRIYSQAQSSMPYSSMQSIVSALLWLKGRGDEYRNFLGL

SEQ ID NO: 191797 - protein, 70 aa, Glycine max
  Coding DNA Sequence Number=SeqID_75019
MKRNHEDMKLTLTPTATVAARLTASGSENEESRHGEFVTERNTYMEASCDEEDDMGDNQSCGRDEDMQQT

SEQ ID NO: 191798 - protein, 301 aa, Glycine max
  Coding DNA Sequence Number=SeqID_75020
  Gene Ontology: Mol. function=transporter activity; Cellular component= integral to membrane; Biological process=oligopeptide transport
  Homolog annotation: Hit_ID=Q9M390; Match level="QueryCoverage=96%, HitCoverage=51%, E-value=1e-131, Identity=76%"; Hit description =Peptide transport-like protein
  Pfam annotation: Domain name=PTR2; Domain location=105-301; Score =34.7; E_value=3.3e-07; Accession=PF00854.12; Description=POT family
MGDVTKSHDVGEDSLYTEDGTVDIYKKPAIKKKTGNWKACRFILGNECCERLAYYGMSTNLVNYLQTRFHQGNATAATNVSTWSGTCYITPLLGAFLADSYMGRYWTIASFSTIYVIGMSLLTFSAIAPGLKPSCGANGCYPTSGQTTACFIALYLIALGTGGIKPCVSSFGADQFDENDDFERKKKSSFFNWFYFSINIGSLIASSVLVWIQMNVGWGWGFGVPTVAMVIAVTFFFIGSKWYRLQLPGGSPLTRICQVIVAASRKARLQVPDNKSLLYETADVESNIKGSRKLGHTNELK

SEQ ID NO: 191799 - protein, 113 aa, Glycine max
  Coding DNA Sequence Number=SeqID_75021
MVLIKPPLLQMLRRNRLCLTHTAFPSPLSLHAAVVTSASPCRDLRKLVIERGRKEGKEGEWISRRILLPLATPVNNDLSFHSLLQRFHFHGFLPRRQLQPSFSSTATAASSAF

SEQ ID NO: 191800 - protein, 277 aa, Glycine max
  Coding DNA Sequence Number=SeqID_75022
  Gene Ontology: Mol. function=transporter activity; Cellular component= integral to membrane; Biological process=oligopeptide transport
  Homolog annotation: Hit_ID=Q9LFB8; Match level="QueryCoverage=96%, HitCoverage=47%, E-value=1e-98, Identity=65%"; Hit description =Oligopeptide transporter-like protein
  Pfam annotation: Domain name=PTR2; Domain location=1-206; Score= -22.4; E_value=4.3e-05; Accession=PF00854.12; Description=POT family
SRCLDKAAIETESDHTNWPNSWRLCTVTQVEELKSIIHLLPVWATMIAFATVYSQMSTMFVLQGNKMDQHIGQHFTIPSASLSLFDTLSVIFWAPVYDRMIVPFARKFIGHEQGFTQLQRIGIGLVISIISMIVAGILEVVRLDIIRKNNYYDLETVPLSIFWQVPQYFLIGAAEVFTNIGQMEFFYGEAPDAMRSLCSALQLTTNALGNYVSTLLVLIVTKVTTSHGRIGWIADNLNKGHLDYFYWLLTVLSLLNFLVYLWIAKRYKYKKVTTNTH

SEQ ID NO: 191801 - protein, 126 aa, Glycine max
  Coding DNA Sequence Number=SeqID_75023
MVSNNEVGSQFPIFSTQIGLEGSSTKRRPRVAFAIEEDTHLISSWLNISTNPIVGVGVQKFKDHYKQMILSQRALRGRARARLTDALSKGGKVRVVATNVYLWKTSGKPKETGQNENSKFGSCIYA

SEQ ID NO: 191802 - protein, 147 aa, Glycine max
  Coding DNA Sequence Number=SeqID_75024
MLHAYAIWKEDEGNQSRWLEQFTENYSKRTKIFSFGEYSLSSNLKTRIKDSKAEASSPIVRPVEQKAIKRKSKGKGVGTSTNLVNLTGVEEAMMERNVLNAKLAALREKELEKEYYDILMKDTCTMSKTQLEDHHAFCKIIRRKLGF

SEQ ID NO: 191803 - protein, 125 aa, Glycine max
  Coding DNA Sequence Number=SeqID_75025
  Gene Ontology: Mol. function=transition metal ion binding; Cellular component=nucleus
  Homolog annotation: Hit_ID=Q9SK39; Match level="QueryCoverage=59%, HitCoverage=75%, E-value=6e-18, Identity=60%"; Hit description =Putative steroid-binding protein 3
  Pfam annotation: Domain name=Cyt-b5; Domain location=40-124; Score =16.5; E_value=0.0088; Accession=PF00173.18; Description=Cytochrome b5-like HemeSteroid binding doma
MHSTRRREAQNSRTSKLTFPVSHQRCCNTAVPEKQRVTGKVKWFDDQKGGGHVYDVSIEKSFYSLGGPYAMFAGKDASRALAKMSKNDDDISPSLDDLSDKEIDILNDWENKFQAKYPVVARVLN

SEQ ID NO: 191804 - protein, 61 aa, Glycine max
  Coding DNA Sequence Number=SeqID_75026
MNKGGFLFTPAVEISPTKTGLEDRRNYLAAIYKNALRDILRWFLGTTLECIYMEVYVGSYA

SEQ ID NO: 191805 - protein, 63 aa, Glycine max
  Coding DNA Sequence Number=SeqID_75027
MVMSYKLYIASGHYRNMLKAFSIQSCTQCSYPGYFANKKNNSSISPNHQHKIYPKSKQTQHLT

SEQ ID NO: 191806 - protein, 262 aa, Glycine max
  Coding DNA Sequence Number=SeqID_75028
  Gene Ontology: Mol. function=sugar porter activity; Cellular component=integral to membrane; Biological process=carbohydrate transport
  Homolog annotation: Hit_ID=P0AEP1; Match level="QueryCoverage=54%, HitCoverage=31%, E-value=6e-66, Identity=86%"; Hit description =Galactose-proton symporter
IPPLVLGFLVMAAGMGILGTMLHIGINSAGEQYFAIAMLLMFIVGFAMSAGPLIWVLCSEIQPLKGRDFGITVSTATNWIANMIVGATFLTMLNSLGNAPTFWVYAALNVFFILLTVALIPETKNVSLEHIERNLMSGKKLRDIGQQAALFLSAACAHAVAYPAATPYAAAHENATANAGLSAARHGRRHRVAGAVANSPQPAGASAGVENLRPRTAARQRVEVDDGGRAGRARPPHPPVRHHFGAQQYLPLSLSLPATSAD

SEQ ID NO: 191807 - protein, 124 aa, Glycine max
  Coding DNA Sequence Number=SeqID_75029
MMNKEHRTKNDVEVDYSRDLVAPRPHFLFFLLILSLSSQYPSMLNLGTLYSASLTPIYGKEKGLGGLAAQSGKLMLHSKVTLLAQGKYLYMGACHSVWNSLVTQTDHHERELPVHDRVTSTLAA

SEQ ID NO: 191808 - protein, 58 aa, Glycine max
  Coding DNA Sequence Number=SeqID_75030
  Gene Ontology: Mol. function=ribonuclease H activity; Biological process=DNA integration
  Homolog annotation: Hit_ID=Q1S8I9; Match level="QueryCoverage=91%, HitCoverage=10%, E-value=4e-11, Identity=61%"; Hit description =Probable integrase-common tobacco
MKNAFDKKVRSRKFLEGDLVLKKVSHAVKDNRGKWAPNYEGLSLSRIVLGSGQMPGRV

SEQ ID NO: 191809 - protein, 255 aa, Glycine max
  Coding DNA Sequence Number=SeqID_75031
  Gene Ontology: Mol. function=nucleic acid binding; Biological process= DNA integration
  Homolog annotation: Hit_ID=Q1S4N1; Match level="QueryCoverage=96%, HitCoverage=40%, E-value=1e-18, Identity=43%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKEESSYALGPPPVFYGQEYKLWASRMTTHLEVLDLWKKTMAQMKNHKERKTRKAKAKNYLFSDAHEQRRMMRQEEVVQGVYHMKAQNLRGGKDNKNNKWMNKKPKPSNKQQCETFPPCPHCKKTNHPQSKPEETKVTTEEQEDENWCLIKNAKGKGIFRVKMRAKSYALNLIEDEQIAFSSTTVNAELWHKKLRHFLLVGLLHMQNHALVKDVLMLEDKLVDCVACQYGKQVKKTISSNSLENNSKAATSTYRC

SEQ ID NO: 191810 - protein, 99 aa, Glycine max
  Coding DNA Sequence Number=SeqID_75032
  Subcellular localization annotation: CTP_CleavageSite=23; ConfidenceScore=5.35e-01
MRGGGCTTACPGKLVTSALSFPVAQASQRLAWSSQGLQKSPNVHFALLFGYFPHSFPKCQKTLQIARQLVLSSTIRLARIQMFANDCARTKLGYDSQVG

SEQ ID NO: 191811 - protein, 208 aa, Glycine max
  Coding DNA Sequence Number=SeqID_75033
MEESFVWEIWGPMGFDFKWQLKPFVGVFLVILHPRGCLSAVMFRMEDDINSVTYKGERKRRAISFNNIKSEEFSFFIHNMELLDVLTSGKKFTWISVDGLSMSRLDCFLIFKDLFLGSNISLQWVGSVEAKLHDESTMIQRCFDDNNDDNKSNEQKAQVNQRTSISRIKIQDSSSRIKKNSRLKKKAYKQRFKISRIKIKIQDLKNQD

SEQ ID NO: 191812 - protein, 324 aa, Glycine max
  Coding DNA Sequence Number=SeqID_75034
  Homolog annotation: Hit_ID=Q1SKD7; Match level="QueryCoverage=51%, HitCoverage=42%, E-value=5e-11, Identity=27%"; Hit description =Ankyrin
MPSSRRQWTQLATPMAKYDPEIVMEFYANAWPTEKGIRDKRSWVKGQWIPFDEDVINQFLGHPLVLEEGQRSEFSQRKSQVTGFDEEAISQLLCIPGQDFARSMAGSQVWIMRTSMTTFTQIWMTLELSNILPSDHNSNLLLPKCQLVYAILTQMSIHVAQLISDTIYQFAGITPPRHLVDSEKSNRALGSRAFIEKYCTITARGGPAAVGHRCTAVASIGITILGVHLHSPAEVRAPDTQVQLNETFYRYTMHQQSQNTSPFPWPTLEQFGATVARPGDAPDFETGIGPLGTTRELRRIMIWLTCWISSLEEAELHGRGRQKL

SEQ ID NO: 191813 - protein, 59 aa, Glycine max
  Coding DNA Sequence Number=SeqID_75035
MSCKSEVIISDQMTVQVAWLGVQLPSVGGTRADGDYIADIIVAQEAWDLGPHRIEAHFD

SEQ ID NO: 191814 - protein, 113 aa, Glycine max
  Coding DNA Sequence Number=SeqID_75036
MENAEEMMQQNDEVALVITRTKAYPTSSNGGTAHVDMSRQHQWRYPRLTPCPAAANSGTPCPAIASGGSKLHAIVNGGTHLQKRPPLEFLLKETLLRKMFLKEAPLCKFANFC

SEQ ID NO: 191815 - protein, 237 aa, Glycine max
  Coding DNA Sequence Number=SeqID_75037
MDGPRTKLGYDNNLNTFLEIPMILAEGETLPTYSRYCRLPTDSKEIEASLCILGRGFVLNSEGHPGMILKKDLTTLAQVWSVLTYSNLDPTSHTSDLTVDRARLIFGLVSQMDMNVGALIFGQITFIAQSNSSRLGFPALITILCKAKGVNSDSLVFERLSPVINLAYIKKNCWNPDDLTVSIRGARHARMRPAEPPSTSTTPIIARTSTAPSILAVEAKLHGESRMIQRCFDDNKG

SEQ ID NO: 191816 - protein, 228 aa, Glycine max
  Coding DNA Sequence Number=SeqID_75038
MARDKVDDTYENWKEAEFEIPEASDSKTKKKLLQTIDERLMQFKSDLTRKGALVANQDSVDDTVCEKYGISKEKWAQMCGKKAQAIQTQNTAPHVLSRGGYEYLEQKLLGEKTKKKLEEAEQSGSVDGVIDPLSPVRRLVRWKMARTKKIGEIMIEAAKEIAEKIDSFEEQARHRDPSSPMDVRMFSLLLLDVQSTLDMSVLLGAGVTIKQYFRSAPRTSCNSSSLPS

SEQ ID NO: 191817 - protein, 156 aa, Glycine max
  Coding DNA Sequence Number=SeqID_75039
  Gene Ontology: Biological process=DNA packaging
  Homolog annotation: Hit_ID=Q2T6F9; Match level="QueryCoverage=99%, HitCoverage=98%, E-value=6e-25, Identity=45%"; Hit description =Conserved hypothetical phage protein
MALTGKKRLFAEALLAGKSNKMAALAAGYSAASASAAGSRLAKDKDVLAHLQRKAKAVSAAPPAAADAAAPPAGSFDLSQALSHRDPRAFLLAAMNDALLEPKLRIDAAKALMPFEFAKKGEGGKKEQQADAAKKVASRFAPAAPPKLAASNGRKV

SEQ ID NO: 191818 - protein, 844 aa, Glycine max
  Coding DNA Sequence Number=SeqID_75040
  Gene Ontology: Mol. function=nucleoside-triphosphatase activity; Cellular component=membrane; Biological process=defense response
  Homolog annotation: Hit_ID=Q1SI25; Match level="QueryCoverage=55%, HitCoverage=50%, E-value=0.0, Identity=70%"; Hit description=NB-ARC domain, putative
  Pfam annotation: Domain name=NACHT; Domain location=419-571; Score= -14.2; E_value=0.00073; Accession=PF05729.3; Description=NACHT domain
  Pfam annotation: Domain name=NB-ARC; Domain location=380-677; Score =139.0; E_value=1.2e-38; Accession=PF00931.13; Description=NB-ARC domain
  Pfam annotation: Domain name=TIR; Domain location=28-165; Score =164.1; E_value=3.6e-46; Accession=PF01582.10; Description=TIR domain
  Pfam module annotation: Pfam domain module=NACHT::NB-ARC::TIR; Domain location=419-571::380-677::28-165
MSSSRYDSDLHDDFFREWYQDDNRKYDVFMSFRGKDTRASFTSHLYAALKNAGITVFKDDETLSRGKHISHSLRLGIEQSRISVVVFSRNYAESRWCLQELEKIMECHRTTGQVVLPVFYDVDPSQVRHQKSHFGKAFEKLLNTILKEIGDKWPQVVGWREALHKATHNQRCWKNSHVNLWRKGLCEAGGVPVVVVFSSSGETEIANEISLILKHWREALCKAAGIVLNCSPQPQLRSQHNGYLTVCNCIKTAVTVASAAFSCNCSPQYKDCLTRRNHHSPPEMSATISGSAVLNSSVEMEMANNEIDDLIQSWKDALHKAAGISGVAVLNHRGEMDTSNEINQFVKRWTEALREAASISGVVVQNFKNESEAIKHIVENVTHLLDKTELFVANNPVGVEHRVQEMIQLLDQKQSNDVLLLGMWGMGGIGKTTIAKAIYNRIGRNFDGRSFLAHIREDWGQDSGQVYLQEQLLFDIDKETNAKIRNVESGKIILKERLRHKRVLLILDDVNELDQMNILCGSHEWFGPGSRIIITTRDISILRRGGVDKVYKMKGMNEVESIELFCWHAFKQASPREDFIDLSRNVVVYSGGLPLALEVLGSYLFDMKVTEWESVLEKLKRIPNDQVQKKLKISYYGLSDDTEREIFLDIACFFIGMDRFDVIRILNGCGLFAEIGIFVLVERSLVSVDDKNKLGMHDLLRDMGREIIREKSPKELEERSRLWFRDDVLDVLSKETGTKAIEGLALKLPKANTEKVRTKAFKKMKKLRLLQLAGVELVGDFEYISKDLRWLCWHGFPLTCIPRNFYQGSLVSIQLENSNITILWKEAQVPFMGIMHKLAATITT

SEQ ID NO: 191819 - protein, 63 aa, Glycine max
  Coding DNA Sequence Number=SeqID_75041
  Homolog annotation: Hit_ID=Q1S897; Match level="QueryCoverage=87%, HitCoverage=8%, E-value=7e-09, Identity=52%"; Hit description =Helicase, C-terminal
MAYLLLHMLLQGVLIFLVFMSIEVEEQPELLLKVEVLLKYHQEIHQSLLHCASHFPRGGNRPG

SEQ ID NO: 191820 - protein, 120 aa, Glycine max
  Coding DNA Sequence Number=SeqID_75042
MANNASASLTRSSPTPTSISNFFINDPLFKSLKDVQNQIHCIQGRIYLHEGRKAKLGWCRWGDSTQRWKLNLDRDNETILLDTRDGGKGEAFVDEAGSRERKERDKFFCLYESRGKKMTG

SEQ ID NO: 191821 - protein, 830 aa, Glycine max
  Coding DNA Sequence Number=SeqID_75043
  Gene Ontology: Mol. function=nucleoside-triphosphatase activity; Cellular component=membrane; Biological process=defense response
  Homolog annotation: Hit_ID=Q1SI25; Match level="QueryCoverage=89%, HitCoverage=80%, E-value=0.0, Identity=72%"; Hit description=NB-ARC domain, putative
  Pfam annotation: Domain name=LRR_1; Domain location=526-545; Score =1.3; E_value=1.6e+02; Accession=PF00560.23; Description=Leucine Rich Repeat
  Pfam annotation: Domain name=LRR_1; Domain location=549-570; Score =11.7; E_value=1.9; Accession=PF00560.23; Description=Leucine Rich Repeat
  Pfam annotation: Domain name=LRR_1; Domain location=572-594; Score =4.8; E_value=36; Accession=PF00560.23; Description=Leucine Rich Repeat
  Pfam annotation: Domain name=LRR_1; Domain location=596-618; Score =6.7; E_value=16; Accession=PF00560.23; Description=Leucine Rich Repeat
  Pfam annotation: Domain name=LRR_1; Domain location=620-642; Score =11.1; E_value=2.4; Accession=PF00560.23; Description=Leucine Rich Repeat
  Pfam annotation: Domain name=LRR_1; Domain location=644-666; Score =2.4; E_value=1e+02; Accession=PF00560.23; Description=Leucine Rich Repeat
  Pfam annotation: Domain name=NACHT; Domain location=136-290; Score= -18.9; E_value=0.0017; Accession=PF05729.3; Description=NACHT domain
  Pfam annotation: Domain name=NB-ARC; Domain location=97-393; Score =172.4; E_value=1.1e-48; Accession=PF00931.13; Description=NB-ARC domain
  Pfam module annotation: Pfam domain module=LRR_1::LRR_1::LRR_1::LRR _1::LRR_1::LRR_1::NACHT::NB-ARC; Domain location=526-545::549 -570::572-594::596-618::620-642::644-666::136-290::97-393
MECHRTIGHVVVPVFYDVDPSEVRHQTSHFGNAFQNLLNRMSIDLNSSGEMEMMLNNETNLHGKSWREALREAASISGVVVLDSRNESEAIKNIVENVTRLLDKTELFIADNPVGVESRVQDMIQLLDQKLSNDVELLGIWGMGGIGKTTIAKAIFNKIGRNFEGRSFLAQIREAWEQDAGQVHLQEQLLFDIDKESKTKIPNIELGKNILKERLRHKKVLLILDDVNKLHQLNALCGNREWFGSGSRIIITTRDMHILRGRRVDKVYTMKEMNEDESIELFSWHAFKQPSPREDFTELSRNVIAYSGGLPLALEVLGSYLFDMEVTEWKCVLEKLKKIPNDEVQEKLKISFDGLNDDTEREIFLDIACFFIGMDRNDVIHILNGSELYAENGIRVLVERSLVTVDKKNKLGMHDLLRDMGREIIRVKSPKEPEERSRLWFHEDVLDVLLKESGTKAVEGLTLMLPRSNTKCLSTTSFKKMKKLRLLQFAGVELAGDFKNLSRDLRWLYWDGFPFKCIPADLYQGSLVSIELENSNISHMWKEALLMEKLKILNLSHSHYLTQTPDFSNLPYLEKLILIDCPRLFEVSHTIGHLRDIVLINLEDCVSLRNLPRSIYNLKSLKTLILSGCLMIDKLEEDLEQMKSLTTLIADRTAITRVPFSVVRSNSIGYISLCGYEGFSRDVFPSIIWSWMSPTNNPLCLVESYAGMSSLVSFNVPNSSSSHDLLTISKELPKLRSLWVECNSKLQLSQDTRIILDALHADTNFEEKESSTTTTSHGPNTKTSALIECSNQEHISGSKSSLKSLLIQMGTNCQGSNILKENILQGPKAK

SEQ ID NO: 191822 - protein, 107 aa, Glycine max
  Coding DNA Sequence Number=SeqID_75044
MSEMPKCSTFSSPSKRYRGSYSTGISNKIIDLHTYWCSTSKIYIEIASPLTQGLGSWLRGMSHELDKAMGKDLRVITERSGGAMGPGDSKVRQRNDPGQIAAEVAMV

SEQ ID NO: 191823 - protein, 197 aa, Glycine max
  Coding DNA Sequence Number=SeqID_75045
  Gene Ontology: Mol. function=RNA-directed DNA polymerase activity; Biological process=RNA-dependent DNA replication
  Homolog annotation: Hit_ID=Q2HTR6; Match level="QueryCoverage=78%, HitCoverage=56%, E-value=7e-23, Identity=35%"; Hit description=RNA -directed DNA polymerase
MASGFVTNWRRKKNLLRGLRMNGEWVEEPKEVKEKVDVKMTLDEFHIHSIILGGSNSSFICLVPKVEDPIHLGKYRPISLVGSMYKILAKILARILPKVIDERQSALLSGRSLLHSALVSNEAVDKAKKKKKLLSFQGLRKGDPLTHFLFTIVVEASLSNVKVIKCLIRSFELVSELKDFEPTFCLFGNTDWCQSNT

SEQ ID NO: 191824 - protein, 84 aa, Glycine max
  Coding DNA Sequence Number=SeqID_75046
MHEWHEVGNAWVARYTFRQGEVVNAVWGVAHNSDRGGMVHDGGMKVKGEILKEREIGCEKGKEVHHFTKFCSENTNFDSENRIF

SEQ ID NO: 191825 - protein, 154 aa, Glycine max
  Coding DNA Sequence Number=SeqID_75047
MTCVANSFMNNCGRSKVDQSLYGLLEPQSIHNAKDRREQCQEYIQTWVKESQRQLYLGAYLHQAHWQLFVLCPRENTVVWFCSLRKKPDINIKATINSAMKTITSSFQGMSNQAAPRWVEPKSHVQTGAYECGYYVMHWMWCIVTGGLKDDWNK

SEQ ID NO: 191826 - protein, 56 aa, Glycine max
  Coding DNA Sequence Number=SeqID_75048
  Subcellular localization annotation: CTP_CleavageSite=28; ConfidenceScore=5.08e-01
MAASSSNSSNLVGSITLLQIALKTKHSRVMATRTLTGKIPRIATDYPCGTLSICKQ

SEQ ID NO: 191827 - protein, 157 aa, Glycine max
  Coding DNA Sequence Number=SeqID_75049
  Homolog annotation: Hit_ID=Q9AVH2; Match level="QueryCoverage=29%, HitCoverage=16%, E-value=3e-20, Identity=97%"; Hit description =Putative senescence-associated protein
RQNEREPTNGSLFWPNIVEEERDTGLIGGGDEIKSDKGLNLKWDSWAARPTSATYQYPVAYLKSSAKGFYPPARWELRFKASRRANPPHEGHQRHVPLGGRGPLLLVGKRTAGARVASSPDSDLEAFSHNPTHGSFAPLAFQPSAMTNCANQRFLSY

SEQ ID NO: 191828 - protein, 79 aa, Glycine max
  Coding DNA Sequence Number=SeqID_75050
MTNQKDQQFLQLGKQGGGAAASSDDASEMIIRGGDGGTTSSSGEGGRFTTRVHGSAGIGSTRAGVGSEGAASLVLTNGS

SEQ ID NO: 191829 - protein, 174 aa, Glycine max
  Coding DNA Sequence Number=SeqID_75051
MSSRKRKSIGARPTTQYDTRRFHSFEAWTRYTDNVLGRHILAERKVEIYHMELDEFKDELERCNFHKRLSNLVDSSIDLALVKEFYANLYNPEGPCPKQVKIRGHLIKIDEDSLNTFLEIPVVLAEGESLPAYSSYCRMPTDIREIEAALCIPGRGFGVFSHTPSWLRLPTPRI

SEQ ID NO: 191830 - protein, 111 aa, Glycine max
  Coding DNA Sequence Number=SeqID_75052
MLENPYCRHWNPTEPTLSWLEEKPTYTVATTVLKHSSLLKGQSFLREAPLTCVCCWVLLIKRINHDFCRWIHRGLEIACNCFNILLSNRGGLTVVVLTYFLFLEQVMLKYR

SEQ ID NO: 191831 - protein, 54 aa, Glycine max
  Coding DNA Sequence Number=SeqID_75053
MAGTFFLLKQQNNLENYERLRLSTTCWILYPDDAKAQAVHSTEAMEPDRGAHQD

SEQ ID NO: 191832 - protein, 115 aa, Glycine max
  Coding DNA Sequence Number=SeqID_75054
MAQLLCIPGQDFTQPLQGDQDCAGKTPSGPKEVQRGLGVLALITGLCRFYGVPVAPNKVTRPPINQAFIKKYCAPRQVQGEAPRQPGDDQLLAADALPPPPESTSAHLQRLEHCL

SEQ ID NO: 191833 - protein, 215 aa, Glycine max
  Coding DNA Sequence Number=SeqID_75055
  Gene Ontology: Mol. function=chitin binding; Cellular component =extracellular region; Biological process=chitin metabolic process
  Homolog annotation: Hit_ID=UPI000044A8F0; Match level="QueryCoverage =92%, HitCoverage=99%, E-value=4e-32, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLYILASRGLHVLASRGLHVLAFRGLHALVFKGQHVLAFRGLHVLAFRGLHTLAIRGLCVLDFRGLYVLAFRGMYVLASKGLYALASRGLHALTSRELHALTFRGLCVLAFRGLHVLAFRGLHVLAFRGLHVLAFRGLHALDFRGLHVLAFRGLHVLTFRGLHVLAFRGLHVLAFRGLHVLTFRGLHTLAFIGLHVLAFRWLHIWAFRELKVLRP

SEQ ID NO: 191834 - protein, 117 aa, Glycine max
  Coding DNA Sequence Number=SeqID_75056
MARTKKTGQMTSQAAKEIAEKIESLEEQSSYGFFVAIGRPEHRSRVGVVGVGVTIKKYFGLAPRTSRMSSSMAPEDLEQLMQQIRDQLEESITEKVTQRLMLSFQATVHPEIRAIEI

SEQ ID NO: 191835 - protein, 173 aa, Glycine max
  Coding DNA Sequence Number=SeqID_75057
  Gene Ontology: Mol. function=N-acetyltransferase activity; Biological process=metabolic process
  Homolog annotation: Hit_ID=Q1LS68; Match level="QueryCoverage=93%, HitCoverage=89%, E-value=3e-16, Identity=31%"; Hit description=GCN5 -related N-acetyltransferase
  Pfam annotation: Domain name=Acetyltransf_1; Domain location=66-147; Score=41.2; E_value=3.4e-09; Accession=PF00583.14; Description =Acetyltransferase (GNAT) family
MSIPEVALRPFILQDAEAFTHAVNQSLNSLLPWMVWAHTDYSVDEAVSWINFTHLQRQKGEAEEFAIVDGNDRLLGGAGLRYARQPGEFSALGYWVRSEAQQQGVARRAVAQLVNLAFAQPHITVLEILAAEENHASRAVALRSGFSFVDYRYGLIVLESGPVNTAIYHLRRP

SEQ ID NO: 191836 - protein, 49 aa, Glycine max
  Coding DNA Sequence Number=SeqID_75058
MWDWHKLKGALKLGVFTPKAYTLKSPSGSFPLDSALVIKLVGFPQWIPS

SEQ ID NO: 191837 - protein, 100 aa, Glycine max
  Coding DNA Sequence Number=SeqID_75059
  Gene Ontology: Mol. function=protein methyltransferase activity; Cellular component=cytoplasm; Biological process=protein amino acid methylation
  Homolog annotation: Hit_ID=Q9SNQ2; Match level="QueryCoverage=90%, HitCoverage=23%, E-value=6e-30, Identity=62%"; Hit description =Protein arginine N-methyltransferase protein-like
TSLWNNLHPHQVVGTAGIIKEIDCLTATVADIEKVRSDFSMSITVDNTKLCGFGGWFDVHFRGRSEDPAEQEIELTTAPSVNYGTHWGQQVCAASQLLGG

SEQ ID NO: 191838 - protein, 73 aa, Glycine max
  Coding DNA Sequence Number=SeqID_75060
MNTGTGTYTDRWKSIGTVLYQQILPCDIAATSQRDGIVASNETTQQRRAGDSATTVQRDGASTVQRNGAIVSR

SEQ ID NO: 191839 - protein, 484 aa, Glycine max
  Coding DNA Sequence Number=SeqID_75061
  Gene Ontology: Mol. function=transferase activity; Cellular component= membrane
  Homolog annotation: Hit_ID=Q6Z527; Match level="QueryCoverage=77%, HitCoverage=68%, E-value=1e-141, Identity=62%"; Hit description =Exostosin family-like protein
  Pfam annotation: Domain name=Exostosin; Domain location=114-438; Score=373.2; E_value=3.9e-109; Accession=PF03016.6; Description =Exostosin family
MSEKIMVHSRFIFCVMIISMFLLSLSSIFLLQFSSHSLIPRSALELILVNNASLYFMPNLKREQILLPPSGDSNFQSQKPRESDCHASDLSQKTTSVGQQMNMASHPTRPLLKVFMYDLPPEFHFGLLGWKGSVNQTWPEVDNPERIPRYPGGLNLQHSMEYWLTLDLLSSKVGQPCTAIRVQDSSQADVIFVPFFSSLSYNRHSKLNGQEKVSLNKRLQDRLVQFLMGRKEWKRSGGKDHLIVAHHPNSLLDARRRLGAAMLVLADFGRYPVELANIKKDIIAPYRHLVGTIPRAESASFEKRTTLVYFQGAIYRKDGGAIRQELYYLLKDENDVHFTFGSIGGNGINQASQGMALSKFCLNIAGDTPSSNRLFDAIVSHCVPVIISDEIELPFEDDLDYSDFSIIVHASDAMKKGYLLNLLRSIKRDEWNKMWERLKQITHHFEYQYPSQPGDAVNMIWQQVEHKISSIRFNLHRKNRYQRS

SEQ ID NO: 191840 - protein, 177 aa, Glycine max
  Coding DNA Sequence Number=SeqID_75062
  Gene Ontology: Mol. function=zinc ion binding
  Homolog annotation: Hit_ID=Q69JV9; Match level="QueryCoverage=64%, HitCoverage=55%, E-value=3e-19, Identity=41%"; Hit description=Zinc finger (C3HC4-type RING finger)-like protein
MGEHVVLSVLDPLIAPGTLLPQHGGDGNALGSLIEGATHVNDVKECDTLEEEKEDLIQMVECRICQEDDTLQNLDIPCACSGTLKPFKPGYTANSPVCQPGDTSIGISDDWAISSSPLDLHNARLLAIAALEHQVPETEHEDYVNAGTGGTSLWHSVGLIQSAEELAFMLQAEEQQG

SEQ ID NO: 191841 - protein, 109 aa, Glycine max
  Coding DNA Sequence Number=SeqID_75063
MDTNIVVTKLESCEQKKKRKRSTYPLRKDKSTSVTRAKDQMSLKVQVPTPAVIANPPLQHPLRHELFEQVVIVCDPISEQDLCFSGQKPCMVEKLKSQHKLKQRTLAKS

SEQ ID NO: 191842 - protein, 1176 aa, Glycine max
  Coding DNA Sequence Number=SeqID_75064
  Gene Ontology: Mol. function=RNA-directed DNA polymerase activity; Cellular component=chromatin; Biological process=chromatin assembly or disassembly
  Pfam annotation: Domain name=Chromo; Domain location=1100-1150; Score= 33.6; E_value=6.9e-07; Accession=PF00385.14; Description='chromo' (CHRromatin Organisation MOdifier
  Pfam annotation: Domain name=RVP_2; Domain location=233-366; Score= -53.5; E_value=0.015; Accession=PF08284.2; Description=Retroviral aspartyl protease
  Pfam module annotation: Pfam domain module=Chromo::RVP_2::RVT_1; Domain location=1100-1150::233-366::441-634
MADATRSKANVDRWEDAFAKLSSSMTSKIDELLHRMNQLETSHANPHVPSAFSGPSSTTTADFAYQLKLEVPRFNGSDPKGWIFNITQFFEYHATRDHDRLTIASFYMEGPAHNSHLQLMRILLVIKPTIRREVQVMQPHSLAQAVSFVRLHEEKLLDGRQPSVRPPPTTTMTSLPSRPSPPPATNSPESPLLPSVTKPHSSTIPFKQLSPTELARRREKGLCFNCEEKYSRDKLSAQIILHALSGHGAPKTLRVTGLIANHQVQIFIDGKSTHNFQQEELVSSLNLCPQNTSTLQVMVGNGEELHCHQVCPGVSVHIQKHDFRVDFHVLPIRGADVVLGMQWLKSLGPVLTDYTTLTMKFIYDGKLIELIGDRDMTLDQISPSQLHCLVDTGNTSSYFHIQMDPHTTTSLPLFHPIPTIQTLLTKCPSLFQPLTTLPPSRPTDHTINLLPNTTPVNVQPYRYPYSQKQEIENQVASMLHHGHIQHSSSPFSSPVLLEKKLRDRFPIPTVDELLDELGGVTWFSKLDLMQGYHQILMKDSDTSKTAFRTHHGHYEFRVMPFGLRNALSFQATMNHLFQPYLRKYIIVFFNDILIYSRTLVEHLKHLETAFLVLMDGKFTLKLSKFTLSGKGVQPIPDKVQSIQQWSQLRIARALRGFLGVAGFYRRFIRGYTTMVAPVSRLLTKENFVWSPEADATFQTLNDAVTKSPVLALLDFTKPFMVETDASGADMGAYRAGKTNVVADTLSRSSEPPIASFLILSMPRFVFLEDLHKELQSHAEFVTLREKICANPVAYPDYLLTPHFILHRGCIWLPSYFSFINTLLIEFHQSPIGGHMGFWKTLNRVAENFTWHTMTIDTPIGRPFNGLHSGVAGVPRQHLHPRCRRPFFQGHSFRHASFPPHIAKCGAAALFSLSGTKLRMSSAYHPQTNGQTEWSYNTSTHLATELTPFEVTFGRKPSNFPQYLTGTSKIDAIDDLLSQWESIFALLRQKLLKTQARMKAIADGHRRDHEFQIGEWFLVKLWPYHQTTAWGGTQSKLAKRFYGPFRIIERMGPVAYKLALPENSRIHLVFHCSILKPFVGPLDAERTVDLPPVAVDNQPVPTPLAILAHKTIPSDTGPRQLVLVQWKGLHPDETSWEDWTNLKNIHHLEDKSFEGLRINCIVVPGCMQVRRSSASIF

SEQ ID NO: 191843 - protein, 79 aa, Glycine max
  Coding DNA Sequence Number=SeqID_75065
MEADHMGRVVKSGVPKREGCIIERERRIGQKKGQQWDPSISDVNHLEVGGTCGRKNLRHSHSPHLSILFWAFQIHTRPM

SEQ ID NO: 191844 - protein, 165 aa, Glycine max
  Coding DNA Sequence Number=SeqID_75066
  Gene Ontology: Mol. function=protein serine/threonine kinase activity; Biological process=protein amino acid phosphorylation
  Homolog annotation: Hit_ID=O81637; Match level="QueryCoverage=70%, HitCoverage=16%, E-value=4e-10, Identity=39%"; Hit description =Mitogen activated protein kinase kinase
MECSEFKSMGGAMVDVRNKFFITALAGNLLLGQQIEHYEHNRTIEAKLLHIYDPLVGKKPEALYKVDNTEVRQFVEKCLEIVSLKLSARELLDHPFLQIYDYGFDSKVVQYQRHFYEVNPLIRQPLNGIYNINNKLISGDTDNVGGYGPVSELDYHRDDFEASEI

SEQ ID NO: 191845 - protein, 82 aa, Glycine max
  Coding DNA Sequence Number=SeqID_75067
MVEENVGECLCNGLKQIEGEKQKKVKLDYMKLSKLGLGQQGHEGGEKKCLNSELWHACAGIDALSYICMRYMISLSNHQHRN

SEQ ID NO: 191846 - protein, 329 aa, Glycine max
  Coding DNA Sequence Number=SeqID_75068
  Subcellular localization annotation: CTP_CleavageSite=67; ConfidenceScore=5.34e-01
MGVQIATRPTWALQNIPPEGCCFWRKQPCSPGRAGKSKPRRFRNVSVTFSVRNFAKVFDRSSTFFIRSSIFNGLSSLGTGVWGANTFPVRKYNSRTFHLKVRRSRLFRFFRRFPQINIGGDSARVPFVEHASCESRVALPPKGRLRQDATVFEVFNPDFPLYIKHENLSEITHGGQCLSISVLQLWILFLKPQLIQRSGQSQFESESYIKSWMQRSKCDVYLRAYLNGGHWQMVVIDPNEHLVVWFCLDDAPQPKSKAPARWIVVKCNRQKGSTECGYYVMHWMSTIILGSFRNNWEVYFNDPRPLEPERLKVLRIQWAQYYLRVRDQT

SEQ ID NO: 191847 - protein, 114 aa, Glycine max
  Coding DNA Sequence Number=SeqID_75069
MDYHRDDFEASEIGLFGCEEDDNLAEVDTTIKGRREDDGIFLTLRIADKEDFNILIRRGTRKEVKDNISTNVRGPFKGTRHLSYHISLWRDTARDSVKCRQNNSPTHQILDKAS

SEQ ID NO: 191848 - protein, 69 aa, Glycine max
  Coding DNA Sequence Number=SeqID_75070
MKTVPAVRSLPSTIPPCRPERDMVKVFGITTEEPWWRKVVGMERISKQPWKVTMVTVASALSPLGVKEG

SEQ ID NO: 191849 - protein, 127 aa, Glycine max
  Coding DNA Sequence Number=SeqID_75071
MLCGAKSSKTLLRKEGRFEYGDSLRKPSSELLDDHEWCTPNSHPKPSCVRPSSSESSNDSWPDHIKGKESTLHLDNECTWGRRIPNVTRGVDHFLGCTEVVLVTILKENTYVHAYTRIHTNTHAHTL

SEQ ID NO: 191850 - protein, 511 aa, Glycine max
  Coding DNA Sequence Number=SeqID_75072
  Gene Ontology: Mol. function=nucleic acid binding; Cellular component= intracellular; Biological process=DNA integration
  Homolog annotation: Hit_ID=Q1SEE1; Match level="QueryCoverage=100%, HitCoverage=50%, E-value=1e-162, Identity=51%"; Hit description =Integrase, catalytic region; Zinc finger, CCHC-type; Peptidase aspartic, catalytic
MVENELKIKKLRFDNGDEYLDTRFKKFCYEHGIRMERTVPNMLQHNGVAEHMNQTLIERARSVCLQSGLPKQLWAKAVNITTYLINQGPSVGICLIPNQRSALSSVMVKMSLTTAYGIMKNKKMIHSRDVIFNERLMYKDKDNTNTSNSEQSGPVYAEVDDVPETPMIETPQLEESIKNNNEQQVDTPEPSTLAPVLRSKLELAMKDEMKSLISNQIWELAELPMGKKALHNKWERVDYTEIFAPVVKFNTIKFVLSIVANEVLYLEQLDVKTAFLHGDLDEEIFVHQLEGFSKEGKKNMVCRLKKSLYGLKQALRQWYKKFESFAHKETGSNMDEIKNLKLQLQLLKEFDMEDLGLAKKILGMQIMRDNQREVLQLSQVEYINRVLQRFNMGNTKPMSTPLASHFRLSKDQSPQIEEEKEFMAKVLYASTIGSLMYTMVCTRPYIGLGVGVVNRFMSTPGELKVQGYIDANFTSEVDDRRSTTSCIFTVGTIAVSWISRVQKIVALSTTE

SEQ ID NO: 191851 - protein, 85 aa, Glycine max
  Coding DNA Sequence Number=SeqID_75073
  Gene Ontology: Mol. function=nucleic acid binding; Biological process= DNA integration
  Homolog annotation: Hit_ID=Q1SEE1; Match level="QueryCoverage=96%, HitCoverage=6%, E-value=4e-33, Identity=79%"; Hit description =Integrase, catalytic region; Zinc finger, CCHC-type; Peptidase aspartic, catalytic
MNKEESWVLDSGASFHATSQKELFENYVPENLGKIYLDNEQSCEIVAKGKVEIKLNGFVWELKNVRHILNLTKNLISIGQLANDD

SEQ ID NO: 191852 - protein, 351 aa, Glycine max
  Coding DNA Sequence Number=SeqID_75074
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q1SJP8; Match level="QueryCoverage=85%, HitCoverage=18%, E-value=7e-43, Identity=32%"; Hit description=D -galactoside/L-rhamnose binding SUEL lectin; Integrase, catalytic region; ...
  Homolog annotation: Hit description=Galactose-binding like; Peptidase aspartic, catalytic
METPTIGVLKQEEENSLLAKLTTRMTQALNLNQTQSQSSSSEVAIQIGIKLDGTNYALWSQIVEMYISGKDKLRYINGDLPEPPQTNPAFKKWRTKNAVVKGWLINSMDLKLVSNFIRFLMAKAVWDSIATTYFNGGDTSQVYDLKRRVTRLKQGDKSIETYYNNLQGLWREIDFCRPNPMLCDADIQRYNLILQEDKVYTFLDGLDDRLDKIRVDVLQMQPFPTVEQAYALGISLQMTLNGKPTTKSQSQGEEEGCKHCGNMKHAKETCFKLHGYPDWWHELKEKKKHESSGGNNSGHATLISGNHDNWIIDSGAIDHMTFDPHEFSKISQPKRICTANANGVTYLVIGA

SEQ ID NO: 191853 - protein, 96 aa, Glycine max
  Coding DNA Sequence Number=SeqID_75075
  Gene Ontology: Mol. function=ATPase activity, coupled to transmembrane movement of substances; Cellular component=integral to membrane; Biological process=transport
  Homolog annotation: Hit_ID=Q1SGX0; Match level="QueryCoverage=96%, HitCoverage=7%, E-value=6e-21, Identity=57%"; Hit description=Cyclic peptide transporter
MGILVANALMWKLVQLLGNQVTCGTNKGEDQMKFLKGFSGDVKENYEEASKVANDVVGIIKTIASFCAESKVMDIYRKKCLESEKQGVKLGLVSGT

SEQ ID NO: 191854 - protein, 130 aa, Glycine max
  Coding DNA Sequence Number=SeqID_75076
  Subcellular localization annotation: CTP_CleavageSite=22; ConfidenceScore=5.13e-01
MSLFQGVFKGSVKTSNNGSQVRRDAKIGSNRQGEGLESRLPRRNREGRIGGFILYRILMLSFEDSAPIKLFFSVRRSLGMLGEGLGENKEEEDDSFKLLDVFEACNTRSSEFGLPGRADPASILLLRLKQ

SEQ ID NO: 191855 - protein, 606 aa, Glycine max
  Coding DNA Sequence Number=SeqID_75077
  Gene Ontology: Mol. function=DNA binding; Cellular component=beta -galactosidase complex; Biological process=DNA integration
  Homolog annotation: Hit_ID=Q1SS89; Match level="QueryCoverage=59%, HitCoverage=77%, E-value=2e-56, Identity=45%"; Hit description =Integrase, catalytic region
MDVTFIESENFFTFQSSHSSRQWEMMSEEQNWEDWSGFKASKDVGVEVIAKIEESAETESEQPLLVEAKTESEQPFHDLTVTQSESPENISEVQVLNTPQNIFVGYKLPFRHNRGQPPNRYSSDHGTSKSKHPIANYVSTHKLSEPLKALVYNLSADDVPYTVNEAMKNPKWIQAIEEEMKAWIVERYKVRLVAKGFTQTYGIDYQETFSPVAKLNTIRVLISLATNMDWLLYQFDVKNAFLHGDLEEEVYMDIPPDWAGSITDRKSTSGYLTFVGGNLVSWRSKKQKVVALSSAEAEFRAAIAIAHNPVQHDRTKHVEVDRHFIKEKLEDKIIQFPFVKSEDQLADILAKVVSSKIFHNSLDKHRHFQTIVVAPNTNKAKDSATSIFKILDSKPTINSSTNEALPLASVSSSELKTLVVPSAYAYMHAVAKQMQSTTSGAVKDVNYYICLVKEHARNLAYTSELQRIAVMVLIALFRHDMPNQWEAEPIFFNESICANIAYAKEGGATEEEIIAAAEATNAQEFIGSLPNGLDLLATTGVPIWLTEPSVDPAQYLKKILRETYSYPTVEGIIMFFGPAQVGFNGTTLTDETFKNTPAGDVVDKLI

SEQ ID NO: 191856 - protein, 143 aa, Glycine max
  Coding DNA Sequence Number=SeqID_75078
VIGVVEEVVFRQVSGKASNCYLALCGMIIACSFFKFLDDYEGDGPITVLLSHCRIKEAQGSYPASISNSFKASKLIINQPVIEIQEFNERYFLYSWALRPGQVLNPMVKGVHSFQVLSNYHQKNHSLARLRQRLLLTLTPSLK

SEQ ID NO: 191857 - protein, 243 aa, Glycine max
  Coding DNA Sequence Number=SeqID_75079
MVRKEQSKEGALQALIKDLGGRTTMSRRVTRLTTTTKIGIGFIHHVHTTKRGITHKEMLDIDQNLLSVGKLIEKGFAVIFENMRYIQSANEGKKLCSNSNGGRTKSILSTCNLYFVYLGLSAMVAFMGNPISNPILLYFFTTKALLNSAPQGYQNRESMQTRESSVDSTHKLKEELEHYANTMKFLKFSPRLAASLKLVVDLVGRGSWYSQLPTEPGNHRTALSGLASSCLALSRRLNSSNSS

SEQ ID NO: 191858 - protein, 355 aa, Glycine max
  Coding DNA Sequence Number=SeqID_75080
  Gene Ontology: Mol. function=protein kinase activity; Cellular component=integral to membrane; Biological process=protein amino acid phosphorylation
  Homolog annotation: Hit_ID=Q2QWU6; Match level="QueryCoverage=97%, HitCoverage=48%, E-value=3e-79, Identity=39%"; Hit description =Leucine Rich Repeat family protein, expressed
  Pfam annotation: Domain name=LRR_1; Domain location=116-135; Score =10.9; E_value=2.6; Accession=PF00560.23; Description=Leucine Rich Repeat
  Pfam annotation: Domain name=LRR_1; Domain location=138-161; Score =10.0; E_value=3.9; Accession=PF00560.23; Description=Leucine Rich Repeat
  Pfam annotation: Domain name=LRR_1; Domain location=163-185; Score =16.6; E_value=0.092; Accession=PF00560.23; Description=Leucine Rich Repeat
  Pfam annotation: Domain name=LRR_1; Domain location=187-209; Score =10.5; E_value=3.1; Accession=PF00560.23; Description=Leucine Rich Repeat
  Pfam annotation: Domain name=LRR_1; Domain location=211-233; Score =8.7; E_value=6.7; Accession=PF00560.23; Description=Leucine Rich Repeat
  Pfam annotation: Domain name=LRR_1; Domain location=22-44; Score =12.7; E_value=1.2; Accession=PF00560.23; Description=Leucine Rich Repeat
  Pfam annotation: Domain name=LRR_1; Domain location=235-257; Score =13.0; E_value=1.1; Accession=PF00560.23; Description=Leucine Rich Repeat
  Pfam annotation: Domain name=LRR_1; Domain location=259-281; Score =14.3; E_value=0.46; Accession=PF00560.23; Description=Leucine Rich Repeat
  Pfam annotation: Domain name=LRR_1; Domain location=283-304; Score =5.9; E_value=23; Accession=PF00560.23; Description=Leucine Rich Repeat
  Pfam annotation: Domain name=LRR_1; Domain location=329-351; Score =14.2; E_value=0.47; Accession=PF00560.23; Description=Leucine Rich Repeat
  Pfam annotation: Domain name=LRR_1; Domain location=46-68; Score =17.4; E_value=0.05; Accession=PF00560.23; Description=Leucine Rich Repeat
  Pfam annotation: Domain name=LRR_1; Domain location=92-115; Score =12.9; E_value=1.1; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1; Domain location=116-135::138-161::163-185::187-209::211-233::22-44::235 -257::259-281::...
  Pfam module annotation: Domain location=283-304::329-351::46-68::92 -115
MLCFLSITLVEKIPDELLSYENLTKVDFRENLLSGSIPSNIGKLSNLESLVLSSTNLTGEIPASLLNLTKLSRFAANQNNFIGLVPPGITNHLTSLDVSINKLSGPIPEDLLSPSQLQVVDLSNNMFNGSVPTNFSPKLFRLRFRSNHLSGNIPSGSFAAIPNLKYLELDNNDLTRLIPVELESCRKMTMLNLAQNHLTGVLPPLLGNITNLQVLRLQMNKLNGAIPIEIGQLHKLSILNLSWNSLGGSIPFEITKLSNITFLNLQTNNLSGSIPTSIDNLKFLFELQLRENKLSGVIPSMPGSLQVSLNLSSNHFSGNTPNNFGNLDSLQVLDLSNNKFPGPIPNQLTGMSALT

SEQ ID NO: 191859 - protein, 36 aa, Glycine max
  Coding DNA Sequence Number=SeqID_75081
MTPMHHEGCTRRRPTTDFVKCTYLDDVHTNGATNRG

SEQ ID NO: 191860 - protein, 68 aa, Glycine max
  Coding DNA Sequence Number=SeqID_75082
MCPFYWIFDHFGCPVESVLVVTCYSNNDDFGKEVVGEVKRKIEWPKEAWILGQDVSPGCCRLFWYRKE

SEQ ID NO: 191861 - protein, 87 aa, Glycine max
  Coding DNA Sequence Number=SeqID_75083
MAGDFIEFNLKIDTLFLILVFYCPSIKGKTLGEAMSSNQAREIPEPDCVTVELIAIYEFSEFSSEPRRPRMPSRSLFLSVSVSAKLA

SEQ ID NO: 191862 - protein, 111 aa, Glycine max
  Coding DNA Sequence Number=SeqID_75084
  Gene Ontology: Mol. function=zinc ion binding; Cellular component =integral to membrane; Biological process=ubiquitin cycle
  Homolog annotation: Hit_ID=Q1SLD9; Match level="QueryCoverage=82%, HitCoverage=27%, E-value=2e-23, Identity=59%"; Hit description=Zinc finger, RING-type; RINGv
MYVVEFKNQVGSRFLDPRSVIPPLVLELHEGCVDEALQRVARDPSTDRRVGVLLDGAGEHHHRDHHECYVPHHVEHCHRLRVGPDGATLFQLTRNHLLDHNGVAVEAKEEL

SEQ ID NO: 191863 - protein, 112 aa, Glycine max
  Coding DNA Sequence Number=SeqID_75085
  Gene Ontology: Mol. function=unfolded protein binding; Biological process=protein folding
  Homolog annotation: Hit_ID=P55737; Match level="QueryCoverage=63%, HitCoverage=10%, E-value=2e-11, Identity=54%"; Hit description=Heat shock protein 81-2
MSTSLWWGHHKIICRILGSSIFVRAGSNYFLVYCAMHNVNNFNIKEMKRCPLTNKEDRLTGISVPHLRSASQANALPVIGVNLVESIILLLCDLLRLCHPNGLMLVHQRAFM

SEQ ID NO: 191864 - protein, 186 aa, Glycine max
  Coding DNA Sequence Number=SeqID_75086
MREHSRITPLMPARLLSFATFCFAQQVKKRMEEVAANADLQLPSVTVEVTFVDTAPVEDYEFKYQKSYREVPDNLDMRMVDYKRVLDLLSEWSDINFKIVYQSKFLGADGEGWISVYLVRHLELPCSFSLLSSPTFFLTLTLLSFSIIFHKMAPSHPPLIGNASFMQTTLNYSVVQGVSNASNLKT

SEQ ID NO: 191865 - protein, 106 aa, Glycine max
  Coding DNA Sequence Number=SeqID_75087
  Homolog annotation: Hit_ID=Q1SJ90; Match level="QueryCoverage=63%, HitCoverage=13%, E-value=8e-07, Identity=38%"; Hit description=E -class P450, group I
IHRFVLMMKVKGEACEVVNVGDELLKLINNIVMRMAIGESCFNNDDEAHKLTERIKESSKEIGKNTIRKYTFNIGYLWHSTLVLKPMLKVPMLNVLQLTSVLQNQC

SEQ ID NO: 191866 - protein, 71 aa, Glycine max
  Coding DNA Sequence Number=SeqID_75088
MESTTKTYLVIASTRMSKDCFRANGMPARKPTKLVQRQCDDGRLRVAMRDSASGVRNNGSGDGGLRVPLRE

SEQ ID NO: 191867 - protein, 59 aa, Glycine max
  Coding DNA Sequence Number=SeqID_75089
MVVLKVMVLWRCKDCNNRIHRTVLKNKGYSYNGGAEGENATRTTECPLLLKPSHAVSIM

SEQ ID NO: 191868 - protein, 186 aa, Glycine max
  Coding DNA Sequence Number=SeqID_75090
MAEATRPKTRMEHIEEAIAKLDSNQLRVTTKLDELIQHITALEALDSVTHAYSVVHANSAATPRTLTILFLMLVPHLDTNSKHQVPHVLSSIFNQLGHAHAIVSLDNLLSIVVHYSREAASHDKLLEHRDMALFERGVVPYGSAMVARKRQPVAFALGTAADPKESRRYKPWDPGGPWWTRNTLRT

SEQ ID NO: 191869 - protein, 225 aa, Glycine max
  Coding DNA Sequence Number=SeqID_75091
MQKLLNILAISCLSVFLEEPLASDHPKDEHNIINNVKQDEEFEYEAALHVTIYCCIPQRQASYQIRLRKHRGKLFFGDGLKHLRKHLDIYESVTINFMACEHKWIFNLHFSPPLEQQACGRPLLASRMHVWTLELTQALLGDPEPLKLPPLAAIHLPSCGFHMTILRRFDPPLQWPVVLVCPGFHGKYVAQPWYRFLAEGDFVHGDELSFYYRPRDNIWEIVIRK

SEQ ID NO: 191870 - protein, 429 aa, Glycine max
  Coding DNA Sequence Number=SeqID_75092
  Gene Ontology: Mol. function=oxidoreductase activity; Cellular component=mitochondrial outer membrane translocase complex; Biological process=electron transport
  Homolog annotation: Hit_ID=O49312; Match level="QueryCoverage=98%, HitCoverage=96%, E-value=0.0, Identity=76%"; Hit description =Putative flavin-containing monooxygenase
  Pfam annotation: Domain name=FMO-like; Domain location=23-429; Score=- 422.7; E_value=0.00029; Accession=PF00743.9; Description=Flavin -binding monooxygenase-like
  Pfam annotation: Domain name=Pyr_redox_2; Domain location=22-390; Score=-39.8; E_value=0.08; Accession=PF07992.4; Description=Pyridine nucleotide-disulphide oxidor
  Pfam module annotation: Pfam domain module=FMO-like::Pyr_redox_2; Domain location=23-429::22-390
MVQTFDPEDLFTRRCIWVNGPVIVGAGPSGLAVAACLKDQGVPFIILERANCIASLWQNRTYDRLKLHLPKQFCQLPNVPFPEDFPEYPTKFQFISYLESYAKHFSIAPQFNETVQSAKYDETFGLWRIKTIRKIKKLGGLSSGGCAECEVEYICRSLVVATGENSEKVVPEFEGLGEFGGHVMHACDYKSGEGYGGQKVLVVGCGNSGMEVSLDLCNHNANPSLVVRSSVHVLPREVFGKSTFELAVTLMKRFPLWIVDKILLILARLILGNVEKYGLKRPSVGPLELKHTAGKTPVLDIGALEKIRSGKIKVVPGIRRFLPGKVELVDGQVLQIDSVVLATGYHSNVPSWLKEDDFFTNDGTPRNPFPNGWRGKGGLYAVGFTRRGLSGASLDAINVAHDIVKSWKEETKQKRKTVAARHRRCISHF

SEQ ID NO: 191871 - protein, 68 aa, Glycine max
  Coding DNA Sequence Number=SeqID_75093
MFSTGFFADGENAYSFGTSGYYSLIFDDDNILRLLYDGLEVSAITGHIHGWHLGKLIRMQCMLDVVVK

SEQ ID NO: 191872 - protein, 89 aa, Glycine max
  Coding DNA Sequence Number=SeqID_75094
MSVLELYIEKDVVGGSAFHSANSVRSCENNLSNNESEPPRNVSNLHEDEDEDNNDYLVSNSYVEDSLDEDDSVDGISDTDDEVADMVQP

SEQ ID NO: 191873 - protein, 79 aa, Glycine max
  Coding DNA Sequence Number=SeqID_75095
MLGFASQTGEMTLRWFSQSHLRDPWSIGFAIRGCGMAFVHWFARYNRCSATCMRGSGIGFAGIMKKKLNMFQGFRKNRL

SEQ ID NO: 191874 - protein, 231 aa, Glycine max
  Coding DNA Sequence Number=SeqID_75096
  Homolog annotation: Hit_ID=Q45Q23; Match level="QueryCoverage=16%, HitCoverage=13%, E-value=1e-10, Identity=81%"; Hit description=PHB2
  Subcellular localization annotation: CTP_CleavageSite=37; ConfidenceScore=5.25e-01
MFAHSIKGCRPLGRTCGVLIPSPSRLFRFFRRFPQINVGGDSARIPFVEHASRESRVALPPKGRLRQVYPEGTHFIISWFKRLVIYDVCARPHLVESTSGSRDMLLGFACSHREMVLCCLKEAIIYQVNLYHSGLLLTMTPKLTVKSKNLKLHHNKSNLHLRKNLKMNVTKHQLYKFPSTILELSEFRFLEKIQSLITYMIKQVNNTRELLTQFGATSPTSGGYQAREEIH

SEQ ID NO: 191875 - protein, 163 aa, Glycine max
  Coding DNA Sequence Number=SeqID_75097
  Gene Ontology: Mol. function=transition metal ion binding; Cellular component=cytoplasm; Biological process=DNA integration
MIRDHGQKSFQQAHAPMYDTLQTNSKKPLYPGCKHSLKLLSAVLQLVNVKARYGWSDKSFSSLLQVVHDMLLEENTSPKSYYQAKKILCPIGMEYQKIHAYLNDCILYRHEFQDMHKCPRCGVSRYKLSVVVTQTQRKAPQQRCFGIFPSFQGLSFYLLMETT

SEQ ID NO: 191876 - protein, 86 aa, Glycine max
  Coding DNA Sequence Number=SeqID_75098
MEALETLNGHNFSYGCPIRAHNMSRCSKLNNGSSREIQMVITFHTEAYHIYRHARLNNGSSREIQMVITFHTDVRFRRIIGQDARH

SEQ ID NO: 191877 - protein, 99 aa, Glycine max
  Coding DNA Sequence Number=SeqID_75099
MDCPLWMLWSMECNICGVKVKSNGPGENGAGNGICVGVGGITRVRMGGNGVVDEEGAGVSGAEVEGASDLLPLAFLGPLKVIVGSSRFQQFFLIYAKLM

SEQ ID NO: 191878 - protein, 126 aa, Glycine max
  Coding DNA Sequence Number=SeqID_75100
MQSLQGLGLPSIMSIEEFEAQVAWRGDQPSSSRRGGASAAQEPDIEEPPAPTPAPAEEETTPDQTPQPSPAPAHIPEDVAPVAEPEQLIQDSSTTPTLDLNEDQPQEEQDFKFLHSKHFSLFSVIL

SEQ ID NO: 191879 - protein, 237 aa, Glycine max
  Coding DNA Sequence Number=SeqID_75101
MGALQILNVASFQLHLNDYAAIQVFRALCLYMHVKATPVDTLPPPAKEAKQKDKGKHKRKHRDQRHGSARPSSHGGSKKIKQQMLEFPSTHPLTNISIFTNGGFFTNEFVSSRLADLIHISDHSHHVLNKSEDATNLENFGQTTAITQHLQGSLRVVALELETKRLEVRAMKAEDSAKLNAEEVERLKTLLALIKKERDVEKQEKARIEKKAYDDEDKDDGGDGGKVQKNVKHYKDS

SEQ ID NO: 191880 - protein, 431 aa, Glycine max
  Coding DNA Sequence Number=SeqID_75102
  Gene Ontology: Mol. function=alpha-1,6-mannosylglycoprotein 2-beta-N -acetylglucosaminyltransferase activity; Cellular component=integral to membrane; Biological process=oligosaccharide biosynthetic process
  Homolog annotation: Hit_ID=Q599H9; Match level="QueryCoverage=95%, HitCoverage=95%, E-value=0.0, Identity=72%"; Hit description=Beta 1 ,2 N-acetylglucosaminyltransferase
  Pfam annotation: Domain name=MGAT2; Domain location=75-415; Score =607.2; E_value=1.5e-179; Accession=PF05060.5; Description=N -acetylglucosaminyltransferase II (MGAT2)
MAVSKKPRLRLRDVALCRLLSVVFVTLCGVLLLIFLLASNSTPIGTHDMIDNADAYHHDMKFEKLHDLPQQNDLSLRLERLNGLPPRNLDLYPTLAKDRIVVVLYVHNRPQYLKVVVESLSQVVGISETLLIVSHDGYIEEMNKIIDGIKFCQVKQIYATYSPHLFSDSFPGVSANDCKEKDDAGEKHCEGNPDQYGNHRLPKIVSLKHHWWWMMNTVWNGLRETRDHSGHILFIEEDHFIFPNAYRNLQVLISLKPKKCPDCYAANLAPSDVNSRGEGWATLIAERMGNVGYSFNRTVWKKIHNKAREFCFFDDYNWDITMWATVYPSFGSPVYTLRGPRTSAVHFGRCGLHQGQEENKACIDNGMVNINVEEPDTVSNIELNWEVHTYKNQPGYKAGFKGWGGWGDNRDRLLCLSFAKMYHSTGTASPL

SEQ ID NO: 191881 - protein, 155 aa, Glycine max
  Coding DNA Sequence Number=SeqID_75103
MRSLRNIKEAQRLVGRIASLSRFLPRIVEKVKLIINLLKKTKNFQWNEECKEAFRQLEITLATPNGLSNQHGNGAGIILEGLNNATCNQIGYEALLVGLRLAKEVGARKVTLISQDTNDRINELARLATSPQPRKLITFIQQTLPVPRILAKEYL

SEQ ID NO: 191882 - protein, 77 aa, Glycine max
  Coding DNA Sequence Number=SeqID_75104
MDQKWRGERRGVELGCRRDRKGEDVEEQKKGCFGIRRIDMMSEALEKPKICVRRIGSDRVGYGGCWMLLEAKSVKGR

SEQ ID NO: 191883 - protein, 266 aa, Glycine max
  Coding DNA Sequence Number=SeqID_75105
MEATLSSHWKNLTIKKYDDTTDPDEHLDVYITQVSLAAKYMQMEELVEYRNQVRAEATSTKKEADKPNFGKTRDEGINHLENLVMLITPPSMTEIGPPKLKGVGVEVDPKKRRKTLLTNQDIEGQNQGMHMVVHEVRPLRAVTETLEKSIQIVAGAEDSQELDLDPRTNEDNRVRPIEETCTFQIDIKEEQGTSFVVQVDGTSTWVAVTKNKRGYISCGSVQVEGTSTWLFKENKGGYIPCGSLLVKVFTRLKRNLKDRRLLGDWM

SEQ ID NO: 191884 - protein, 150 aa, Glycine max
  Coding DNA Sequence Number=SeqID_75106
  Gene Ontology: Mol. function=DNA binding; Cellular component =mitochondrion; Biological process=DNA integration
MATQVIRVGYYWPNLKTNCTNFVKKCNPCQKHGNLIHRPTEELHPFTSSWPFAIWGMSILRPFPMAPGQRKSLLLAVDYFTKWVEAEPLATITAQNVQKNNQRKIGQRALRGLIDAIAIHYSRDPLLVSVWNKCYGPNGSGRDIPQGKIS

SEQ ID NO: 191885 - protein, 58 aa, Glycine max
  Coding DNA Sequence Number=SeqID_75107
MPRQTVFAIVIEELPFKQQGRQGIMGDCFMLVHYHNKMQIDVISFRGLMKTLMLVQLK

SEQ ID NO: 191886 - protein, 116 aa, Glycine max
  Coding DNA Sequence Number=SeqID_75108
MKNVVVNEQDEPAPALAVVNQHVVHEEINLSQPPSSQDIDLDLFLRPPGVAGQPPSSQQPMPNVPFNMAGSSSRYRPPPIWPNYNISILNPSTSQQQPSMCFIPTPRFPHQGPINN

SEQ ID NO: 191887 - protein, 120 aa, Glycine max
  Coding DNA Sequence Number=SeqID_75109
MEGGYPWCMHGMHACMEMEGVCFVNGTGETHWTRELDTVTAVLLVVLTKPLSTAVGLGEIGCFASANDKTPLKTDPPRISLQTDSFRKKFCAVKLTILTLHFLGHRIRNGKACFNREKMR

SEQ ID NO: 191888 - protein, 107 aa, Glycine max
  Coding DNA Sequence Number=SeqID_75110
MSNSEIGVKIVCSPLENSHLNRKHSSDAMRIEPACLDNNGQVFWKLKSYNSECAVLLQDIKIKDETATAPAEKWFVYGPEKKDEVDKYISSRAKRLKGHKVAYMLSQ

SEQ ID NO: 191889 - protein, 123 aa, Glycine max
  Coding DNA Sequence Number=SeqID_75111
  Gene Ontology: Mol. function=lipid binding; Cellular component =cellular_component; Biological process=lipid transport
  Homolog annotation: Hit_ID=Q43681; Match level="QueryCoverage=77%, HitCoverage=96%, E-value=3e-27, Identity=58%"; Hit description =Probable nonspecific lipid-transfer protein AKCS9 precursor
  Pfam annotation: Domain name=Tryp_alpha_amyl; Domain location=58-123; Score=54.6; E_value=3.2e-13; Accession=PF00234.12; Description =Protease inhibitorseed storageLTP f
MIVLTNTTIVNATNFAVLLMQRNLSEERMMMKSAMCALVLVALVVVEVGPMAEAAVTCNPTQLTPCLPAINSGSAPSSACCQKLKEQKPCFCGYLKNPSLKQYVNSPNAKKTVSSCGIAYPTC

SEQ ID NO: 191890 - protein, 342 aa, Glycine max
  Coding DNA Sequence Number=SeqID_75112
  Gene Ontology: Mol. function=protein serine/threonine kinase activity; Biological process=protein amino acid phosphorylation
  Homolog annotation: Hit_ID=Q53VE0; Match level="QueryCoverage=65%, HitCoverage=33%, E-value=1e-22, Identity=30%"; Hit description =Ser/Thr protein kinase
MASLLIHLPPIPILQHFILLLILIQTPPYLSSYNDDRGCTNQLISCGNIKNIGFPFWGEKRPRDCGHPRMQLSCEQEITYININDFRYKVLEVNPDNHTLRITREDYLEGICQPKFVTTSLDTELYVHDSAYKNLTLFYCANDLPSTTGFLPSCVPNGNYVYPRFEPLPPPNYYASCKTVVVPVPPSLVDTSDADKIHNAIIDGFVVRWIVGIGECEKCMISAGRVCGGIEWYPNQTCYCRDGPCSNFLPDDKAPQSPPTVIVLICGRLDHVSHRGNNYCVVGSYFKANSTNINYPFPSQTLIFLDRIRYSKNNTNIKDNCKTTKSTTKRENENVKEAMQKS

SEQ ID NO: 191891 - protein, 350 aa, Glycine max
  Coding DNA Sequence Number=SeqID_75113
  Gene Ontology: Mol. function=phosphoprotein phosphatase activity; Cellular component=integral to membrane; Biological process=beta -lactam antibiotic catabolic process
  Homolog annotation: Hit_ID=Q9FFX0; Match level="QueryCoverage=83%, HitCoverage=64%, E-value=6e-76, Identity=51%"; Hit description =Arabidopsis thaliana genomic DNA, chromosome 5, P1 clone:MBB18
  Pfam annotation: Domain name=Rhomboid; Domain location=137-282; Score= 127.8; E_value=3e-35; Accession=PF01694.12; Description=Rhomboid family
VHHIDDHARSKTGLESLDEYLGKLNRGANQEPHVPSYVENRSEENLAPKRSLTKDIERSNFRKRNAYVDIGRLKGVHGPRSAIDSQQHVETSSLYLIGILASVNIAVFLFEIASPIRNSDLELFSIPLLYGAKINHLIMVGEWWRLVTPMFLHAGIFHMAVSCWALLTFGPQVCKGYGSFTFFLIYILGGVACNFISFLHTPDPTVGGTGPVFAIIGAWLMYQIQNKDVIASDASENLFHKAVIMTALIFILSHFGPIDEWSHFGAAFSGMAYGFLTSPILQLNDSSSGTGQEGLKLVRKYGDSCKSVFIFTIFIIVLSSFLFFMEPPPNALASVNAAAVDALEYILIFG

SEQ ID NO: 191892 - protein, 625 aa, Glycine max
  Coding DNA Sequence Number=SeqID_75114
  Pfam annotation: Domain name=DDT; Domain location=464-525; Score=7.9; E_value=0.087; Accession=PF02791.7; Description=DDT domain
  Subcellular localization annotation: CTP_CleavageSite=17; ConfidenceScore=5.30e-01
MAITAISNSSQNMNEVAAGGVKPKRSNSRGVRIVGSRIYDSANGKTCHQVLFFFEILRIPVSFFLVFLRCGVCWFVESAKSECGVESGCGNCVKKGNCGGWGYFEVCLDDNIFVCLVFTLKCRQKTRDFAVSCMGRRQKRWSSWVIGCVQNVETFATAVFAAKASGFKSVSEMLVSKTAESNDLESNKVNRVFPSKEATEVKKQKRVNKSSSDKVPVSKAVSPMKQIASDKELVVLLSGEIGKENSSDGKLDPVISQKASTKKSKKTKREELKEISNENNVESAGKKKSLKRPKICKVPSEEAKGKANDETKVCNGVSKKETKVDRKHDTAHILMDSPEAQAANDLLLFGKYAKGNPFSEVQPQMHKNPDTIFEDPANDPIVPVTVAPKHYLFNSKHPDMKHMHGENWNNTVLVDGNAGAKFQVGIATFPSIGMNLVVEKIEEEIPLPPGTELTEILDTELPPEDVGNALQLLEFCRVFGKALDLKKGEAEAILRELVRKQNLRRGQNTLVVQFQIRVLTLILTDSGNESPSLTTSNGNNSWLKPLEDLIAGSDHILKDFPLDWLQEGVGGYYNLDLSKKLTLLNFLCDEALITDKLRSCIEDQNSRHAEEVKEAKNKIAAAKEK

SEQ ID NO: 191893 - protein, 37 aa, Glycine max
  Coding DNA Sequence Number=SeqID_75115
MNLMCMQCMLGVPMTGFEQLGTLREKILEHGVACIRF

SEQ ID NO: 191894 - protein, 58 aa, Glycine max
  Coding DNA Sequence Number=SeqID_75116
MKLEFENENRLLPKFTIEPLIHENLCHPWKKCLLEIDKEKVINVIISLFVLGLQSLWR

SEQ ID NO: 191895 - protein, 662 aa, Glycine max
  Coding DNA Sequence Number=SeqID_75117
  Gene Ontology: Mol. function=actin binding
  Homolog annotation: Hit_ID=Q9FF41; Match level="QueryCoverage=84%, HitCoverage=97%, E-value=7e-46, Identity=27%"; Hit description =Arabidopsis thaliana genomic DNA, chromosome 5, P1 clone:MXA21
  Pfam annotation: Domain name=DUF827; Domain location=12-521; Score =13.5; E_value=1.6e-11; Accession=PF05701.2; Description=Plant protein of unknown function (DUF827)
  Pfam annotation: Domain name=FlaC_arch; Domain location=301-421; Score=-16.0; E_value=0.1; Accession=PF05377.2; Description=Flagella accessory protein C (FlaC)
  Pfam module annotation: Pfam domain module=DUF827::FlaC_arch; Domain location=12-521::301-421
MDGVKLGSKRVGSVNAAVNFYDDKKPSSRTKELHRARRDIGRYKESKWTAESAKAQAESELSNAKKTANHLSSMLEESNYKAKTQMRDVERLEKWGKGQHGTIVVAKRNENFEYAQVMRELEYLKKELFKLKLDVAYVMEQKSRAEKEIEASNSKMLSCLTTAEELRREIEEANEEQVLAELARIEASKELTDIETQRKQEANEFSFKLESTRRKLKEAIEEIDESKELEMKLAVTISDVDFLQNELKSVKEMDKRVQGDGSAKQLEGRFKKGEESEDSIVLQTITEELEAARKELALVREEGFQFMASLDVIRNELKHVTAETDRLKKKEGKVDSTVQNLNFKILRAKSKLEAVSAAEEKARSIVMSLSHTLEKLKTETEEAKKENEDVSQEVAATKEEIQKVELDIDTTEERLQGVMQELEVAKASEALALEKLKTLTERTMRERALTAQHSSMITISKFEYEYLTNHAASAEEIADKKVAAAEAWIEALKASEKEILMETKIAQRELKESKLEQELEVYTKEKMLSRRVSSSEELDNWPRKREKTSSKNFQRALSRKSIKLNGTITPARGAKFQKTASPAARHISPFTIKKRKKNSTGGSLSSDSRGSSSYVLNNIQLASRKKLIPYDPSSQCFEDKKQFHCSAWNAKKYRIFLLLHQK

SEQ ID NO: 191896 - protein, 92 aa, Glycine max
  Coding DNA Sequence Number=SeqID_75118
  Homolog annotation: Hit_ID=Q5QMW8; Match level="QueryCoverage=60%, HitCoverage=4%, E-value=7e-11, Identity=57%"; Hit description=HEAT repeat-containing protein-like
MEGCDIKTKAEPKKAIPPAFSTEYLYSSALFHPRHGELTQRIVQPQKEVDNAAEWCKNFHLEKEIFVKNEILNHKGAVTVQRQTNTRAEFTV

SEQ ID NO: 191897 - protein, 102 aa, Glycine max
  Coding DNA Sequence Number=SeqID_75119
MAAIETVYPVILKLIARKDFVDVLFSFLTLSLGTIARLVAKEKSNMQPIEVRSLSSLYRSVKNLDKEYLCTVMCKEMLLQPRNSLEAYCKKLRLNIDNTPPT

SEQ ID NO: 191898 - protein, 167 aa, Glycine max
  Coding DNA Sequence Number=SeqID_75120
  Homolog annotation: Hit_ID=Q5KS41; Match level="QueryCoverage=72%, HitCoverage=26%, E-value=4e-12, Identity=31%"; Hit description =FOLDED PETALS
MSIIRDKNGEKKWEKVEVKLEDHIKVPTFPNGKSSNFLYDEYLDEYLSTIAVEHLPHNRPLWELHIIKYPTNNAKGTLVFKLHHALGDGFSLMGALLSCMQRADNTSLPFTLPSSLRPKASISNTKGVFKKLPSIFFQTISEFGWSFLKSNMIEDDQTPIRSCAEVV

SEQ ID NO: 191899 - protein, 110 aa, Glycine max
  Coding DNA Sequence Number=SeqID_75121
METKADAADSFWTWNANNDQKQFSVTKFLGNNKPPKPQTSVLGPGFGAGIGCGAGIGLGLVGGFGYGGWPFNHMHFVFGLGIGCGVGVGFGFGQGIGYDFNFRTLSALGF

SEQ ID NO: 191900 - protein, 513 aa, Glycine max
  Coding DNA Sequence Number=SeqID_75122
  Homolog annotation: Hit_ID=Q1SR88; Match level="QueryCoverage=70%, HitCoverage=63%, E-value=6e-15, Identity=23%"; Hit description=IMP dehydrogenase/GMP reductase
  Pfam annotation: Domain name=DUF674; Domain location=1-461; Score =164.7; E_value=2.4e-46; Accession=PF05056.3; Description=Protein of unknown function (DUF674)
MADIVSKHQVTLKLWVNKERNKVFFAKAEKDFVDVLISFLTLPLGTIVRLANKESNMDLVEFGSLSSLYKSVENLDNECLCTDTCKEMLLRPRNSLEAYCRNMKLNIDDTEPTKYLVCNDLVNCRHYYPVLLSTFRNKRCSCGNTLGKPISPESQCSNVFDGFVKSNATFMITDDLKVLSDSLNTILSVLMSSGLENASLLTEMTVSITKTQVIHLLKSCLLSKTTLTDTFLVEKPYLERFNKIKLAPLDLNTNGSGKINIKIMQRKSNGKILFAQGKEDFANFLFSFLTFPLGAVVQLMECCSSIGSVDALYKSIVDLDEDYWTTKETKHKVVHPVIAPQFKLTNQLLPICDAPIPEYFCFTKDVYDERDCQRKLISWFLTSERTRRKRRTETCEGMKFVDPISESGKGEGFAKGPTMYMATDDLVVTPMSSDSLLSLLNRTNILVRDLEEKEVSIGVKEGISILQASLSSTSALTAALAIIVFHILEVTEAKIPSQVPPQIPEIVKSNGMD

SEQ ID NO: 191901 - protein, 73 aa, Glycine max
  Coding DNA Sequence Number=SeqID_75123
AQQSIDGARRSQLEKHEEESRLSKVKPINSHDRGVQGNRQSQVGYKEVAVSHAQKRKKFRQKAHLLAGTKSEQ

SEQ ID NO: 191902 - protein, 148 aa, Glycine max
  Coding DNA Sequence Number=SeqID_75124
  Gene Ontology: Mol. function=heat shock protein binding
  Pfam annotation: Domain name=DnaJ; Domain location=70-144; Score =21.5; E_value=3.6e-05; Accession=PF00226.21; Description=DnaJ domain
MAHFFTSEHRHCNVQASNRSLNKKRKQETQLKFKLAPFNFWNHIVNKCLHFFMNRKVIKDPTSYNVNIRGIKSADTATDIKKAYHKATLRHHADKLLARSEVGDEGQLWKEISQEVYKDADKLFKMIGEAYTVLSDPAQGYTYDFSTS

SEQ ID NO: 191903 - protein, 372 aa, Glycine max
  Coding DNA Sequence Number=SeqID_75125
  Homolog annotation: Hit_ID=Q9FUU9; Match level="QueryCoverage=18%, HitCoverage=7%, E-value=1e-13, Identity=63%"; Hit description=Leaf senescence-associated receptor-like protein kinase
MGSRNDEDIYTLFECVFPILKAEWETSMTAGDASLDEFKPEVLDWDCSAFFNKLLYVKLRHLNVKILTFNICWILTFYKMQHDDDKWVNKIRDLFVFFASSKLKHTFLEHLHYLAAQCKISPPRLLSKFFTNEGVTAAVQVESLQCYAFLCSLSQDKWQIELLAEFPSVLVPFASDNQSIRVAAMSCIDSLRTLWCHVEHSGKKNGNNATWIHFLGDVLALMDQQKTFILSDKKFLPSLFASAFSSPCPNILEPRNILVPQDIEKRNLSSSGLSRKIDPSILNLTMLENLDLSNNSLKDEVPDFLSQLQHLKILDKLDVIKGFAPTSGTNSDKDDHNGEQLMEYESQIALRRRKKLVLDGDLERQIKDLHEK

SEQ ID NO: 191904 - protein, 73 aa, Glycine max
  Coding DNA Sequence Number=SeqID_75126
MQQNHSIIDVCLLHIRSYTAAAIPPAISPTAVAAMPRPMTPSTMKEKKQSVLYPLALGKKKGAEKNVKWKIKN

SEQ ID NO: 191905 - protein, 86 aa, Glycine max
  Coding DNA Sequence Number=SeqID_75127
MASHQREIRHLSESPTEGQEARQERFARLKTVLDSVDSRLDQAREIDRVRDNERARLRAEMDHDCDRWRALERKNAQMRLKVNELN

SEQ ID NO: 191906 - protein, 171 aa, Glycine max
  Coding DNA Sequence Number=SeqID_75128
GGECKQPCAPIMKVDIKEGNLVLCKQVGLRAWGLGLRDWDMLGAPSNIVGAPSNSLKVSSAKASSLLSSPTSFFSARLLRQPLDPFAFEVGGLLLSFGFVMHYIRVDPLGVLPKLLEEGLPKDFRKNSYSGTTETSSGSTGLSKSSRNTYSGKFPEEMVVPETFRKKGSSG

SEQ ID NO: 191907 - protein, 52 aa, Glycine max
  Coding DNA Sequence Number=SeqID_75129
MPHSLTMTIMSYMGKIRIAFGVEKDFIDKQLFKSCLENSLEMIKEAAKKIST

SEQ ID NO: 191908 - protein, 330 aa, Glycine max
  Coding DNA Sequence Number=SeqID_75130
MTAPTYCLVGVRICLRKKLIEEKRKKRQEKAMLTENTPLLEDLPSPIERHVKWEMARTKRYGQMTSEDSLQEQTTQGSFVPHGQDDILNTVIGRPKHPGHVRVAGSSMMISQYYGNSSTSITQQQLADIIGSLKEEWRNEIIKNLKEEHELKDALKIEFFQMGSQYSPLIEVDIHALGARVSIKGSNVEAAENPSGEEHDGRVIPTMGVSVEKVLDGDAQVPFPTSEIQYVRANNVFEDDPLRQLIKSLYDIYEKPVELMWDATKFGIPNVDASFFLTYFDVNEIKAGDKCLNLAILQLWMMFMDEWSSSLGHVSLYGFLEPQSIHGAKD

SEQ ID NO: 191909 - protein, 404 aa, Glycine max
  Coding DNA Sequence Number=SeqID_75131
  Gene Ontology: Mol. function=oxidoreductase activity; Cellular component=membrane; Biological process=electron transport
  Homolog annotation: Hit_ID=Q9FF18; Match level="QueryCoverage=99%, HitCoverage=79%, E-value=1e-160, Identity=68%"; Hit description =Cytochrome P450-like protein
  Pfam annotation: Domain name=p450; Domain location=1-397; Score =194.6; E_value=2.4e-55; Accession=PF00067.12; Description=Cytochrome P450
PRLCLTDTEMIKEFLSKYSTTSGKSWQQQQGTKHFIGRGLLMANGEEWRHQRHMVAPAFMGDRLKSYAGHMVECTKDMLQSLQNALEVGQSEVEIGECFTELTADIISRTEFGTSYQKGKQIFYLLTQLQSRVAQATRHLFFPGSRKYNREIKSMKMEVERLLMEIIESRKDCVEMGRSNSYGNDLLGILLDEIKKEGGTLNLQLVMDECKTFFFAGHETTALLLTWTAMLLASNPHWQDKVRAEVKEVFKGEIPSVDQLSKLTLLHMVINESMRLYPPATLLPRMAFKDIELGDLHIPKGLSIWIPVLAIHHSEELWGKDANEFNPERFASRSFMPGRFIPFASGPRNCVGQTFAIMEAKIILAMLISRFSFTISENYRHAPVVVLTIKPKYGVQVCLKPLDP

SEQ ID NO: 191910 - protein, 94 aa, Glycine max
  Coding DNA Sequence Number=SeqID_75132
MAMFDPEIVMEFYANTWPIEEGVTDMRSWVRGQWIPFDEHVINQFLGHPLVLEEGQHCEFSQRRSQGSNFDEEAISQLACVPGQDFAWSVAWRQ

SEQ ID NO: 191911 - protein, 447 aa, Glycine max
  Coding DNA Sequence Number=SeqID_75133
  Gene Ontology: Mol. function=nucleoside transporter activity; Cellular component=membrane; Biological process=transport
  Homolog annotation: Hit_ID=Q69S29; Match level="QueryCoverage=83%, HitCoverage=89%, E-value=1e-140, Identity=66%"; Hit description =Putative equilibrative nucleoside transporter ENT8 splice variant
  Pfam annotation: Domain name=MFS_1; Domain location=24-420; Score= -43.0; E_value=0.029; Accession=PF07690.6; Description=Major Facilitator Superfamily
  Pfam annotation: Domain name=Nucleoside_tran; Domain location=127 -422; Score=77.7; E_value=3.8e-20; Accession=PF01733.8; Description =Nucleoside transporter
  Pfam module annotation: Pfam domain module=MFS_1::Nucleoside_tran; Domain location=24-420::127-422
VDTREESKAAMENNEPPRRLEGKYAAMVVCWLLGNGCLFAWNSMLTIEDYYVHLFPKYHPSRVLTLVYQPFAVGTLAILAYKEDRINTRIRNLFGYTLFFISTLSILIGKAAYNIPPPYLRIAKSLWAMGGAFGIADAHTQGGMVGDLSYMLPEFIQSFLAGLAASGVLTSALRLITKAAFEKTKNGLRKGAIMFFAISTFFELLCVLLYSFVFPKLAIVKYYRSKAASEGSKTVSADLAAGGIQIPSGGANQYEKEIDRKGNKKLLLENIDYALDLFLIYALTLSIFPGFLSEDTGSHSLGTWYALVLIAMYNVCDLIGRYIPLLKFLKVESRKKLTTAIVSRLLFVPAFYFTAKYGTQGWMIMLTCFLGLSNGYFTVCVLTSAPKGYKGPEQNALGNLLVLFLLGGIFAGGVLQVPMTKHPISPGLATTLRSFASTTSDTAVVVS

SEQ ID NO: 191912 - protein, 288 aa, Glycine max
  Coding DNA Sequence Number=SeqID_75134
  Homolog annotation: Hit_ID=Q9M886; Match level="QueryCoverage=98%, HitCoverage=100%, E-value=2e-78, Identity=56%"; Hit description=LOB domain-containing protein 41
  Pfam annotation: Domain name=DUF260; Domain location=4-109; Score =135.3; E_value=1.7e-37; Accession=PF03195.5; Description=Protein of unknown function DUF260
MRMSCNGCRVLRKGCSEDCSIRPCLQWIKNPESQANATVFLAKFYGRAGLMNLINAGPENLRPAIFRSLLYEACGRIVNPIYGSVGLLWSGSWQLCQAAVEAVLKGEPITPITSEAAANGRAPPLKAYDIRHVSKDQNSANETPKTKTRSRFKRTSGTLIKPKASKGTGFVPVEPEMANRTASHESGLSHLSEATAMVEGESKESESVVSMDTSNLIHEEPEWVAKTSDGTGESGNEIGLELTLGFEPVSRLHHVVPMKKRKIIELKSCGDSAEKDSCKMELGLEYPA

SEQ ID NO: 191913 - protein, 310 aa, Glycine max
  Coding DNA Sequence Number=SeqID_75135
  Gene Ontology: Mol. function=GPI anchor binding; Cellular component =anchored to membrane
  Homolog annotation: Hit_ID=Q9SUC9; Match level="QueryCoverage=61%, HitCoverage=84%, E-value=4e-52, Identity=74%"; Hit description =Uncharacterized GPI-anchored protein At4g28100 precursor
MARGRSRTEANQRPAACSPGRDYTWTREGAHCTSSHAAPPKRWGTEAFSATSVRGVTTIILQVANRGGWSGVSVRKRDVKRSVASQRRDLVEPDAAEAENGVARGVGLRDSSPEDGGGAAETSRAVRAWAAKSQAARTGQQRLRSRSLPQASLTPPNSSSERSRRQVRAWVWTGKAGTVLEPGSSGWLGSLTGSESKPAREKGSRNKSSTSTSDVEKKGVWVWVWLKMIIAREKKGEEIHGTLVVLYGGIWFEIRRGLDFLAFALDPAAAAGVSLTALCSLTNWISLRAIYNNNTTDTVNKALQIIVTTS

SEQ ID NO: 191914 - protein, 50 aa, Glycine max
  Coding DNA Sequence Number=SeqID_75136
MEHAQARTRVATLLSRGETVSDGEDVLAMTTTGLLRETQIDGLGKGITTP

SEQ ID NO: 191915 - protein, 167 aa, Glycine max
  Coding DNA Sequence Number=SeqID_75137
MCTVRPTKLDTYSGHETPRGDPQLPLMNSSMMHRGALPTWLRTLCNSLNTYIDPEGRSSSKDVSSKCGEGGTLTKAVSEWKDGCEHVTLEVVGAFALVTKLIPCFGCVVREGASGVSRACDEYDTLTEPVLEVDHIFISLPIESSRLSFRCILSLRFDDLGKYRPTP

SEQ ID NO: 191916 - protein, 80 aa, Glycine max
  Coding DNA Sequence Number=SeqID_75138
MSLESNVKAAQEDIQGPSAQLDIEKDIQPFSQPTKGPSTSSSLLILQHGLNLSRSWVVQFSRWMSHALKHSMFLNVVSIN

SEQ ID NO: 191917 - protein, 228 aa, Glycine max
  Coding DNA Sequence Number=SeqID_75139
  Gene Ontology: Mol. function=RNA-directed DNA polymerase activity; Cellular component=nucleus; Biological process=RNA-dependent DNA replication
  Homolog annotation: Hit_ID=Q1SKV6; Match level="QueryCoverage=64%, HitCoverage=31%, E-value=9e-30, Identity=44%"; Hit description=RNA -directed DNA polymerase
MSFCAKWIHWIAGCLKSASVSILVNGSPSSELIPQRGLRQGDPLSPMLFNIVAEGLNGLMTNALEKRVPKKVENKIVRLQRKFLWGSASEQNKIAWIRWEKVCLPKVDGGLGVKDIRSFSSTLLGKWKWKLFQNQGELWARVIESKYGGWRSLNEAPRANKESIWWKDLKNVSQHPQQGQLLNAPISWKVGRGDKFKFWEDNWTGGDNCLLEKYQRLYNISVQQNQII

SEQ ID NO: 191918 - protein, 275 aa, Glycine max
  Coding DNA Sequence Number=SeqID_75140
  Gene Ontology: Mol. function=ATP binding; Cellular component =chloroplast; Biological process=response to heat
  Homolog annotation: Hit_ID=Q1SF11; Match level="QueryCoverage=93%, HitCoverage=50%, E-value=1e-96, Identity=62%"; Hit description =Glyceraldehyde 3-phosphate dehydrogenase; Heat shock protein Hsp70
  Pfam annotation: Domain name=HSP70; Domain location=9-275; Score=9.9; E_value=5.4e-16; Accession=PF00012.10; Description=Hsp70 protein
MAKKHKEFSVGIDLAAKRLIGRKYSDPVVQKDKKLWPFNVVVGVNDKPMIVVKYKGEKKRLCAEEVSSMILVKMREVAEAYLKSHVKNAVVTVPAYFNYSQRKPTKDAGAIAGLNFMRIINETIATAIAYGLEKRTNCVEKRNIFIFYLGGGTFDVSLLTIKDKDFKVKATAGDTHLGGEDFDNRMVNYMVHEFKRKNKVDISGNPKARRRLRTACERAKRRDVHDVVLVGGSSRIPKVQHLLQNFFEGKHLCKSINLDEADAYGEAVQAILLGE

SEQ ID NO: 191919 - protein, 406 aa, Glycine max
  Coding DNA Sequence Number=SeqID_75141
  Gene Ontology: Mol. function=oxidoreductase activity; Cellular component=chloroplast; Biological process=induction of apoptosis by oxidative stress
  Homolog annotation: Hit_ID=Q9ZUC1; Match level="QueryCoverage=90%, HitCoverage=92%, E-value=1e-127, Identity=65%"; Hit description =Quinone oxidoreductase-like protein At1g23740, chloroplast precursor
  Pfam annotation: Domain name=ADH_N; Domain location=113-204; Score =63.2; E_value=8.2e-16; Accession=PF08240.2; Description=Alcohol dehydrogenase GroES-like domain
  Pfam annotation: Domain name=ADH_zinc_N; Domain location=234-366; Score=26.9; E_value=7.1e-05; Accession=PF00107.16; Description=Zinc -binding dehydrogenase
  Pfam module annotation: Pfam domain module=ADH_N::ADH_zinc_N; Domain location=113-204::234-366
  Subcellular localization annotation: CTP_CleavageSite=73; ConfidenceScore=5.94e-01
MSLCASLSSTASHLTSLASVSSSTSPLSRKFSLTFREKNRTPIAPPHKLPFFSARPAPTRVVLVKSQATAPASSEAVKVTPVPSEMKAWVYGEYGGVDVLKLDSNVAVPDVKEDQVLIKVVAAALNPVDAKRRQGKFKATDSPLPTVPGYDVAGVVVKVGSQVKDFKVGDEVYGDVNEKALEGPKQFGSLAEYTAVEEKLLAPKPKNLDFAQAASLPLAIETAYEGLERTGFSPGKSILVLNGSGGVGSLVIQVCLQFYDRDAGILAKQVYGASRVAATSSTRNLDLLKSLGADLAIDYTKENFEDLPEKFDVVYDAIGQCDRAVKAVKEDGSVVALTGAVTPPGFRFVVTSNGEVLRKLNPYLESGKVKPIVDPKGPFPFDKLAEAFSYLETNRATGKVVIHPIP

SEQ ID NO: 191920 - protein, 103 aa, Glycine max
  Coding DNA Sequence Number=SeqID_75142
  Subcellular localization annotation: CTP_CleavageSite=20; ConfidenceScore=5.44e-01
MDRLTTMMSALLSAQNSQAAAAAVEQPLVSTTPLSTVTSPPLFLPPGCTWGMPPPVCGSSQPAVSEAPPPFAQQSAPVPQPSTSFPQAAMTYSAPLIHTIQQE

SEQ ID NO: 191921 - protein, 136 aa, Glycine max
  Coding DNA Sequence Number=SeqID_75143
MLNSLAYPVESPTVTTFPLAGVQKGLSVDQRDASSVKGKRVDSPPTFIRGKCQKNQNRKGQRSAHFENEGSGVVYARGRVNKGVSLTPTYSAIAMRKSDLRSSLRNECWKESLRHWTLNVLLIFERRESLRCWTLK

SEQ ID NO: 191922 - protein, 70 aa, Glycine max
  Coding DNA Sequence Number=SeqID_75144
MEDEVKLKINGGLRRTYLKLLCSDYHLMEACLRHPLGNKPWKKELHRRESALDEKLREEASMEEKKEREK

SEQ ID NO: 191923 - protein, 92 aa, Glycine max
  Coding DNA Sequence Number=SeqID_75145
MGAKHLTRTEEWSHVIEQRSPDEIRESFDLIHRKILQLFLVLEKILFARINSFFHSSSLRGYENKTTIGTSKPYTGAMRGIVHEPLVNLGAD

SEQ ID NO: 191924 - protein, 197 aa, Glycine max
  Coding DNA Sequence Number=SeqID_75146
  Gene Ontology: Mol. function=NADH dehydrogenase activity; Cellular component=membrane; Biological process=electron transport
  Homolog annotation: Hit_ID=P00393; Match level="QueryCoverage=66%, HitCoverage=30%, E-value=2e-57, Identity=84%"; Hit description=NADH dehydrogenase
MVWAAGIKAPDFMKEIGGLETNRINQLVVKETLQTTLDDDIYAIGDCASCALPGGGFVPPRAQSAHQMASRALENILAQRKGKPLKAYVYKDHGSLVSLSRFSTVGSLMGNLMRGSMMVEGRIARFVYISLYPSTACCVRVSNCIDGWRAVIPARCAPGCRNLLIAVQSAPDYGAMTLPLRTLLKAGPAGFPLRFLH

SEQ ID NO: 191925 - protein, 107 aa, Glycine max
  Coding DNA Sequence Number=SeqID_75147
MGLRKKVENGELHKPITTHGSKLVGGGCMNENAIHGAPKRGVENGELHYAITTHGSRLVGGGCMNENAIHGAPKQGSEWRIALSNHYARLQKMGGGCMNENAIHGAP

SEQ ID NO: 191926 - protein, 311 aa, Glycine max
  Coding DNA Sequence Number=SeqID_75148
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=1e-47, Identity=34%"; Hit description= UPI00006A17C9 related cluster
GLHALAIRGLHVLTFRGLHALAFRGLHVLSFRGLHALAIRGLHVLTLRGPHALAIRGPHVLTFRGLHPLAIRGPHVLTFRGLHALAIRGLHVLTFRGPHAIAIRGPHVLTFVGLHALTFRGPHVLTFRGLHALAIKGLQVLTFRGLHALAIRGLHVLTFRGLQALAIRGPHVLTFVGLHALTFRGPHVLTFRGLHALAIRGLHVLTFVGLHALAFRGLHALTFRGLHVLANRGLHALTLRGLHVLASRGLHDLTLRGLHVLANRGLHALTSRGLHILALRGLHALTFRGLRVLIFSVLHICTLRAFKVLCP

SEQ ID NO: 191927 - protein, 616 aa, Glycine max
  Coding DNA Sequence Number=SeqID_75149
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=99%, HitCoverage=47%, E-value=0.0, Identity=52%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam module annotation: Pfam domain module=RVT_1::RVT_2; Domain location=170-401::141-398
HIPDQLRRKLDDKAQAVVMVGYHSTGSYKLYDPIEKKIMFSKDVKFDEASSWNWEGSSSRKNSMVYLNDTESPVQEVNTNQGGASERPTRNVQAPQRLNDCVRFPDTAVADDGELIQLAMLAESEPVSLEQAMKEEHWRNAMLDELQSIEKNETWSLVKLPTSKKCIDVKWVYKTKLKPDGQVAKYKARLVARGFLQRQGLDYNEVFAPVARMETIRLIIAIASWKSWKMFQLDVKSAFLNGELEEEVYVSQPPGFEIKGKEDYVYRLRKALYGLKQAPRAWNKKIDQFLISQGFEKCITEHGIYFRNSDDNQKLIVCLYVDDMIVTGSDTMEIEWFKEAMMRKFEMSDLGVLSYFLGIEIVMSTEGVLIHQKKYARDILKRFNMNNSKPVTTPIDTGTKLIKEGVEELSGCYFVQADCRFMEKPMTSHLVAAKRILRYVKGTEGLGILYRTGIDTPDAELYGYSDSDWSRDVNDRKSTAAYVFMYGNAPFSWCSKKQAVVALSSCEAEYIAASMAACQAQWLCMLMQELGLKSDDKVRIMLDSKSAIDLAKHPVAHGRSKHIETRYHFLRDQVNNDKLELLHCKTEDQLADILTKALKTSTLENLKMKLEMNSTS

SEQ ID NO: 191928 - protein, 184 aa, Glycine max
  Coding DNA Sequence Number=SeqID_75150
  Gene Ontology: Mol. function=phosphoenolpyruvate carboxylase activity; Biological process=carbon utilization by fixation of carbon dioxide
  Homolog annotation: Hit_ID=Q6Q2Z9; Match level="QueryCoverage=82%, HitCoverage=26%, E-value=2e-39, Identity=93%"; Hit description =Phosphoenolpyruvate carboxylase
MYKGYTIPWPWRQYWSWWWPNISGYSVPTPWGTLGSTEQGEMVEAKIGLAQIAVRQLEIYTTAVLLATLGPAIPPREEKWRNVMEEISNISWQCSERQELGHELRSELMTAEKFVMVISGHEKLQQNNRSLRRLIENRLLFLNPLNMLQVERLKRLRRDDDNCKIRDALLITINGIPAGMKNTG

SEQ ID NO: 191929 - protein, 88 aa, Glycine max
  Coding DNA Sequence Number=SeqID_75151
MIGTSKPYTGAKRGIVHGPQVNIGADQKFSPVDVFKHKKKGGDKPWNFNGLIKRQTAPSPSLQNGQVTKSNRTYTLREFSERFAKDRI

SEQ ID NO: 191930 - protein, 79 aa, Glycine max
  Coding DNA Sequence Number=SeqID_75152
PTDTTVSEWQRGADNRKVSPRIIMTKLGLCVPSDTTVSEWQRGADNRKVSPRIIMTKLGLCVPSDTTVSEWQRGADNRK

SEQ ID NO: 191931 - protein, 104 aa, Glycine max
  Coding DNA Sequence Number=SeqID_75153
MLRHNLKLLWTSAHEKNPHPFPRRRGQQNLLMEERITNAKTRIPNQRSKEKEKRKERNEKKEKEKNEKEEMKRKKRKGKEGFPIEDRKKAKREGSEENRIIPDQ

SEQ ID NO: 191932 - protein, 126 aa, Glycine max
  Coding DNA Sequence Number=SeqID_75154
  Subcellular localization annotation: CTP_CleavageSite=49; ConfidenceScore=5.31e-01
MVVILIVVASDDCAGSSSSSDRGSGVNGDCNNNSVTTIVSTVMVAIVMMVTMFQDNNSARGGDNGDDNNNSIGRGGDRANGGYGDDVGDDCREGAVSVVVVVVTEVLVLAMVVRSVIIKCKVPVLF

SEQ ID NO: 191933 - protein, 119 aa, Glycine max
  Coding DNA Sequence Number=SeqID_75155
  Homolog annotation: Hit_ID=Q2QW42; Match level="QueryCoverage=44%, HitCoverage=28%, E-value=3e-09, Identity=55%"; Hit description =Expressed protein
SVEESASHLFFHCSKVLPLWWESLSWVNMVVVFPQHPRQHFIQHMHQSYEGLMAKRWKWWWLVLCFYPSPTCVFGLRAIESKEQGVREEKEMAIADMEYMIEKRAKKKVYARFKEIARL

SEQ ID NO: 191934 - protein, 124 aa, Glycine max
  Coding DNA Sequence Number=SeqID_75156
  Gene Ontology: Mol. function=carbonate dehydratase activity; Cellular component=chloroplast; Biological process=carbon utilization
  Homolog annotation: Hit_ID=Q1PG92; Match level="QueryCoverage=84%, HitCoverage=55%, E-value=9e-28, Identity=60%"; Hit description =Carbonic anhydrase
  Pfam annotation: Domain name=Pro_CA; Domain location=1-113; Score= -24.9; E_value=0.00014; Accession=PF00484.9; Description=Carbonic anhydrase
MVISMNLTCHLNPCQQKIIEFIEHWVQICTPAKSKVKTEANTLEFSEQCTSCEKAIMLYRIENFLLTSMQEAVNVSLGNLLTYRFVRDAVVKKTLALKGAHYNFVKGTFELWDLDLKISNSVSV

SEQ ID NO: 191935 - protein, 43 aa, Glycine max
  Coding DNA Sequence Number=SeqID_75157
MYGVAFPCWTEKICEEVILSPQLEVVARLHPHKMVLSTNKSLA

SEQ ID NO: 191936 - protein, 160 aa, Glycine max
  Coding DNA Sequence Number=SeqID_75158
  Gene Ontology: Mol. function=carbonate dehydratase activity; Cellular component=chloroplast; Biological process=carbon utilization
  Homolog annotation: Hit_ID=Q5NE21; Match level="QueryCoverage=99%, HitCoverage=57%, E-value=4e-59, Identity=77%"; Hit description =Carbonic anhydrase
  Pfam annotation: Domain name=Pro_CA; Domain location=78-160; Score =30.6; E_value=9.5e-09; Accession=PF00484.9; Description=Carbonic anhydrase
MAGGSYEEAIAALTKLLSEKADLGGVAAAKIKQLTAELDTATANGSTPFNPDERIRTGFAHFKNEKYQKNPELYGELAKGQSPKFMVFACSDSRVCPSHILDFNPGEAFVVRNIANMVPPYDKTKYSGTGAAIEYAVLHLKGMSYRWRILWSLGTAAVEV

SEQ ID NO: 191937 - protein, 134 aa, Glycine max
  Coding DNA Sequence Number=SeqID_75159
MGIIEETQNTKLKRVLDAIKLEGIIVSLPSFSFSRNPNGLAKRLVLCRLSALSSSSLVANLRDQIYDCWTRSVTIVALAFLHGFSLRFLLGDFVELESDFGVEVILLHLDDRGPVEPTGMDGGEGDVVVEGCGN

SEQ ID NO: 191938 - protein, 74 aa, Glycine max
  Coding DNA Sequence Number=SeqID_75160
MQQGQTYISIVRFPDPNYAKVAHGGHQWSVVVEEELRVLGEGLGEVKEEEDGCFTLLDTFEACNTRPGEFGSPG

SEQ ID NO: 191939 - protein, 283 aa, Glycine max
  Coding DNA Sequence Number=SeqID_75161
  Gene Ontology: Mol. function=hydrolase activity; Cellular component =mitochondrial outer membrane; Biological process=aromatic compound metabolic process
  Homolog annotation: Hit_ID=Q1S4M1; Match level="QueryCoverage=99%, HitCoverage=84%, E-value=1e-123, Identity=74%"; Hit description =Alpha/beta hydrolase
  Pfam annotation: Domain name=Abhydrolase_1; Domain location=45-265; Score=51.4; E_value=3.1e-12; Accession=PF00561.10; Description =alphabeta hydrolase fold
  Pfam annotation: Domain name=LIP; Domain location=32-278; Score= -132.3; E_value=0.059; Accession=PF03583.5; Description=Secretory lipase
  Pfam annotation: Domain name=Peptidase_S9; Domain location=31-278; Score=-83.4; E_value=0.087; Accession=PF00326.11; Description=Prolyl oligopeptidase family
  Pfam module annotation: Pfam domain module=Abhydrolase_1::LIP::Peptida se_S9; Domain location=45-265::32-278::31-278
MEESYEKSSKGLEIFCKSWLPSASKPKAAVFYCHGIARKLASSGYAVFAMDYPGFGLSEGLHCYIPSFDGLVDDVIEHYSKIKENPEFHSLPSFLFGQSMGGAVALKIHLKQPKAWDGAILVAPMCKIADDMVPPKFLTHILIGLANVLPKHKLVPNKDLAEAAFRDLKKRELTAYNVIAYKDKPRLQSAVEMLKTTEEIERRLKEVSLPLFILHGEADTVTDPSVSKALYENASCSDKKLQLYKDAYHGLLEGEPDEIITQVFGDIISWLDEHSLKHNQSSS

SEQ ID NO: 191940 - protein, 129 aa, Glycine max
  Coding DNA Sequence Number=SeqID_75162
MRVASNHDSEGSNKNRPFFFFFCFHVPLGVMENKFPCGVELPCLLESVDYSEKEHVAGLEAGCVWAQRKSECKNLGDELKQSNMASRRARSGPVKLGVERLGNMEGSLKRLEMTEKAFELGEGGTGVRF

SEQ ID NO: 191941 - protein, 44 aa, Glycine max
  Coding DNA Sequence Number=SeqID_75163
PFIHIYSKKRGVKGIKPITNGPPGSMETRSEERKRGVAHWREVG

SEQ ID NO: 191942 - protein, 487 aa, Glycine max
  Coding DNA Sequence Number=SeqID_75164
  Gene Ontology: Mol. function=transcription regulator activity; Cellular component=nucleus; Biological process=regulation of transcription
  Homolog annotation: Hit_ID=Q0WNR2; Match level="QueryCoverage=94%, HitCoverage=97%, E-value=6e-51, Identity=29%"; Hit description =Putative bHLH transcription factor bHLH090
  Pfam annotation: Domain name=HLH; Domain location=284-331; Score =45.0; E_value=2.5e-10; Accession=PF00010.16; Description=Helix-loop -helix DNA-binding domain
MSGLGVVECLRPLVKTNAWDYVVVWKYGDDPTRGSCSVNIDVVKPEEEKGEVCNLAQSCRDDHFHFQHLVRTKACEALAQLPFALSLYSGVHGEVAISQQARWLTQVDSIGTQVLIPIVGGLIELFTENLIPMDMNIIEFITAHGCVSLEQEAISAQSYTSLNINEHLPLREQYSHWSPHMPTLTPSVHQPATRQCSSHPSIEGPSSGSNPSTEEPSFDSKFASLIPHEYLKPPVKKSPIPKTETPKYNKTSGKWQRGLSSHCSNEEDDESKSVKESQKEVYQAKNLVTERNRRNKIKKGLFTLRSLVPRITKMDRAAILADAVDHIKELQTQVRELKDEVRDLEEQECEKNTPQLMITKGKKPEGTRSNPPLNQSSSGCTKKMQMEVQVEVHHISKTDFLIKLCSEQTQGGFSKLMEAIHSIGLKVDSANMTTLDGKVLNILTAKANKQDIHPTKLKEYLIQKTSDDRQSSKQVRENGGDMKSSRK

SEQ ID NO: 191943 - protein, 270 aa, Glycine max
  Coding DNA Sequence Number=SeqID_75165
  Homolog annotation: Hit_ID=Q9LK89; Match level="QueryCoverage=41%, HitCoverage=45%, E-value=7e-17, Identity=42%"; Hit description =Arabidopsis thaliana genomic DNA, chromosome 3, TAC clone: K16N12
  Pfam annotation: Domain name=DUF1645; Domain location=79-248; Score =54.2; E_value=4.4e-13; Accession=PF07816.2; Description=Protein of unknown function (DUF1645)
MNNMQNKTSSIKKLKMHALSILRMSHLFHKSNDVAPIPSMLNQNFISENQIQIDKEENFEEQQEFSFPNFCAQGTFTFADDIFDNGKIRPKSTTFDQSLIFTIVQDNDTLHLQPPLKKLFVDKELNGFSSQSKGTSKGSCNETSQKMTMVEVLTLNNQCKKSKSTGFSNTWRLREDIKLRSISDGKDAFVLLNPSGSMPMKSNEAKEEIVVSKRKKGEKRKTTFSPHEKIYVMNKKRKETNKRKSFLPYRQNLIGVFANVNGFSRILSPF

SEQ ID NO: 191944 - protein, 57 aa, Glycine max
  Coding DNA Sequence Number=SeqID_75166
MVCTRLVVAGSVMVVVTGCPVLIKPRQDIKLSSNLIILLSCSPCPEQLEQNSTNNEY

SEQ ID NO: 191945 - protein, 718 aa, Glycine max
  Coding DNA Sequence Number=SeqID_75167
  Gene Ontology: Mol. function=protein serine/threonine kinase activity; Cellular component=membrane; Biological process=protein amino acid phosphorylation
  Homolog annotation: Hit_ID=Q9FFW5; Match level="QueryCoverage=52%, HitCoverage=55%, E-value=1e-132, Identity=61%"; Hit description =Similarity to protein kinase
  Pfam annotation: Domain name=DUF1842; Domain location=248-336; Score=- 50.4; E_value=0.092; Accession=PF08896.1; Description=Domain of unknown function (DUF1842)
  Pfam annotation: Domain name=Extensin_2; Domain location=11-306; Score=-126.6; E_value=0.023; Accession=PF04554.4; Description =Extensin-like region
  Pfam annotation: Domain name=Pkinase; Domain location=349-622; Score =130.4; E_value=5.1e-36; Accession=PF00069.15; Description=Protein kinase domain
  Pfam annotation: Domain name=Pkinase_Tyr; Domain location=349-622; Score=166.2; E_value=8.4e-47; Accession=PF07714.7; Description =Protein tyrosine kinase
  Pfam module annotation: Pfam domain module=DUF1842::Extensin _2::Pkinase::Pkinase_Tyr; Domain location=248-336::11-306::349 -622::349-622
MSTKHTEEDNDSSYLTIPNKDKRKQKSSHDNDKESAPSPKPPDLDTQESAPSNSPPPSPPPPPPQLKLPILSPPRLKPSSISLLSPPSKDLSGSPSWSPPPPPSRSPSPPSSLSLLSSSSPPPSPSSPPPPPSSPPPPPPPSSPPPPPSSPAPPQSVPLRNNGNPSPPPPYYPRKQSPPQFHAPPPPSSLPRNAPSNDSTPRTSDKPRSGHHGKHGGATSSHTNSTGSSPNQTSSDDNSEKYIGYTLIGIFAVALVALAVSLVFVFKKKKSRGDAHVTPYMPPLNIHVKSGVNGHYYVQQPIPSPPLANNYGNGNASMHHLGASFDSAQFKSAQIVFTYEMVMEMTNAFSTQNVIGEGGFGCVYKGWLPDGKAVAVKQLKAGGRQGEREFKAEVEIISRVHHRHLVSLVGYCICEQQRILIYEYVPNGTLHHHLHASGMPVLNWDKRLKIAIGAAKGLAYLHEDCCQKIIHRDIKSANILLDNAYEAQVADFGLARLADASNTHVSTRVMGTFGYMAPEYATSGKLTDRSDVFSFGVVLLELVTGRKPVDQTQPLGDESLVEWARPLLLRAIETRDFSDLIDPRLKKHFVENEMLRMVEVAAACVRHSAPRRPRMVQVVRSLDCGDESSDLSNGVKYGHSTVYDSGQYDKEIMLFRRLANGTFVDSDFEIYSREYSLSRDTSMTSRGSHQELIRHSSSGSLNLELSTCIGPVLNENRD

SEQ ID NO: 191946 - protein, 64 aa, Glycine max
  Coding DNA Sequence Number=SeqID_75168
MSMEFTLLDQPTCRSPLYMLHMDVFSYGLLLLQQINMVGAMTKVEEVVAVVKGVGDKRKRRRMR

SEQ ID NO: 191947 - protein, 80 aa, Glycine max
  Coding DNA Sequence Number=SeqID_75169
MEALRYYQIQMMIPEGHEKRGDKRSVSYSAVAEHSNPGLVWDSNSGAIFNTSHCNRNSSNSHAIAALPWYRLQKPFFTPE

SEQ ID NO: 191948 - protein, 78 aa, Glycine max
  Coding DNA Sequence Number=SeqID_75170
MIDLTSCLHLLPLALHSFLSFSQSSFCFPLCAALNEENHADLVNALKVAFKTGDLKRQTIYAIDAYRSSNEFFKPMSS

SEQ ID NO: 191949 - protein, 85 aa, Glycine max
  Coding DNA Sequence Number=SeqID_75171
MKNKNSVDLAQEAFLLCLPCISVRGEDLHYVCIGLGVLLPPRLHLQELLDHSGDDERLGFRGGREELILCISLPLCNLCAEGLRP

SEQ ID NO: 191950 - protein, 183 aa, Glycine max
  Coding DNA Sequence Number=SeqID_75172
  Subcellular localization annotation: CTP_CleavageSite=46; ConfidenceScore=5.58e-01
MSLQAQPQQQPQQPVQVYPTNQPPSSSHHSNGSFGAVFIVLAIILVISVVACFLGRLCNKRYNNSHSNRQKPSKQHNRPQIHNLHPRDHHHHEGDIEFGDKGMPPPIIRTQQEHGHGHGHEGDIEFEGDIRMPPPIIRTKERGHGHHGHGAAGTGGPQLHHVNDTMKDFNLRPGHGEVLRAGA

SEQ ID NO: 191951 - protein, 170 aa, Glycine max
  Coding DNA Sequence Number=SeqID_75173
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=O82531; Match level="QueryCoverage=85%, HitCoverage=65%, E-value=3e-73, Identity=91%"; Hit description =Proteasome subunit beta type 1
  Pfam annotation: Domain name=Proteasome; Domain location=1-155; Score= 28.0; E_value=1.8e-08; Accession=PF00227.16; Description=Proteasome A- type and B-type
MKSRIFMDLHKVITIIKSQRERRKYNIYQHQHNKQMSCPAMAQLLSNTLYYKRFFPYYAFNVLGGLDNEGKGCVFTYDAVGSYERVGYSSQGSGSTLIMPFLDNQLKSPSPLLLPAQDAVTPLSEAEAVDLVKTVFASATERDIYTGDKVEIVILNASGIHREYMDLRKD

SEQ ID NO: 191952 - protein, 110 aa, Glycine max
  Coding DNA Sequence Number=SeqID_75174
  Homolog annotation: Hit_ID=Q00VP3; Match level="QueryCoverage=66%, HitCoverage=37%, E-value=3e-08, Identity=40%"; Hit description =Homology to unknown gene
MASSFSFCTLKFRTKPNDSRSSASSLPRILFCHNLHDDIHTPTDQINRRQLILRSSEIATIGAIFDFSGKKPDYLGVQKNPPALALCPVTRNCVSTSENISDRTHYAPLW

SEQ ID NO: 191953 - protein, 139 aa, Glycine max
  Coding DNA Sequence Number=SeqID_75175
MSIISFTKYHKFPKSSILDSYHFILLVRSVIRRKQWLSNQSFGNPPSLWIKINTDKAVRGNLGRASSGASIGIESAFIAKIIASILAIEKVILGGIHHLLSFLRSLVDTQMSFLFKGSFSLASLGMVWPSQVFCSSFHQ

SEQ ID NO: 191954 - protein, 138 aa, Glycine max
  Coding DNA Sequence Number=SeqID_75176
MTVLVKTVIDRSPLKMGLDYHCCIQFKLIKNLKCHVHSSMLLLGFFNSKSSFLCNQIVSLKPNARIEVHRCRLQLRCKCVNNYDYAINRKVDDDFDAFITSKVWTYIMVFLSKLKMESLESETSLEKERLWESEATVV

SEQ ID NO: 191955 - protein, 79 aa, Glycine max
  Coding DNA Sequence Number=SeqID_75177
MSGCSHSRNEENNPNPRAILGLAAKQDLEVEQLDVKTPFLHGDLEEEIYMEQPKRFCRTRERTLSVPPEENLGSDKLVQ

SEQ ID NO: 191956 - protein, 263 aa, Glycine max
  Coding DNA Sequence Number=SeqID_75178
MKHMSDARVTSVRVFPNLSVPVAVIACLGIGFLQSISWNPSPIKIPEDEYQQGLISCKHSPHGRMILVKGGLAKCLSTGFLQSATWNPLPITRTLDFSPNNLQIPTIILFVAGGVGILITIDEKIRDKEFGHYACILVVINLEDALPNLILMQSEEARENKEQIDPKLTGKGQRYALVIFQNQPAIDVVHVGTNSGKDNEFPRIDGGLLDFLENTEDQVDDLLLQQHHVDPYGGYYFQNMQVALVEMDSPFRQVMLKAKKKKQ

SEQ ID NO: 191957 - protein, 307 aa, Glycine max
  Coding DNA Sequence Number=SeqID_75179
  Gene Ontology: Mol. function=nucleic acid binding; Cellular component= nucleus; Biological process=multicellular organismal development
  Homolog annotation: Hit_ID=Q1SD98; Match level="QueryCoverage=98%, HitCoverage=83%, E-value=1e-121, Identity=67%"; Hit description=Zinc finger C-x8-C-x5-C-x3-H type (And similar), putative
  Pfam annotation: Domain name=zf-C3HC4; Domain location=248-285; Score= 14.2; E_value=0.0054; Accession=PF00097.15; Description=Zinc finger, C3HC4 type (RING finger)
  Pfam annotation: Domain name=zf-CCCH; Domain location=171-197; Score =26.8; E_value=7.5e-05; Accession=PF00642.15; Description=Zinc finger C-x8-C-x5-C-x3-H type (and similar)
  Pfam module annotation: Pfam domain module=zf-C3HC4::zf-CCCH; Domain location=248-285::171-197
MGDSDQLSKSAKNQKTEQDNEEDSNKESSLLHIQKKTLKPDNKLYFSTGSSKSSASAEPIEESGKPVFQFESSKEIQVQHGSKATATLETETEFSKDARAIRERALKQAAGSLKGKSASSEDEKLYKGINNYKDYKAGFRREQAIASEKAGGSHGPLWASAHIRVSARFDYQPDICKDYKETGCCGYHDSCKFMHDQGDYKSGWQMEKEWEEVEKARKMKLAAGEDADEEEGANLTDEDEDGSLPFACFICRNPFVDPVVTKCKRYFCEHCALKHHAKNKKCFVCNQPTLGIFNVAHEIRRKMAEDK

SEQ ID NO: 191958 - protein, 107 aa, Glycine max
  Coding DNA Sequence Number=SeqID_75180
  Homolog annotation: Hit_ID=Q00VP3; Match level="QueryCoverage=75%, HitCoverage=39%, E-value=5e-20, Identity=57%"; Hit description =Homology to unknown gene
  Pfam annotation: Domain name=DUF1499; Domain location=1-101; Score =14.2; E_value=4e-06; Accession=PF07386.2; Description=Protein of unknown function (DUF1499)
MHHSSKNYNPEGRKNPVSREEAMEELIDVIESTTPDKFTPRIVERKEDYIHVEYQSSILGFVHDVEFWFPLGKGSTVEYRSASRLGNFDFDVNKKRIKIYLHANYAT

SEQ ID NO: 191959 - protein, 102 aa, Glycine max
  Coding DNA Sequence Number=SeqID_75181
MMSPNRVSEDRGTPPQHFRCIDVCQCFCSFLEAVSQCVSCFRNWVGANGSSFSIVIASIVYFDSVLICVEGKFEVNTRAKCNALSGCNLIYNLLGVCLVQLI

SEQ ID NO: 191960 - protein, 93 aa, Glycine max
  Coding DNA Sequence Number=SeqID_75182
  Homolog annotation: Hit_ID=Q2HSM1; Match level="QueryCoverage=48%, HitCoverage=10%, E-value=5e-10, Identity=58%"; Hit description =Cdc20/Fizzy; WD40-like
  Pfam annotation: Domain name=WD40; Domain location=25-63; Score=23.0; E_value=0.001; Accession=PF00400.22; Description=WD domain, G-beta repeat
MDRRNVGAKCKGYLLLGYNVGLGSTTEFVNIDEEEGIVTSIAWAPDGCHLAIALNNTHVQLWDTHVSRLDMGRGYAFFLWKDMVEMYDSNDVE

SEQ ID NO: 191961 - protein, 143 aa, Glycine max
  Coding DNA Sequence Number=SeqID_75183
  Homolog annotation: Hit_ID=Q38888; Match level="QueryCoverage=72%, HitCoverage=40%, E-value=5e-26, Identity=59%"; Hit description =OBP32pep
MGDSEVAKFGLKVGKNEKNGFPRGLDPAISKFFVQLQSVVKSRLSRLAKQDGMSLMSSVQRKGDKSFSYSEAELNEQLQAWRENPSWVDKPPLIKVTAPKGSLCNLDVEVDVGLPPDAVYNIVIDPDNRRVFKNIKVGDFNHP

SEQ ID NO: 191962 - protein, 437 aa, Glycine max
  Coding DNA Sequence Number=SeqID_75184
  Gene Ontology: Mol. function=mannose-6-phosphate isomerase activity; Cellular component=cytosol; Biological process=carbohydrate metabolic process
  Homolog annotation: Hit_ID=Q5BMC5; Match level="QueryCoverage=95%, HitCoverage=96%, E-value=1e-170, Identity=72%"; Hit description =Phosphomannose isomerase
  Pfam annotation: Domain name=PMI_typeI; Domain location=20-395; Score= 398.7; E_value=8.5e-117; Accession=PF01238.11; Description =Phosphomannose isomerase type I
MELAPSNSNQQHENNNSNKVQGLHCSVKNYEWGKPCRDSLVAKLFSMNSGSLQSSQLDEDQPYAELWMGSHVSGPSFIVFDGSQQRVTLKSWLLENPNVLGPKVVEKWGGDLPFLFKVLSVDKALSIQAHPDKELARTLHKLHPDVYKDGNHKPEMALAVTEFEALCGFVTLKELKAVLTVPEVVELVVAENVNSVLQITDEDGEEKVKPILKSLFTDIMSAGKERVAGAVDRLRSRLHKESQVRQLTEKEQLVLRLEKQYPSDVGVIAAFFLNHVKLAPGEALFLGANEPHAYICGECIECMATSDNVVRAGLTPKHRDVQTLCSMLTYKQGSPEILRGVPINQYVNKYIPPFEEFEIDCCILPQGEKVVFPAVPGPSIFLVTVGEGMMTTESPKGYPITEGHVLFVAANTEITVSSAPQLHLFRTGVNSRFFQDS

SEQ ID NO: 191963 - protein, 81 aa, Glycine max
  Coding DNA Sequence Number=SeqID_75185
MEDISKRFKELNVCGKVTLKCKLREFSYLDLNSMCASPEKVKTKGIGEDSWSLVHNHLLKELAKWSDEYMNLLGGIDRFEE

SEQ ID NO: 191964 - protein, 421 aa, Glycine max
  Coding DNA Sequence Number=SeqID_75186
  Gene Ontology: Mol. function=RNA-directed DNA polymerase activity; Cellular component=extracellular region; Biological process=RNA -dependent DNA replication
  Homolog annotation: Hit_ID=Q1RYC6; Match level="QueryCoverage=61%, HitCoverage=42%, E-value=9e-66, Identity=46%"; Hit description=RNA -directed DNA polymerase
MVHYRGLQQHQRSFAKVGSLSKGDGGEKFTWFKPNGATRSKLDKFLVSPEWLAKWPGSTQHPLDRNFSDHFPVLLRSKFVDWGPKPFRILDCWFLDKSFNSIVQTWNRDQYGDTLKKYKKIEVELNQLEVSTIDRQLSPQDRGANKKTAPRKFVGSCTISSRSRGCNASFIVLIPKVENPQALDEYRPVSLIECMYKIVAKLLANRLKKIMPLIINERQFAFIEGKHLLQSALIANEVAEEAKRRQKLCIVFKVVYEKAYDSVSWEFLVYMLKSPSSEFFPQRGLKQGDPLAPFLFNIVAEALNGLVREDVKKNIFRGFPVGSNNVDISILQYADDTIFFGEASMENVKAIKAILRTFALVSGLKINFAKSSFGAIGMSNRWKLDAASCLNCSLLSIPFVYLGIPIGANPRRGQLWDPILK

SEQ ID NO: 191965 - protein, 124 aa, Glycine max
  Coding DNA Sequence Number=SeqID_75187
  Homolog annotation: Hit_ID=Q00M75; Match level="QueryCoverage=24%, HitCoverage=5%, E-value=1e-09, Identity=96%"; Hit description=PPR -repeat containing protein
MLHITTCSNRTSYCDIARIIVYYAYFGLAQPPNPLRFVQQFFRHNVNGRPSITTLCQDTAVEVDEYVEDFSDDEDLTSSEVATTEALSVKRYLRASPGAAVKLCLGDLLVMGSNPETVSLHMQG

SEQ ID NO: 191966 - protein, 294 aa, Glycine max
  Coding DNA Sequence Number=SeqID_75188
  Gene Ontology: Mol. function=chromatin binding; Cellular component =chromatin; Biological process=chromatin assembly or disassembly
  Pfam annotation: Domain name=rve; Domain location=143-266; Score= -6.7; E_value=0.022; Accession=PF00665.16; Description=Integrase core domain
  Pfam annotation: Domain name=zf-H2C2; Domain location=87-125; Score =5.5; E_value=0.068; Accession=PF09337.1; Description=His(2)-Cys(2) zinc finger
  Pfam module annotation: Pfam domain module=rve::zf-H2C2; Domain location=143-266::87-125
MEFLKDYDFELSYHPGKANVVADALRRKSLHMSVMMVKELQLIKEFRDLNLAVERGASGLIKFKERVCIPQVDELKQAILDEAYKSRLSFHLGSTKMYQYLKKNFWWNGMKKDVARYVAKCLTCRKMKVEHQQAPGEIQPLEIPEWKWNNISMDFVSGLPRMRHNYGVIWVIVDQLTKSSYFIPINMKYKLEKLIELYIKEVFKLHGVPLSIVFDRGPHFTSRFWDLLRACMMEQQGGWDKCLPLLEFTHNNFHANIRMTPFKALYGRKIKQVHGKTILLVKVIWSTTDEGNAT

SEQ ID NO: 191967 - protein, 70 aa, Glycine max
  Coding DNA Sequence Number=SeqID_75189
  Subcellular localization annotation: CTP_CleavageSite=32; ConfidenceScore=5.62e-01
GGETSSSTESNGGSQNVRLSIPILPNSSSSLVSMTYSPSFNSSQLVAQRKLFAESQIGRTSFQRLLEPNS

SEQ ID NO: 191968 - protein, 80 aa, Glycine max
  Coding DNA Sequence Number=SeqID_75190
MGAKYFEVVKRGSHPNNRWSPDKIRDIVMLCTSPCCTIAHLHHVVTHVSYVGLIFCHRKPECPYHLLNCIHGALCPQMFK

SEQ ID NO: 191969 - protein, 54 aa, Glycine max
  Coding DNA Sequence Number=SeqID_75191
MGCYEEHKFAPKRNDNHGSGAKVGYKNNNGVKPKVQGKVFAMSESGATTSNDLI

SEQ ID NO: 191970 - protein, 277 aa, Glycine max
  Coding DNA Sequence Number=SeqID_75192
MEFQMGNISGFPKEQSWLLTKKEPKSIGHVMGDKTKFVSLKAKEGGYVTYGDNNKDKILGIAYPHPFFFPNPLNISFYLHLQPTSIANNKNKMMKSIGHKPLAPKAKLKKEKEPTKGGPSNRAKCSACSPSPPPSPKPTLWFVEEHYEVSYKFSFTKKELIQPKFFYTTAHVDGESSYLCVEVKGKQIVITPELWEDIVGLYSEGMMANEKGLNDVGVKFNKVTRQGKGKIWHWPLVDGTPTFVIFDCLDHYSQGEQSCITDRGRSTSHLFDYKSQF

SEQ ID NO: 191971 - protein, 81 aa, Glycine max
  Coding DNA Sequence Number=SeqID_75193
  Gene Ontology: Mol. function=RNA-directed DNA polymerase activity; Cellular component=chromatin; Biological process=RNA-dependent DNA replication
MDWLSFNHVLLNCKNKTLIFGACAQDIPRSSSLEISNESLGIGGMPVVCEFPKVFPKDVTKLPPERELEFAIDLLLGSSPI

SEQ ID NO: 191972 - protein, 110 aa, Glycine max
  Coding DNA Sequence Number=SeqID_75194
GINCLIEFISSYPIAVANVGRGAVGALVPQLLPETESWQRLQTRSPAQGQFIFEFPAQVKAMQYSGDKEEAVPGLRSRPDLRTFEMASPGSVKGLVLDLLDQVLKVGSRL

SEQ ID NO: 191973 - protein, 71 aa, Glycine max
  Coding DNA Sequence Number=SeqID_75195
MLYDTLNDPLGSQFERAKPYHKWFWVDEDVGGLEGMKARGERVPKGRGVWVERRRGISIEEKRKEKVKEKE

SEQ ID NO: 191974 - protein, 114 aa, Glycine max
  Coding DNA Sequence Number=SeqID_75196
MEEEGCLHAHFGYIWCHVSQLDEPHVPLITIKANFFGHDVNERPSRTTVLQDTAVEVYEDVRDFNDDEDLTLSEIAYYRDVIGEEIPEGEMFLSDEERDSLGDESDHFKDMTSP

SEQ ID NO: 191975 - protein, 126 aa, Glycine max
  Coding DNA Sequence Number=SeqID_75197
MGYGGTCLEHLEEQKFFGAHSKERPRRDDGTGDGPVVAVQFCIGRDKGYDGMHKVPHHLGVKTKDLSTHIEVPFKDKTNEATLVLSLDQEASSGSHRVSHRLEVKVKDSTLSPQTHRGILQGKNHE

SEQ ID NO: 191976 - protein, 109 aa, Glycine max
  Coding DNA Sequence Number=SeqID_75198
MIQKAIDEGRLKFEEKPMRASYVEPVQILMVETTLYEEEVNQAFEDFEKEEEFVFPPTEEKLLKFLVKKQKVEKEVMLCPRYSAIFDKFTTKSFEASDIQKNIIRRFKK

SEQ ID NO: 191977 - protein, 131 aa, Glycine max
  Coding DNA Sequence Number=SeqID_75199
MEDKELEGTKDVCMILITNIDKELCPLTITEFLRRHTSVSARVVIFPSFSMEVYTKGAIMVNSTREFQELCDFLNNPNRIITSSTGRPWVILEKVVGFKNIKASIGALVHTSEVDFIPHFLPSFLPTKRIF

SEQ ID NO: 191978 - protein, 66 aa, Glycine max
  Coding DNA Sequence Number=SeqID_75200
MSFHSPSQARVKEEGYIRLSAAKSNARSLLENNVLYRPCIVSSVVNGGWRFMAESQKSTIKIWRMA

SEQ ID NO: 191979 - protein, 272 aa, Glycine max
  Coding DNA Sequence Number=SeqID_75201
  Gene Ontology: Mol. function=endonuclease activity
  Homolog annotation: Hit_ID=Q1S9P8; Match level="QueryCoverage=75%, HitCoverage=68%, E-value=2e-16, Identity=45%"; Hit description =Endonuclease/exonuclease/phosphatase
  Subcellular localization annotation: CTP_CleavageSite=42; ConfidenceScore=5.41e-01
MAPPSTTRNATAIWWRFFKFPQRYSAMAPPWSLFDNTDSVKRARAVASVQKCSVKCARTLTFSWTNLGFKLWYTGKVRGKNGVGTMVDKGLIFHEKFFLGGDLNGHVGIQKRQFTGAHGGFGFRDLNKEGQTIIDFSMAYDVKIMNTCFQKREEHLITYKSGSSRSHIDFFLVKSVDKRVCKDCKVVGKQGNANLIWDGMAKKIRKFVKAVMGESKGFGLRDKESWWQDEKVKENVKNKRQSLEILLGCNNAENWSRYQYAGNETRKVISEA

SEQ ID NO: 191980 - protein, 72 aa, Glycine max
  Coding DNA Sequence Number=SeqID_75202
MKKTVTEITEYLELGEGGIIGTMEVGKFVEVDRGLVETAVYAGFTTPAVQCPHSQTAEESSKQQGNAEVDEP

SEQ ID NO: 191981 - protein, 74 aa, Glycine max
  Coding DNA Sequence Number=SeqID_75203
MDLREGQTQPILDPNQPSHVYHLALDIGVMKLGTESVPSENFKILLCLPEAIGWANVYNPAENICSSDGCACSG

SEQ ID NO: 191982 - protein, 180 aa, Glycine max
  Coding DNA Sequence Number=SeqID_75204
  Subcellular localization annotation: CTP_CleavageSite=52; ConfidenceScore=5.63e-01
MASANNNSSLPPPLLPVPMLAPRSLVFFSHVVMAKLTDFNCLLWRSQKQFFLASSIVQPRGICGIDCTSTFNPLRGNTHSSSNYDSVYGNQGRGDGGCSYGQGGRGGARGRGCGRFADVQCQICCKFGHEAFHCWYRNDTSYSSNPSQPNSQPNSQTNYQSNYPKQNPNSPYPYSPYPFY

SEQ ID NO: 191983 - protein, 196 aa, Glycine max
  Coding DNA Sequence Number=SeqID_75205
  Gene Ontology: Mol. function=nucleotide binding; Cellular component =intracellular; Biological process=small GTPase mediated signal transduction
  Homolog annotation: Hit_ID=Q9LYJ3; Match level="QueryCoverage=91%, HitCoverage=96%, E-value=9e-99, Identity=98%"; Hit description=ADP -ribosylation factor-like protein
  Pfam annotation: Domain name=Arf; Domain location=4-177; Score=433.0; E_value=3.9e-127; Accession=PF00025.11; Description=ADP-ribosylation factor family
  Pfam annotation: Domain name=MMR_HSR1; Domain location=18-129; Score =7.4; E_value=0.00021; Accession=PF01926.13; Description=GTPase of unknown function
  Pfam annotation: Domain name=Miro; Domain location=19-129; Score =19.0; E_value=7.7e-05; Accession=PF08477.3; Description=Miro-like protein
  Pfam annotation: Domain name=Ras; Domain location=19-179; Score= -47.1; E_value=9.6e-06; Accession=PF00071.12; Description=Ras family
  Pfam module annotation: Pfam domain module=Arf::MMR_HSR1::Miro::Ras; Domain location=4-177::18-129::19-129::19-179
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKLIGDGSKIDLCIIQAA

SEQ ID NO: 191984 - protein, 172 aa, Glycine max
  Coding DNA Sequence Number=SeqID_75206
  Homolog annotation: Hit_ID=Q1T4S3; Match level="QueryCoverage=47%, HitCoverage=5%, E-value=6e-20, Identity=67%"; Hit description=Zinc finger, CCHC-type
  Subcellular localization annotation: CTP_CleavageSite=72; ConfidenceScore=5.44e-01
LLKRCFYMAKLVKIGLYHFSNLLQPLQKPAACVSKSSVNTVVSNSVNVASTSSDSYFVWHSSTDAEYRSLALATAEVTCIQSLLTELKVPHAPPVIFCDNMSTVSLAHNPVLHSRTKHIELDYRNTFLSLSLLPKSLYVGVSEIELGSSSLLRVWCSVQDNGFMNLWFTLVQ

SEQ ID NO: 191985 - protein, 66 aa, Glycine max
  Coding DNA Sequence Number=SeqID_75207
  Homolog annotation: Hit_ID=Q1SRP4; Match level="QueryCoverage=43%, HitCoverage=6%, E-value=5e-07, Identity=72%"; Hit description =Integrase, catalytic region
MTVFSFNHPILMMGVGTYASMDNTLISKESLDVEATLTELETTVLTEDLETQAAGFCKGWSKFEKW

SEQ ID NO: 191986 - protein, 656 aa, Glycine max
  Coding DNA Sequence Number=SeqID_75208
  Homolog annotation: Hit_ID=Q6EPR2; Match level="QueryCoverage=29%, HitCoverage=40%, E-value=2e-38, Identity=45%"; Hit description =Enhancer of polycomb-like protein
MGKFSQNAWSWEFKWRGRLFDYEYAMAVDFMDEISDISIQNQVQDNMIWKADPSGVYSTKSAYRLLMPSISPAPTRRNFQILWHLKIPPRAVVFSWRWIRAIGALPADPASHFIQFCDGFAARSNHSRRGMWWIALSITIWQHRNSLLFQGTPFEPQKVLEDALFLVWSWIKVGDKGFNTSFNHWSTNLVEALGGTFVPCNCYLQYLWRNLDQAKSLLEALIKREEKKREVMDSEVTLQRMQMKYKHETEFLEDNIALSGFTPFTSKFVSSEEEYFDSDDVMTNRLLRTRSTALQSFPSHETNIPMVPAASTKQEFRRRYVPHGWPHKLDPLEPVLLFTKPLLPDKLAMAGIMPPDSITPNGRVSPPPYRYRGRMGRGGRIIFDRWNPLMQTPIDCVEACLIVYDDGNGDIEPVTCPKDPVLAHSILQNYEFQKNQRPPKKFGIQDFVEDRKNIIEAEISKVHKEITNIKYPTSDPSFINMEEDQLRAFIALVDAKIRTCDHSLKNMHQSEANFMQNMAWGSASSSHPTPMEPLNNNGRVDVTNSIDQVYEAMQLVDAPFSYIPDMVQKSFNCLQNISQSQPILDVEDEMVGFSNRVDVSLDTTNQIADLLDWFDGPIIGWSDLVDWTSQPDESQNEQQGGGDLDGFQTECYNLNF

SEQ ID NO: 191987 - protein, 192 aa, Glycine max
  Coding DNA Sequence Number=SeqID_75209
  Homolog annotation: Hit_ID=Q8GYN9; Match level="QueryCoverage=47%, HitCoverage=26%, E-value=1e-13, Identity=44%"; Hit description =Putative enoyl-CoA hydratase/isomerase
MGGAQLTTQVEFVCGTGSVFKNLGSKCHQVLNRELLPQGPIQDPKVSITMRKKKRIEKVNLGYSFPDGLLVDNVGEVLAGVVVVGGDDPPNDVVGWNFSVDAAEAVVPTGSEARGEFAGCVVIRRRSEVVGHRGKPSGGGFKVVVVVVLRHRIVRAIGSDHQWRARKIVKLLVGFIHSIRSLTFPGGRGGWG

SEQ ID NO: 191988 - protein, 90 aa, Glycine max
  Coding DNA Sequence Number=SeqID_75210
MEDEEKRALMVEIDEECVSPNKSEQEKEDILEKHNMKSVFAFNPTFDNRDVLFRFNPRNGRSVLTYRDVVVVYLDGELKVFVVVFGIGSE

SEQ ID NO: 191989 - protein, 143 aa, Glycine max
  Coding DNA Sequence Number=SeqID_75211
  Gene Ontology: Mol. function=phosphoglycerate kinase activity; Biological process=glycolysis
  Homolog annotation: Hit_ID=Q337T1; Match level="QueryCoverage=98%, HitCoverage=21%, E-value=2e-15, Identity=36%"; Hit description =Methyltransferase family protein, expressed
MVRFDSNILLRRECDKKNQSVYNATYTIKYLHEAGANVILVSDWNMNTPEFHIESVADFVSEVLQIQVVPLHGSSFNKLSKTNGLEKENILLLENLSNIKEEVANSLEFARVLSSGVDIFVNDSFSNSHKVLASTVGVTPFLL

SEQ ID NO: 191990 - protein, 174 aa, Glycine max
  Coding DNA Sequence Number=SeqID_75212
  Homolog annotation: Hit_ID=Q84VH5; Match level="QueryCoverage=53%, HitCoverage=13%, E-value=1e-29, Identity=73%"; Hit description =Envelope-like protein
KRTGKRCLDCKEIMDLIKAAGLLKTVTNIKLPKGNHCQASPALAKEKGKLSAGKLSVNQHPNILNNIDSVKKRESPLSLHYKLFEGTHVPDIVSTSGKAAASGAVSKDDLIAELKDTCKVLEATIKANTEKKMELERLIKRLSDNGIDDGEAAEEEEDAAEDTESDDDDSDATP

SEQ ID NO: 191991 - protein, 863 aa, Glycine max
  Coding DNA Sequence Number=SeqID_75213
  Homolog annotation: Hit_ID=Q10MI0; Match level="QueryCoverage=9%, HitCoverage=7%, E-value=3e-14, Identity=55%"; Hit description=Cyclin, putative, expressed
  Subcellular localization annotation: CTP_CleavageSite=14; ConfidenceScore=5.21e-01
MNPANCKGWLNGVGTSTGAGGWNAGGASSTGGSGWNAGGASATGGGGWNVGGASSTGGGGWNAGGASSTGGGGWNAGGPSSKRDAGSNHSAPSLLNTESTSNPFSSKGAEDSAWETKSNSNKTSSWGAAVDKTGIASNADQSGGWGSGGGSWGQAEHKTGSVGDGNQNSNWNTTKASEGESSGWNSIQKSNETSSAGWGGGNGFKSGSDEGNLNSTWSGWKSGSSGVKQAGNPAGTSDIDANQDAGWKNKPNKDGSESSGWETKNNWNAPVSSSNDKVEKGNDQGGWNAGKASGGSAVDFSQASGWKGGLSEHTQEGSNWGDKKFGSCDACGDSSGNQGSNGWGQKSNWNSGSRSGNETQNSHWSSGRNEPGNQDSNLDKKSNWNSGNSGNLASDPKSSNWNSGYENSNWGTNVNNKSSWGTGNENKNSSWSSGHSDPGNQDANQGKKSNGNSGNSGNQPSDPNSNWNSNKSSWSAGNENKKSNWSSGDPGNKDSNWGNKNNCISGSGDANQNTTWRSNSSWNTANASSDDGNEGSNENSDGVGGGNWRGGYRGRGGSDRGGFRGRGFRGKGERGGFSGRGELGGFGGRGEQGGFGGRGGDQKEDVEAEAGEGTINLVVGTTEGILVRMGPLTGRRGQIMVDGRIVMDLRLGTRILVTRIGRAGAREMQIRSILAGTKEVEEIRAGVQQVELMIMDLRLGTREMQIRSIQAETKLEISRAGVQQVVETAEASWKKSTTEGTNIQGGGWNKGSSSNTTSKDETIQTLGCQCLSKFIYCQVDATYTHNIEKLVPKVCMLSREHGEACEKRCLSASSLQCLSAMVWFMAEFSHIFVDFDEGDGEKILMVGLKGLNIPVVNTDPEKC

SEQ ID NO: 191992 - protein, 93 aa, Glycine max
  Coding DNA Sequence Number=SeqID_75214
MVSVEGSSLRDSIGGEFEVRGYDDVVFDVSSNSYSLGSIFSSSSDLSAFEGSNDLLAFLIQLPMNTTKNMVESVATLVVTTVAEVRTSQRATS

SEQ ID NO: 191993 - protein, 131 aa, Glycine max
  Coding DNA Sequence Number=SeqID_75215
  Gene Ontology: Mol. function=DNA binding; Biological process=DNA integration
  Homolog annotation: Hit_ID=Q1SIT1; Match level="QueryCoverage=91%, HitCoverage=39%, E-value=2e-19, Identity=49%"; Hit description =Integrase, catalytic region
MSSSCRDRAQSLLGCKDPATSLLIKLERKRKLQLSELDEIRLEAYENSNFYKEKTKKFHDNLIAKKNFVVGQKILLYNSRLGLMSVEIKSESTDKSFKVNGHRLKPFLTNPSLVDVVVEETSLLHPTFLPP

SEQ ID NO: 191994 - protein, 123 aa, Glycine max
  Coding DNA Sequence Number=SeqID_75216
MKSFNGAPITARINPDDINPLLPLLFLKTNSPRNAEIKPQAFICSLTSSLAQAGEKRASTGGGYSVSLGFSLLCLRVSSMRGSVFLSQASSVTRIQREVNHTRVKRDWENESLGGCSFLRRQR

SEQ ID NO: 191995 - protein, 153 aa, Glycine max
  Coding DNA Sequence Number=SeqID_75217
  Gene Ontology: Mol. function=nucleic acid binding; Biological process= DNA integration
  Homolog annotation: Hit_ID=Q1T010; Match level="QueryCoverage=64%, HitCoverage=9%, E-value=5e-20, Identity=41%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MAGNSGVPGNLPILDGKNLDRWDILAKCYTGGDKVRKVKLQSLRRQYELLQMEASERIENYFATVLNLTNQMKSYESKDVESMKIEELQGSLEAQELKLIERESVKPTEQALQAQTFQEVRNSEEEANEAQDGDSVSDPVTATGDYQWWRSSF

SEQ ID NO: 191996 - protein, 74 aa, Glycine max
  Coding DNA Sequence Number=SeqID_75218
MDVIFHETESFFVNPRLQGKRNLEVIEAEDESTLESLPLSLQGAQGANGEITNEIKEEAHNKAEKEKRFFGTIY

SEQ ID NO: 191997 - protein, 83 aa, Glycine max
  Coding DNA Sequence Number=SeqID_75219
MDKSLKVGENEWRDKERRSMKFCASNKAHENPRALSCISGPIFLESSIQCPWWVELHHSLPLEKDLTSNPEVLEALSFFPQHL

SEQ ID NO: 191998 - protein, 122 aa, Glycine max
  Coding DNA Sequence Number=SeqID_75220
MTNEEYRTKNDVEVDYGHNSEMTGLGGLAARLGELMLQSEVTLLTLASWSNPFQGGGNDEILPPRALDKRLQEDWARDARQGHRVLMSLRGRSSELQEPLDLRSNPFQEGGNDAILPTKGIG

SEQ ID NO: 191999 - protein, 231 aa, Glycine max
  Coding DNA Sequence Number=SeqID_75221
MLATVKEGRTTTSVVAAEEYTTEFRAYNDDAWYTVRVLLEGERLIVKYQNFSDENDEAFEPSRFGDCEDLEDFKERFRPLSRQLQDAECRRFGPGARVCACHSFAPDDVRFYDAVIDGVQENEHSWEIGEEECLCTFLLYWLHGPNARNLTAEPIDNICEVQSAWELDPAVTSFLDMAGKKIHLFSSRYVLASSGVSGLEMGPYCNGSSNTTHRMSYFERMEKASSICIFL

SEQ ID NO: 192000 - protein, 94 aa, Glycine max
  Coding DNA Sequence Number=SeqID_75222
MTKDNDWYLKALHWGNERHLLSIAANKTVDTRRFTSSSAQTNSVILTLESRDMRRYPSETDSAPFIILEQQAEWVNAQRQTLRPLSFKHNKLSG

SEQ ID NO: 192001 - protein, 89 aa, Glycine max
  Coding DNA Sequence Number=SeqID_75223
  Subcellular localization annotation: CTP_CleavageSite=48; ConfidenceScore=5.42e-01
MVGLDKFRTSFSSQVFHSLGTQRKITLYLSPTSGVVQLGKVAHESQPRSEIFRSLTLTGGSNSKLEINWWTKSAILPILFIKLKLVNQS

SEQ ID NO: 192002 - protein, 147 aa, Glycine max
  Coding DNA Sequence Number=SeqID_75224
  Gene Ontology: Mol. function=RNA-directed DNA polymerase activity; Cellular component=mitochondrion; Biological process=regulation of transcription, DNA-dependent
MEVAKQTLNSWSSNEQLLARKAYDYIRGAKPAINWNSVVWNPVIPPEMSFILWLATKNRLLTLDRAAFLNKGLLCPLCRTKAESHAHLFFSCRISLRVWANIRDWIPLHRQTISLQRTINSLIRGRATSGTWGKFWCLASATTVYYT

SEQ ID NO: 192003 - protein, 655 aa, Glycine max
  Coding DNA Sequence Number=SeqID_75225
  Gene Ontology: Mol. function=RNA-directed DNA polymerase activity; Biological process=RNA-dependent DNA replication
  Subcellular localization annotation: CTP_CleavageSite=52; ConfidenceScore=5.23e-01
MGTTSGSGETQESSSTSLSGGIVGGQDTPSACLASQKNTAPQVFDKKPGSFSASTRVPAHQVFVKMYGCLAGPYFIFQRPLLLKVMPPFFDFDHLTASKGSISFARELVEVDASLDLIKEVRFKLPTAKYKVVSVVKQDNRITTSEGPTAGSPSVQSQDAKVVAFTETNLTNPSGKPKEDQTSKSSLHQDSTEDPGDGFVRDTMKREFGDWNFSHNFASHNAGYFNNILSPNDRFNGVDISAYEMQDFADCCFELGLGNLNSHGSMYTWTNGRVWSNLDRAFCNQLWLNSFENSSCKVVGFESISDHAPLVVTTKVLVPRDGWSHQVSGCCMFEVCKRLKTHKAPLKLLFKQEFSHIGNRVEQAEAEYNRLLNFLQSGYPTQESRVKDVAQLIRNSTSSQSEIANAFVNHFKALFSAQELHHSASLAVYNSGMDNNKVSGPDGYNALFFKKAWNIIADDIFAAVNKFFMSGKLLKQINHALIALIPKSDQASQVNHFRLISYSNLLYKIISKILANQIAPVLEHIIGASQSAFLKNRNMMDNIFLVQELLRKYARKRISPRCLLKIDLHKAYDSISWEFLDWMLKSMGFLAQFCSWIMECITTTSFSLVVNGSIYGHFKGQCGLRQGDPLSPYLFVLCLEYFSCDLQSLKDNINF

SEQ ID NO: 192004 - protein, 207 aa, Glycine max
  Coding DNA Sequence Number=SeqID_75226
  Homolog annotation: Hit_ID=Q2HSY3; Match level="QueryCoverage=64%, HitCoverage=66%, E-value=9e-09, Identity=28%"; Hit description =Nucleic acid-binding, OB-fold
MVLFGLLLLSRVLKDRSFSGTFVLLRYPAMSRKENLISELHMRKGTWKIVVRITDLWEVRKQNSKQAIEMVFQGTKIGATLWQELFAKFRHKIVDNQSEYRVSPVPHLVYFVRTTSVKEIQRLEIPPNVYMSTPFADIISGVAPCHTLMDIVGVVTDLIGVKIVNPPHRMTVRLRGNSNSDIIMTFGRTMLFSFMMLLTKTFCFRNH

SEQ ID NO: 192005 - protein, 56 aa, Glycine max
  Coding DNA Sequence Number=SeqID_75227
MMGVVKMTVVTIETIVAGLVARYDSYSTLSYSILTAKWVVKIHGSKRIEYEAVARY

SEQ ID NO: 192006 - protein, 124 aa, Glycine max
  Coding DNA Sequence Number=SeqID_75228
MVFHLRLVMSFKTKKGEHRLKEAIKGINSRKHQQELSQGYCASNQWGKTHQKIMMMDGSNSHKVKKEIGKKNSLSHGRRRVWWSKEVSSTTTSTKEGFVRNGLSWCPLTLKLLFVESLLISTIP

SEQ ID NO: 192007 - protein, 310 aa, Glycine max
  Coding DNA Sequence Number=SeqID_75229
MIAETKPFGSDENGEEEEEEGVVEICVPDRGSTHNRKGEANVKEKDVATGWLCETGNVISTIGGGSMVFAVGGGLTEEEDGLVTLGSKGDIGGDFAKAEDGEGCLGTMVFSIRRMSSSLEAMEVWAAVVEVWIAASLAMAASRRSTQAVESSVSAIEEWQDFRRVLGIHEGLVVHFAAPDRNTSFYLHFMPPLDRQTSGRPYSTTRTYVFIVDITNHIISTPTPLVLPPDAVDIIGYRSQYLTVEPPRGRQIWWMSIQDGLQTLTTPWYQFLKDNNLMARDEVIFYYQPNQGVWEIILRKEIGWNEDEST

SEQ ID NO: 192008 - protein, 102 aa, Glycine max
  Coding DNA Sequence Number=SeqID_75230
MRIQRIRLLQYLLRKRKSGVDSSRESVISPNSNIRLMSVETALGTKGKCEARDNRIGVHKKPTHTAKISLNGKRSVQNELVILELKNLELNIHYVARIASCN

SEQ ID NO: 192009 - protein, 261 aa, Glycine max
  Coding DNA Sequence Number=SeqID_75231
  Gene Ontology: Cellular component=endoplasmic reticulum
  Homolog annotation: Hit_ID=Q1RY25; Match level="QueryCoverage=80%, HitCoverage=22%, E-value=3e-09, Identity=43%"; Hit description =Reticulon
VAAEANKLLKYNPTIGVEVVNGGTRLTLEQKRMQPNPCQAGDHIWALRYILEVVPFLLLGVEYGHLIAGNLISEGFKSWLLDTWSACTHKKKVMASALMAFWNLSSKIEVIGVKITSGSNRSTFLRCLEFRCLTNMTFEFVSPNLRLTMFEVSAPLVHVVSMVIIGFHILFLITADDDDSNHCLAFMFMNLVNPCLITANVVPFLLLGVKYGYLIAGNFISEGFKSWLLDTWSACTHKKKVMASALMAFWNLSSIKTRMFT

SEQ ID NO: 192010 - protein, 104 aa, Glycine max
  Coding DNA Sequence Number=SeqID_75232
  Subcellular localization annotation: CTP_CleavageSite=46; ConfidenceScore=5.44e-01
IGQLAQRARSSSARTLAQWASAQAKLSARSPMRKAQGALSTKGAVLANKGPTMKDGVEKDEDNEDEEYDDDYESEYIKRKIRNKLPMAPGINLAKLQKVLALVP

SEQ ID NO: 192011 - protein, 668 aa, Glycine max
  Coding DNA Sequence Number=SeqID_75233
  Gene Ontology: Mol. function=hydrolase activity, acting on glycosyl bonds; Cellular component=intracellular; Biological process =carbohydrate metabolic process
  Homolog annotation: Hit_ID=Q1T2K1; Match level="QueryCoverage=95%, HitCoverage=80%, E-value=2e-83, Identity=27%"; Hit description =Tetratricopeptide-like helical
  Pfam annotation: Domain name=PPR; Domain location=112-146; Score =12.0; E_value=0.29; Accession=PF01535.11; Description=PPR repeat
  Pfam annotation: Domain name=PPR; Domain location=147-181; Score=3.6; E_value=2.8; Accession=PF01535.11; Description=PPR repeat
  Pfam annotation: Domain name=PPR; Domain location=216-250; Score =10.1; E_value=0.47; Accession=PF01535.11; Description=PPR repeat
  Pfam annotation: Domain name=PPR; Domain location=283-317; Score =28.7; E_value=2e-05; Accession=PF01535.11; Description=PPR repeat
  Pfam annotation: Domain name=PPR; Domain location=385-419; Score =21.7; E_value=0.0027; Accession=PF01535.11; Description=PPR repeat
  Pfam annotation: Domain name=PPR; Domain location=488-522; Score =40.9; E_value=4.4e-09; Accession=PF01535.11; Description=PPR repeat
  Pfam annotation: Domain name=PPR; Domain location=523-556; Score=8.5; E_value=0.74; Accession=PF01535.11; Description=PPR repeat
  Pfam annotation: Domain name=PPR; Domain location=559-593; Score =14.7; E_value=0.13; Accession=PF01535.11; Description=PPR repeat
  Pfam module annotation: Pfam domain module=PPR::PPR::PPR::PPR::PPR::PP R::PPR::PPR; Domain location=112-146::147-181::216-250::283-317::385 -419::488-522::523-556::559-593
MLVSTLKPWWSWMQKPLLHSFIRAITTLTPIPPHTFLHLHNPSDSVIYLKNREIDAFIKLRNLNAALAVFHTTPLRDTVTYNLIISAFRNQPNHALRFYAEMGLRGIRESPTTLTSVIAVCTNAMFFKEGVQVHCRVIKFGFTCNVFVGGALVGFYAHVGECGVALDLFDELPERNLAVWNVMLRGLCELGRVNVEDLMGFYYPRMLFEGVQPNGVTFCYLLRGCGNQRRLEEGKKIQGCVLKMGLVESSVFVANALVDFYSACGCFVGARRCFEDIENEDVISWNSLVSVYAENNMLIEALEVFCVMQVWRKRPSIRSLVGLLNLCSRSGELCLGKQVHCHVMKFGFDEGSVHVQSALIDMYGKCMDIESSVNVFECLPKRTLDCFNSLMTSLSYCDAVDDVVELFGLMFDEGLVPDGVTLSTTLRALSVSTLASFTSSQLLHCYALKSGLGGDAAVACSLVDSYSRWGHVELSRRIFESLPSPNAICFTSMINAYARNGAGKEGIAVLQAMIERGLKPDDVTLLCALNGCNHTGLVEEGRLVFESMKSLHGVDPDHRHFSCMVDLFCRAGLLHEAEELLLQAPGKGDCFMWSSLLRSCRVHKNEEVGTRAAQVLVELDPDDPAVWLQASIFYAEIGNFDASRQIREVALSRKMTREIGHSLTEIRQ

SEQ ID NO: 192012 - protein, 61 aa, Glycine max
  Coding DNA Sequence Number=SeqID_75234
  Subcellular localization annotation: CTP_CleavageSite=44; ConfidenceScore=5.06e-01
MTMSPRISFSHDFSQSDVIPVEKHPLRSNSSGLNSSMDFDFCVRESLELESSSADELFSHG

SEQ ID NO: 192013 - protein, 103 aa, Glycine max
  Coding DNA Sequence Number=SeqID_75235
  Gene Ontology: Mol. function=pyroglutamyl-peptidase I activity; Biological process=proteolysis
  Homolog annotation: Hit_ID=Q8GVF6; Match level="QueryCoverage=84%, HitCoverage=31%, E-value=2e-16, Identity=48%"; Hit description =Pyrrolidone carboxyl peptidase-like protein
MHFYEKIFIFMLQLHLGVNSGAARFVIEHQAANEPTFRCPDELGWQPQSTPMFCISKTHYLFFNFLSRQVPIVLEDGGISRTRQNSMPVDAILKSLKKGELMT

SEQ ID NO: 192014 - protein, 873 aa, Glycine max
  Coding DNA Sequence Number=SeqID_75236
  Gene Ontology: Mol. function=nucleic acid binding; Cellular component= beta-galactosidase complex; Biological process=DNA integration
  Homolog annotation: Hit_ID=Q1SIY6; Match level="QueryCoverage=98%, HitCoverage=95%, E-value=1e-144, Identity=50%"; Hit description =Integrase, catalytic region; Zinc finger, CCHC-type
  Pfam annotation: Domain name=rve; Domain location=437-571; Score =111.6; E_value=2.3e-30; Accession=PF00665.16; Description=Integrase core domain
  Pfam module annotation: Pfam domain module=RVT_2::rve; Domain location=539-709::437-571
MDSKTPLFKGKNYKLWTARMKAHLEANDLWEVIEEDYEDNLTMAQLKSHTLKKSRKSKEKATLFDVVSEENFTRIMHQNIAFEVWNFLKAEYEGDDKVKGMQVLNLIRVFEMQRMKESETINEYTDKLLSIANQIRLLSSEFSYSRIVQKILVTLHERFDATISVMENSKDVSKITLAELNNALQAQEQRRLMRSEDFVEGALQANLQSNQGEKDKRRSFKKNFNQVLQLAKRRGNFLLANIVTRRNDAQAVSEQEEEQQLFVASYFTSSSSSSSDCWLVESSCTNHMTSNEELFRDLDKSQVSKVRIGNVDYITVKGKGTVIIKSSTSTKQIYDVLYVPNIDQKLLSVGQLLEKGFKVFFEKKQCTIKDPYDNEATMTNTETWHKRLGHFHHVTILNMQKKELVRGFPHIEFNLPSCKACHFGKQAKLPFQKGAWRANMKLQLIHTDVVGPHKTPSLNRSKYYIAFIDDYTRMCWIYFLRFKSEEYTSNEFDKFFEETGIEHQLTAPYTPQQNGVNERKNRTIMEMARWLLHKKELPKEYWAEATNTVVLLLNRLPTKAIDGKTPFEACCKARYNQNVTSYCNTKAMEDYQLDVKLAKGDEDKVYLLKKVLYSLKQAPRACDNFFVVSLYVDDLLVTGSNIELIQQFKEDMMRVFEMTGLGEMSYFLIIEIKQRQNEIFICQKKYAEEILKKFHMGNCKSMSTPMCQKEKLCKDDGTTKVDEFEYRSLVGFLMYLTTRPDIMYAISVLSRFMNYANESHLRVAKRVLRYVKGIVSFSVKFCLTPSFELQGYSDSDWVGSLDDMKSTSDFCFNFESGIFTWSSKKQEIVAQSRAEVEFIAATTSLSQTIQFFMARPSISASNYSSSEMFRKIV

SEQ ID NO: 192015 - protein, 218 aa, Glycine max
  Coding DNA Sequence Number=SeqID_75237
  Gene Ontology: Mol. function=metal ion binding; Cellular component =nucleus; Biological process=multicellular organismal development
  Homolog annotation: Hit_ID=Q9LDT3; Match level="QueryCoverage=99%, HitCoverage=96%, E-value=7e-64, Identity=57%"; Hit description=Axial regulator YABBY4
  Pfam annotation: Domain name=YABBY; Domain location=5-163; Score =270.2; E_value=4.2e-78; Accession=PF04690.4; Description=YABBY protein
MSTLNHLFDLPEQICYVQCGFCTTILMVSVPCSILSTVVTVRCGHCTSLLSVNMKKASFVPFHLLASLTHLEPKEGASDDGANKSLNSYNNASIITTNSDCEEENVTQISNVVHKPPEKRQRTPSAYNRFIKEEIKRLKSENPNMAHKEAFSTAAKNWANFPPSQCDGEADSCNGTEQLGDLDSHEEPRDAIEVHKEGQGFRGRKAPRNSIWERAPFE

SEQ ID NO: 192016 - protein, 164 aa, Glycine max
  Coding DNA Sequence Number=SeqID_75238
MAMKPVLVGIRPNSFRFGREISELIEYGFGFGDYPTFLIEVGVRDKDVTTHPIPFPYRRQVQVYIEESESRTERQYPSPPCPVAMSTYLHVPQTVKWRNYPSAILLPEDDFSGNFPENLFPELFRKNLLPEEEFVSSGSTYKQLPEECHPECFRKKLLPEVSFF

SEQ ID NO: 192017 - protein, 71 aa, Glycine max
  Coding DNA Sequence Number=SeqID_75239
MNTGSFSLKSFEGPSKLEASLGEIGSRKTGRRLASVPDRSSSIKRCGSTNKRLVIKATEIWMTPLPVKEDK

SEQ ID NO: 192018 - protein, 408 aa, Glycine max
  Coding DNA Sequence Number=SeqID_75240
MANALPEASMSFRAQFCHDGKDKESVIQGSNSLLEEEATRRGTKKMSFPKNDKFLRIGLNRLINIGVHSEPLVREFYVIVVLKDDYTKMKAWVKNHFVKYDAISINSMLGSTFKLRKGKQSSYEEWLNKERSTQKEQQPMITEMEEVLCLPNRHFKCGVIVKKLHKVDMTGLAQFWTTFILDNIVPNSHKPNIPMKRAQLLYAIIKDLSINIGQILSYKIFTISRKKCSPLGLPCLITALYARRGIDNTGDIVEPYVALKPNMDTRYILKTFSKIGDESLPVQPPPPPPKPLSLNERLEKILEEMNENLEANHRLNLLIFYHLRVIDPRSSRSRLSRSRKELLTEGQRGGEATHGIGARAEDVANDGINVSNAIVNDEVREEKEISLEDTTEGAPQENNNEEEFETTE

SEQ ID NO: 192019 - protein, 103 aa, Glycine max
  Coding DNA Sequence Number=SeqID_75241
MDESSSYETLDHPDLTLRGLATYLSPFYPFLSQEEVLAAIGWPTTFGDQASEGQMSSEATNGVGDGVEDVFDAGGFKEGTDVGTTTATIGVNDEAGAKEESAP

SEQ ID NO: 192020 - protein, 172 aa, Glycine max
  Coding DNA Sequence Number=SeqID_75242
  Homolog annotation: Hit_ID=Q1S3Z1; Match level="QueryCoverage=64%, HitCoverage=9%, E-value=1e-08, Identity=35%"; Hit description =Integrase, catalytic region; Zinc finger, CCHC-type
MVMEKMKIERFTRSNDFSLWRVKVNSLLVHQGLDAALLEEAIMKAEEKKEIQRNGDSKRDKIDEGLFTRGRQEKKDFKPKKSLRSKSRGKKIRCFFICDKEGNFKKDCPNNKDRSNEQNKHMGNEWFETYKQIDGGSMLLGNNKACKVVGIGSIRQRMYDGVKAVLGCAKGH

SEQ ID NO: 192021 - protein, 118 aa, Glycine max
  Coding DNA Sequence Number=SeqID_75243
  Homolog annotation: Hit_ID=Q1SDG1; Match level="QueryCoverage=42%, HitCoverage=4%, E-value=1e-07, Identity=50%"; Hit description =Integrase, catalytic region; Zinc finger, CCHC-type
MVSGNTTIGQPREDWSKEERRLVQYKLKAKNIITYALGIDEYFRVSNCKSAKDMWDTLQEHEMELQRLNQHEENDKKKGIALKASSSIQEESDMEDSIDLYDDEELSLFVKRFNNFLG

SEQ ID NO: 192022 - protein, 379 aa, Glycine max
  Coding DNA Sequence Number=SeqID_75244
  Gene Ontology: Mol. function=RNA binding; Cellular component =ribonucleoprotein complex; Biological process=mRNA processing
  Homolog annotation: Hit_ID=Q657G7; Match level="QueryCoverage=81%, HitCoverage=49%, E-value=3e-88, Identity=52%"; Hit description =Putative CRS2-associated factor 2
  Pfam annotation: Domain name=CRS1_YhbY; Domain location=197-305; Score=60.6; E_value=5e-15; Accession=PF01985.11; Description=CRS1 YhbY domain
  Pfam annotation: Domain name=Extensin_2; Domain location=1-329; Score= -138.5; E_value=0.068; Accession=PF04554.4; Description=Extensin-like region
  Pfam module annotation: Pfam domain module=CRS1_YhbY::Extensin_2; Domain location=197-305::1-329
  Subcellular localization annotation: CTP_CleavageSite=79; ConfidenceScore=5.31e-01
MVIVALSSSLPAGRNLFSSIPPTPPPPTTVSATPQPPIPIPKYPPPRKKPQPPPPQNPALKHPRRSKYHRPVPRDGGIIASDGADRAVVIGESGVSYLLPGAPFEFQFSYSETPKAKPIAIREPAFLPFAPPTMPRPWTGKAPLKGKKSKKVPLFDSFNPPPAGTKGVKLVEMPGPFPMGQFPLEGKSREEILGEPLKKWEIHMLVKPMMSYNRQVNLGLEWWFHCDMLGTNVVGETAIAVVNGRDGLTHNMLELIHSHWKRRRVCKIRCLGVPTVDMDNVCHHIEEKTGGKIIHRVGGVVYLFRGRNYNYSTRPQYPVMLWKPAAPVYPKLIQDAPGGLTKDEADELRMKGKSLLPICKLGNHLLGFHICLSNAHTRM

SEQ ID NO: 192023 - protein, 118 aa, Glycine max
  Coding DNA Sequence Number=SeqID_75245
  Gene Ontology: Mol. function=RNA-directed DNA polymerase activity; Biological process=RNA-dependent DNA replication
  Homolog annotation: Hit_ID=Q1SY48; Match level="QueryCoverage=85%, HitCoverage=26%, E-value=3e-14, Identity=37%"; Hit description=Zinc finger, CCHC-type; Peptidase aspartic, active site
  Subcellular localization annotation: CTP_CleavageSite=41; ConfidenceScore=5.61e-01
MDMGLASGTKSLENSISLSGGKPNTSSGNSLTTRRSPMETLVSTSRSLFKEDTKSLRFSTHEQDINEWVAPESNSTSKGISLMKHLPSIKSLDFEASTSLRVNVGSSGLGIITKGGGS

SEQ ID NO: 192024 - protein, 282 aa, Glycine max
  Coding DNA Sequence Number=SeqID_75246
  Gene Ontology: Mol. function=RNA binding; Cellular component =ribonucleoprotein complex; Biological process=mRNA processing
  Homolog annotation: Hit_ID=Q657G7; Match level="QueryCoverage=88%, HitCoverage=38%, E-value=5e-46, Identity=42%"; Hit description =Putative CRS2-associated factor 2
  Pfam annotation: Domain name=CRS1_YhbY; Domain location=4-87; Score =40.6; E_value=5.5e-09; Accession=PF01985.11; Description=CRS1  YhbY domain
MEGIYSENLKVCMKRTTLCEGEIFTAKNGVYTSLVKDVRDAFEGSILVKINCKGLDPSDYKKIGAKLKDLVPCVLLSFDDEQILMWRGKDWKSRYPQPLPVFTPSKANIVGNLENSGETDDNQYKHDGNMVNTSPKMLSLWKRAIQSSKALLLDEFNLGPDALLEKVEEFDTVSQALEHSHPAFSLSSKENDAEGSSANFENSYSSDGLHTEEDYAKFEDSYSSDALQTEEEEEEEEDEDEDEDEDYYDDEDDDLYAVDTSAQPGSLPVDMIVKKLKQRPLE

SEQ ID NO: 192025 - protein, 343 aa, Glycine max
  Coding DNA Sequence Number=SeqID_75247
  Gene Ontology: Mol. function=2-C-methyl-D-erythritol 2,4 -cyclodiphosphate synthase activity; Biological process=terpenoid biosynthetic process
  Homolog annotation: Hit_ID=Q681X6; Match level="QueryCoverage=77%, HitCoverage=94%, E-value=3e-53, Identity=37%"; Hit description=MRNA, complete cds, clone: RAFL21-92-C23
  Subcellular localization annotation: CTP_CleavageSite=39; ConfidenceScore=5.08e-01
MSFFTESSSHTWQPTITSDSTTLSYWLNWRFFFCALWILASMALASFLIFKYEGFNKSRSNSGENQGEEEAGLLYEDEAWNTCLKGIDPSWLLIYRIICFVVLLALIIASVAADGAGIFYFYTQWTFTLVTIYFGFGSYFSLYGCSLKQNKYGSSTVNGTSLDPELGTYIVDARKTAGLWGYIFQIIFQTCAGAVVLTDSVFWFILYPFLMSKDYSVDFLIFCMHSINALFLLGDTSLNCMWIIHVCVSLWWPYPFLDLSSSYAPLWYLAVALMHFPCYGVFALIDEQQLDACLHHRATDAFPHLASYLVIFINYVHGDSKITNRKMKAGKKETVSQKDQKAK

SEQ ID NO: 192026 - protein, 461 aa, Glycine max
  Coding DNA Sequence Number=SeqID_75248
  Gene Ontology: Mol. function=nucleoside-triphosphatase activity; Cellular component=peroxisome; Biological process=cell division
  Homolog annotation: Hit_ID=Q9LZF6; Match level="QueryCoverage=49%, HitCoverage=48%, E-value=1e-107, Identity=70%"; Hit description=Cell division control protein 48 homolog E
  Pfam annotation: Domain name=AAA; Domain location=389-461; Score= -0.0; E_value=0.00021; Accession=PF00004.19; Description=ATPase family associated with various cellular activities (AAA)
MEAGKKGGGVNDNEKNDIYWFPVEDLARLQFQKTPIYIDVDDGRTKVCAFAPAVLDSIVTFGFDCFNPFQAFDDSKTGVQGLVENGVTKVPLMFYCENSNLNDGVTNASNSKISIPIIDLTGIHDDPILRDHVVGKVRYACEKWGFFQVINHGIPTQVLDEMIKGTCRFHQQDAKVRKEYYTHKVSQKVAYLSNYTLFEDPSADWRDTLAFSLAPHPPEAEEFPAVYRLISLPLPTNRPNSIDPALKRSGRFDSEIDIGVPDEVGRLEVLRVHTKNMKLSDAVNSACLTSISVATLQCIREKMDVIDLEDESIDAEVLNSMAVSNEHFHTALGTSNPSALREIVVEVPNVSWEDIGGLENVKRELQETVQYPVEHLEKFEKFGMSPLKGVLFYGPPGCGKTLLAKAIANECQANFISVRGPELLTMWFGESEANVREIFDKAKQSAPRVLFFDELDSIATQ

SEQ ID NO: 192027 - protein, 328 aa, Glycine max
  Coding DNA Sequence Number=SeqID_75249
TLADKFRNCKEAEHWSLYKFFNLVLQGLTVFGVVALVCLVPPVRFVQVGLGVYFALVVLLFGLVDFIIESGCEEHGMKRYLGIEILDLDGYSRKFVHELSEGLVVFLSLIGQGGRGHAVRPVTDDLCTESFDKGVEAVYAPRKTSRCSFGSVVSSYRLRLSGFHPKGMSASKIWSTKRCRRTICALRCMWERLKSSAVLPMCWGCDFPWVRSGEPLAGHGQHLALSTLPPGVAPSKQCSFGVVVVFVFVIDRVLTMGECERIDEKPQEWMWLSEVLNFTRRLESKYMLSGARMRERGRGRHKGYCSLVDNSLELIDNVRDKHLPIDKR

SEQ ID NO: 192028 - protein, 103 aa, Glycine max
  Coding DNA Sequence Number=SeqID_75250
KFPIKNLAFHCKAAPFNYKMRVFEENYRLHSGRDVSSTSKNLEITPKPRIFLKAKPLKGFSVLKGSLSVIFALSATRACVANSLPDSPHSLSELMSRLADVAR

SEQ ID NO: 192029 - protein, 476 aa, Glycine max
  Coding DNA Sequence Number=SeqID_75251
  Gene Ontology: Mol. function=helicase activity; Biological process =viral genome replication
  Homolog annotation: Hit_ID=Q9LTU4; Match level="QueryCoverage=57%, HitCoverage=19%, E-value=4e-74, Identity=51%"; Hit description =Helicase-like protein
  Pfam annotation: Domain name=DUF889; Domain location=1-210; Score =239.8; E_value=5.6e-69; Accession=PF05970.5; Description=Eukaryotic protein of unknown function (DUF889)
MRVLSSASGQPNNQELKQFSDWLLDIGDGKVGQANDRFSEITLPDEFLIKDYIDPVQAIVEATYPNLIHNYSNTDYLQKRVVLASKKDIVDKINDYVLSLIPNDEKEYCSADSVDKSDELLNPAFGLLTPEFLNSLQTSGIPNHKLKLKVGTPIMLIQNLDQADGLCNGTRLIITRLGSNVVESEVITGPNTGNRIYIPRMNMSPSDSPWPFKLIRRQFPFIVSYAMTINKSQGQSLEHVGLYLPHRVFSHGQLYVALSRVKSKKRLHILIHDNQEPSGSPLSFHRQWMYRYPKHVLFHYDGNKHFIRVRTYGSKCLFADGLKEFRRAHDLNESVILHFVAFHKNTTFSIDVIGPIHRQVRVKPVISTKRHIFTTDVTKEMIQHRLPLSVHTVSSSSSFEICLWFQKIYYPSAGTGKTHPVARHHPVEAKLHDESRLIQRCFDDNKDDDKGDDKKLKGQSKNEFKMFKIESRTLKD

SEQ ID NO: 192030 - protein, 128 aa, Glycine max
  Coding DNA Sequence Number=SeqID_75252
MASTTNSLVAMVDSFTCMIRSLSSLDAHTYGGCIVGMCYFREGEELLEINPNAAAEQDNHEDGSAEGVDNDTNRVMGDNKNDVEAFTKKVDDYDDAKTPSTRSLPPTTSVSLEHALRVWESLLRMGCE

SEQ ID NO: 192031 - protein, 63 aa, Glycine max
  Coding DNA Sequence Number=SeqID_75253
MKFGGAVPFLIPMTRCIINCSNIKVEGKEHQDGCGGSDNNLGDDVVVRVDNRLGMASIVMTNY

SEQ ID NO: 192032 - protein, 128 aa, Glycine max
  Coding DNA Sequence Number=SeqID_75254
MAGGKRQVEPIVRHKNIHLWWWTVLPLPDLRNCPPPLCRFRRRVELLEVNGDEARAEIVQCHGAHRWIYEHFPSIVKAFTNSDYEERSPRAFRWTSTKTLLASTYGKRLDRLTTADICWMPYGNHYAV

SEQ ID NO: 192033 - protein, 154 aa, Glycine max
  Coding DNA Sequence Number=SeqID_75255
  Gene Ontology: Mol. function=DNA binding
  Homolog annotation: Hit_ID=Q1SFS3; Match level="QueryCoverage=80%, HitCoverage=24%, E-value=8e-13, Identity=32%"; Hit description =Lambda repressor-like, DNA-binding
MVEVSTEAIASLAQYYDQSLRCFTFGDFQLSPMVEEFEEILGCPLGGRKPYLFIGFYPSLARISKIVQISAQELDHRKQVENGVVGILRKCLEAKARVLAGKGEWAPFIDILALLIFGGVLFPNVDGFTPFSPRGEACLPVRKPPFMHREREGE

SEQ ID NO: 192034 - protein, 384 aa, Glycine max
  Coding DNA Sequence Number=SeqID_75256
  Homolog annotation: Hit_ID=Q1T1F7; Match level="QueryCoverage=43%, HitCoverage=34%, E-value=1e-15, Identity=33%"; Hit description=IMP dehydrogenase/GMP reductase
METRGLGRVLSRVIGRALEREDNHHLDDVPQQRRPTTSARRQQEVAAIVEDVPHVDDVAEEEHPELKLSSHGRKVQKFGKPATEIKGLVAVTGLSPLIACSLNTDDRGLILAFFREVAQGDEQFPSSSRRGALHSFETLHVDEAVLMLVELLKVPGDEARAETVQCHGAYCYTCICDVLGRLPRPQSEWKLRMGSCHPSAYCWIYEHFPFIAEAFTDPDYDERSPRACRWTFTKASTKSLPALTYRKRLDRLTIIVVCWMSYGDHHTVRELDLISYFSGHIQWGPVVVIHRPERVVRQFGYVQTIPPHSPGSRLSFEDIDDRWMHFSEYLAPVGQICVVSGQCAPNYMHWFYMISHLFKTPTHAGDPPRHPHVKLDETCGTRYA

SEQ ID NO: 192035 - protein, 190 aa, Glycine max
  Coding DNA Sequence Number=SeqID_75257
  Gene Ontology: Mol. function=steroid hormone receptor activity; Cellular component=nucleus; Biological process=regulation of transcription, DNA-dependent
  Homolog annotation: Hit_ID=Q1SFD4; Match level="QueryCoverage=97%, HitCoverage=23%, E-value=2e-22, Identity=64%"; Hit description =Steroid nuclear receptor, ligand-binding
MAPAGALIGPIAFAIIVIGNSAIILGLWSAHAVWTYYCVARFGLVFKLVVLMGLPVPLLLWPIVGIVGSLLGGIGYGFFAPLLATFQAVGEGENVNQKFYHCFIVSVNFCLCNVSFSAPFGHLTLLVEVSFNSNPFHDLELLDLSRMQEALMPLNSDIRMVVGQQLKEAAQWFRMSQTSAFTPIFHTWMN

SEQ ID NO: 192036 - protein, 52 aa, Glycine max
  Coding DNA Sequence Number=SeqID_75258
MSSFALEIASGISKMFAQKKVTLSPGRHKIVILDEADRYQIRYLCGLTSELN

SEQ ID NO: 192037 - protein, 81 aa, Glycine max
  Coding DNA Sequence Number=SeqID_75259
MKLWILYTVTTVTVPDFGSINRSRSSTWITDFVVVSINRNFRSEGEEGEGEAEAEVSAKGRVDGAVGGGGGVGLFSVGEGE

SEQ ID NO: 192038 - protein, 165 aa, Glycine max
  Coding DNA Sequence Number=SeqID_75260
  Gene Ontology: Mol. function=ATPase activity, coupled to transmembrane movement of substances; Cellular component=membrane; Biological process=transport
  Homolog annotation: Hit_ID=Q0XE46; Match level="QueryCoverage=49%, HitCoverage=32%, E-value=4e-32, Identity=76%"; Hit description=ABC-2
  Pfam annotation: Domain name=BolA; Domain location=85-160; Score =75.1; E_value=2.2e-19; Accession=PF01722.8; Description=BolA-like protein
MAAFQNFVIMPLTFLSGVFYSIHSLPPFWQAVSQLNPFFYMIDGFRYGFFGQGDVSPWLSLAVVGSFLLVLAWLCLKMLKSGGYVLTAAQLEAYIRSGLECDYLKVNGDDGTHFDAVIVSAAFEGKRMVQQHQLVYAALGDRMRAEIHALSMQTYTPTQWQQKQA

SEQ ID NO: 192039 - protein, 79 aa, Glycine max
  Coding DNA Sequence Number=SeqID_75261
MSLPCGFDKEGPPLKITTVNKSENRSYQQGQSVGEGEPMQREEEDEATMDIDWEKMKWLSSESQSSEKKSLVGDGRPWS

SEQ ID NO: 192040 - protein, 130 aa, Glycine max
  Coding DNA Sequence Number=SeqID_75262
MEGAFPSGGCLTLEREFSLMRTLTWRLNPEVKEILTFIHSQHGPRLPSCERDKRETLGWNIHDMKGLDPTLYIYKINTKEGSLPKWSSQEKLIPNMMEVVKGEDAKPTIKIKAYHEGFQQVLTIMHPFDL

SEQ ID NO: 192041 - protein, 176 aa, Glycine max
  Coding DNA Sequence Number=SeqID_75263
MILKFHDDPTVNGFEIVVFLRLVCFLNLFTKNWDVTSFSSRLKSAGNRSLDTHIVLNTAGNPSAEPTEPPTLLFEVWLEEYPTYIVVLLIEVRGKLQVSCHFVTSHCHCHCLGWRCSLFFIVTAIVTVCKRSDQKAGPSIVCVAFCSFFGNFQFTCVNCNALIAGVAAMFECKNNK

SEQ ID NO: 192042 - protein, 103 aa, Glycine max
  Coding DNA Sequence Number=SeqID_75264
  Subcellular localization annotation: CTP_CleavageSite=49; ConfidenceScore=5.34e-01
MAWIDQRMKQVKSQLTNIQPFLSQRKLNNLLSQPKTNPKREDINVVMIRSKRISRRRKVFSPKITNGVLTEKDQASKKVEIPTNGNPVPKKEGDKKKEIMTSP

SEQ ID NO: 192043 - protein, 233 aa, Glycine max
  Coding DNA Sequence Number=SeqID_75265
MVAHSTSGNYSEQRLPTYLNLSMKSIVDSSTIYFMFIKSTIVTSGKFEYQVKATPVREGKKMQLVKLILTSFTILSTKASYGPPILDMARLSGASSKGGKYAESPPMFICGKRQKNRRKPVIKNIPDSGVAFTFEEGISTSHVDKSGALAPTYPPSKRKSDLRSSFLRGAKYLEAVKQRLHAMKQWSPNEIRDKPHLATNRLDYVKHSCIFDEVACHVDIKAIFGWNNGINSA

SEQ ID NO: 192044 - protein, 260 aa, Glycine max
  Coding DNA Sequence Number=SeqID_75266
MAHHRFHLFFLDPKKTISFLNWWLAVKDALFSKGLPFYLLQENDHVQLNPIGQTPSQPQPFSHSAFVSTKKKKSSSTEITINPLLALQSEELTCLESTPLTFKRTTRSVIALKFSTPDPPSTQKSAAAPSRSHKRLKLRSISTLIHLRQLQTQKSTYAANFQVVEAEQQANLAKQKHLNKRIVDLIVELGWLNMLNPKITLPNSKLKGNLDLCVHLSALANSFHTNIIHLLYQHEGQEKDLSTTVNAHNISTEYQIDVLC

SEQ ID NO: 192045 - protein, 93 aa, Glycine max
  Coding DNA Sequence Number=SeqID_75267
MDYATILFFSLWNVAGLYVLRNNALFDFRNVAKIYGLRNNALFDFRNVAEFYGLRKNACFDFWNVEIGKEDWCHPLKSLSQEARGKPPLELLD

SEQ ID NO: 192046 - protein, 69 aa, Glycine max
  Coding DNA Sequence Number=SeqID_75268
SLSLSKIIGRQLRVTMFYENAPTIWDQHKLKGELKPSDPKAYTLKSLSWPLPVDLGPTPQIILAHRHCL

SEQ ID NO: 192047 - protein, 190 aa, Glycine max
  Coding DNA Sequence Number=SeqID_75269
MGSISGLLVLDTTVYGTLALVVEASFMMMNQTILMMPKAQVIDSRLQDQASRIQSKIQDSREETKKQQVKTSYRIRYILCGTSRAYIYLSCNTENKRGYISCGSVQVECTSTWLFKENKGGYIPCGSLLVKDFTRLLEISRTGGCLGTGRRHGLWPNQYKSCVCLSSCLHSLFFCCALFIYALLLSKLLF

SEQ ID NO: 192048 - protein, 496 aa, Glycine max
  Coding DNA Sequence Number=SeqID_75270
  Gene Ontology: Mol. function=RNA-directed DNA polymerase activity; Biological process=RNA-dependent DNA replication
MSEKSGDDQNNKKNHDQEKKKERKETYLAKERKEFEDVFLKEIPHGLPALRGIEHHIDLAPGDVLPNRPTYRSNPQETKETQKQKDGTWRMCLDYRAITNITIKYRHLIPSSQGVRVDQEKVKPIQEWPIPKNVSEGQCKLNKRNAKWVEFTEKFPYVIQHKKELYEHDSYFSSKYSSCVHIAQNEYFRHNDYLLKGKRLCMPKGFVRELLVKERCMKGSKSKEMPHGLYFALPILDFPWIDLSMDFVLGLPQTRNGKDSIFVAMHSTYILKHKDGKVKAEYVKKLHEQVKAQIEQKTKSYVKHANKGNPSFNHEKMVHFQVLFKIIDNAYKINLPGGDDEDQTSNMDNEALQGLGAPMTRASAKQRKPYTKWRTSYGDRYGYQIGGAKGNNNSNKASYAQGVNFNVTKGDMEWLKNSLVGRVKNVTKVATLPQTLIMEGVECIRVRYLGDNLVLLSDVYGTKVEEVVKREEVWFTKLFASINKWSLEDRSGHRLA

SEQ ID NO: 192049 - protein, 146 aa, Glycine max
  Coding DNA Sequence Number=SeqID_75271
MSHFQGFFKGNIKTSNNEIAKRWSGGFVTESTSWVLKIQLQSKASTPCGGLEASGGSLWWSPVAVGEGRGGKFPLSETFVLSAISPLAEIALSKLVSLSEIFSLGGIVLSELALLSELVSVTELSTNLQGAPTYFTAFVQRSYLTL

SEQ ID NO: 192050 - protein, 304 aa, Glycine max
  Coding DNA Sequence Number=SeqID_75272
  Gene Ontology: Mol. function=hydrolase activity
  Homolog annotation: Hit_ID=Q8S9P9; Match level="QueryCoverage=76%, HitCoverage=60%, E-value=2e-80, Identity=62%"; Hit description =Purple acid phosphatase-like
  Pfam annotation: Domain name=Metallophos; Domain location=39-300; Score=6.5; E_value=0.088; Accession=PF00149.18; Description =Calcineurin-like phosphoesterase
KTKKNTRKEKEKECLGGKSCANLVAYGLATCGDGTEEMVLVGVLGSSGGVTRRRRGRVVGRALIGAIVMMARAMVRFKEDEDFVIYLGDVITANNIMIANASLYWDQATAPARNRGIPWASVFGNHDDAAFEWPLKWFSAPGIPPIHCPQNTTSYSGEEECSFKGTGRLNLMTNEIKHNGSFSSYGPRNLWPSVSNYVLQVSSPNDPQTPVAFLYFLDSGGGSYPEVISSGQVEWFRQKAEEVNPDSRVPEIIFWHIPSTAYKVVAPKFGIPKPCVGSINKETVAAQEVETGMMDLLVNRTSVK

SEQ ID NO: 192051 - protein, 128 aa, Glycine max
  Coding DNA Sequence Number=SeqID_75273
MRPITATHSQNVFLKGFPLCALSPCVIDYTPLVIDYQRPYNILSPFLSPVIDYQRLISRYHPRYIAGQPPHKPPCFVDFVLLLVDCHELAFLGGDRAMAQINSPTSTSQAQAYHPQLPTFNLSSRTPT

SEQ ID NO: 192052 - protein, 201 aa, Glycine max
  Coding DNA Sequence Number=SeqID_75274
LGGLDGDPVLRGTRIRATVVPGDMSRGSGDLGDVRRAHGSQPIKEQSPRSKEACVAAGQLCILGGIWKLASGNRLQGLKMEIGCYMASGNRLPRGDRALIAMAAQLIHDRVVMECLEGVWETFEGNERCQFRGTIRLTATSLVHLEEPARTLQQPMEWILPTPTPYRLVEPVQVIEVSSSEEDLEEDLEELPPEPAMDALD

SEQ ID NO: 192053 - protein, 163 aa, Glycine max
  Coding DNA Sequence Number=SeqID_75275
MYSQLWVPKLLAKIHLGLPTKKEIVVTSNASSKAWVFEHLPNVGYLEPNDYIDKDPLATKWKPLRGSEHALLMKERLDELRMDDGHNVVLCVYHPFHDSHNLGSHWQTGLIPDVVNSYAELVRPQSCTKGYESSLTHTTNFAIVVGGFSSQVQLRHTEPQEED

SEQ ID NO: 192054 - protein, 85 aa, Glycine max
  Coding DNA Sequence Number=SeqID_75276
MMPCPTKGNVEACFFKLNLCLGMKMDDGDFPEHVHARQDGKTKDLANEVVNGTAAMVQNDSNPFHYHQSGWLIGTKECWARFWGL

SEQ ID NO: 192055 - protein, 77 aa, Glycine max
  Coding DNA Sequence Number=SeqID_75277
MVLKESQKTRLEKNTWVRCQGVTVARIHLKDSMENNPSILSFIGSLRCEETKHAKKKKEVAVQGSSSGDDDDTGSGK

SEQ ID NO: 192056 - protein, 344 aa, Glycine max
  Coding DNA Sequence Number=SeqID_75278
  Gene Ontology: Mol. function=heme transporter activity; Cellular component=membrane; Biological process=cytochrome c oxidase complex assembly
  Homolog annotation: Hit_ID=Q1H4T2; Match level="QueryCoverage=92%, HitCoverage=83%, E-value=1e-136, Identity=73%"; Hit description =Cytochrome c assembly protein
  Pfam annotation: Domain name=Cytochrom_C_asm; Domain location=161 -344; Score=110.8; E_value=4e-30; Accession=PF01578.11; Description =Cytochrome C assembly protein
MSSNRKNMDLDQDFARMQQQLTDLLQRYAGFMDVYEVSFLFGAVAVFSYLGWRWSAIARLVLGVAVLSLIGVYSYQGDLANGSQRFLLKFLLTSQSAVMWMNVLFVLAMVTYWLALFQKSAFTAKVASALTWAATLFGFVGLMVRWYESYLIAPDVGHIPISNLYEVFILFCLITALLYLHYEKLFNTRQLGGFVLVVINAAVGFILWYTFDRHANEIQPLVPALQSYWMKIHVPANFIGYGSFSLAAMVAGAYLLAKRGVLASRLPALHVLDDLMYKAIAIGFAFFTIATILGAMWAAEAWGGYWSWDPKETWALIVWLNYAAWLHLRLMKGLRGSVLAWWAL

SEQ ID NO: 192057 - protein, 126 aa, Glycine max
  Coding DNA Sequence Number=SeqID_75279
MEVSEGTGADGGGRVDAEGADVEAGAEVEVGAGEQKKMDPQILEPEPYGESNITPRAMHKAVIRAGKPSREELDWTIYPSSGASRVPLQHSKQIHALEYRAWKQAPKGLRASCRKENKKYTSPLAE

SEQ ID NO: 192058 - protein, 90 aa, Glycine max
  Coding DNA Sequence Number=SeqID_75280
MAKFGMSLSVGMLAITGDGDDVDVGTRNDPHVSRCDGDGLTLVRGGDGVGATSKDLTAIDTVNENGIDDTRLSLGAHQPRMSLLVAGYDT

SEQ ID NO: 192059 - protein, 156 aa, Glycine max
  Coding DNA Sequence Number=SeqID_75281
MERSTDCHTTTKSRFNIVKLTSIFDKTDVNKNAVTKCFANPFSLTVVSLLHDTAFCDPSPPSPRHPRSLGVTISASEPTTGPRHPRFITTVARFRKSRKGSSKGILTLETYFRVEMCDLWSDWRPIKCAGTYHMVVETWREIRELVFTNPNARTFH

SEQ ID NO: 192060 - protein, 104 aa, Glycine max
  Coding DNA Sequence Number=SeqID_75282
MGAKYLEAVKQRLHAIKQWSPNEIRLTTAAASAMYARRNNAERKRKILQDRTSPSILEEPQSSELSSIFPQPREPELGASEANIMAKDQPRRVTLEDYSSFTVP

SEQ ID NO: 192061 - protein, 47 aa, Glycine max
  Coding DNA Sequence Number=SeqID_75283
MWWHVKEGVQYDEEFGKENKYEGAANEGGRGPSTWDTYSHKYPGISV

SEQ ID NO: 192062 - protein, 84 aa, Glycine max
  Coding DNA Sequence Number=SeqID_75284
MREFGTMAAHPGELMLSPEKIGSPNRAGSFSPKQFGAPSEPKASLGEPRLNKKFCRSVDLEPLAKLIIWLSEPSAKRSSSWLST

SEQ ID NO: 192063 - protein, 109 aa, Glycine max
  Coding DNA Sequence Number=SeqID_75285
MGGQGEMKMCIFQKGECEGVATNVYSRKNVRKTKKKGLQISKIRVRELFTCREDEWQQNGERKRERRCHFKEKMSLEEAHHHRRPWLRAWRKEMNEGRGREEHEILCSK

SEQ ID NO: 192064 - protein, 79 aa, Glycine max
  Coding DNA Sequence Number=SeqID_75286
MDWSLRLTDAILPPRTLDKRLQEDWVSDAREGPRVLMSLRTSFVAKNFVLLLPPSSSHTSKLIFMASYGGEFLLDSSSP

SEQ ID NO: 192065 - protein, 258 aa, Glycine max
  Coding DNA Sequence Number=SeqID_75287
  Gene Ontology: Mol. function=binding; Cellular component =intracellular; Biological process=metabolic process
  Homolog annotation: Hit_ID=Q6H7X0; Match level="QueryCoverage=84%, HitCoverage=95%, E-value=9e-22, Identity=24%"; Hit description =Putative pentatricopeptide (PPR) repeat-containing protein
  Pfam annotation: Domain name=PPR; Domain location=125-159; Score =28.8; E_value=1.9e-05; Accession=PF01535.11; Description=PPR repeat
  Pfam annotation: Domain name=PPR; Domain location=160-194; Score =30.5; E_value=6e-06; Accession=PF01535.11; Description=PPR repeat
  Pfam annotation: Domain name=PPR; Domain location=195-229; Score =16.5; E_value=0.083; Accession=PF01535.11; Description=PPR repeat
  Pfam annotation: Domain name=PPR; Domain location=55-89; Score=31.8; E_value=2.4e-06; Accession=PF01535.11; Description=PPR repeat
  Pfam annotation: Domain name=PPR; Domain location=90-124; Score=42.7; E_value=1.3e-09; Accession=PF01535.11; Description=PPR repeat
  Pfam module annotation: Pfam domain module=PPR::PPR::PPR::PPR::PPR; Domain location=125-159::160-194::195-229::55-89::90-124
MNGQEVRIETEDADLKVSDCILSTVVNGFSKKIGILVMVKVFKELIFKGYESGQVTYASVINAYFHLEQYSKAEEVFLEMEQKGFDKCVYAYSTMIVMYGRMGRVTSAMKLVAKMKQRGCKPNVWIYNSLIDMHRRDNNLKQLEKLWKEMKRRRVAPDKVSYTTIIGAYSKAGEFETCVKLFNEYRMNGGLIDRAMAGIMVGVFSKVGLVDELLKLLQDMKAEGKRLDQRLYQSAWNAFKDVGLQIQARWMKEIFFVT

SEQ ID NO: 192066 - protein, 88 aa, Glycine max
  Coding DNA Sequence Number=SeqID_75288
MIFEGTILDLIVIYSRETSWLAILLSHYLHYDAVASYLPRCVTPSSNIFGRHSLTVEASGWGESTIVATTTVAAGGSSIARYLHAKQS

SEQ ID NO: 192067 - protein, 87 aa, Glycine max
  Coding DNA Sequence Number=SeqID_75289
  Gene Ontology: Mol. function=sequence-specific DNA binding; Cellular component=nucleus; Biological process=regulation of transcription, DNA-dependent
  Homolog annotation: Hit_ID=Q1S8N0; Match level="QueryCoverage=62%, HitCoverage=23%, E-value=4e-19, Identity=78%"; Hit description =Leucine zipper, homeobox-associated; Homeodomain-related
  Pfam annotation: Domain name=HALZ; Domain location=28-72; Score=8.9; E_value=0.043; Accession=PF02183.8; Description=Homeobox associated leucine zipper
  Pfam annotation: Domain name=Homeobox; Domain location=2-27; Score= -2.7; E_value=0.0096; Accession=PF00046.19; Description=Homeobox domain
  Pfam module annotation: Pfam domain module=HALZ::Homeobox; Domain location=28-72::2-27
MKLLRELGLQPRQIAVWFQNRRTRWKTKQLEQLYDVLKHQYDVVSNEKQKLQEEVEQRYRQYHNQMKIVISSSFEQSAFLQVESKQM

SEQ ID NO: 192068 - protein, 72 aa, Glycine max
  Coding DNA Sequence Number=SeqID_75290
MNRQAAFRSYLFGWCKPTGGHHVQRNQISNHHSVYLQMGVIWTRNEGDMAETRIGNKGSRENEKLQISDFEF

SEQ ID NO: 192069 - protein, 38 aa, Glycine max
  Coding DNA Sequence Number=SeqID_75291
MAPSLYSDVLCLSSAGKGRRSVSRDPIVHLHPFLSTYK

SEQ ID NO: 192070 - protein, 99 aa, Glycine max
  Coding DNA Sequence Number=SeqID_75292
  Subcellular localization annotation: CTP_CleavageSite=76; ConfidenceScore=5.25e-01
MSMPTVKKRLSFEVQKVTVKLSSVVGLSVHPPLSAASACLARRRISQSISIKTGKQMIGTDSRAHHSAYFRKRALEAAREAACALKPSFYKIIIVRVSL

SEQ ID NO: 192071 - protein, 74 aa, Glycine max
  Coding DNA Sequence Number=SeqID_75293
  Gene Ontology: Mol. function=DNA binding; Biological process=DNA integration
MATPMSTSCYLDKDEIGQSIDVKQYRDKKSTSGTCQFIGTALVSCIVRNKTVLLYPLLKRNISLSAVVVHKFYG

SEQ ID NO: 192072 - protein, 108 aa, Glycine max
  Coding DNA Sequence Number=SeqID_75294
MGTRGCISYNPVLTIRQLGYPMRGAPLEEELAPIIARGFNKTNMEALQKVRKAWEMVQKKDTKLRGNNNGPIGSYRRWLKARMQSLDWLPSLRTTKGVEVEAREEDEE

SEQ ID NO: 192073 - protein, 345 aa, Glycine max
  Coding DNA Sequence Number=SeqID_75295
  Gene Ontology: Mol. function=ATPase activity, coupled to transmembrane movement of ions, phosphorylative mechanism; Cellular component=membrane; Biological process=transcription termination
  Pfam annotation: Domain name=Rho_N; Domain location=309-345; Score =23.1; E_value=0.001; Accession=PF07498.2; Description=Rho termination factor, N-terminal doma
MVIQTHLKRLFGIRDEWMFAKGVICIFLPAGLEVCECNKKKPATASECKLKQRLLQPPLSEGGWVTMLQAMHLMMANTYNVAVVLVIPWDVEWQKGYHRIHSHVTIRGLKCSSRGACASFVCEARRNPESFSRQNKHGFSRSRKWLNVDRDSFENIEKDMLSLKNGSLVSHSSTLKNHANANAAPRPKEKEIITLFKKLLRKHSVEQVKRSSGVNRGENDSLDWLQDCGQDNESQSTKFPDLNEKDQDQIGIKLDPEPEHDSELELDPKDKPLFPEVGIAISHDDDYLDSEQIYNDEHGEDQQVEQHEDLSTMKLSELMALAKSRGLKGFSIMKKSELMELLTGS

SEQ ID NO: 192074 - protein, 832 aa, Glycine max
  Coding DNA Sequence Number=SeqID_75296
  Gene Ontology: Mol. function=ubiquitin-protein ligase activity; Cellular component=ubiquitin ligase complex; Biological process =protein ubiquitination
  Homolog annotation: Hit_ID=Q6ZC56; Match level="QueryCoverage=86%, HitCoverage=92%, E-value=2e-93, Identity=47%"; Hit description =Putative arm repeat-containing protein
  Pfam annotation: Domain name=Arm; Domain location=507-547; Score =33.8; E_value=6.1e-07; Accession=PF00514.13; Description =Armadillobeta-catenin-like repeat
  Pfam annotation: Domain name=Arm; Domain location=548-588; Score =34.4; E_value=3.9e-07; Accession=PF00514.13; Description =Armadillobeta-catenin-like repeat
  Pfam annotation: Domain name=Arm; Domain location=589-629; Score =28.1; E_value=3.2e-05; Accession=PF00514.13; Description =Armadillobeta-catenin-like repeat
  Pfam annotation: Domain name=Arm; Domain location=630-669; Score =19.2; E_value=0.015; Accession=PF00514.13; Description=Armadillobeta- catenin-like repeat
  Pfam annotation: Domain name=Arm; Domain location=670-710; Score =21.5; E_value=0.003; Accession=PF00514.13; Description=Armadillobeta- catenin-like repeat
  Pfam annotation: Domain name=Arm; Domain location=712-751; Score=0.5; E_value=11; Accession=PF00514.13; Description=Armadillobeta-catenin -like repeat
  Pfam annotation: Domain name=U-box; Domain location=210-284; Score =107.0; E_value=5.5e-29; Accession=PF04564.6; Description=U-box domain
  Pfam module annotation: Pfam domain module=Arm::Arm::Arm::Arm::Arm::Ar m::U-box; Domain location=507-547::548-588::589-629::630-669::670 -710::712-751::210-284
MQIVHNGSFQGFPTHAQTVMCLHLKPVLDDIVDFKIPFDENLHRECEELDMRVNEAREFIEKWGPKMSRIHSVLQSGELLIKLQNSSYKICHMIVKSLKGPASVLVSGNLQELQCLKKEPAMIYIEDALRNQRDNIEPCYDSLKEIIRLLMISNQELLIESIAVEKERSNAEVNKTKGDLDEINQIVNLVCSLRDYVMKFERPEVKSGVSIPPYFRCPLSLELMSDAVIVASGQTYERQSIQKWLDHGLTVCPNTRQILVHTNLIPNYTVKAMIANWCEENNVKLPSNSKQSNSSHISSPSDHLLHQDLDRLCSFESSASSDSNSNQIANAFEKPKDDNSFRSSRESDRSWNGETEKFEQQSPAPSCSNSRSESFSSSISSTDYVFPVLKEVSGISNKHQNVELSREITDGCPASPAYKESVIYPWLSGKQFHSPGSKIGRMEDENKYNESNNISITSHSKVASHPVGSNELITTSHVNELIEDLQSQSNETQTAAAEQLRLCTKHNMENRISVGRCGAIMPLLSLLYSERKIIQEHAVTALLNLSINEGNKALIMEAGAIEPLIHVLKTGNDGAKENSAAALFSLSVIDNNKAKIGRSGAVKALVGLLASGTLRGKKDSATALFNLSIFHENKARIVQAGAVKFLVLLLDPTDKMVDKAVALLANLSTIAEGRIEIAREGGIPSLVEIVESGSLRGKENAASILLQLCLHNQKFCTLVLQEGAVPPLVALSQSGTPRAKEKENSVQILVFNHGYRINLLKQCAKKSGILIYVLQCILPPALPPKTVKKVSHHKHNLKRGRSANNMFAYMQAQQLLSHFRNQREGVKGKGKS

SEQ ID NO: 192075 - protein, 97 aa, Glycine max
  Coding DNA Sequence Number=SeqID_75297
  Gene Ontology: Mol. function=catalytic activity; Biological process =metabolic process
MECKEKRIYGWCASKNKNTDTAWEVVGESGYGDIHHLTRPQHSVSDPRNDRDPPRRQAPPSRAILCVPLRPHPIDARKFRRRFLKKMIIDVREESRV

SEQ ID NO: 192076 - protein, 203 aa, Glycine max
  Coding DNA Sequence Number=SeqID_75298
  Homolog annotation: Hit_ID=Q1SI74; Match level="QueryCoverage=64%, HitCoverage=61%, E-value=4e-63, Identity=89%"; Hit description =Ribulose bisphosphate carboxylase, large chain
  Pfam annotation: Domain name=DUF640; Domain location=31-163; Score =301.7; E_value=1.3e-87; Accession=PF04852.3; Description=Protein of unknown function (DUF640)
  Subcellular localization annotation: CTP_CleavageSite=78; ConfidenceScore=5.32e-01
MDSNIQDFIDTCNSDNTCNLITNSITTANLTASAASSSPASTSITSSSRYENQKRRDWNTFGQYLKNHRPPLSLSRCSGAHVLEFLRYLDQFGKTKVHTPICPFYGHPNPPAPCPCPLRQAWGSLDALIGRLRAAFEENGGKPEANPFGARAVRLYLREVRDLQSKARGISYEKKKRKRPPPQQQPMPIPHHPLPPPGASATH

SEQ ID NO: 192077 - protein, 89 aa, Glycine max
  Coding DNA Sequence Number=SeqID_75299
MTNIQSQILLSKHKELRGVSGVQRQATTAYGSHQWSWVVKNKRAHLAKPESTFCAYHENSCLAQLPLHYGSLIVLLLAKRNFLSGWKCA

SEQ ID NO: 192078 - protein, 266 aa, Glycine max
  Coding DNA Sequence Number=SeqID_75300
  Gene Ontology: Mol. function=DNA binding
  Homolog annotation: Hit_ID=Q1SWX1; Match level="QueryCoverage=72%, HitCoverage=40%, E-value=2e-21, Identity=36%"; Hit description=IMP dehydrogenase/GMP reductase
LLVLGIILFPNAKELVDLAVIDAFLAYHHSKESSVIAVLADAYDTFDIRCEKSNARIVCCTIALYVWLVSHVFHHEGMIRASVSWFPRWKEGGAEVLCSCEGFPNVPLMGTRGCISYNPMLAIRQLGYPMRGAPSEEIIAPFVAWGFSDGNAKILQRVRKAWNTVERKDKELRGSNNGVINGYHKWLKARTQGITWLPKLKGPSEEEAKVPEESEEVQALKAKHEKMRVVKEKLKMTFTRVRKECDELRDVNMTTAEALERETKTA

SEQ ID NO: 192079 - protein, 77 aa, Glycine max
  Coding DNA Sequence Number=SeqID_75301
FGTMAARLGELRLSHEAIGSPRQAGYLTWKSFGGPGEIEASLGKPGFRKLSNMTLLPLRFGIFHIPDQNVERPLILC

SEQ ID NO: 192080 - protein, 311 aa, Glycine max
  Coding DNA Sequence Number=SeqID_75302
  Homolog annotation: Hit_ID=Q47522; Match level="QueryCoverage=21%, HitCoverage=87%, E-value=9e-22, Identity=73%"; Hit description=LacZ protein
  Subcellular localization annotation: CTP_CleavageSite=42; ConfidenceScore=5.12e-01
WNSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSISSEGNTEPSRPLKPSRGEPQGAGVEGFELEASWLTPSAVVFCGEFPAGLLFDALADVNEISSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 192081 - protein, 73 aa, Glycine max
  Coding DNA Sequence Number=SeqID_75303
MKKVSTLFQLEDHGAPSAPQQKGVVERKNRSLEEGERTLLNETRLRINEALGLNLELGLGLNPELGLDLNRAD

SEQ ID NO: 192082 - protein, 57 aa, Glycine max
  Coding DNA Sequence Number=SeqID_75304
MARLVRISGFWLSGSLLAQCGGLEAPTVIALSGFLAQRMNWLSELTILHFTNLAYFT

SEQ ID NO: 192083 - protein, 124 aa, Glycine max
  Coding DNA Sequence Number=SeqID_75305
MENKNRKENLNEELKEVLFNKLSQRASQQQPAINKGYQHCTHLVALGKIYEGSLIVCHVSLTDDIVKVGVSKAIDEVVEVPFPTLEDLQRHPKKPVQHVDRLKPIDYPLVDFVMVFSDLYQQPY

SEQ ID NO: 192084 - protein, 249 aa, Glycine max
  Coding DNA Sequence Number=SeqID_75306
  Homolog annotation: Hit_ID=Q1SS44; Match level="QueryCoverage=96%, HitCoverage=96%, E-value=8e-75, Identity=60%"; Hit description =Cyclin-like F-box
MSPPPWEALILVATYLDPKTLAMASCVSKSWFSSMSSDIIWKPILATHFPSLSTLPSSAPTVAYRRLFSMGHTATTHRLRGPSKPSLSLGDLVFAVSICTRDSNIVSIASPCDALRVDAPGVFRFGVGCDGAVLREGVEEVRMAWNVVLRGWRGVFTMMERVGKVGFAPGGEGWFSQELPAPGCCSGAVESAVVADLKVRMCGGEDKNVNGVRVNEVSVGILSVVDWRYVRVEDGLRYLQHFLLTNYAN

SEQ ID NO: 192085 - protein, 97 aa, Glycine max
  Coding DNA Sequence Number=SeqID_75307
MSFDLTPVYDLSDFVDHVMQVHEDQRPERKEWERVVQEALAEIQVEEDIAKVTKVLVDLKTFGALQENPDQVTSPKVSTAAKANELLHTTHPKLASS

SEQ ID NO: 192086 - protein, 288 aa, Glycine max
  Coding DNA Sequence Number=SeqID_75308
  Homolog annotation: Hit_ID=Q1SKD7; Match level="QueryCoverage=46%, HitCoverage=34%, E-value=1e-07, Identity=24%"; Hit description =Ankyrin
MAPKKLSTKRSRRDATGEGSSAASGDDFQEEIARRHWTPLVTPMAKFDPEIVLDFYANAWPTEEGVWDMRSWVRGQWIPFDTDALSQFLGDPLILEEGQQSEFSQRRSRADGFDEEAIAQLLCIPGQDFARTAAGRRVRIMRTSMTTLTQTWMTCCLAMSYLAITTLTSLCLSATFIEKYCTPRQVQQGDTHQATSAPPPPWQAANHRGQVQIHECLYRFSLSQQGQGVAPFVCPTTEQFGAEVAWPGDWPDAQVGEEPAGSPGEADEPHMDEDMTDLLGFLGGSGAT

SEQ ID NO: 192087 - protein, 98 aa, Glycine max
  Coding DNA Sequence Number=SeqID_75309
MVTWDDSDNEKSNNLDDEKANIYLMADTNEKLEVKTCFEFDTSSCSSSNNEEEMPYDVLLQNNHMISLQCKNYNTLTMLLKFHQHPYDKSGLGLEKGA

SEQ ID NO: 192088 - protein, 126 aa, Glycine max
  Coding DNA Sequence Number=SeqID_75310
  Gene Ontology: Mol. function=translation release factor activity, codon specific; Cellular component=cytoplasm; Biological process =translational termination
  Homolog annotation: Hit_ID=Q1SS34; Match level="QueryCoverage=99%, HitCoverage=26%, E-value=4e-33, Identity=64%"; Hit description=Class I peptide chain release factor; PCRF
MVWDFDMWNDPAKSNDIIVKLENSAKVVDSLRDLKYKLILLLAAFGPPYFFALLYAQQVEEAKLINQLAEINVIDYGLYKQAYETSLDVSEILDQYEISKLLKGPFDMAGACLVIKAGPNGIYSKV

SEQ ID NO: 192089 - protein, 142 aa, Glycine max
  Coding DNA Sequence Number=SeqID_75311
  Subcellular localization annotation: CTP_CleavageSite=41; ConfidenceScore=5.27e-01
MGKQLQQMKETTLYVKVLMTDSKNLTRGRNLRNPSPTGFVSYSSVQLNIPMKEKTWLNNTWVGRLKNLALFDRMEDDLMWNGGDDITPKYIRDDMVLLIGLTETKAAQMVKEANEQGSSLFYSLEKSTPQLRTGYRLVWLLC

SEQ ID NO: 192090 - protein, 215 aa, Glycine max
  Coding DNA Sequence Number=SeqID_75312
  Gene Ontology: Mol. function=translation release factor activity, codon specific; Cellular component=cytoplasm; Biological process =translational termination
  Homolog annotation: Hit_ID=Q1SS34; Match level="QueryCoverage=98%, HitCoverage=53%, E-value=7e-93, Identity=79%"; Hit description=Class I peptide chain release factor; PCRF
  Pfam annotation: Domain name=RF-1; Domain location=75-185; Score =20.5; E_value=1.6e-06; Accession=PF00472.11; Description=Peptidyl -tRNA hydrolase domain
MYLRWAKRQGYAGRIVDKCLFKNGGINSAIIEFEFECAYGYLSGEKGVHYMIRGSPNESSQLEASSATVDVIPMFLENACDLEIDSEDLIISSPLIHGENKRQTDHTVCIQHIPTGISVQSSGERSYFANKMKALNRLKAKLLVTAKEQRVASIKSIRKENIVNLWQEEFRRYISHPYKLVHDVKTGVEVPDLNNVLEGNIGPLIVAHINSRVMS

SEQ ID NO: 192091 - protein, 170 aa, Glycine max
  Coding DNA Sequence Number=SeqID_75313
  Gene Ontology: Mol. function=tetrahydrofolylpolyglutamate synthase activity; Cellular component=mitochondrion; Biological process=folic acid and derivative biosynthetic process
  Homolog annotation: Hit_ID=Q8W038; Match level="QueryCoverage=83%, HitCoverage=21%, E-value=3e-32, Identity=53%"; Hit description =Dihydrofolate synthetase
MNGRYDGKECQVYHKGFIYKTSSEVLFERESNAVTDGRLQNFPVSSYETAMEKISSLITRQRRGEKPPISNKLEIMSLYLKILGLDEDINKLNIIHVAGTKGKGSTCIFCEAILRECGFRTGVFTSPHLIDVRERFRIDGLVIERNNLSRMADGVSAFHSSILISVSLFQ

SEQ ID NO: 192092 - protein, 168 aa, Glycine max
  Coding DNA Sequence Number=SeqID_75314
MWRSLRWQRVLFTREKGKKIHRGCLEVEGEKISVTLVEEASCAVCVNFTHQGPAWGCVWQCFELAATRTACQFSKRSPEKLKQVVGKRRSMMVLSLDCGSTKQRQNRAEQRLNRFTGGKGAWQGGRRRMGHTSERESAVEEVTVGGVGFTGERHFGTEGHASEMAAQW

SEQ ID NO: 192093 - protein, 101 aa, Glycine max
  Coding DNA Sequence Number=SeqID_75315
  Gene Ontology: Mol. function=tetrahydrofolylpolyglutamate synthase activity; Cellular component=extracellular space; Biological process= folic acid and derivative biosynthetic process
  Homolog annotation: Hit_ID=Q9SR80; Match level="QueryCoverage=99%, HitCoverage=22%, E-value=3e-35, Identity=72%"; Hit description =Putative folylpolyglutamate synthetase
MPPLFLFLTILAFKIFISEQVDAAIIEVGLGGKEDSTNVIKEPTVCGITSLGMDHTEILGDTLGQIASHKAGIFKPKVPAFTVPQPPEAMDVILERAKELM

SEQ ID NO: 192094 - protein, 83 aa, Glycine max
  Coding DNA Sequence Number=SeqID_75316
  Homolog annotation: Hit_ID=Q9SR80; Match level="QueryCoverage=50%, HitCoverage=9%, E-value=7e-11, Identity=71%"; Hit description =Putative folylpolyglutamate synthetase
FLPLKVRSELDEYPQVRKLSCLVVLKDKLLVPLEVTEPFDCKQMKGLELGLSGDHQFYNAALAVSLSRCWLQRTGNWGKKYQK

SEQ ID NO: 192095 - protein, 383 aa, Glycine max
  Coding DNA Sequence Number=SeqID_75317
  Gene Ontology: Mol. function=Rab GTPase activator activity; Cellular component=intracellular; Biological process=regulation of Rab GTPase activity
  Homolog annotation: Hit_ID=O81347; Match level="QueryCoverage=89%, HitCoverage=92%, E-value=1e-149, Identity=78%"; Hit description =Plant adhesion molecule 1
  Pfam annotation: Domain name=TBC; Domain location=83-313; Score =115.5; E_value=1.6e-31; Accession=PF00566.9; Description=TBC domain
MEKKRLDDYEPGPVPSPRALDRFGFVKQDVNTSEGLFKNRAAYEYERYREERRVRKWRKMIGVGGSDWKHYLRRKPHVVKRRIRKGIPDCLRGLVWQLISGSRDLLLMNPGVYEQLVIYETSASELDIIRDISRTFPSHVFFQQRHGPGQRSLYNVLKAYSVFDRDVGYVQVLLRNPSPFCACYKGMGFLAGLLLLYMSEEDAFWLLVALLKGAVHAPMEGLYLAGLPLVQQYLFQFECLVREHLLKLGEHFSNEMINPSMYASQWFITVFSYSFPFHLALRIWDVFLYEGVKIVFKVGLALLKYCHDDLIKLPFEKLIYALKNFPEDAMNPDTLLPLAYSIKSLSKKGFTGPNLDQFITLNMQLKYRARFKYHFNLVVSMSR

SEQ ID NO: 192096 - protein, 83 aa, Glycine max
  Coding DNA Sequence Number=SeqID_75318
  Gene Ontology: Mol. function=serine carboxypeptidase activity; Biological process=proteolysis
  Homolog annotation: Hit_ID=P32826; Match level="QueryCoverage=91%, HitCoverage=15%, E-value=7e-14, Identity=49%"; Hit description =Serine carboxypeptidase precursor
MAPSSTHDHVNPPKSRAEKLIRSLNLFPKNPINIVKGDGLANAFVSGNIVEKKFSFLGDSGPSIEDLGHHAGYFSLPNSKAAR

SEQ ID NO: 192097 - protein, 63 aa, Glycine max
  Coding DNA Sequence Number=SeqID_75319
  Gene Ontology: Mol. function=oxidoreductase activity; Biological process=electron transport
  Homolog annotation: Hit_ID=Q2LAK9; Match level="QueryCoverage=66%, HitCoverage=9%, E-value=6e-12, Identity=90%"; Hit description =Cytochrome P450 monooxygenase CYP82E13
MQRDPQLCNDATCFKPGKFDGEGEEKKLVWEEGLAQENPWLCKESGEYLKLIVLVSKWWLCTY

SEQ ID NO: 192098 - protein, 504 aa, Glycine max
  Coding DNA Sequence Number=SeqID_75320
  Gene Ontology: Mol. function=nucleoside-triphosphatase activity; Cellular component=integral to membrane; Biological process=cell division
  Homolog annotation: Hit_ID=Q8LBL6; Match level="QueryCoverage=80%, HitCoverage=63%, E-value=1e-104, Identity=53%"; Hit description=Cell division protein FtsH-like protein
  Pfam annotation: Domain name=AAA; Domain location=401-504; Score =47.8; E_value=3.6e-11; Accession=PF00004.19; Description=ATPase family associated with various cellular activities (AAA)
  Pfam annotation: Domain name=FtsH_ext; Domain location=194-375; Score= 81.6; E_value=2.4e-21; Accession=PF06480.5; Description=FtsH Extracellular
  Pfam module annotation: Pfam domain module=AAA::FtsH_ext; Domain location=401-504::194-375
MERLTCERLNLGVPKTQVLWVYSFDCGRSMACFSLPCNTGSFATPTLTQRRYLGVCGGFNQCFKFQHELVWNKELGYCGSRSRIPSLRVPYCCKTPHGVSSKIEPLVSRSKGERKTHYGKGGSDGLRKRFSLRLRPRLRLLAMRMKRASIRSILNEVGIFIRKNIRAVTFSASISTVFCLCFLFLKLTTLPPPKSVPYSNLIISLQNGYVEKVLVEEGSRRIYYNMKSQHIENDGVSGEESEVADVSIDKDVDKIGSEGTSGAGQTPVGNVLKKFSKTRASIPEWQYSTRKIDHDEKFLVSLMREKGVTYSSAPQSVLRSMRSTLITVITLWIPLIPLMWLLYRQLSAANSPARKQRPNGQTVGFDDVEGIDSAKVELIEIVSCLQGDINYQKLGAKLPRGVLLVGPPGTGKTLLARAVAGEAGVPFFTVSASEFVELFVGRGAARIRDLFNAARKFAPSIIFIDELDAVGGKRGRSFNDERDQTLNQASLLIHCAFSETNDLQ

SEQ ID NO: 192099 - protein, 201 aa, Glycine max
  Coding DNA Sequence Number=SeqID_75321
MHPELIKMLWRNSEFQDKKKIISRILGKKVIMRTMFLRCYTRRTFTRWEIRRLSTTSYARKQNCGKIFVTSFLHKLGSKNSIPDLHIFALFHLMESIPFNPPHTIFINILRTIKTLDGYEDIYYVVLVNKILWEQCMYQIFNSKLDEQTNNAIMIKGSMIAKQQNFAMKLEVDMTKREVPRVDEEEIIRRRQEQVTRVKAN

SEQ ID NO: 192100 - protein, 160 aa, Glycine max
  Coding DNA Sequence Number=SeqID_75322
MDERDFADHVMQVHEALKSEREKWEKAIQAELIATQVKEAIAHVTEVLDASNIFEPSNEATYVQKDVLDVVVVFSSSSSNPKDVAFISYAAPNALSKDRFQAIVTQAMTKQREETQELVNQAIMKQREEMQKEQTQMNMLGAVVQPPPPVQQQRLLGPPP

SEQ ID NO: 192101 - protein, 401 aa, Glycine max
  Coding DNA Sequence Number=SeqID_75323
  Gene Ontology: Mol. function=protein dimerization activity; Cellular component=nucleus; Biological process=regulation of transcription, DNA-dependent
  Homolog annotation: Hit_ID=Q84MG6; Match level="QueryCoverage=67%, HitCoverage=48%, E-value=5e-39, Identity=33%"; Hit description =Putative Tam3-transposase
  Pfam annotation: Domain name=zf-BED; Domain location=2-39; Score=9.7; E_value=0.044; Accession=PF02892.5; Description=BED zinc finger
  Subcellular localization annotation: CTP_CleavageSite=71; ConfidenceScore=5.02e-01
MEISPEVKKAVCRYCKSKFATGGNGSSTTHLKRHSKICIQKKAKTTAKSRQPTIPFQPSNSNNLFMIPGVRYSNKKMREIIATAIMVHEYPFSVVEDSIWMWAFQYANPDFHKVTHKTARNDCLALFEMEKKTLKKFLKSVSKIILTTNMWKSSHQVVEYMVITGHFIDARWNLQKRVLSFVKVPAPRRVQDGLNTIKDIIFNIRESVKYINLNDARLKAFCVVVEQKRLKEMKLVIDCPTRWNSTFNMFSTTLKFKIAFASYKEKEPHYNYAPSLEEWNQVEKVCKLLEVFNLATHVISGSEYPTANLYLAEVWKVKQILDKEIEDEDLFIREMAVVTSFDKIMSMLCEKEVVSPIKSELQDYLDEGIYVPNTNSFTVLDWWRNNSMKYKILSIAVVHNN

SEQ ID NO: 192102 - protein, 122 aa, Glycine max
  Coding DNA Sequence Number=SeqID_75324
MASYGEANDSIDEEDPRPTSSTWSYISPYGFDTWTSNACKLGPKIHHCNMNLILTSESENFMYRILEDLCFHPYNNSGDRRIMKRGINQVENDSQTELGKQMQALTLKIKKLMRSQDQAPSL

SEQ ID NO: 192103 - protein, 76 aa, Glycine max
  Coding DNA Sequence Number=SeqID_75325
MEDVESYDKKGENVESYESIKTEDIESYEKYRRGETEDIESYEKYRQRMLTPMKNKGEDVDSYGNIKTKNFESYEK

SEQ ID NO: 192104 - protein, 74 aa, Glycine max
  Coding DNA Sequence Number=SeqID_75326
MVGTGYNARPKGRSGFDGCLSDLETKSHKERGKMVISKTFLDLNSPRLASGSPRPRRSFKPKQATRLGEVIPLA

SEQ ID NO: 192105 - protein, 226 aa, Glycine max
  Coding DNA Sequence Number=SeqID_75327
  Homolog annotation: Hit_ID=Q8LGU6; Match level="QueryCoverage=15%, HitCoverage=4%, E-value=2e-07, Identity=69%"; Hit description=HOBBIT protein
  Subcellular localization annotation: CTP_CleavageSite=36; ConfidenceScore=5.14e-01
MPKFLELGYNSKYPFQWFSTNKLQFSKPEKSPSTVYRFKTKETYQRHSRKLQTSIHSLKQLTQHENKTESKSLKANNAPSRNFNTGIESNSYRYPNQKTSITKRRKKHLGGKLSTETLRDEDGIGVHEMAKTLLRAIYEYCFHGSLSRFSILYLVWFKLGAARVHLSFLKFGHVTWHRSMRCVLRNDAPLVSLSTVESAGWTDNGGWRNSISRFLIINENKKKRKK

SEQ ID NO: 192106 - protein, 109 aa, Glycine max
  Coding DNA Sequence Number=SeqID_75328
  Gene Ontology: Cellular component=integral to membrane; Biological process=protein transport
  Homolog annotation: Hit_ID=Q9ZTX0; Match level="QueryCoverage=70%, HitCoverage=26%, E-value=4e-11, Identity=47%"; Hit description =Similarity to SCAMP37
MYFLKATICKGKSIKPVKLQWGAFYTANPGSVPAATNSRLSPLKPEPVDYNYGFGATVDIPLDSSTDLKKKEKELQAKETELRKREQSYNLKSLGESISSLGTIYWMSG

SEQ ID NO: 192107 - protein, 682 aa, Glycine max
  Coding DNA Sequence Number=SeqID_75329
  Gene Ontology: Mol. function=binding; Cellular component=thylakoid; Biological process=cell division
  Homolog annotation: Hit_ID=Q8LGU6; Match level="QueryCoverage=99%, HitCoverage=91%, E-value=0.0, Identity=64%"; Hit description=HOBBIT protein
  Pfam annotation: Domain name=TPR_1; Domain location=376-409; Score =1.6; E_value=3.4; Accession=PF00515.18; Description=Tetratricopeptide repeat
  Pfam annotation: Domain name=TPR_1; Domain location=39-72; Score =24.8; E_value=0.00031; Accession=PF00515.18; Description =Tetratricopeptide repeat
  Pfam annotation: Domain name=TPR_1; Domain location=444-477; Score =43.4; E_value=7.5e-10; Accession=PF00515.18; Description =Tetratricopeptide repeat
  Pfam annotation: Domain name=TPR_1; Domain location=478-511; Score =23.2; E_value=0.00092; Accession=PF00515.18; Description =Tetratricopeptide repeat
  Pfam annotation: Domain name=TPR_1; Domain location=512-545; Score =32.3; E_value=1.7e-06; Accession=PF00515.18; Description =Tetratricopeptide repeat
  Pfam annotation: Domain name=TPR_1; Domain location=590-623; Score =3.8; E_value=1.9; Accession=PF00515.18; Description=Tetratricopeptide repeat
  Pfam annotation: Domain name=TPR_1; Domain location=624-657; Score =16.8; E_value=0.053; Accession=PF00515.18; Description =Tetratricopeptide repeat
  Pfam annotation: Domain name=TPR_2; Domain location=376-409; Score =4.0; E_value=11; Accession=PF07719.7; Description=Tetratricopeptide repeat
  Pfam annotation: Domain name=TPR_2; Domain location=39-72; Score =26.9; E_value=7e-05; Accession=PF07719.7; Description=Tetratricopepti de repeat
  Pfam annotation: Domain name=TPR_2; Domain location=444-477; Score =32.0; E_value=2.1e-06; Accession=PF07719.7; Description =Tetratricopeptide repeat
  Pfam annotation: Domain name=TPR_2; Domain location=478-511; Score =15.9; E_value=0.14; Accession=PF07719.7; Description=Tetratricopeptid e repeat
  Pfam annotation: Domain name=TPR_2; Domain location=512-545; Score =24.7; E_value=0.00033; Accession=PF07719.7; Description =Tetratricopeptide repeat
  Pfam annotation: Domain name=TPR_2; Domain location=590-623; Score =12.6; E_value=1.1; Accession=PF07719.7; Description=Tetratricopeptide repeat
  Pfam annotation: Domain name=TPR_2; Domain location=624-657; Score =16.5; E_value=0.094; Accession=PF07719.7; Description=Tetratricopepti de repeat
  Pfam module annotation: Pfam domain module=TPR_1::TPR_1::TPR_1::TPR _1::TPR_1::TPR_1::TPR_1::TPR_2::TPR_2::TPR_2::TPR_2::TPR_2::TPR _2::TPR_2; Domain location=376-409::39-72::444-477::478-511::512 -545::590-623::624-657::...
  Pfam module annotation: Domain location=376-409::39-72::444-477::478 -511::512-545::590-623::624-657
MAQSRYLFAISCFHMDLLSEAEAALRPADEPGAEVPNGAAGHYLLGLIYRCTDRRKNAIQHFKQALSMDPLMWAAYEELCILGAAEEATVVFGEAAAFCLQKQYLNCSTSPNSHMSPEHSNEVAARPCMSEEASPRQLKQMQSLKDIATYHHGASILGGAAVVYCCPPPLYRNVLPNGQNLTTLSTDSSPKSTVNSPIQAPRRKFVGEGKLRKISGRLFSDSGPRRSSRLSSDSSVNTNANSTVVSGNGTNNSYKGGSKLNHMAFRTMAIRKGQSWANENIDEGICNDVPDDSSLNRTSINSCSSPVIEAKSYEQEAATFHIGGQVTSGSKVITGTSEILTLLRVLGEGYRLACLYRCQDALDTYLKLPQKHYNTGWVLSQVGKAYFELVDYLEADCAFSRARQITPYSLEGMDIHSTVLYHLKEDMKLSYLAQELISTDRLAPQSWCAMGNCYSLQKDHETALKNFQRAVQLNPRFAYAHTLCGHEYVALEDFENGIKCYHSALRVDSRHYNAWYGLGMLYLRQEKYEFSEHHFHMAYQINPRSSVILSYLGTALHALKVNNLVPLVVVRSGEALAIMEKAILEDKKNPLPMYQKASILVSLERIDEALDVLEELKEAQPRESSVYALMGNIYRRRHMHERAMFHYGVALDLKPSITDAAMIKAAVEKLIIPDEFQDEDDS

SEQ ID NO: 192108 - protein, 55 aa, Glycine max
  Coding DNA Sequence Number=SeqID_75330
MVYTDQSDLMANRYDGDGGGKKQVHTMVDKIDSFKLEFHHCAFHSINVSFIGIIA

SEQ ID NO: 192109 - protein, 183 aa, Glycine max
  Coding DNA Sequence Number=SeqID_75331
  Gene Ontology: Mol. function=hydrogen ion transporting ATP synthase activity, rotational mechanism; Cellular component=proton -transporting two-sector ATPase complex; Biological process =intracellular signaling cascade
  Homolog annotation: Hit_ID=Q8RV74; Match level="QueryCoverage=64%, HitCoverage=29%, E-value=7e-36, Identity=58%"; Hit description=Leaf senescence protein-like
MKFQKIELLFGNKTPTQMLPKVTLLAILAILIFAITPMCYPLSYSSLLKINKYKQPSTTYDGTESLPSTSVKKCDIFSGEWVPNPKAPYYTNTTCWAIHEHQNCMKYGRPDSEFMKWRWKPNECELPIFNPFHFLEIMRGKSMAFVGDSVGRNHMQSLICLLSRPLLFFSTKLSSSPMNSKGV

SEQ ID NO: 192110 - protein, 79 aa, Glycine max
  Coding DNA Sequence Number=SeqID_75332
MSASTVSITAANPGTRRRPVIATEKKTATSLELLANDVAVSPAVATSGDGATGRDLSHHSIRGEALLDRAPRDLTPAKK

SEQ ID NO: 192111 - protein, 124 aa, Glycine max
  Coding DNA Sequence Number=SeqID_75333
  Gene Ontology: Cellular component=nuclear envelope
  Homolog annotation: Hit_ID=Q5NBL8; Match level="QueryCoverage=83%, HitCoverage=23%, E-value=1e-27, Identity=59%"; Hit description=Unc -84 homolog B-like
  Pfam annotation: Domain name=Sad1_UNC; Domain location=5-113; Score =75.6; E_value=1.6e-19; Accession=PF07738.3; Description=Sad1  UNC -like C-terminal
MDLPRWLFFCITYVSTDVSSVEQSVAYDRSSAPKDCRVSGWLQEHNADSAIDTEKMHLLSEFTYDLEKSNAQTFNVLNSAASGVINMVRLDFTSNHGSPSHTCIYRFRVHGHEPDSVSMMALES

SEQ ID NO: 192112 - protein, 153 aa, Glycine max
  Coding DNA Sequence Number=SeqID_75334
  Subcellular localization annotation: CTP_CleavageSite=45; ConfidenceScore=5.10e-01
MLIGKGKKRRRLRLDLCNSYAVKVHSPHLIFFSFSFSFSLIPSPTAAPFSDRRSPLPEALSGADDPLFFLFLSKKIRKTEMLPPLPKRSSAVAPIDKRIARLKLSDAVADVVGGTKRTLTMKVKFRGLGFEFELGWESDIDTELESRVVEGLA

SEQ ID NO: 192113 - protein, 199 aa, Glycine max
  Coding DNA Sequence Number=SeqID_75335
  Gene Ontology: Mol. function=carboxypeptidase activity
  Homolog annotation: Hit_ID=Q8RV74; Match level="QueryCoverage=93%, HitCoverage=52%, E-value=2e-46, Identity=43%"; Hit description=Leaf senescence protein-like
  Pfam annotation: Domain name=DUF231; Domain location=42-189; Score =70.2; E_value=6.7e-18; Accession=PF03005.6; Description=Arabidopsis proteins of unknown function
MADSHGPSNTGLFNLYLDEVDEKWTTQIEEFDYIILDGGHWFYRPMVFYEKQKIVGCHYCLLENVPDLTMFYGYRKAFRTAFKAINSLENFKGIVFLRTFAPSHFENGIWNQGGNCVRTKPSRSNETRLEGTNLELYMIQLEEFKKAEKEGRKKGLKLKLLDTTQAMLLRPDGHPRPIDTWSDFLLEMLKMEGVRSAIS

SEQ ID NO: 192114 - protein, 74 aa, Glycine max
  Coding DNA Sequence Number=SeqID_75336
MEALFMSQIKKHYQKNHREVGTSILGVTECLGIKRYLGMLLLVGWKKNDVFNFVKEKVWRKIQSWNWGWKISDG

SEQ ID NO: 192115 - protein, 490 aa, Glycine max
  Coding DNA Sequence Number=SeqID_75337
  Gene Ontology: Mol. function=inositol or phosphatidylinositol phosphatase activity; Cellular component=actin cortical patch; Biological process=abscisic acid mediated signaling
  Homolog annotation: Hit_ID=Q6AVN0; Match level="QueryCoverage=82%, HitCoverage=82%, E-value=1e-118, Identity=50%"; Hit description ='putative inositol-1, 4, 5-trisphosphate 5-phosphatase'
  Pfam annotation: Domain name=Exo_endo_phos; Domain location=79-455; Score=69.6; E_value=1e-17; Accession=PF03372.13; Description =EndonucleaseExonucleasephosphatase family
MDIEFEDRQEETVSDMIPSNRQRKKQSFLWKVLAMRERNGRTIERSSNDSLDPLSVSSFDNRGSEPSMPSNEAIQNFRVFAATWNVGGQCPTGNLDLSDFLQVRNEPDIFQEIVPLNAGNVLVLEDNEPAAKWLALINQSLNGSSDLASKGLKPTASFGGPLFSQKPSLKKIKKTFKKLNGKRLRSCNCVLEMERKAGKDFCFRCQESNFNSDDSSTEEEDENFPIPVALATSQMKYSLVTCKQMVGIFVSVWMRRELVQYVGHLRICCISRGIMGCLGNKGCISVSMSFYQTSFCFICSHLASGEKEGDELRRNLDVIEILKNTQFPRICKTPHSRMPDKILDHEISLSHDDAKRLVEKRDWPALFNKDQLKMEREAGRVFKGWKEGKIYFAPTYKYAFNSDTYYVEGVKVSKNKRRTPAWCDRILWHGGGIQQLSYVRREFKFSDHRPVCATFNVEVEVMFRGQKKKVSTCNFQNIHDLVSTRSPYYS

SEQ ID NO: 192116 - protein, 83 aa, Glycine max
  Coding DNA Sequence Number=SeqID_75338
  Homolog annotation: Hit_ID=UPI00006A2901; Match level="QueryCoverage =37%, HitCoverage=20%, E-value=2e-10, Identity=96%"; Hit description =UPI00006A2901 related cluster
PGVPVPNPSAVGGLLELLPRRERVVACRSGEGLGNGPFGASSPGVEQSTQNCALNVKVKKFNQARVNGGSNYDSLKVAKCLVI

SEQ ID NO: 192117 - protein, 245 aa, Glycine max
  Coding DNA Sequence Number=SeqID_75339
MTRRYSATDWRDIFYNAVREAPGGVTAAAAFLTDRREKAIHPEDLRRRLRGADGESLSTEMLELLSEWLIDMGRPDARRWLQSFNARFSMASAYLPPPPEGGWACEATAIRQKVMQITAKNGLLAGICARVTEDNQIDGTECDELEAGCMEIIELVFRLRRNARRAAGEVRQALVLACEQLATPGSGCTLRELADAARVGVDACRRAVDNMRRAGVLVKVGERRVSYRNRPVALYAPVASKASGE

SEQ ID NO: 192118 - protein, 115 aa, Glycine max
  Coding DNA Sequence Number=SeqID_75340
  Subcellular localization annotation: CTP_CleavageSite=41; ConfidenceScore=5.60e-01
MAEPSKKRKGSSSTATAAAHRRHGPSGAPTAPIPPSLSSPRSSTLFSSDDQRLRYLSQFSSRIILDPKYLDVEFFNDETFDCYCRNLPFGGRATRDSRDACSTKGIRAESPPTFI

SEQ ID NO: 192119 - protein, 185 aa, Glycine max
  Coding DNA Sequence Number=SeqID_75341
  Gene Ontology: Mol. function=guanyl-nucleotide exchange factor activity; Cellular component=intracellular; Biological process =regulation of small GTPase mediated signal transduction
  Homolog annotation: Hit_ID=Q2URQ9; Match level="QueryCoverage=99%, HitCoverage=11%, E-value=2e-87, Identity=93%"; Hit description=Ras1 guanine nucleotide exchange factor
  Pfam annotation: Domain name=RasGEF; Domain location=4-167; Score =34.3; E_value=4e-11; Accession=PF00617.10; Description=RasGEF domain
MAALSEIDWKDLVDMRWSSGSPSSVSWVQFLMEEERRGIDLVVGRFNLMVKWILSEIVLTRNIHERARTITKFIHTAAHARRMCNYATMLQIAIALSSTDCSRLQKTWGLVPSEDRGLLKDMEVLIQPVRNFHDLRVEMETANVQEGCIPFVEAGTGCSPWRRAFDQLRTLPHDRQDSEKSSSLD

SEQ ID NO: 192120 - protein, 211 aa, Glycine max
  Coding DNA Sequence Number=SeqID_75342
  Gene Ontology: Mol. function=chitin binding; Cellular component =extracellular region; Biological process=chitin metabolic process
  Homolog annotation: Hit_ID=UPI000044A8F0; Match level="QueryCoverage =88%, HitCoverage=99%, E-value=1e-28, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MKGPINESISCFLLRVEPWVVVPITFRGLRALVFRGLHTLAFRGLHSLVFRGLHSIAYRGLHVLAFRGQHILAFIGLHDLAFRGLHALAYKGMHAFAYKGLHTLAFRGLQSFAYRGQHTLAFRVLHVLASRGLHILVFRGLRILVFRGLHALAFRGLHALVFRGLHVLAFRRLHTFAFRGLHALAFRGLRVLVFRGLHSLAFRGQHALTFR

SEQ ID NO: 192121 - protein, 583 aa, Glycine max
  Coding DNA Sequence Number=SeqID_75343
  Gene Ontology: Mol. function=aminoacyl-tRNA ligase activity; Cellular component=mitochondrion; Biological process=tRNA aminoacylation for protein translation
  Homolog annotation: Hit_ID=Q6D7L6; Match level="QueryCoverage=89%, HitCoverage=60%, E-value=0.0, Identity=84%"; Hit description=Leucyl -tRNA synthetase
  Pfam annotation: Domain name=Anticodon_1; Domain location=363-493; Score=33.6; E_value=4.9e-08; Accession=PF08264.3; Description =Anticodon-binding domain
MAVPGHDQRDWEFATKYDLNIKPVVLNLDGTAPDISAAAMTEKGTLFNSGEFDGLDHDAGFNAIADALAAKGVGVRKVNYRLRDWGVSRQRYWGAPIPMVTLEDGTVMPTPEDQLPVILPEDVVMDGITSPIKADPEWAKTTVNGQPALRETDTFDTFMESSWYYARYTCANYNEGMLDPAAANYWLPVDQYVGGIEHAIMHLMYFRFYHKLLRDAGLVNSDEPAKRLLCQGMVLADAFYYVGANGERNWVSPVDVNVERDEKGRITKAIDNQGREVIYAGMSKMSKSKNNGIDPQLMVERYGADTVRLFMMFASPAEMTLEWQESGVEGANRFLKRVWKLAYDHVAKGATVALDVNALNDEQKALRRDLHKTIAKVADDIGRRQTFNTAIAAIMELMNKLLRAPQESEQDRALMQEALVAVTRLLYPFTPHASYVLWQALGGEGSIDDASWPVADEAAMVEDSLLVVVQVNGKVRGKITVAPDATQEQVQARAAQEHLVAKYLDGVTLRKVIYVPGKLLNLVVPPEMKTLIVQSGDPYGPLARTVRQQLRINDVKIVEDSKAASAQYPTLRLGAESQDATPR

SEQ ID NO: 192122 - protein, 221 aa, Glycine max
  Coding DNA Sequence Number=SeqID_75344
  Gene Ontology: Mol. function=RNA-directed DNA polymerase activity; Cellular component=nucleus; Biological process=RNA-dependent DNA replication
MAQAIPSYCKSAFLLPPSTLQDEIQKIMNSFWWGRKQGWKLASDQDVVVSQVFKAKYYHNGEFLGSSLGHNPTLVKDGIRWKMIDGNKIKIWTEPWLQDSQNSYIVSPHIDGLADLTLSKDGMFSVRSAYYYAMENMTDSFHLQMNVFLWRVSRGCLPTREKLISRGVECPISCPYSVDSIENDWYIFAGYPHAKKLWLEASLLHQVNDIATVTPSTPTYI

SEQ ID NO: 192123 - protein, 131 aa, Glycine max
  Coding DNA Sequence Number=SeqID_75345
MVISLSLKGVPNRVTCPQVQRKLRSQDYLREATKERIQWILRILLRLKYSSWCGGSAASNGSLWWPSVVMGGGGGVSRISLNELFSLRGRPLLALSMTICTERNSSCAKRDNSRPARFLLGLELCLARFSR

SEQ ID NO: 192124 - protein, 181 aa, Glycine max
  Coding DNA Sequence Number=SeqID_75346
PGELASSDYPTFGALIWCVVGPYCEICGIVMHLGHESVVCLDNLTQWSGGLTHTTHNILGAGHGASAKDVHVDHVLLGVALTMLSPTTPTWDLSNQIPHFSSCDTSLGMMLVGGPLDLTSIIIQPLKSMRMWEILSTMRISCHPISLSIRASTVKRYSEERWFHPIRNGIPREMRVTLLRI

SEQ ID NO: 192125 - protein, 167 aa, Glycine max
  Coding DNA Sequence Number=SeqID_75347
  Homolog annotation: Hit_ID=Q75GV2; Match level="QueryCoverage=54%, HitCoverage=97%, E-value=1e-19, Identity=53%"; Hit description =Expressed protein
MRSYNYNSVTNDGPKIWKVHIRNGTKANAQYEEQAATVWQGKGSVVCKTPYRELYVESCIVETIVLSTGVLESMDTQKSQPEKQSSSAATAPSVTSCQKKKNEEAAFLDDLKDHIDEFIKASMDEHKSCFKKIIQKMFGMSKTVAEGHSNASKEIQSSLHLQTTVQD

SEQ ID NO: 192126 - protein, 87 aa, Glycine max
  Coding DNA Sequence Number=SeqID_75348
MDLANRLCDWGIWETRNSVMWGQVWRRGGRDVRPLGRKVEEEGVVVPLLLVACWHWQMVRMLEEGAYLRREGTLNFDGGGIGVRAQE

SEQ ID NO: 192127 - protein, 698 aa, Glycine max
  Coding DNA Sequence Number=SeqID_75349
  Gene Ontology: Mol. function=choline kinase activity; Biological process=phosphatidylcholine biosynthetic process
  Homolog annotation: Hit_ID=Q42811; Match level="QueryCoverage=74%, HitCoverage=100%, E-value=0.0, Identity=95%"; Hit description=GmCK3p
  Pfam annotation: Domain name=APH; Domain location=324-579; Score =42.5; E_value=1.5e-09; Accession=PF01636.13; Description =Phosphotransferase enzyme family
  Pfam annotation: Domain name=Choline_kin_N; Domain location=272-323; Score=74.6; E_value=3.1e-19; Accession=PF04428.5; Description =Choline kinase N terminus
  Pfam annotation: Domain name=Choline_kinase; Domain location=348-575; Score=247.5; E_value=2.9e-71; Accession=PF01633.10; Description =Cholineethanolamine kinase
  Pfam module annotation: Pfam domain module=APH::Choline_kin _N::Choline_kinase; Domain location=324-579::272-323::348-575
LEVFAMGATEDLVNSTQGAAECQENRTTGPSENPIKDNTSSTSENLVQYKALDAENPVSDQQGGAEIPETGGAENPASDQKNVEQIPASEQVGIAENMVNDQAGGAEDPTKDRTAGGAENPLNDLIFLAQNSESEQAGSVENLLSDQAGVAEDHTKNRAAGSAENPSNDLIDLAQNPESEQAGSEENLLNYQAGGVENSAKNHAAAGAGDPPNDQAADGAENSAKNLSARSAGDPPHDQAADAIENSLNNQTEATEKLVKDEQGTAESFVEDVADAVEMPENSQRNGVETPVSNKADRLPEEAKEILKSLASKWEDVLDANALQVIPLKGAMTNEVFQIKWPTMTGELSRKVLVRMYGEGVDVFFDRDNEIHTFEFMSKNGQGPRLLGRFTNGRVEEFIHARTLSASDLRDPSISALIAAKMKEFHDLDMPGEKKVHLWDRLRNWLSEAKRLSSPKEVEAFYLDTIDKEISILEKELSGSHQQIKFCHNDLQYGNIMLDEETNSVTIIVSFSLRDQWAITSKYDLKCYLLQQDYEYASYNPVAFDIANHFCEMAANYHTEEPHILDYNKYPDFEERQRFVQAYLSTSGEQPSDSEVEQLLQEIEKYTLANHLFWGVWGIISAQVNTIDFDYKEYAKQRFQEYWARKPYLLINSEAPSPYNVPEGTGELASAVPTKSKNSGIFRKMKRVLGLGLFRSKS

SEQ ID NO: 192128 - protein, 351 aa, Glycine max
  Coding DNA Sequence Number=SeqID_75350
MAGSNVEKHLQGLSLEEEKDNGERMANLWRLMKGVMITKFDQGIFIFQFYHKLDLKRITRMTHGISTTTFTNSNDGGLQEAVGVQEGNARPTRNKRSPAYWKDYEGLGPRNPSGIIGAFIAMADETRSKTSSDRVEVAIAKLTASHLSMNSKIDDLLHHMSQLESSHNNPYTPSSPSLGPSVTSSREPTHRVKLDIPRFDDSKPTGWIFKITQFFEYHSTPDTEHLTIASFYIEGPALTWFQWMHHNAQLSSWSAFLHALHFRFASSTYEDPTSLLCKLSQRSLVSAYLSEFESLANRITGLLAPFVLSCFISGLNLVIQREVQTPSRLARDPREGPRVLMSLRVDFEAMG

SEQ ID NO: 192129 - protein, 91 aa, Glycine max
  Coding DNA Sequence Number=SeqID_75351
MKTKARSRFTDNIVSEIEQEAPYQDDELVGLQEVLELDPDVINESLAGVDGGGEEIDADLLKQLGLIEPDKDECMLSENDIESDFDDTNTS

SEQ ID NO: 192130 - protein, 144 aa, Glycine max
  Coding DNA Sequence Number=SeqID_75352
  Homolog annotation: Hit_ID=Q00M75; Match level="QueryCoverage=21%, HitCoverage=5%, E-value=5e-10, Identity=100%"; Hit description=PPR -repeat containing protein
MEKCFTSVLDWATKVCFLDHQETRLGPRNTQDTYVKIPTSQMLQMCRKLSTVQLTERLDYSNLPGLNPNMKNGRGSSLCEGIGEGYCTQPYPCICKEAVSGFEPMTNKSPRHNFTAAPGLALHLHWLLFNKLAHKYLNSLILYF

SEQ ID NO: 192131 - protein, 79 aa, Glycine max
  Coding DNA Sequence Number=SeqID_75353
MRRGAKRKTKQGQEAIHDAPEDNKPKSQPRAKRAKTSKPQSEPKYFEDKRNLCTLYLRLFWFGARTHVLVWHAGSTKKE

SEQ ID NO: 192132 - protein, 103 aa, Glycine max
  Coding DNA Sequence Number=SeqID_75354
  Gene Ontology: Cellular component=integral to membrane
  Homolog annotation: Hit_ID=Q6D2T9; Match level="QueryCoverage=99%, HitCoverage=64%, E-value=4e-19, Identity=46%"; Hit description =Putative membrane protein
MDAIKQILIDEIDTLNREERRDNLPRFSFNFLKTHPGLWGVMYLCYGLCVALIFSTEMLGWPAFWFATVFVLVMSFLMLLDINPKYRFEDIDTLDLRVCYNGE

SEQ ID NO: 192133 - protein, 125 aa, Glycine max
  Coding DNA Sequence Number=SeqID_75355
  Subcellular localization annotation: CTP_CleavageSite=27; ConfidenceScore=5.44e-01
PANLLPSAVRHFSILNLIRRPMNSLPSAVHVSSTNESGAPRIHYLAFPANSLPSAFRQFSMLNLIRRPMNSLPSVVHVSSTIESGAPRIHCLALFANSPFSIFQRPMNSLPSAVHVSSVIKRGAS

SEQ ID NO: 192134 - protein, 50 aa, Glycine max
  Coding DNA Sequence Number=SeqID_75356
EAKDLKNKADMIKKLMEKGYRVKMFSSILSLQNLGSNLVSNCVSTMFYPE

SEQ ID NO: 192135 - protein, 261 aa, Glycine max
  Coding DNA Sequence Number=SeqID_75357
MVKEIMSTSFVYQDTDRVGVKDRYSRGRDASSIGACRPRIFFINGFLCFLEDEWQRNGERKRERRRHFKEKMSLEEAHHHRRPWIRAWRKKEMNEGRGREEHEILADGRNPGGCPRPSSPRGIARKHTCALEKTFHHNESIIPSLCGRQVLLGEENESLEISRKRACEMREDDVHRGAFPPEDEHASFNGDFPPWRCSGRQRRRGERRRHPLGNKPWKKELHHQDEPWIRSLEGCFNGGKERGRGEHEIEGIKEGEKWNFE

SEQ ID NO: 192136 - protein, 79 aa, Glycine max
  Coding DNA Sequence Number=SeqID_75358
  Gene Ontology: Mol. function=chromatin binding; Cellular component =chromatin; Biological process=chromatin assembly or disassembly
  Homolog annotation: Hit_ID=Q1T2D5; Match level="QueryCoverage=72%, HitCoverage=3%, E-value=2e-12, Identity=56%"; Hit description=Chromo
MVISAFHTGPTRFIKGYASLAAPLTKLLCHDQFQWSSEATKAFQALKDAITNSPILALPDFCVPFVVETMLPALGWWQF

SEQ ID NO: 192137 - protein, 480 aa, Glycine max
  Coding DNA Sequence Number=SeqID_75359
  Gene Ontology: Mol. function=chromatin binding; Cellular component =chromatin; Biological process=chromatin assembly or disassembly
  Homolog annotation: Hit_ID=Q1SAV4; Match level="QueryCoverage=40%, HitCoverage=78%, E-value=2e-39, Identity=33%"; Hit description =Integrase, catalytic region
  Pfam annotation: Domain name=Chromo; Domain location=273-326; Score =26.3; E_value=0.00011; Accession=PF00385.14; Description='chromo' (CHRromatin Organisation MOdifier
  Pfam annotation: Domain name=rve; Domain location=102-211; Score= -14.1; E_value=0.09; Accession=PF00665.16; Description=Integrase core domain
  Pfam module annotation: Pfam domain module=Chromo::rve; Domain location=273-326::102-211
MEDQPASLYVISMPQFLFLKDLRKELLSLQGFTELRDKIQRDPATYTEYTLTPDFILHKGRIWLPSNSSFIKPLLEEFHQSLTGGHMGIQKTLHRFCVTCQHTKPDNQKPTGLLCPLPGLHLGMLPTHHTAHAMVVLFMEIVGKLHGMPWSIVSDRGLLFISKFWRELFSLSGTKLRLSSAYHPQSDGQTEWSYNTSYHSSTGMTPFEITFGRKPPTFPQYVTGTSKIDAFDDILAYSKLAKRYYGPFQVTERMGKPPTTDLPPLALDNHPLLTPLAIMASKFIPSESGPKRMVLVQWKGLPPEETSWEDWSAFKTTHHIEDKVLLDGDGSVMDSNDGGLQEAVWVQEGNARPTRNKREYLSVRIFPDIASFPFFLVGLCPLGLGPRNPRGINNLLALGRIQLGDVPNQVKVLSWNCRDLVNLRVVPVLKDILGVHKPGTLFLSKTLVHSNRVEEIRVALGFQKVFVVDKDGRSGGLALF

SEQ ID NO: 192138 - protein, 366 aa, Glycine max
  Coding DNA Sequence Number=SeqID_75360
MDGTTKGCVSSQPLIWIFGRDLSYQTGASLCLLEASRTLYKVHCHQPSNMSFSREGFVRFDRMLSWEVHPIEKVPTMSPPIFMVVLTLLGTKSLTFAWVTSSLVVSWSLLMLDEAESPQLNPPPNVIDLDLEAIIIQVLPRRLFVPPPPLSKNMFQENKKGGWISLIGIIDKAIITNSYKKFKGHFFQEDMVILHKLPRGLHRKPWWTSFFPRLQIRTGIASLTIVPLGRLRLKRLRMSLWKRIRRIRRKIPKMTWCLLLLLLLPVSSFGASMGLPVVVLHKGRVVESIPTFLLIKERVSSLWRKDFNTKALIQASMLGQSYKDMLREVGPLVSMHSIICFVARSWGIVEFWGNEFERAEAESQKA

SEQ ID NO: 192139 - protein, 43 aa, Glycine max
  Coding DNA Sequence Number=SeqID_75361
MMNSSHGPHCPNQAPVFYDIVLQGLFLLHEYPTNYSLMRFMKA

SEQ ID NO: 192140 - protein, 149 aa, Glycine max
  Coding DNA Sequence Number=SeqID_75362
  Homolog annotation: Hit_ID=Q1T2D5; Match level="QueryCoverage=68%, HitCoverage=6%, E-value=2e-31, Identity=59%"; Hit description=Chromo
MNELIGDVKRILEMMENHNKEYAARFETLETTLEMTLKDKIGDPGSTSLAMNNHPFQVRNVKIDFPRFDGLDVLQWISKAEQFFNYYKTQDEQRLIIASIHLDKEVVPWYQTMTRENSFKTWIAFTQTLETEFGPSPYECPRSQLFKLT

SEQ ID NO: 192141 - protein, 309 aa, Glycine max
  Coding DNA Sequence Number=SeqID_75363
  Gene Ontology: Mol. function=transcriptional repressor activity; Cellular component=mitochondrion; Biological process=regulation of progression through cell cycle
  Homolog annotation: Hit_ID=Q45Q24; Match level="QueryCoverage=90%, HitCoverage=100%, E-value=1e-111, Identity=74%"; Hit description=PHB1
  Pfam annotation: Domain name=Band_7; Domain location=31-223; Score =163.8; E_value=4.3e-46; Accession=PF01145.15; Description=SPFH domain  Band 7 family
MGRNEAAISFLTNVARTAFGLGAAATAVSSSLYTVDGGQRAVLFDRFRGILDSTVGEGTHFLIPWVQKPYIFDIRTRPHTFSSVSGTKDLQMVNLTLRVLSRPDTEKLPTIVQNLGLEYDEKVLPSIGNEVLKAVVAQFNADQLLTERSQVSALVRDSLIRRAKDFNIVLDDVAITHLSYGGEFSRAVEQKQVAQQEAERSKFVVMKAEQERRAAIIRAEGESDAAKLISDATASAGMGLIELRRIEASREVAATLAKSPNVSYLPGGQNLLMALGPSRKLPTNAADAASIAIADTYKTLMLWTKSLCH

SEQ ID NO: 192142 - protein, 123 aa, Glycine max
  Coding DNA Sequence Number=SeqID_75364
  Gene Ontology: Mol. function=asparaginase activity; Cellular component=lysosome; Biological process=glycoprotein catabolic process
  Homolog annotation: Hit_ID=Q56W64; Match level="QueryCoverage=91%, HitCoverage=31%, E-value=5e-38, Identity=64%"; Hit description =Probable L-asparaginase 3 precursor (EC 3.5.1.1) (L-asparagine amidohydrolase 3) ...
  Homolog annotation: Hit description=[Contains: L-asparaginase 3 subunit alpha; L- asparaginase 3 subunit beta]
MGHIVVGTSTNEAIFKIPGRVGDGPIVGSSAYVVDEVGACSATGDGDIRIRFLPCYLVVESMRLGMERKLAAKDAIARIARKYPDFLGAIVALNKKGEHAGACHGWTFKYSVRSLNERCGSFY

SEQ ID NO: 192143 - protein, 542 aa, Glycine max
  Coding DNA Sequence Number=SeqID_75365
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=44%, E-value=1e-133, Identity=60%"; Hit description =Chromo
  Pfam annotation: Domain name=rve; Domain location=223-379; Score =106.0; E_value=1.1e-28; Accession=PF00665.16; Description=Integrase core domain
  Pfam annotation: Domain name=zf-H2C2; Domain location=164-205; Score =10.5; E_value=0.015; Accession=PF09337.1; Description=His(2)-Cys(2) zinc finger
  Pfam module annotation: Pfam domain module=rve::zf-H2C2; Domain location=223-379::164-205
MSPNWLAHFQHLETVLKVLQQHKLYAKLSKCSFGLQEVDYLGHIVSGKGVPMDQEKVQAVLNWPYPTNLKQLRGFLGLTGYYRKFIKGYASIATPLSNLLKKQNFHWNDHTSMAFDNLKAVITKAPVLALPDFSKAFTLELMPLGRLVIPSNHELVKRILHEFHTSLIGGHAGVARTLSRIASQFYWKCMHKYLKEFVQQCLTCQQAKSDTMLPSGLLQPLLIPMQIWEDLAMDFITRLPPSNGFTVILVVIDRLSKYAHFFTLKSDYNSKQVAEVFVKNIVKLHGFPKSIVSDRDKAFTSPFWQQMFKLSGTTINLTTAYHPQPDGQSEALNKCLEMYLRCFTHDSPKEWAKLLPWAEFWYNTAYHNNSGMTPFKVVYRRDLPKLTRDIADQSCSMSIKEQLMLRDLTRSKLKQNLIKAQAHMKKYADMKRRQVEFNVGDLVLVKLQPYRQHSVALRKNQKLSLRYFGPFPVIERIGLVAYKLLLPPTTKIHPGFHASQLKPCKGDHPQLYISLPITNDEVDLVIQPARFLKERVVIKGQQ

SEQ ID NO: 192144 - protein, 229 aa, Glycine max
  Coding DNA Sequence Number=SeqID_75366
  Gene Ontology: Mol. function=RNA binding; Cellular component=nucleus; Biological process=regulation of translation
  Homolog annotation: Hit_ID=Q9T0G5; Match level="QueryCoverage=59%, HitCoverage=18%, E-value=5e-36, Identity=59%"; Hit description =Putative DNA-directed RNA polymerase
  Pfam annotation: Domain name=KH_1; Domain location=152-218; Score =78.9; E_value=1.6e-20; Accession=PF00013.19; Description=KH domain
  Pfam annotation: Domain name=KH_2; Domain location=152-204; Score =11.0; E_value=0.0058; Accession=PF07650.7; Description=KH domain
  Pfam module annotation: Pfam domain module=KH_1::KH_2; Domain location=152-218::152-204
MGKKQNDIQKTGLGRALLSRFYRKKFLESFNEVSDIDAVVEQSLEPLPKLAAVASTTLISLSEPGSVPDETTTPEEARKQQKQEEIEHYAKIQITRDADADPLCATRSVELIGILESIDKAEKLMNVADVGDSPSLVARGLSPAQATVGSEQIQIQVPNEKVGLIIGRSGETIKSLQTKSGVRIQLIPQHLSEGDDSKERTVQVTGDKRQIQIAQELIKEVMNQDNGSW

SEQ ID NO: 192145 - protein, 88 aa, Glycine max
  Coding DNA Sequence Number=SeqID_75367
  Subcellular localization annotation: CTP_CleavageSite=43; ConfidenceScore=5.19e-01
IKQTLDQHIDSGSLSSQINSSASQVDSPQAIITSPGNANPVAVAALENKDLAFLVAQPGSDSHQSNNNNNSEGDEANFILSYLSITLA

SEQ ID NO: 192146 - protein, 42 aa, Glycine max
  Coding DNA Sequence Number=SeqID_75368
MTSHCLPPHPKWRYPESFSHLRWNYLISLPILDKVIHHEVSQ

SEQ ID NO: 192147 - protein, 65 aa, Glycine max
  Coding DNA Sequence Number=SeqID_75369
  Gene Ontology: Mol. function=transcriptional repressor activity; Biological process=regulation of nitrogen utilization
  Homolog annotation: Hit_ID=Q3KN71; Match level="QueryCoverage=97%, HitCoverage=20%, E-value=1e-18, Identity=64%"; Hit description =Isoflavone reductase-like protein 2
LPPPHNIPVPILHSVFVRGDLVNFELRENDLEASSLYPDYNYTSIHKLLDIFLANPPTPASAAFE

SEQ ID NO: 192148 - protein, 73 aa, Glycine max
  Coding DNA Sequence Number=SeqID_75370
MGWKWIRRNSPQRGLEETPQQKGPMPPPSLIVIVSGAPSTSSASRPSKDGRSIGPCGLNNLKRDRLRMQKKQQ

SEQ ID NO: 192149 - protein, 97 aa, Glycine max
  Coding DNA Sequence Number=SeqID_75371
HVFSSSLRARLLVVVGSDANPSRRRKKWGKEWLQWRLPEEPRRLLPELPEEGVPKNFRKKGSSESNERSFGRSLSFRNLPGTPLIGNFPEEGSSGAL

SEQ ID NO: 192150 - protein, 252 aa, Glycine max
  Coding DNA Sequence Number=SeqID_75372
  Gene Ontology: Mol. function=transporter activity; Cellular component= outer membrane; Biological process=transport
  Homolog annotation: Hit_ID=Q5H6Z9; Match level="QueryCoverage=84%, HitCoverage=30%, E-value=1e-51, Identity=52%"; Hit description=Iron transporter
  Subcellular localization annotation: CTP_CleavageSite=61; ConfidenceScore=5.71e-01
MAVTAIAVARRARSSAASASSAPATTRTRRWRKPSPPATRPRRSYRPRPPIDGSAGPCPARAAHVLQPRESTQFTAGQGPAASALHVQQGKARRPFGGDVVDHGIAAGRGLQCPLPVGGAPLQACERLLARHTRQATVRRDHVVRVQVRRAHLRLQPGPGQLQFQLLGQRLSVLQFHALAAGAANVAIGAAPSGVAGNGQLIVSICTEQADIELDSALRVPLAANLQIAAAGGRQVQCQSRLPVGAIAQFVE

SEQ ID NO: 192151 - protein, 210 aa, Glycine max
  Coding DNA Sequence Number=SeqID_75373
  Gene Ontology: Mol. function=ribonuclease H activity; Cellular component=intracellular; Biological process=DNA integration
MMKDLCEEFKIEHHNSSPYRPQMNGAVEAANKNIKKIVQKMVITYKDWHEMLPYALHGYRTSVRTSTGATPFSLVYGMEAVLPVEVEIPSMRVLMEAQLSEAEWCQSRYDQLNLIEEKRMKALCHGQLYQQRMKQAFDKKVHPRVFQEGDLVLKKVLSFQPDSRGKWTPNYEGPYVVKRTFSGGALILTTMDGDELPRPVNADAVKKYFV

SEQ ID NO: 192152 - protein, 118 aa, Glycine max
  Coding DNA Sequence Number=SeqID_75374
MLQPYGINIGLKEHSNPVTPKAYTPKSPSGPLPPDSGNLHFLFNTAHLHFSQDNTGRVIVQFTAYNTNNVTSRINHTFIHNQNSFTISHLIMSQSTITCFHVSHNSTPVLLYTFTQSQ

SEQ ID NO: 192153 - protein, 66 aa, Glycine max
  Coding DNA Sequence Number=SeqID_75375
MLLSSNVIYIYVRVVMLVRMICTRLFAAAQVNLAPLVLLQYQGVAQEPLKGNYWPLNRKCKPRLSI

SEQ ID NO: 192154 - protein, 109 aa, Glycine max
  Coding DNA Sequence Number=SeqID_75376
MTKRMKMRILLKWILMIIEVILNEVKNKIKGFLFLDLVTGDPPQQKRSLIIEIEEELKNITKDDAPQRERSQKIQKNKELKNITQGDPSKQKRSQGNKKKIKDDNITQG

SEQ ID NO: 192155 - protein, 84 aa, Glycine max
  Coding DNA Sequence Number=SeqID_75377
MLRKQLRTSFLAESEMNWLVLLKDAYDGNGFLIEKDPQVVFNEKLYKYAQVDHMEPRFWGGSFENFKTSLELYLLVCQSTSGQD

SEQ ID NO: 192156 - protein, 141 aa, Glycine max
  Coding DNA Sequence Number=SeqID_75378
MVKSEGELGFCGRNLGERVGALEGIKIGSLRVVCRHESRLSLLFVWMYEIVDVCGKRATHVWMMDKDTLGYNERRGSKNLGKLASGYYPTFGGLIWHGELSPHFATFDELRDYAFLSWELGNQCTLYPYLASLLTVIHAIV

SEQ ID NO: 192157 - protein, 124 aa, Glycine max
  Coding DNA Sequence Number=SeqID_75379
MVSSVRVYEKGDQGTMVSSVRVYEKGDQGTTNQEGHLLLRNTKKVLKENDGNSEQNMDGPLISVSNLELMNWATPSFNTLVVNVMERRVNFRTLEAKLQRSWTKNGSIQIIDLHDGFYQVVRRI

SEQ ID NO: 192158 - protein, 92 aa, Glycine max
  Coding DNA Sequence Number=SeqID_75380
  Homolog annotation: Hit_ID=Q1SB62; Match level="QueryCoverage=93%, HitCoverage=7%, E-value=6e-23, Identity=62%"; Hit description =Integrase, catalytic region; Zinc finger, CCHC-type; Peptidase aspartic, catalytic
MIFDNHEENERQQDPTLYELESSRRTQRNCHLPSKYEDCVISNDNDPSDEEIINFALFAECSELVIFEEATSDENWKKAMDDEIHAIEKNNI

SEQ ID NO: 192159 - protein, 85 aa, Glycine max
  Coding DNA Sequence Number=SeqID_75381
MSHHRLKQQDLELLQEGVAAKCSIDIQRPKKRTSKDGDKKAELSCLTLVVAQYERFFDVSVKNAENTQKGEQKGHFEAFSDPWLA

SEQ ID NO: 192160 - protein, 49 aa, Glycine max
  Coding DNA Sequence Number=SeqID_75382
DVPQWISAKDDLHKHDLYNVVAVTEAQATLTQGERRRTIWFKRKEKEEE

SEQ ID NO: 192161 - protein, 72 aa, Glycine max
  Coding DNA Sequence Number=SeqID_75383
  Gene Ontology: Mol. function=nucleic acid binding
MSLMIIKSGILEVVRGVVSKGIINVKDFLDELEKCFTKSDKVETSTLLQHLISMKYSGKGNIMESTSWKCLI

SEQ ID NO: 192162 - protein, 230 aa, Glycine max
  Coding DNA Sequence Number=SeqID_75384
  Gene Ontology: Mol. function=DNA binding
  Homolog annotation: Hit_ID=Q1RUD8; Match level="QueryCoverage=87%, HitCoverage=54%, E-value=4e-12, Identity=25%"; Hit description=IMP dehydrogenase/GMP reductase
MVEVSIEAIASLAQYYDQPLRCFTFGDFQLSPMVEEFEEILGFPLGGRRPYLFSGFYPSLARISKIVQISAQELDHRKQVENGVVGIPRKCLEAKARILAGSPLSECGWVGGPSSDRRFLAYHNHKESPVVAMLADLYDTFDRRCEESNARIVCCTPALYVGLVSHLFFQEGRPVYPLQGYHSPVLAIRQLGYPMRGAPLGESITPFIARGFSDHNARVLQGVRKAWDAA

SEQ ID NO: 192163 - protein, 493 aa, Glycine max
  Coding DNA Sequence Number=SeqID_75385
  Gene Ontology: Mol. function=hydrolase activity, hydrolyzing O -glycosyl compounds; Cellular component=membrane; Biological process =carbohydrate metabolic process
  Homolog annotation: Hit_ID=Q1S8W5; Match level="QueryCoverage=96%, HitCoverage=93%, E-value=0.0, Identity=73%"; Hit description =Glycoside hydrolase, family 17
  Pfam annotation: Domain name=Glyco_hydro_17; Domain location=39-360; Score=313.4; E_value=4.2e-91; Accession=PF00332.9; Description =Glycosyl hydrolases family 17
  Pfam annotation: Domain name=X8; Domain location=373-458; Score =166.3; E_value=8e-47; Accession=PF07983.3; Description=X8 domain
  Pfam module annotation: Pfam domain module=Glyco_hydro_17::X8; Domain location=39-360::373-458
MEGMKLKRWLVSVLFLIVATVSNAAADEASHFFNLGAFVGVNIGTDVTDLPSASNVVAILKAHQITHVRLYNANEHMLRALSNTGIEVIVGVTDEEILGIGESASVAAAWISKNVAAYMPSTNITAISVGSEVLTSVPNVAPVLVPAMNHLHTALVASNLNFRIKVSTPLSMDIISRPFPPSTATFNSSWNSTIYQLLQFLKNTNSSYMLNAYPYYGYTKGDGIFPIEYALFSPLSPVKQIVDPNTLFHYNSMFEAMVDATYYAIEAFNFNNIPIVVTETGWPSFGGANEPDASTKNAETYNNNLIMRVLNGSGPPSQPKIAINTYLYELFNEDKRKGPISERNWGVFYANGSSVYSLSFSAANMSNANSLGSFCVAKDDADTDKLQAGLSWACGQGQANCVAIQPGRPCYSPNNVKSHASYAYNDYFQKMHNAGGTCDFDGTATKTTEDPSYGSCIYAGSANASIGGRSSSSTALGLGPLYVPSFMVYLGSL

SEQ ID NO: 192164 - protein, 109 aa, Glycine max
  Coding DNA Sequence Number=SeqID_75386
MVEGHIVFLYCHRMLLHYLTYNDHLAKMDDLSYKKILLHLVTMNTMYPCNHVSMKECEICQKFLDWLMVISYLRHNVYSPQSSFTSYWLDSEISQDDVDEIWRHMKVTI

SEQ ID NO: 192165 - protein, 46 aa, Glycine max
  Coding DNA Sequence Number=SeqID_75387
MGVLNILRRSSEGRMPTYNGPQTKLGLLHNTCNRLPELLNVLIFKI

SEQ ID NO: 192166 - protein, 107 aa, Glycine max
  Coding DNA Sequence Number=SeqID_75388
MMSPVSTLPFYIDDIKTLWEHDDALYVEFHTTILLLCHAYARGHFPTPMSPQLVLLESQVLPGVDLVDLVSKDEGEELEEDTSFKEDPSMDKEDPITEPEFMKEDAS

SEQ ID NO: 192167 - protein, 289 aa, Glycine max
  Coding DNA Sequence Number=SeqID_75389
  Gene Ontology: Mol. function=DNA binding; Cellular component =intracellular; Biological process=DNA integration
MELEQLDVKTIFLHGILEEDILMQQLEGFKVEDGSCIYLLLYMDDMLIAFQNKFEIQNLKSLLSSEFEMKDMGVVEKILGMEIKRDRVQKKLFLFNVVSNYTGKLAKEHWQAMKCIFRYLKGTTDIGLFYQGDTSCALSRYLDYDYAVDLDARRSMIEYAFTIGNSLVSWKATLQPVVALSTTEAEYMTLAEATKKDIWLKGLISNLKFPRDKTIIFYDSLREICLTKDQVQHERTKHIDITYHFIHIEKRIVVQKVGTKGSKTLGKAWKQSGSGFFFPLDQLVKMEEE

SEQ ID NO: 192168 - protein, 240 aa, Glycine max
  Coding DNA Sequence Number=SeqID_75390
MGHQFKFICVKDVENVLRLEKDLDNILIDIIKIHSKGKQNKEGENKDNRRQQPTYALKRLSGKGKPTRDNNQRTLQQICNGTKNHNGINRVNLEPASNGGRLQNQIWQVKKGNIKEDNFEEWTSLNVKANGIQAQRLQECWVGTLKDTMFCKLHEECYEGNMGEIKLKLWKIGNQQWYLVQEAIRDGDGGCKERSIEEGGNTNEMKAVIDHKGEDEIMQSTPVTLIDGNSYSLGENFVRN

SEQ ID NO: 192169 - protein, 153 aa, Glycine max
  Coding DNA Sequence Number=SeqID_75391
  Subcellular localization annotation: CTP_CleavageSite=54; ConfidenceScore=5.26e-01
MDWANKSQSRVWNTPTHDFARTTLGAMVLSGRLMHMGSISRGNNMVHLTNAKVKARKIMDTCWGLLTMDAKMKWEKGVWGLLKWKFIKDIIVKEGVLLDTGRSRHLLRFDDWKQHQIWKVLILSDRNALYPFISGNKINLHNSHINQFRRYSP

SEQ ID NO: 192170 - protein, 137 aa, Glycine max
  Coding DNA Sequence Number=SeqID_75392
MATMMEAMMSMKKIMDANAVAVAATSVVAKVNPMPPFDLNHMNHPTSNMVGQDLGSTGSPHDVQIQNEYVFPPYGLPPNYTPPNVAYTPDEDVNNSALILIESRQRHHAHVSQPMGETYEIPHHNLADFEPCLGYAT

SEQ ID NO: 192171 - protein, 98 aa, Glycine max
  Coding DNA Sequence Number=SeqID_75393
  Subcellular localization annotation: CTP_CleavageSite=25; ConfidenceScore=5.10e-01
MPLNPDLAFQLSKPHSFSTHNTIFSLSNPSEKEVYPNLKFRGPTRRDALHDSENALLSRFGAEMVTKGWSFVGASMVEEEEENGNVRERKELSEIFFG

SEQ ID NO: 192172 - protein, 237 aa, Glycine max
  Coding DNA Sequence Number=SeqID_75394
MDFFWELAKVEGVERVRLAQARVEILSLGSDGGGGGSFVLAVWVRLATPCLLRHRSKLKINRLILSAYRLINHKLWFLFGLLLDFAIKLYRYRRPRGGARYQLLFPLVRVNFELGVIMLTHINCVALTARFPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 192173 - protein, 283 aa, Glycine max
  Coding DNA Sequence Number=SeqID_75395
MDADKLIRMKKAYGMLEAHDICISLTSLDKRLMRPDERQATKWILPSRPPIPKASPSLQGWEQSTYGLELRMKLLAYKEEIRSRQTSFKQIKRLNVHMPFMIGFQFSCFDTHNTQLQILVDKPMQYQKVNYYNGKELLIEDDEDASPTRYVKAHPRRLFKHDHEALKQKTELTNLNWSGTRQEAPSRSSPGDRVLLLDLQSYFFYSGNAFQHDLFMDKGVFCSDRTFSFVVNLPHSRFTFTHHMQPIIKEVDSNVEAEVDLSAMAVEVYDRPSSREYVKLIEA

SEQ ID NO: 192174 - protein, 73 aa, Glycine max
  Coding DNA Sequence Number=SeqID_75396
  Subcellular localization annotation: CTP_CleavageSite=41; ConfidenceScore=5.40e-01
MSSTGFESSSKDTNATSTSLMSPCSVFPESCVPPGWIWRISCSLAFTTSLSMYDLLSFLVYSSTQVNHTCLEE

SEQ ID NO: 192175 - protein, 180 aa, Glycine max
  Coding DNA Sequence Number=SeqID_75397
  Homolog annotation: Hit_ID=Q47522; Match level="QueryCoverage=28%, HitCoverage=64%, E-value=5e-23, Identity=98%"; Hit description=LacZ protein
MGVADIFPEYTQTPIKRKVKKEPKEEPQFVVDQTIGTQDQPVDLEFGSMSQQTRACASLTLSTPSTFVTSNSCSPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVTATLASAD

SEQ ID NO: 192176 - protein, 115 aa, Glycine max
  Coding DNA Sequence Number=SeqID_75398
SLLFAGIVPARHLVDPKKANRVLQLSALITGLCQFYGVPVAPNKFIRHPINRAFIKKYCTPRQAQGETPQQPGECWQRATDAPPPPLEFTSAQQQKGSENTLDMHVARYLGYACI

SEQ ID NO: 192177 - protein, 116 aa, Glycine max
  Coding DNA Sequence Number=SeqID_75399
MGLLHASRQLGWRFLHCMHLASVASGTYIMHAGWMAHGCRMDAWEARISRQWYWRNPLGCCRDVVELTRKSMNELKYNFVLGGYSVWNSRVAHADPMSWSILARQDNLDVLPTVLS

SEQ ID NO: 192178 - protein, 135 aa, Glycine max
  Coding DNA Sequence Number=SeqID_75400
  Gene Ontology: Mol. function=DNA binding; Cellular component =endoplasmic reticulum membrane; Biological process=DNA integration
  Homolog annotation: Hit_ID=Q1SXA8; Match level="QueryCoverage=91%, HitCoverage=8%, E-value=4e-42, Identity=65%"; Hit description=Zinc finger, CCHC-type; Polynucleotidyl transferase, Ribonuclease H fold
MEEELHQFTRNDVWKLVPKPKNKSIIRTRWVFRNKLDEQSKVVRNKAKLVAQGYNRQEVIDFTKTFTLVTRLKAIRIMFAFATHKNIKPFQMDVKSDFINDFIGEEVYVKQPSSFEDHTLPNHVLKLKKALYGLK

SEQ ID NO: 192179 - protein, 151 aa, Glycine max
  Coding DNA Sequence Number=SeqID_75401
MLTWRLLQRNLASYLLLFICSHERRFAIITRNSLNVSTRHSHLGKLGSKYRGQPIMHMKLPPPHGDQLESQGSSKSSDMPPSTTPCRTCRPWIFFINGVLRFLKINGSGMENDERTSSPPLEAMDKSLKVGEDEWRERERRGHEFYASNEV

SEQ ID NO: 192180 - protein, 76 aa, Glycine max
  Coding DNA Sequence Number=SeqID_75402
MASSSPTKPTTPFSSPDTRRQSKSPPLFILWEDIAFLVDFPHCTVPLMLRSEAGIETNQTIGYLSCDLSSTPARYR

SEQ ID NO: 192181 - protein, 185 aa, Glycine max
  Coding DNA Sequence Number=SeqID_75403
  Homolog annotation: Hit_ID=P31582; Match level="QueryCoverage=22%, HitCoverage=21%, E-value=3e-11, Identity=76%"; Hit description=Ras -related protein RHA1
  Subcellular localization annotation: CTP_CleavageSite=39; ConfidenceScore=5.10e-01
MSLSKVATHARFFLFLLHLCRRVPGTCSSFSKIEMELLSLKNAVSTFSLIASPESRHLHRRKVSTFSLIASLESCHRRRRKGETQSLQVVTLTRVKAVFVAPWFCNVTQNVRNSGWSQPDLIMEESTIGAAFFSQVLAVNDATVKFEIWDTSGQERHVCFIPQFYGSESKDDYFSLRNGFKRCMI

SEQ ID NO: 192182 - protein, 101 aa, Glycine max
  Coding DNA Sequence Number=SeqID_75404
  Gene Ontology: Mol. function=RNA-directed DNA polymerase activity; Biological process=RNA-dependent DNA replication
MEICKTHISFLGTEIGNGKIRLQPHISQKILGFPDKMEDTKTLRAFLGLLNYARNFINDLGKYTVPLYNKTSLTGQRKFNTEDIKLVQKIKEMVNNLPYLS

SEQ ID NO: 192183 - protein, 49 aa, Glycine max
  Coding DNA Sequence Number=SeqID_75405
MGFPLSAVIYPAENLSGFSIRYSLSLEEILLSFSSGERMRILFMGQGSK

SEQ ID NO: 192184 - protein, 186 aa, Glycine max
  Coding DNA Sequence Number=SeqID_75406
  Gene Ontology: Mol. function=zinc ion binding
  Homolog annotation: Hit_ID=Q1S216; Match level="QueryCoverage=98%, HitCoverage=46%, E-value=1e-18, Identity=36%"; Hit description =Cyclin-like F-box; FBD
  Pfam annotation: Domain name=F-box; Domain location=3-50; Score=34.2; E_value=4.5e-07; Accession=PF00646.23; Description=F-box domain
  Pfam annotation: Domain name=LRR_2; Domain location=154-179; Score =29.9; E_value=9e-06; Accession=PF07723.3; Description=Leucine Rich Repeat
  Pfam module annotation: Pfam domain module=F-box::LRR_2; Domain location=3-50::154-179
MADRISNLPDVVLSHILSLVPTNVAVATSVLSKRWKLLWRSVSTLNFNHSHHDDNNHETCSLFAQRVHAFILMHDMDQPFTRFCLSSSCPLDPIHVNAWISAATQHRVEHLDLSLGCAVELPSFLLFSCKTLVVLKLLNVVLSFNNSCCVYLPRLKILHLSSVAFSKDRDLAQLLSGSPNLEDLEA

SEQ ID NO: 192185 - protein, 81 aa, Glycine max
  Coding DNA Sequence Number=SeqID_75407
  Subcellular localization annotation: CTP_CleavageSite=53; ConfidenceScore=5.00e-01
MHSLTHAIACTRALTHKPLKVSPDQKGFSFQHAQHNLSKPSLLFLPLSLRHARALQPQPLPEPGTKGNDSHQKPQHTKETK

SEQ ID NO: 192186 - protein, 115 aa, Glycine max
  Coding DNA Sequence Number=SeqID_75408
MPISPCGRVAPTRHPVDPEKSNRALGFPALVTGLYQSYWVMPSRHRDRAHRTPSGPKEVQQGPGVSRSDCGPLSSGPLLIELSSRGVAPPGRRKAKHHSSLGMASNRQQMHRRHL

SEQ ID NO: 192187 - protein, 54 aa, Glycine max
  Coding DNA Sequence Number=SeqID_75409
MDDGQRYTGCSGQGGSKNLGELACANYPTFVVTPDCLPHDFVRSSRPRRIGGSD

SEQ ID NO: 192188 - protein, 329 aa, Glycine max
  Coding DNA Sequence Number=SeqID_75410
  Gene Ontology: Mol. function=zinc ion binding
  Homolog annotation: Hit_ID=Q1SAG6; Match level="QueryCoverage=84%, HitCoverage=65%, E-value=7e-36, Identity=37%"; Hit description =Cyclin-like F-box; FBD
  Pfam annotation: Domain name=F-box; Domain location=3-50; Score=41.6; E_value=2.6e-09; Accession=PF00646.23; Description=F-box domain
  Pfam annotation: Domain name=LRR_2; Domain location=152-177; Score =31.2; E_value=3.6e-06; Accession=PF07723.3; Description=Leucine Rich Repeat
  Pfam module annotation: Pfam domain module=F-box::LRR_2; Domain location=3-50::152-177
MADRISSLPDTLLCHILSFLPTIESVATSVLSKRWRPLWRSVPSLHFNDQIYWQYGETYYRFVQLVYTVMLRRDVTRPIERFNLECVSCLCDPSVIDTWLIATIHGKVKHLSLLLPSDLNLPCCILTSTTLVDLKLKGLTLNSRVSSVDLPSLKTLHLRKVHFVEPRLLLQILSACPLLEDLLIRSLHVTNNFSSDEHLERMPKLVKADISNASIDVQMATFYNVEFLRTQVGSDFFSDNKHTFLNLTHMELIFRFRFNVLGRLINLLHECPNLQILVVDEGNLFVKTSSDALRLKLNHIELIQPVQFFDTERQMSCCPVRKYKGCLFM

SEQ ID NO: 192189 - protein, 279 aa, Glycine max
  Coding DNA Sequence Number=SeqID_75411
  Homolog annotation: Hit_ID=Q1SDS1; Match level="QueryCoverage=52%, HitCoverage=27%, E-value=1e-10, Identity=29%"; Hit description=IMP dehydrogenase/GMP reductase
MGPVHRHSRSVDLRRSPLSKCGWVVSHLFRQEVRHACPLESHHSCTEKGGANWDQLLANKEGASVNWFPQWKEERIGVLISCGGFPNVPFMGTRGCISYNPVHAIRQLGYPMRGAPLEEEIAPVISQGFNKTNMETLQKVCKAWEVMQKKDKELRDSNNGPIGGYRKWLRAHVQGLDWLPSLRTAKREEVEASEEDEEVQALRAELEQAQTVKERFKSAALKIRKENAELRDINIATTKALEQETKRARRDEHNRNKFRGALWGSNSELKLRREERDQS

SEQ ID NO: 192190 - protein, 37 aa, Glycine max
  Coding DNA Sequence Number=SeqID_75412
VTDAPPPPLEFTSTNSQKGWSVAYDTWPTSRQPSPKP

SEQ ID NO: 192191 - protein, 91 aa, Glycine max
  Coding DNA Sequence Number=SeqID_75413
MKKLSKKGTVLVGLQLSHFLKQIVKFCGHGFLVCSEVDLGGAPCGAYRPWIFFINGVLCFLKFNGSGMEKEERLLEMPLQGENESIRSSPP

SEQ ID NO: 192192 - protein, 65 aa, Glycine max
  Coding DNA Sequence Number=SeqID_75414
MVPSFCFMVVLIILLEYILQKNMGLYGQRAGCLRLFSDISCSWGVHMLDLDDTPNTLDVDNLHVS

SEQ ID NO: 192193 - protein, 58 aa, Glycine max
  Coding DNA Sequence Number=SeqID_75415
MSIFCVGVAWSVVIRGGKRWDYSVFSMMTLQNGTMGQKGCSSGRWRRSSRWWEEQTTF

SEQ ID NO: 192194 - protein, 377 aa, Glycine max
  Coding DNA Sequence Number=SeqID_75416
  Gene Ontology: Mol. function=zinc ion binding
  Homolog annotation: Hit_ID=Q2HUI7; Match level="QueryCoverage=98%, HitCoverage=77%, E-value=2e-55, Identity=37%"; Hit description =Cyclin-like F-box; FBD; Zinc finger, FYVE/PHD-type
  Pfam annotation: Domain name=F-box; Domain location=6-53; Score=36.1; E_value=1.2e-07; Accession=PF00646.23; Description=F-box domain
  Pfam annotation: Domain name=FBD; Domain location=296-346; Score =41.1; E_value=3.9e-09; Accession=PF08387.1; Description=FBD
  Pfam annotation: Domain name=LRR_2; Domain location=154-179; Score =27.3; E_value=5.5e-05; Accession=PF07723.3; Description=Leucine Rich Repeat
  Pfam annotation: Domain name=LRR_2; Domain location=251-275; Score =1.6; E_value=9.8; Accession=PF07723.3; Description=Leucine Rich Repeat
  Pfam module annotation: Pfam domain module=F-box::FBD::LRR_2::LRR_2; Domain location=6-53::296-346::154-179::251-275
MSPTVDRISSLPNELLCHILSFLPTKQAVATGILSKRWGPLWRSVSTLDFNDESYLQKRTFFYWYRSVQSVYTVMLRRDVAQPIKRFILACSFCDVYTVSTWIMTAIEHRAEHVSLSLNPLITLSCSILSSRYLVVLELSGPTLRGISSCDFPSLKTLHLKMVHLRECRCLVEILAACPVLEDLFISSLRVTSSYCHGGDQLRLSKLVRVDISDSAYLACIQLPTLSNVKFLRTDVVQLRTTFVGLFTFVNLTYLELIVDAHYWDWLLKLLHCCPNLQILVIDKGNSFNKTSNDENWVYSHLVPKCLSSKLKTCRFQKYEGWECEFQFARYIMQNARALCAFTICSTGFSPLAAKFQMIKRLSSCPRISITCKLSFE

SEQ ID NO: 192195 - protein, 64 aa, Glycine max
  Coding DNA Sequence Number=SeqID_75417
MTKQRPFRQASFLNHFQYLNLKKDRFKGHLGMMHPIIRTLIGVTLIMKIFWVKMCIIHGILEMS

SEQ ID NO: 192196 - protein, 95 aa, Glycine max
  Coding DNA Sequence Number=SeqID_75418
  Homolog annotation: Hit_ID=Q00M75; Match level="QueryCoverage=32%, HitCoverage=5%, E-value=5e-10, Identity=100%"; Hit description=PPR -repeat containing protein
MRASPGAAVKLCLGDLLVMGSNPETASLHMQGCECSFQVHFVCLTSVLTVSLRLSSVSCRQVVIELFIGLLLYFWIVLIASGKFLSIHPDSEENR

SEQ ID NO: 192197 - protein, 56 aa, Glycine max
  Coding DNA Sequence Number=SeqID_75419
MRGKALVDSKPFDPKITNIERKNRKKKKQATAKTPVLWELLTKMLKLSTSELYHFY

SEQ ID NO: 192198 - protein, 110 aa, Glycine max
  Coding DNA Sequence Number=SeqID_75420
MSEHESGSFSATTEVNPREQCNAITARRGIVVGLKDESEFSENKTNEGVVKISDEKEVVEKEQKNELLAKEKQVEKQKLPASKKGKVILDHSPIQHLPYPNAPSKKDKEK

SEQ ID NO: 192199 - protein, 58 aa, Glycine max
  Coding DNA Sequence Number=SeqID_75421
MLTIVEEFVDFLGHGVGVCHCFGLGQQSGKFLTPIQSLGGGYVYISQFGVLLSDPNSC

SEQ ID NO: 192200 - protein, 166 aa, Glycine max
  Coding DNA Sequence Number=SeqID_75422
  Homolog annotation: Hit_ID=Q1RTB4; Match level="QueryCoverage=55%, HitCoverage=20%, E-value=6e-10, Identity=38%"; Hit description=IMP dehydrogenase/GMP reductase
MEGASVNWFPHWKEGRTRILSSCEGFPNVPMMGTRGCINYNLVLAVRQLGYPMRGAPSEESITPFIARGFSDPNTRVLQGVHKAWDAVRRKDKELRGSSNGIIDGYRKWLRVRIQGLDWLQKLRAVRDKEAEAPEENEEVRTLKVELEGARATKEKFKSMAIKVQR

SEQ ID NO: 192201 - protein, 63 aa, Glycine max
  Coding DNA Sequence Number=SeqID_75423
MDENNGKRMKKNEKEMSKKSVAYNKDWKRKLVRCLEEYFLVLEVNHPRSTIGFEATKASPNFE

SEQ ID NO: 192202 - protein, 159 aa, Glycine max
  Coding DNA Sequence Number=SeqID_75424
VHKAWEVVQKKDKELRGSNNGPIGGYRKWLKAHVQGLDWLSSLRTAKTEEVEAPEEDEEVQALRAELEQAQIVKERFKSAALKIRKENTELRDVNVATTKALERETKRACREEHGWNKLARGPKEVCLSGYARQRPTSDEHRVADEYAQVYAEKKARGR

SEQ ID NO: 192203 - protein, 129 aa, Glycine max
  Coding DNA Sequence Number=SeqID_75425
  Homolog annotation: Hit_ID=UPI0000689CD3; Match level="QueryCoverage =96%, HitCoverage=97%, E-value=7e-19, Identity=41%"; Hit description =orotate phosphoribosyltransferase
MNLEGRKIIVNKSSKELAELLKTPDNYKEFMPDGLQKFESREDGFKFGLQGMPEIALKIDEVTDQKAVLKSASSSLDFSLTATLNPVNDSQTEVQMLFEGKFNPFIKMMVEKPLQNFINTLTDKIEAYK

SEQ ID NO: 192204 - protein, 203 aa, Glycine max
  Coding DNA Sequence Number=SeqID_75426
  Gene Ontology: Mol. function=hydrolase activity
  Homolog annotation: Hit_ID=Q1XU60; Match level="QueryCoverage=96%, HitCoverage=90%, E-value=8e-29, Identity=38%"; Hit description=NUDIX hydrolase
  Pfam annotation: Domain name=NUDIX; Domain location=67-196; Score =48.2; E_value=2.7e-11; Accession=PF00293.18; Description=NUDIX domain
MYKVFVNEKKLLLSKQSENLEKNVRYENFTTFEIALDLLENTSVKELNVFGDDIDTIWKEFQSLFRIIEAAGGLVNNSKGEMLFIKRLGKWDLPKGKMEKGESREESAVREIEEETGLKDVELVKFINTTYHIYVERNGEKILKCTHWFEMNFNGEDTSKPQIEEGITEVAWKNNTQIENEVFPNTFKNIRLIVTEFRDGQPK

SEQ ID NO: 192205 - protein, 216 aa, Glycine max
  Coding DNA Sequence Number=SeqID_75427
  Gene Ontology: Mol. function=DNA binding
  Homolog annotation: Hit_ID=Q1SFS3; Match level="QueryCoverage=97%, HitCoverage=44%, E-value=3e-71, Identity=64%"; Hit description =Lambda repressor-like, DNA-binding
  Pfam annotation: Domain name=DUF1723; Domain location=48-97; Score =11.5; E_value=0.022; Accession=PF08330.1; Description=Protein of unknown function (DUF1723)
MDIPLRSTRKYLFKKTDLLRLRELASLVSDPVDFQAHHGKLLRILRVDVEEGCLETLVQFYDPLYHCFTFPDYQLVPTLEEYSYLVGLPVPDKIPFHGFEPTPKPSDIAAALHLKTSIIQANLTSKGGLQGLPTHFLYQQASIFAEAASTLAFHSILALLIYGLLLFPNIDNFIDINAIKIFLTKNPVPTLLADTYHSIHDLAYLPLTSIPCLQDQ

SEQ ID NO: 192206 - protein, 91 aa, Glycine max
  Coding DNA Sequence Number=SeqID_75428
  Subcellular localization annotation: CTP_CleavageSite=61; ConfidenceScore=5.50e-01
MGHATLSPSSCNLCPNMRSPSARKWPRGNLPQRDPGRIKRPKELVPLPSMTVTALGALNTSSASRPSRDGHFSESDTSSSGTMSIPISRRR

SEQ ID NO: 192207 - protein, 97 aa, Glycine max
  Coding DNA Sequence Number=SeqID_75429
MVAWPWTQPSLHREDEGPTAQVPQHMEDESSEATIPEPFDIGEEAEETQPSADPSTPLPEMPEDPTTPILAMETSPLTTSVLQLTDEEDGQTQDTHD

SEQ ID NO: 192208 - protein, 237 aa, Glycine max
  Coding DNA Sequence Number=SeqID_75430
  Homolog annotation: Hit_ID=Q40538; Match level="QueryCoverage=15%, HitCoverage=64%, E-value=4e-08, Identity=86%"; Hit description =Nicotiana tabacum (clone 5) activating factor DNA sequence
ETTAKGTGLAESAGKEDPVELDSSPTFGALPLFLDPRSASAGRSGRKTLSVRIRTVKAWPIDPLVLRNLNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGSERAAAKPFFHRLRPLTASRNLTLKSV

SEQ ID NO: 192209 - protein, 137 aa, Glycine max
  Coding DNA Sequence Number=SeqID_75431
CQSYGVPVTPSKVIHPITRAFIEKYCTPRQAQGDAHQAADAPPPPRQADPAGSLGVERYLHHLVCQQAANHHGQGQGSAPFACPTPEQFGAEVAWPGDWPDAQVGEELAGSLGEPDESHMDEDMIDLLGFLGGSGAT

SEQ ID NO: 192210 - protein, 216 aa, Glycine max
  Coding DNA Sequence Number=SeqID_75432
  Gene Ontology: Mol. function=hydrolase activity; Biological process =aromatic compound metabolic process
  Homolog annotation: Hit_ID=Q2L209; Match level="QueryCoverage=80%, HitCoverage=65%, E-value=1e-63, Identity=65%"; Hit description =Putative alpha/beta hydrolase
PLGAQSALLFAPGRAEGAHLLGAHARQRLPDRVGVPRPLAGIGAAAGAGNRRIDQHQPPHAGGLQNGGAQGEAGAHRMAEQGVTVQAQRGGEGVDVLRAGLRVISQFRAAGRQTAAAHVEHVDVVFFPQPLGDETPGDRRAGDAGDQDQRRAVAAVAQVVLANAVGVNVGAVEEGAHAAFSDFSACAYRKVLALDTACTLDARSLRLASYSWKAVR

SEQ ID NO: 192211 - protein, 102 aa, Glycine max
  Coding DNA Sequence Number=SeqID_75433
  Homolog annotation: Hit_ID=Q1XR96; Match level="QueryCoverage=65%, HitCoverage=37%, E-value=1e-08, Identity=46%"; Hit description =Hypothetical protein precursor
LTTDDADKTSKAAAEFVKTAAAIDSKVISSTHLSALKKNAGTISGTKSIDTQREAFLNLSKDMIALTKQFKLSGKPVFVMYCPMADGSWLSNEKQVVNPYYG

SEQ ID NO: 192212 - protein, 121 aa, Glycine max
  Coding DNA Sequence Number=SeqID_75434
  Subcellular localization annotation: CTP_CleavageSite=70; ConfidenceScore=5.01e-01
MHPPPIEIKKRALSLSILTMSGPGASGVLKATSADPWSASFMVETRTLFVFHKSKNFTSDYEIRMPPTVPVNHYSDPEGQHNRIRILTGGTTRPVKDRSASPAEGTSRPVHTGGGPIDPFS

SEQ ID NO: 192213 - protein, 125 aa, Glycine max
  Coding DNA Sequence Number=SeqID_75435
MTKSKRFVEVEDEDNVVHEKKTVDKKSTNGKKNEVRGESNGRRSRGSESRNQNIRSPSEGFNFLEKGLKNNLEKYFLKNSLFAKRKPRAKRIFIHALSCESQALSAQPMNLRLIGSAKLAKVELS

SEQ ID NO: 192214 - protein, 98 aa, Glycine max
  Coding DNA Sequence Number=SeqID_75436
MGQLAKQIADKSSNSFGANTENNPKEECKAVMTRSKRFVEAEDEENEVDKEQLSEKTGVEVKKNDVKEKSRSGKVVEESVEVPYHVVPSKNEKDRHLA

SEQ ID NO: 192215 - protein, 177 aa, Glycine max
  Coding DNA Sequence Number=SeqID_75437
  Homolog annotation: Hit_ID=Q47522; Match level="QueryCoverage=17%, HitCoverage=38%, E-value=9e-11, Identity=96%"; Hit description=LacZ protein
  Subcellular localization annotation: CTP_CleavageSite=35; ConfidenceScore=5.19e-01
MATGMGLNMQARRSIQLMVPSSGADGKRRVRLRPVAVHVAARNRAHPARTAGAGGADPHATATTAMGHAPPAVAYQRPARPPAVAREAAAEAPARAACAGARPVGQAPHPPFASWRNSEEARTDRPSQQLRSLNGEWDAPCSGALSAAGVVVTRSVTATLASADVRRCFCRYAPPRQ

SEQ ID NO: 192216 - protein, 82 aa, Glycine max
  Coding DNA Sequence Number=SeqID_75438
  Subcellular localization annotation: CTP_CleavageSite=19; ConfidenceScore=5.22e-01
MPDSMQRLTSSSAPFGQPVASEPVDTQKLTLSSAPLSSRDGESNDIRGYLMVIRTFCQPEASEPVDTWRFMSSSAQTTSVKH

SEQ ID NO: 192217 - protein, 118 aa, Glycine max
  Coding DNA Sequence Number=SeqID_75439
MLVRMIHTRLFAAARGKSCPDMHSRCVIASLSGGARTVGHPPISEGKRSFYSPKVWIWSTLKMRTRSPLKTRACSPLQARMCSPLMARTYSPLKVHLYEKARDRLIERVGHPTRLDTR

SEQ ID NO: 192218 - protein, 128 aa, Glycine max
  Coding DNA Sequence Number=SeqID_75440
  Gene Ontology: Mol. function=ribonuclease H activity; Biological process=DNA integration
MLGPGVGSPPAKAVHAKLHHLVGVQDGPRQAIKGSALADYLAQQPINDYQSMHPEFPDEDIMTLFEEEVADEDKNKWIVWFDDVSNTLGHGVGVVLVTPNDKCIPFTARLGFDCMNNMAEYEVCARGI

SEQ ID NO: 192219 - protein, 96 aa, Glycine max
  Coding DNA Sequence Number=SeqID_75441
  Subcellular localization annotation: CTP_CleavageSite=80; ConfidenceScore=5.78e-01
MPPKASGISLRGGRSTSKGARLALPEPTIKKSSTSSGSPTQAGSSTQKTNLERSSTQIASINPEPSTQESPKPATAKQTSADYAWPIETLQALQDM

SEQ ID NO: 192220 - protein, 40 aa, Glycine max
  Coding DNA Sequence Number=SeqID_75442
GRLRHPPFLRVVANCSIVSGGRQETKGMTSDGAAGNGSTH

SEQ ID NO: 192221 - protein, 56 aa, Glycine max
  Coding DNA Sequence Number=SeqID_75443
MYFPCYLGASLTIPSLQNHAHMPLRHFTEHLVGACLGMNSKRVGAMWHAPLLQDAP

SEQ ID NO: 192222 - protein, 103 aa, Glycine max
  Coding DNA Sequence Number=SeqID_75444
MFSKKEGMMRILKLTKYRLKAQTYQGNPCGVYPDLSSFTGSGVIQISVACIKRSAPTQVHINDLSNCYKRTTHSVGEEPCSFMGRCLGNGCLDLTLLQYTKHH

SEQ ID NO: 192223 - protein, 118 aa, Glycine max
  Coding DNA Sequence Number=SeqID_75445
  Homolog annotation: Hit_ID=UPI000044A741; Match level="QueryCoverage =38%, HitCoverage=11%, E-value=3e-09, Identity=69%"; Hit description =PREDICTED: similar to Ac1147, partial
MGGGAWPFLVGGAICLVNSVNERDLSLLNSYVEIIAIVGLQRGIPSKRESSARVDYVPALCTHRPSLLPIEWSGEVFGLRRRERFAARDVGPAEGSLSMPHNQIDPRIVYSSPSGGRG

SEQ ID NO: 192224 - protein, 35 aa, Glycine max
  Coding DNA Sequence Number=SeqID_75446
MASMDTSTMVNSKIFPAFNLDLVKPLAGLICPHAY

SEQ ID NO: 192225 - protein, 126 aa, Glycine max
  Coding DNA Sequence Number=SeqID_75447
  Gene Ontology: Mol. function=DNA topoisomerase (ATP-hydrolyzing) activity; Cellular component=chromosome; Biological process=DNA topological change
  Homolog annotation: Hit_ID=O24308; Match level="QueryCoverage=58%, HitCoverage=5%, E-value=3e-35, Identity=98%"; Hit description=DNA topoisomerase 2
MAGLSVVGRDHYGVFPLRGKLLNVREASSKQIMDNEEIQNIKKILGLQQNKEYTSVKSLRYGHLMIMADQDHDGMQAWHWPSFYNVVTGKTLALPNLIALQHIPLSPAGVIAKRPAPIALPNSCAA

SEQ ID NO: 192226 - protein, 216 aa, Glycine max
  Coding DNA Sequence Number=SeqID_75448
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=6e-30, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MHALAFRGLHILTFRGLHLLTIRGLHILANRGLHILDFRGLHALNFRGLHILTFRGLNVLPFRGLHVLAIIGLHVLTFRGLHVLAFRGPHALAFRGLHILTFRGLHALTFRRLHTLAYRGLHALACRGMHILTFRRLHVLTFRGLHILVVIGLHVLTFRGMHTLAFRGLDVLTFRGLDVLAFRGLHTLTIRGLDALTFRGLHVLAFIGLDVFNLQM

SEQ ID NO: 192227 - protein, 90 aa, Glycine max
  Coding DNA Sequence Number=SeqID_75449
  Gene Ontology: Mol. function=structural constituent of ribosome; Cellular component=intracellular; Biological process=translation
  Homolog annotation: Hit_ID=Q1SP37; Match level="QueryCoverage=98%, HitCoverage=31%, E-value=1e-27, Identity=56%"; Hit description =Bacterial adhesion
MRVDALRQKGLSPLQKCTAVIRILSYGSPGDIVDEYIRIGIYTIFGNEYLRRPNNEDTERLLQMGVARRFPGMLGSIDCMHWEWKNCPVS

SEQ ID NO: 192228 - protein, 88 aa, Glycine max
  Coding DNA Sequence Number=SeqID_75450
  Gene Ontology: Mol. function=unspecific monooxygenase activity
  Homolog annotation: Hit_ID=O04892; Match level="QueryCoverage=88%, HitCoverage=14%, E-value=5e-19, Identity=73%"; Hit description =Cytochrome P450 like_TBP
  Subcellular localization annotation: CTP_CleavageSite=31; ConfidenceScore=5.15e-01
MPPTPGRTHKRIRAGHGGPSPEPVGCRWTARAASAARAGRRVPVGGRIGNGPFGASSPGVEQSTQNWYGQGESDCLIKTKHCDGPCGC

SEQ ID NO: 192229 - protein, 354 aa, Glycine max
  Coding DNA Sequence Number=SeqID_75451
  Gene Ontology: Mol. function=hydrolase activity, hydrolyzing O -glycosyl compounds; Biological process=trehalose biosynthetic process
  Homolog annotation: Hit_ID=Q5PHK1; Match level="QueryCoverage=99%, HitCoverage=59%, E-value=1e-154, Identity=74%"; Hit description =Putative hydrolase
MTPWGAGIAYDVDAARRYIVEAPIYWLKEFNLDGLRFDAIDQIEDTSSKHVLIEIAERIRSEIHSRPIHLTTEDSRNVIFLHPRDADGNAPLFSGEWNDDFHNAIHVFATGETHAYYQDFADVPEKLIARILTEGFAYQGELSPQSGQRRGVPSAGQPPVAFVDFIQNHDQVGNRAQGERLISLAGVDRTKVLLATLLLSPHIPLLFMGEEYGETNPFLFFTDFHGDLAKAVREGRAREFTGHAGHDDTVPDPNAEETFARSKLDWSKVENPAGQAWLTLTHQLLALRQQHIVPLLPDARRHNGQVLRTAPGFVAVSWKFTQGQLSLALNIVQHSQSLPAMPGETLFACAQESG

SEQ ID NO: 192230 - protein, 80 aa, Glycine max
  Coding DNA Sequence Number=SeqID_75452
MEEQVHRDALSLEIKFEPNVMCEPIDKKVTFRTSQGCWCPLSTYQLWQTVVDSGDVGRRCLPLSVSGRLAMALSCRGVAI

SEQ ID NO: 192231 - protein, 61 aa, Glycine max
  Coding DNA Sequence Number=SeqID_75453
  Gene Ontology: Mol. function=DNA binding; Biological process=DNA integration
  Homolog annotation: Hit_ID=Q1RSC7; Match level="QueryCoverage=88%, HitCoverage=16%, E-value=2e-14, Identity=69%"; Hit description =Integrase, catalytic region
MKQPPVFLGKEDLTCLPSRHDSQSKTDSLLRLGTIIFNFARLGWPRRSCQGFGEEAAKLDT

SEQ ID NO: 192232 - protein, 106 aa, Glycine max
  Coding DNA Sequence Number=SeqID_75454
  Subcellular localization annotation: CTP_CleavageSite=64; ConfidenceScore=5.55e-01
MDAVSFVLKTRSASSALTSLIVPPSALSGSEQCKICILSVGSASSTPTSSIAPPFACRGDGGARCASGAHSFVRRGSPHEGKDSEQEHLISLNQFQLGVVKNACTP

SEQ ID NO: 192233 - protein, 208 aa, Glycine max
  Coding DNA Sequence Number=SeqID_75455
MKHAQGLMTKLSGPNRSASNGGAAARGLHASEVARDKGGAWELLWWPDFQGWVAFFEAILTLVSPEKNDWRWRQMADETRSDANLKTERGPSIASNPHAGIWPLELRRDAMVILDSGTILSCLYNNCLVVKLGSRSSSAQAKNKTFLGTILPCFGNHVSSGRSGRSRCSYVEYQEYVWLKSNIQTQSSSTPSVSVASISQYVDSQGPW

SEQ ID NO: 192234 - protein, 107 aa, Glycine max
  Coding DNA Sequence Number=SeqID_75456
MAAMMELRCGFLKKRHRTAVAWRVKDGGAMAAAIAMAAMADVAARRKMADAAATLDLEAPTQRDDPRSLRPATTSEPPTPATSNDPRRRRAWQRPPTATRMAATSTA

SEQ ID NO: 192235 - protein, 109 aa, Glycine max
  Coding DNA Sequence Number=SeqID_75457
MGAGIITVMVNWNQRQRGQGDENPKTVQIQGPMTRNRTKQSVDTLQQIIAGIFSKAQVEKDKSPNGEGRRPKWKRTKPQVEKDKGPSGEGRKTQVEKDEGPEAEALLSI

SEQ ID NO: 192236 - protein, 165 aa, Glycine max
  Coding DNA Sequence Number=SeqID_75458
MTRPCILQFIAAFHNEKSLIPDTPQTIPTKLVLCRWPETVEEALKYLRACGRPLPAFRMHVWTIELTQSLLCDPEPLMLPPLAAIYLPSCGFHMTILRKLEPPLQWPVVPVGPSYHDKYVGDPWYRFLAEGDFVHGDEVLFYYRSREDIWEMFIRKQRNWGDNDD

SEQ ID NO: 192237 - protein, 338 aa, Glycine max
  Coding DNA Sequence Number=SeqID_75459
  Gene Ontology: Mol. function=helicase activity; Biological process =viral genome replication
  Homolog annotation: Hit_ID=Q9LW42; Match level="QueryCoverage=58%, HitCoverage=11%, E-value=3e-45, Identity=50%"; Hit description =Helicase-like protein
MENHRFISKFDSAKARSNRKHIRQQKLHPILKIIITNQRRHHIVSMQLSIRLQTMLKIISSFFCFEVNVSGSSDNESSGSTQEYQTLSSVGYANCESSHHDSTMDTGEYFDLGDQLMQCRHCNAKMCHYNEIEAHIVSNLQKMLDENNAHAKSLRMARDRLTGTEVHNIRLKLIAGREKDGRTYNVPSVPEVAGSLISGDIDANSNRNIIVETQNCQLQRIHELHCSYLALQYPLLFPYGEDGYRADILHRDTLSGKKRKRNRFTMREWFAYRLQCRPNEGQTLLHSKKLFQQFVAEGYTMIESKRLSYVRNNQKKLRVDKFCSLQQSSDAGNTKGLS

SEQ ID NO: 192238 - protein, 95 aa, Glycine max
  Coding DNA Sequence Number=SeqID_75460
MKNVEERLKPCEIPHGKRYGNVRKRLGLDFFTETIFPSKSKEREQNRGGGCRPARPGELSSPRRARLLPPEATAFWRNILEGPSGPGCYLHPHFY

SEQ ID NO: 192239 - protein, 315 aa, Glycine max
  Coding DNA Sequence Number=SeqID_75461
  Gene Ontology: Mol. function=hydrolase activity, acting on ester bonds; Cellular component=nucleus; Biological process=biosynthetic process
  Homolog annotation: Hit_ID=Q4IYK4; Match level="QueryCoverage=99%, HitCoverage=72%, E-value=1e-109, Identity=56%"; Hit description=Non -ribosomal peptide synthase:Amino acid adenylation
  Pfam annotation: Domain name=AMP-binding; Domain location=1-185; Score=-38.2; E_value=5.6e-06; Accession=PF00501.18; Description=AMP -binding enzyme
MLQAFMSHEAVEHCVSLRRVVCSGEALPAELARQTLQRLPAARLYNLYGPTEAAIDVTHWTCQPDENISVPIGQPIDNLKTHILDGSLQPAVRGSAGELYLGGVGLARGYHQRPALTAERFVPDPFSTDGGRLYRTGDLARYRADGVIDYAGRIDHQVKIRGLRIELGEIEARLLELPSVREAVVLAQDGPSGKQLVAYVVPADSTQEQGALRDSLRAALKAGVPDYMVPAHLLLLAQLPLTPNGKLDRKALPQADASQLQGEYVAPQSALEQQIAAIWAQPSTPGRARVYPPGAVQASDRAAPGPGRTVTAYRT

SEQ ID NO: 192240 - protein, 162 aa, Glycine max
  Coding DNA Sequence Number=SeqID_75462
MDWSYACFFKLEEALKNLERKEEEGFGTLSFGAEEEKSRPCLNLAALSPLRVSSLKYAATFSSSVSKLHFSISFFIHLNSTNNPSSSMKCIFHYNNYKNATSLFSKAVHLVMQAPLELVGLGSSSSMDSFASWKINGSGMEKEEREETPLQGEDESRRSSPP

SEQ ID NO: 192241 - protein, 95 aa, Glycine max
  Coding DNA Sequence Number=SeqID_75463
  Subcellular localization annotation: CTP_CleavageSite=15; ConfidenceScore=5.06e-01
MKNGGKSSRNHPRKRLGSVTEVPRLGFSSRKQFFSLILSDSQIPGGGKEGGGCHPARPSKLSSPRRARLLPPEGTAFCWKILEGPSGPDLLILFP

SEQ ID NO: 192242 - protein, 114 aa, Glycine max
  Coding DNA Sequence Number=SeqID_75464
MKNKLKILRNLCFMSQYLCGDLQEKGEVLFQMIMSYFSTNMRKIMGFCFVRFVIVPILHSRRVGAAQMTWRRGVVVAWFCWKPQVPPTNTTSSREAWQLAACVNDELERSRESG

SEQ ID NO: 192243 - protein, 157 aa, Glycine max
  Coding DNA Sequence Number=SeqID_75465
MSAHVAQSYGVPVTPSKVIRPITRPFIEKYCTPRQAQGDAHQAADALPPPRQTDPAGSLGVEHYLQHLVHQQAANHRGQVQIHECLYRFSLSQQGQGSAFFACPTPEQFGAEVAWPGDWLDAQAGEEPAGSPGEPDESHMDEDMTDLLGFLGGSGAT

SEQ ID NO: 192244 - protein, 76 aa, Glycine max
  Coding DNA Sequence Number=SeqID_75466
MTLSMLTTSARRQWVDAAVVEEDDLVDHHADKVHEEPQELVTDGVERPELKLASHGRKIEKFGRLIPEIEGIMAAT

SEQ ID NO: 192245 - protein, 102 aa, Glycine max
  Coding DNA Sequence Number=SeqID_75467
MKNGGKPSRNRPRKRLGSLACGASMEAGSLSFNEEEGASPPRIALDKKLEEDALMEEKKERRGEHEIEGIKEGKKWNFEVYLIRLSFIKVTTSVTHASIYRL

SEQ ID NO: 192246 - protein, 80 aa, Glycine max
  Coding DNA Sequence Number=SeqID_75468
MASYVVEAQATVEELKLILEDGSWKRLFDWHFAWKKLLKHFELGSVDRKSGGCKSLGEDVRTLINSRNVNHSNQISEHLF

SEQ ID NO: 192247 - protein, 240 aa, Glycine max
  Coding DNA Sequence Number=SeqID_75469
  Gene Ontology: Mol. function=transcription regulator activity; Cellular component=nucleus; Biological process=regulation of transcription
  Homolog annotation: Hit_ID=Q5FAM4; Match level="QueryCoverage=87%, HitCoverage=82%, E-value=3e-46, Identity=51%"; Hit description =Putative bZIPtranscription factor protein
  Pfam annotation: Domain name=HLH; Domain location=160-210; Score =22.8; E_value=0.00054; Accession=PF00010.16; Description=Helix-loop -helix DNA-binding domain
MAEFTENLQRIGPSSFPFLDIDPSMELLNQFIGMNQLYVLDNSNLMPYFSFDTFLLGPQEPEFPGNLEEDFPFLFNHVNHNNALPISLPIFQAENEIHEGKKRKSMDLPETSSVNSTPKVSESGNKFKHSSGRGKRVKNNVTEEEKAKEVVNVRARSGQATDSRNLAERVRRGKINEKLRYLQNIVPGCYKTMGMAVMLDEIINYVQSLQNQVEFLSLKLTAPSTFYDFNSEIDALETMQ

SEQ ID NO: 192248 - protein, 298 aa, Glycine max
  Coding DNA Sequence Number=SeqID_75470
MALAGLAGLSSVEKSAHNGVDQPSYLLRGFMFLWSLGASFSLVELLFGLSKFVPEYGHFFHLDVALVLFMQLVHSTRDLDNNVCKPIHEFVEKFIICLSQTAIDGPWRKSTVLSQCHTFEGHWEDTPQDCIVIGVQVCLGYVSFHDVVDEGVSMSSPPCRTVDVGETWIILIVDYAWVSVMVVGGGLELSKKVSRLRLDQVLTMGERERGNMILRGMFYHDPTVDAKCTYQNPKLAHVRVDVAKAEGGTCKAKGSDTQGVQGNLVLIGVSGSCEYLFIGVVTAFVDNYQLVDTVRDNA

SEQ ID NO: 192249 - protein, 77 aa, Glycine max
  Coding DNA Sequence Number=SeqID_75471
MAFWRSLAFSALLLSLFVHGALCFYLPGVAPQDFQKVRSIFISISISISRECVFLGDNVAKVTVLVSGDYCCRVFYA

SEQ ID NO: 192250 - protein, 229 aa, Glycine max
  Coding DNA Sequence Number=SeqID_75472
  Gene Ontology: Mol. function=RNA-directed DNA polymerase activity; Cellular component=chromatin; Biological process=RNA-dependent DNA replication
MTTFGQGPLSRSFTIRYLIADANTSYFALIRKKTLNELRAIVSIPHLKMRFPTLTGEIMTVKTDQKQARLCYIEILKMTPYPPTRESAKPHPTADATTQVMSVDEGSPVRALIVHQASLYDKFDVDPYDDTSDRGPKSIEELVKLQLGPKLGVGPNDAYPLPSIDRLVDEASEFQVLSFLDTYSGYNQIRMHALDEEKMKFIIENAKFCYRGMPFGLKNASATYQRLMD

SEQ ID NO: 192251 - protein, 80 aa, Glycine max
  Coding DNA Sequence Number=SeqID_75473
  Pfam annotation: Domain name=zf-H2C2; Domain location=1-34; Score =16.2; E_value=0.0025; Accession=PF09337.1; Description=His(2)-Cys(2) zinc finger
MGVAKTIARLTKNFYWTGIRKDVERFIASCVDCQHTKYETKKMVLEWGFTWVCYPLITLLILSSSCSWRLSENSMECREA

SEQ ID NO: 192252 - protein, 258 aa, Glycine max
  Coding DNA Sequence Number=SeqID_75474
  Gene Ontology: Mol. function=nucleoside-triphosphatase activity; Cellular component=membrane; Biological process=cell division
  Homolog annotation: Hit_ID=Q683K1; Match level="QueryCoverage=83%, HitCoverage=46%, E-value=8e-66, Identity=54%"; Hit description=AAA -type ATPase like protein
  Pfam annotation: Domain name=AAA; Domain location=68-242; Score=17.2; E_value=1e-05; Accession=PF00004.19; Description=ATPase family associated with various cellular activities (AAA)
MVFIVAWSEEEEQGRKNGSYWVKFGFQGLEPLQGRRIEKQKHAIVDDLDRFLRRKKMYKKVGKPWKRGYLLYGPKGTGKSSLVVAMANYLKFDVYDLELGSLCSNSDLMCALRDMSNHSIVVIEDIDCYKEVNTKRFTLSGLLNIMDDLWSSGGYKQIIIFTSNHRERIDPALLCLGRKDMHIHLSFLKGNAFRILASNYLGIEGHHPLFEQIEGLLEKVEVTPAVVAEQLMRNEDPDVALEALVKFLKEMDKEKACI

SEQ ID NO: 192253 - protein, 123 aa, Glycine max
  Coding DNA Sequence Number=SeqID_75475
  Gene Ontology: Mol. function=RNA-directed DNA polymerase activity; Cellular component=chromatin; Biological process=RNA-dependent DNA replication
MHLRPEPSQILGHVVSSRGIEPVLTKVQDIQQWPHPHFAGALRSFLGLAGFYHRFIRRYAMIVAPLNKLLTIEPFEWTLEAQSAFTHLKEVLTLAPIIHLPDFTLLFTEETDASGIAMGAVLS

SEQ ID NO: 192254 - protein, 344 aa, Glycine max
  Coding DNA Sequence Number=SeqID_75476
  Gene Ontology: Mol. function=chromatin binding; Cellular component =chromatin; Biological process=chromatin assembly or disassembly
  Homolog annotation: Hit_ID=Q1SAV4; Match level="QueryCoverage=60%, HitCoverage=52%, E-value=2e-51, Identity=48%"; Hit description =Integrase, catalytic region
MEVLNRVIEQYHRTFVHKKPSSWGKSLHWVEWSYNTSWHSGSGVSPYEITFGKKPFNFSQYLASASNIKVVDEMLIDIATVFAEIKKKLENSQTSMKHFADTKHRDVQFVIGDLVIVKVHPHRQTFVSGQSTGYSKLAKRFYGPFRVIERIGPTAYKLQLPKEARIHPAFHCSLLKPFHPPHPGDISSTATLPVLTGDDHLIIQPLAILNTCKPYDSTLEVLLDGKGNDSNTVKPETRPQRKSKTPTYLKDFAGCVNLVFCQQCLLPPVEWILMVLFAACMAWEIVLGSLGLGWFGDPKTGMRLLSAVLSSIMNVEKAAYTSNHDDDAEGKEEERFFCMYDAMD

SEQ ID NO: 192255 - protein, 177 aa, Glycine max
  Coding DNA Sequence Number=SeqID_75477
  Gene Ontology: Mol. function=methyltransferase activity; Biological process=metabolic process
  Homolog annotation: Hit_ID=Q82SX4; Match level="QueryCoverage=99%, HitCoverage=83%, E-value=1e-57, Identity=58%"; Hit description=SAM (And some other nucleotide) binding motif
  Pfam annotation: Domain name=Methyltransf_11; Domain location=44-140; Score=9.7; E_value=0.006; Accession=PF08241.2; Description =Methyltransferase domain
  Pfam annotation: Domain name=Methyltransf_12; Domain location=45-138; Score=21.2; E_value=0.0036; Accession=PF08242.2; Description =Methyltransferase domain
  Pfam module annotation: Pfam domain module=Methyltransf _11::Methyltransf_12; Domain location=44-140::45-138
YYTSKIIAHGDTPQGVDWNGKDGQILRFQQLAKLININGEFSINDIGCGYGALYEYLLEQNFEFDYHGIDISEAMIQAAELRYKDQIKANFICASTPRKVADFGVASGIFNVRMENSDTEWLSYIEQTLDVLNNTSKVGFAFNCLTAYSDKDKMRDYLYYADPCSFFDLCKQKYSRH

SEQ ID NO: 192256 - protein, 108 aa, Glycine max
  Coding DNA Sequence Number=SeqID_75478
MEQLQRLAETIAETYIRDRIREHGNAQFTHNGKTGEVRRELLASGLVDNCVYAARSSGKVDYEREAYTMLMEMISLDGKEYQVTNRGLNVIESMHRIALDKTAPRISH

SEQ ID NO: 192257 - protein, 187 aa, Glycine max
  Coding DNA Sequence Number=SeqID_75479
MGETHEAPRDHTLADSEPHLGYSTEGQAFGGIPLPNTLGGPQYRPQPLHFAAERLPPAMVEREKIDHIEERSRPIEGGRDYTFADMAKLFLVPDMIIPLKFKVPDFDKYKGTTCPKNHLKIYCRKMGAYAKDEKLLVHFFQESLTRVAVTWYTNLESSRVRSWKDLMVAFIRQYQYNSDMTPNRMQL

SEQ ID NO: 192258 - protein, 86 aa, Glycine max
  Coding DNA Sequence Number=SeqID_75480
MGRYSKMMVFTTILLLGLQQIWAFRPLKEDQWLKQRLVIQSLQRGSVQHSERNPCSTVPGGSNGRCTSEINVVDYVAHAPPPEDAN

SEQ ID NO: 192259 - protein, 117 aa, Glycine max
  Coding DNA Sequence Number=SeqID_75481
  Gene Ontology: Mol. function=phospholipid-hydroperoxide glutathione peroxidase activity; Cellular component=chloroplast; Biological process=response to oxidative stress
  Homolog annotation: Hit_ID=O24296; Match level="QueryCoverage=83%, HitCoverage=41%, E-value=4e-46, Identity=83%"; Hit description =Phospholipid hydroperoxide glutathione peroxidase, chloroplast precursor
  Pfam annotation: Domain name=GSHPx; Domain location=6-77; Score=34.1; E_value=3.8e-11; Accession=PF00255.10; Description=Glutathione peroxidase
MGMTAMLLYVGTWVSFGLINSGLEILAFPCNQFGMQEPGSNEDIKQFACTRYKSEFPNFNKVDVNEPFTTPVYQFLKSSAGGFLGDLIKWNFEKFLVDKNGKVIERYPPTMSPFQIE

SEQ ID NO: 192260 - protein, 268 aa, Glycine max
  Coding DNA Sequence Number=SeqID_75482
  Gene Ontology: Mol. function=5-formyltetrahydrofolate transporter activity; Cellular component=membrane
  Homolog annotation: Hit_ID=Q1RSU5; Match level="QueryCoverage=79%, HitCoverage=43%, E-value=2e-86, Identity=71%"; Hit description =Biopterin transport-related protein BT1
  Pfam annotation: Domain name=BT1; Domain location=83-268; Score= -207.8; E_value=0.027; Accession=PF03092.7; Description=BT1 family
MTNIFLHTVKVNPNLPSQNPVPSHPHETDTMGENENATVTTKKKTSKTLLTLLTEPFQWIQKLSSQLNPTFVIGVFLIYGIGQGFSGSLFKVVADYYWKDVQKIQPFTVQLYVGFYFIPWVLKPLWGILTDAFPVRGYRRRPYFIISGVIGAVSAAVIAFAGNLAAVAALMCFVGVSASLAIADVTIDACIARNSIEVRELAPDLQSLCGFCSGAGALVGYLASGFFVHRLGPQESLGLMALSPALTIVLGFVIYENRTSGSHIEKKQ

SEQ ID NO: 192261 - protein, 279 aa, Glycine max
  Coding DNA Sequence Number=SeqID_75483
  Gene Ontology: Mol. function=phosphoribosylaminoimidazole carboxylase activity; Cellular component=phosphoribosylaminoimidazole carboxylase complex; Biological process=purine nucleotide biosynthetic process
  Homolog annotation: Hit_ID=P55195; Match level="QueryCoverage=73%, HitCoverage=36%, E-value=3e-92, Identity=82%"; Hit description =Phosphoribosylaminoimidazole carboxylase, chloroplast precursor
  Pfam annotation: Domain name=ATP-grasp; Domain location=12-136; Score= 91.7; E_value=2.2e-24; Accession=PF02222.12; Description=ATP-grasp domain
MGTFCQGNTAGAKLTNLEFLYIVVNLLSSMDLKGFFLLLAMELAVIVARGRDNSISCYPVVETIHRDNICHIVKAPANVKWKTRELATEVAFNAVNSLEGAGVFAVELFLTKDGQILLNEVAPRPHNSGHHTIESCYTSQYEQHLRAVVGLPLGDPSLKTPAAIMYNILGEEEGDIGFQLAHQLIKRALTIPGATVHWYDKPEMRKQRKMGHITIVGPSLSNIESNLAVVVEGKRLDDKTAASISLRSTNTLLALDVVVEDMLLTYLPNTYVTLLDTSY

SEQ ID NO: 192262 - protein, 62 aa, Glycine max
  Coding DNA Sequence Number=SeqID_75484
MEGSFMVVFSPCLSDSNILRSSIIIKLLGTSKCSQERANPLEYKKKKQDVNVFGYRPTNVPF

SEQ ID NO: 192263 - protein, 192 aa, Glycine max
  Coding DNA Sequence Number=SeqID_75485
  Gene Ontology: Mol. function=phosphoribosylaminoimidazole carboxylase activity; Cellular component=phosphoribosylaminoimidazole carboxylase complex; Biological process=purine nucleotide biosynthetic process
  Homolog annotation: Hit_ID=O80937; Match level="QueryCoverage=53%, HitCoverage=16%, E-value=2e-45, Identity=84%"; Hit description =Putative phosphoribosylaminoimidazole carboxylase
  Subcellular localization annotation: CTP_CleavageSite=55; ConfidenceScore=5.27e-01
MLHSARLVFSGHTSISAFAFRPSNPSIKTTSSLGFYMEQSPPLKLKQCDQPHLACQATTQDDAVSLRNDESPVHGLTEVVVGVLGGGQLSRMICQAASQMAIKVMVLDPQENCPASSLSYDHMVGSFDDSTTVEEFAKRCGVLTVEIEHVDVDTLEKLEKQGVDCQPKASTDKYQQKVHFSQHGIPLPEFMK

SEQ ID NO: 192264 - protein, 75 aa, Glycine max
  Coding DNA Sequence Number=SeqID_75486
MGNARKGTGARVQSGSKGFCELKEKEEKFEKSLRKIGGEGKERRGRLGIRGVAEASLVRAEKGIQVWGYPQKEGI

SEQ ID NO: 192265 - protein, 242 aa, Glycine max
  Coding DNA Sequence Number=SeqID_75487
  Gene Ontology: Mol. function=transcription factor activity; Cellular component=nucleus; Biological process=regulation of transcription, DNA-dependent
  Homolog annotation: Hit_ID=Q94ID6; Match level="QueryCoverage=58%, HitCoverage=99%, E-value=3e-17, Identity=35%"; Hit description =Ethylene-responsive transcription factor 12
PQGWRFVQVDEDVVPNEPQKQRRWRTLHHLNSTANGYSSIVGISTSNNSDRWERFLGQVNISKNNGVEKVIEDKEVCLGLDATKGVGGAVLGEGGLLGSIECDQPNTCLLPRVSYFCGIASLWSLPNPFVAVVAIDGAVGDDGVGFDSAGGAVVSSHATVTVDEMLETLQRTTPDKEEEDEAMINHLSFIIQNVMSKEFVKKDIETEEQLNGHGETSNSSPSKPTDTFTKATLDDSSKQENS

SEQ ID NO: 192266 - protein, 122 aa, Glycine max
  Coding DNA Sequence Number=SeqID_75488
  Gene Ontology: Mol. function=nucleic acid binding
  Homolog annotation: Hit_ID=Q2QQM2; Match level="QueryCoverage=73%, HitCoverage=59%, E-value=1e-23, Identity=60%"; Hit description =Expressed protein
  Pfam annotation: Domain name=Alba; Domain location=17-87; Score=58.7; E_value=1.9e-14; Accession=PF01918.11; Description=Alba
MATVAAVPALTANDSHKKNRIQVSNTKKPLFFYVNLAKRYIQQHNEVELSALGMAIATVVTIAEILKNNGLATEKSKASSSFLLLTSIEIVLGKSDKFDNLMSPPAPTESEEAAADDDDKKE

SEQ ID NO: 192267 - protein, 752 aa, Glycine max
  Coding DNA Sequence Number=SeqID_75489
  Gene Ontology: Mol. function=nucleic acid binding; Cellular component= nucleus; Biological process=DNA repair
  Homolog annotation: Hit_ID=Q9SR14; Match level="QueryCoverage=99%, HitCoverage=100%, E-value=0.0, Identity=77%"; Hit description =Mutator-like transposase
  Pfam annotation: Domain name=SWIM; Domain location=621-653; Score =37.0; E_value=6.4e-08; Accession=PF04434.8; Description=SWIM zinc finger
  Pfam annotation: Domain name=zf-CCHC; Domain location=733-750; Score =15.9; E_value=0.0023; Accession=PF00098.13; Description=Zinc knuckle
  Pfam module annotation: Pfam domain module=MuDR::SWIM::zf-CCHC; Domain location=130-310::621-653::733-750
MANHDLILGQSHNLALGHDQQLVLGHDHNLGLSQNHELEMGSAHEHHLDLGQTHDHELGLGHAHDELGLEQNHEHEGDDGHTYEHEHEHELAMDQKPEHDDHDLPLPGQNHDLVLSENNDLTVSENQDLDENTALSVVQNSDMGIDSANDMDVQHPQLVAVSTPPIIQARTASPSYELSVGQEFPDVKSCRRALRDTAIALHFEMQTIKSDKTRFTAKCASEGCPWRIHAAKLPGVPTFTIRTIHENHTCGGISHLGHQQASVQWVANSVEQRLKENPNCKPKEILEEIHRVHGITLSYKQAWRGKERIMAAMRGSFEEGYRLLPQYCEQVKRTNPGSIASVYGNQADGCFQRLFISFQASIYGFLNAFRPLLGLDRTYLKSKYLGTLLLATGFDGDGALFPLAFGVVDEENDDNWMWFLSELHNLLEIHTENMLRLTILSDRQKGIVDGVEASFPTAFHGFCMQHLSDSFRKEFNNTMLVNLLWEAANALTVIEFEAKILEIEEISQDAAYWIRRIPPRLWATAYFEGHRFGHLTANIVESLNTWILEASGLPIIQMMECIRRQLMTWFNERRETSMQWTSILVPSAERRVAEALDRARTYQVLRANDAEFEVISHEGTNIVDIRNRCCLCRGWQLYGLPCAHAVAALLSCRQNVHRFTESCFTVATYRKTYSQTIHPIPDKSLWKELSEGDANASKATEVVINPPKSLRPPGRPRKKRVRAEDRGRVKRVVHCSRCNQTGHFRTTCAAPI

SEQ ID NO: 192268 - protein, 181 aa, Glycine max
  Coding DNA Sequence Number=SeqID_75490
  Homolog annotation: Hit_ID=O81977; Match level="QueryCoverage=58%, HitCoverage=58%, E-value=1e-29, Identity=66%"; Hit description =Rudimentary enhancer
  Pfam annotation: Domain name=ER; Domain location=60-181; Score=56.2; E_value=1.1e-13; Accession=PF01133.8; Description=Enhancer of rudimentary
MNCSQIDNCSSRGHEIKCCLAIYPNLLKARNTIQHTEPYLDSLDDSLQLTEPTFGQCNQLKRENDHIFQRDLYSCACTGICALYERKLKELNPAIRNLSYDITDLYNFIDGLADMSALVSCIIDRSVGEIMICNPPPSVLLAPPSALFGPRGYDSSIHAYLPHDRLWIKQRTFQHLKKLAH

SEQ ID NO: 192269 - protein, 116 aa, Glycine max
  Coding DNA Sequence Number=SeqID_75491
  Subcellular localization annotation: CTP_CleavageSite=43; ConfidenceScore=5.13e-01
MQMADRGRGGGRRTFNRGRRCGFSLGAPITTNPSSSSIHISTSESMIHVVAQTPNTLPTSQDQPNPTFVRESIPTTPVRDASPSAPDDSLTPEYPLDPNCEHIVDQRPFIRAYKGE

SEQ ID NO: 192270 - protein, 143 aa, Glycine max
  Coding DNA Sequence Number=SeqID_75492
MSRRGAAVAAKPGREPGGAVVGADLGGSSKYSNENFEGRRGERFHVNGTCTWGIGLKFLNRDVAADGNVRESGDVGGGPGKKLSFLFNSLPTLETAQPEVGSSGWKSTARRVVSGAPPAALENPEDRVPPTPGRTHNRIRSPR

SEQ ID NO: 192271 - protein, 205 aa, Glycine max
  Coding DNA Sequence Number=SeqID_75493
  Gene Ontology: Mol. function=transcriptional repressor activity; Cellular component=intracellular; Biological process=regulation of transcription, DNA-dependent
  Homolog annotation: Hit_ID=Q8ZC39; Match level="QueryCoverage=70%, HitCoverage=97%, E-value=2e-72, Identity=93%"; Hit description =Transcriptional repressor nrdR
MRSACTSACGLAGAQMIAFTDNFAVAHDNAADVRIGCGGKTPQPRQFEGARHIKFVAGDLFAELAHVFEAAVYRREANVGDLIQLFQRVHHQIAHQFGRHFAFAGGAQLGFDMIKGVFHVVRAYRALFQRFQHAAAQFVFVERLAHLIAFNHSRHHQLSHLEGGEAFIAHQTLAATAHLRTVPHQAGINDFGINGGAERAMHNTS

SEQ ID NO: 192272 - protein, 48 aa, Glycine max
  Coding DNA Sequence Number=SeqID_75494
MYKQNQKDFPRLVVRFRIQLLAKIIQLKKGAKGTIIIQEIDAKIITHS

SEQ ID NO: 192273 - protein, 161 aa, Glycine max
  Coding DNA Sequence Number=SeqID_75495
  Subcellular localization annotation: CTP_CleavageSite=30; ConfidenceScore=5.14e-01
MAVPLSRRSCWRYPLSLSPSQPLSTPIPPLALAVQASRQCQWRHPPLPLVRGGTSVEHSGEDESTSVEHCDGRWRQTRYADGGLLSRTYGCLSDQVDPKAGVAAHDVQRYVKESDWAAQCTRQDKMSNEELKLQDPRCRIRCPGHPARKYWTHKSVISLTD

SEQ ID NO: 192274 - protein, 102 aa, Glycine max
  Coding DNA Sequence Number=SeqID_75496
  Gene Ontology: Cellular component=chloroplast thylakoid membrane
  Homolog annotation: Hit_ID=Q8LBR6; Match level="QueryCoverage=95%, HitCoverage=45%, E-value=8e-34, Identity=66%"; Hit description =Rhodanese-like family protein
NTFLPKDASTAINSEGFVLLDIRPTWEREKARVAGSLHVPMFVEDTDNSPITLLKKWVHFGYIGLWTGQYLTTLNSEFLIQVENSIPTGKETKLLVACGGGL

SEQ ID NO: 192275 - protein, 160 aa, Glycine max
  Coding DNA Sequence Number=SeqID_75497
  Subcellular localization annotation: CTP_CleavageSite=31; ConfidenceScore=5.33e-01
MAEPSKKRKGVSSQSQRHSKTQETQIPSSISSSSLFSSEEQRIRYTNLFSSFSIIDPKFIDMDFFSNESCECIQAFENSNLIPFMSLKFPIYTELVKAFYYNLEIQEGTLISEVYGIKMVIDQSLFYDLTQLSSEGVPFEVGLHQPSGYDRKASCRFIGF

SEQ ID NO: 192276 - protein, 81 aa, Glycine max
  Coding DNA Sequence Number=SeqID_75498
  Subcellular localization annotation: CTP_CleavageSite=52; ConfidenceScore=5.00e-01
MSFLGLGFSLGTVPVCHGAKHKVLDRRVRITKLVLRCVSLGLGVVAIVLVVTDSQVKEFFSFQKKAKFTDMKALICKWTNC

SEQ ID NO: 192277 - protein, 374 aa, Glycine max
  Coding DNA Sequence Number=SeqID_75499
MKEMKREKHASYSSHNSCKSLSEELHDYYEGRHRSHLRPYSHRREKERKPQEANINLPYFHGKDNVEANLDWEIRVEQQLKKKSTSKSYGSHSYPKKDQGQGILGVTPSKTKDDKGKTIEKQPLKARHITSKCPTKKTMIRRGQDIYSSQDEATTSPSSSESEEAKGEESSEEIYPQEERQPLMVKEECKEINIKETSHLRQPPHLLLFKKTLVSTATPLGLQVIPQVKELLDECLVRKSLNPCALLVPKIGIIRHQIPTISDMMNVLSVATLFCKISHAPNVFMIHIHRDSLGRNNQHKNTEKGTRYCITFLNFLNSDQGVPTDPKRIKVIPDWPTPPSVEGRSLEYEEPRDLRSNPFQGGGDDAILPPKGIG

SEQ ID NO: 192278 - protein, 73 aa, Glycine max
  Coding DNA Sequence Number=SeqID_75500
MGCYNQVALEHGLILVDTKYEFGNIDILVPIDIDIGNIDNMDETHCSPRREFDSIVAIVFVIFTYFLVSFTGW

SEQ ID NO: 192279 - protein, 60 aa, Glycine max
  Coding DNA Sequence Number=SeqID_75501
MISNTMIIDLLVNGGVWSGGLTWGLMTRADYVEASEKTLSLFEYGQPDHFFSCTGSWRLR

SEQ ID NO: 192280 - protein, 111 aa, Glycine max
  Coding DNA Sequence Number=SeqID_75502
MWSRTGGTMESGDGKDASVPASGKPNVRIDEAFKFASEGFGIEAAEEAAATQRLKKRAMRVGLEGGGEGIGGVRWHTTVILGFCKLGMAVRSGGVFGSKVLDCRVIMGVMP

SEQ ID NO: 192281 - protein, 117 aa, Glycine max
  Coding DNA Sequence Number=SeqID_75503
  Gene Ontology: Mol. function=microtubule motor activity; Cellular component=microtubule associated complex; Biological process =microtubule-based movement
  Homolog annotation: Hit_ID=Q9C7B9; Match level="QueryCoverage=94%, HitCoverage=11%, E-value=6e-22, Identity=49%"; Hit description =Kinesin heavy chain, putative; 55116-47986
  Subcellular localization annotation: CTP_CleavageSite=62; ConfidenceScore=5.96e-01
MASKRSAKSKGLGLSTKAANSPSSSTTSSSMQFLETSVDGLSSPASSSARSKTPYSFSESVPLDAKENVAVTVRFRPLNPREIRQGEEIAWYADGETVVRNEYNPSLAYAYDDDVKL

SEQ ID NO: 192282 - protein, 194 aa, Glycine max
  Coding DNA Sequence Number=SeqID_75504
  Homolog annotation: Hit_ID=Q9FH24; Match level="QueryCoverage=18%, HitCoverage=9%, E-value=2e-08, Identity=78%"; Hit description =Arabidopsis thaliana genomic DNA, chromosome 5, TAC clone:K20J1
  Subcellular localization annotation: CTP_CleavageSite=45; ConfidenceScore=5.13e-01
MLSGTEASSTLQTSSQRSQRSDHGALSCEAADQISRRSNGVTVVVARSTGGRFGATKKTFFYKEHSKMILKNHLGKSDGGNYLKMRFFNEDDLTSHPLPSPPQHPPLPLPPIISFSSAKNPSPRHEETTPWSTMTRSWSLGVLVPGREMTSAYASSFECKVSRSRSIGCGSNSFSRDFFNCISIGFGDCTLRRV

SEQ ID NO: 192283 - protein, 224 aa, Glycine max
  Coding DNA Sequence Number=SeqID_75505
  Gene Ontology: Mol. function=nucleic acid binding; Biological process= DNA integration
  Homolog annotation: Hit_ID=Q1SEE1; Match level="QueryCoverage=49%, HitCoverage=8%, E-value=1e-42, Identity=76%"; Hit description =Integrase, catalytic region; Zinc finger, CCHC-type; Peptidase aspartic, catalytic
  Pfam annotation: Domain name=rve; Domain location=1-145; Score=54.7; E_value=3e-13; Accession=PF00665.16; Description=Integrase core domain
MVISSIGGKQCFMTFINDHSRKVYVYFQKHKSEVFEAFKIWKAMVENEIELKIKKLRTKNGREYEDNIFKKFCYEHRIRMERIMPTTPQHNGVAEHMNQTLTERARSFNAFQGYFDDAKESRVKQIPKIQELSVQESRFKNNQDQDSRLKIQESIKIKGTSTWVVVTENKRGYISCGSVLVEGTSTRLFKENKGGYIPCGSLLVKDFTRLKRNLKDRRSLGDWM

SEQ ID NO: 192284 - protein, 54 aa, Glycine max
  Coding DNA Sequence Number=SeqID_75506
  Homolog annotation: Hit_ID=Q6YZ52; Match level="QueryCoverage=56%, HitCoverage=5%, E-value=3e-09, Identity=87%"; Hit description =Kinesin motor protein 1-like
MMQPSNIEEAKKSARKKYTLPLDRVFGPTTTTRQVYDVAAQHIISGAMEGINGN

SEQ ID NO: 192285 - protein, 87 aa, Glycine max
  Coding DNA Sequence Number=SeqID_75507
MNIILGQNTVTQTFKESRQRRTLIAVTESEWKDTQVAVTIAVETKSFARSFNGSGSKKKEEKGERAMCLSTRRKDKGERSEREGPKF

SEQ ID NO: 192286 - protein, 761 aa, Glycine max
  Coding DNA Sequence Number=SeqID_75508
  Gene Ontology: Mol. function=microtubule motor activity; Cellular component=microtubule associated complex; Biological process =microtubule-based movement
  Homolog annotation: Hit_ID=Q9C7B9; Match level="QueryCoverage=99%, HitCoverage=73%, E-value=0.0, Identity=60%"; Hit description=Kinesin heavy chain, putative; 55116-47986
  Pfam annotation: Domain name=Kinesin; Domain location=4-141; Score= -23.9; E_value=1.2e-12; Accession=PF00225.13; Description=Kinesin motor domain
MLGPQISTYSAAGAIQYFPWWTIESSPCGKNNEGEAVTLSQLNLIDLAGSESSRAETTGMRRREGSYINKSLLTLGTVISKLTEGRASHIPYRDSKLTRLLQSSLSGHGRISLICTVTPSSSNAEETHNTLKFAHRTKHIEIQAAQNTIIDEKSLIKKYQHEIQCLKEELEQMKRGIVSVQPKETGEVDFVLLKQKLEDGQVKLQSRLEEEEEAKAALLGRIQRLTKLILVSTKAPHTTRFSNRPGPRRRHSFGEEELAYLPYKRRDLISDDENPDMHVNLEGNTETADDSFKEEKKTKKHGLLNWLKIRKRDTGLSALSGTSDKSCGAKSVSTPSTPQAETVNNLESRHSHSLPAQSSPADLISVAREDKEFYEDSLLGQETPLLLKKGAIFYVSIKSIDEIDLLREQQKILSEEVALHSSALKRLSQEAARNPQNISESLHFLWLTHTKVEMERLKDEIKSKKEQIDLLERKIADSFIAKNKLDKSGVSLSLTELMTQLNEKSFELEVKTADNHIIQEQLNQKIHECESLQETIGSLKQQLADALELRNFSPHHFSVTKDYHGEPHLDKESAMITNTNEKILLQEQASEIEGMKQKLAELLESKEQLELRNQKLAEESSYAKGLASAAAVELKALSEEVAKLMNQNERLSAELAAPKNSPAQLRNSGTGTVRNARRESHVRRNDHQGGSNSDIKRELASSKERELSYESALLDRDHKEAELQRRIEESKQREAYLENELANMWVLVAKLKKSQGADTDV

SEQ ID NO: 192287 - protein, 373 aa, Glycine max
  Coding DNA Sequence Number=SeqID_75509
  Gene Ontology: Mol. function=binding; Biological process=carbohydrate metabolic process
  Homolog annotation: Hit_ID=Q1T5G9; Match level="QueryCoverage=48%, HitCoverage=48%, E-value=3e-59, Identity=39%"; Hit description =Tetratricopeptide-like helical
  Pfam annotation: Domain name=PPR; Domain location=128-162; Score=5.6; E_value=1.6; Accession=PF01535.11; Description=PPR repeat
  Pfam annotation: Domain name=PPR; Domain location=58-92; Score=28.6; E_value=2.2e-05; Accession=PF01535.11; Description=PPR repeat
  Pfam module annotation: Pfam domain module=PPR::PPR; Domain location =128-162::58-92
MAEGCMTEGAFQVHAHVIKCGLVCDVFVGTSLLHFYGTFGWVAEVDKVFKEIEEPNIVSWTSLMVGYAYNGCVKEVMSVYWSLRRDGVYCNENAMATIIRSCGVLVDKMLGYQVLSSVIKSGLDTTVSVENSLISMFGNCDSIEEASCVFDDMKEHALYSCKNRLYYYFSLVTSVWLCSKFEAGKSEGFDEYMNLVLDDAEEVNIKKKSRKTLGGNDEHSLTVVNYVPIKQKGIAIFPLGNSNVYGFLEPQSIQRSGQSQFELKSYMKSWMQSSKRDVYLGAYLNGEHWQMVVILLKENLVVWFCSLHNRPDNYLKGIINSALKGLDDTPQPKSKVAARWLIVKCNRQKESTECGYYVMHWMSTIILGSFRNN

SEQ ID NO: 192288 - protein, 1448 aa, Glycine max
  Coding DNA Sequence Number=SeqID_75510
  Gene Ontology: Mol. function=DNA binding; Cellular component=beta -galactosidase complex; Biological process=DNA integration
  Homolog annotation: Hit_ID=Q1SLU3; Match level="QueryCoverage=98%, HitCoverage=98%, E-value=0.0, Identity=42%"; Hit description =Integrase, catalytic region
  Pfam annotation: Domain name=rve; Domain location=584-744; Score =156.2; E_value=8.8e-44; Accession=PF00665.16; Description=Integrase core domain
  Pfam module annotation: Pfam domain module=RVT_2::rve; Domain location=939-1196::584-744
MVISYSDFATNPSNPYYMHPNENPSLILVQPVLDNKNYQIWCRSMKVALISKNKVKFVDGTLSPPPISDPLYEPWLRCNNLVPSWLQRSISEEIAKSLLWCDCASLVWKSLENRFSQGDIFRVADIQEGVARLQQGTLDISSYFTKLMTLWEEIEYFRPIRDCTCAIPCSCGAATDLRKFKEQDKVIKFLKGLGDQYSHVRLQIMLMSPLPTLDNAFNLILQQERQFNLPSTTDSSIENQSLVNHFSQMPSRPSNNSDRGRGRGYSSGGRGNRLRTHCNRTNHTVETCFIKHGYPPGFQLRKSNSSRNASVVNSVQDAGSAHISSSSSASTSTNGSSASLSTIQEQYTQILQLLQQSNLQSTSPSSVNSVFATNSVSHTSPSPSSGKNLSNNTSHWWIVDTGATDHITHIFDSFSSTYHIAPKTMTMPNGDTVTTTIAGSVLLYNSLVLHNVYYFPSFHVNIISVTTLFDSTLYDVKLYPNCCKIVQLLHPKMTGFTARRIGKLYVLDTTSPLVFSPTPGSANTSFSHDLATIWHFRLGHLSSHIHKCISSYFPFVTFNDNHKPCNTCHLAKQRNLSFAHSTTKSVAIFDLIHTDIWGPLSTSSISGHKYFLTLVDDYSRFTWTIFMRNKSETRTHLVNFIFFIETQFNKKLKCIRSDNGPEFLMTSFYLSKGIIHHRSCVETPQQNGIVERKHQHILNVARALSFHSHLPHNLWHLSIQQAIHIINRLPTPLLNNLTPYQMLHSTPPSLHHLRVFGCLAYSSTLHNNRTKFAPRARKSIFLGYREGTKGYLLYDPITHEFYVSRNVIFHETVFPFASPPPANNSVSVNPDITNLDTSDILLDIPLSLPPPNEPTSPPAPTRKSHRLTKPPAYLSDYHCNLLSSMLPASNPSKSPYPLSSVLLYDKCSLCHKRFCLSISSLTEPKTYKQACKFDCWNLAMKSELDALASSNTWSIVDLPEGKQPIGCKWVYKIKHHADGSIERYKARLVAKGYTQLEGVDYFDTFSPVAKLTTIRTLLSVAAIKDWHLEQLDVNNAFLHGDLHEEVYMDLPPGFLLPGSSSNKVCKLHKSLYGLKQASRQWFSKLSTALISLGYSPSSADHSLFTKLHNSHFTALLVYVDDIVLTGDDLQEIQSLKQFLDSTFKIKDLGKLKYFLGLEIARSTQGIFLNQRKYALELLEDSGLLATKPSTTPFDCSLKLHDSDSPPYEDETTYRRLVGRLLYLTTTRPDIAFIVQQLSQFISQPLQVHHSAAIRVLKYLKSAPAKGLFYSSSSTLKLSGFADSDWASCPATRRSVTGYCVFLGTSMLSWKSKKQSTVSRSSSEAKYRALASLTCELQWLQYLFKDLHISLDQPISVYCDNKSAIYLAHNPIFHERTKHIEIDCHVIREKIQTGLIHLLPVSSAAQLADVLTKPLPAPSFNSLISKLGLLDIHSPTCGGLLHDVNSNSS

SEQ ID NO: 192289 - protein, 122 aa, Glycine max
  Coding DNA Sequence Number=SeqID_75511
  Gene Ontology: Mol. function=catalytic activity; Biological process =metabolic process
  Homolog annotation: Hit_ID=Q1RVC0; Match level="QueryCoverage=60%, HitCoverage=21%, E-value=4e-12, Identity=50%"; Hit description =Sterol desaturase
LPVVRLNAFNLAQGYPEREGDNVARNHGMQRDDGGGEGNEHAYDVFIALKDEEEEQNFVALEEVIGLGGKVVELEGLREGEVAAQRCRDLWDGSVGEHHHRNPRIAGSVGCDVREGRGQGSV

SEQ ID NO: 192290 - protein, 157 aa, Glycine max
  Coding DNA Sequence Number=SeqID_75512
  Subcellular localization annotation: CTP_CleavageSite=68; ConfidenceScore=5.16e-01
MDVGEGGGSIGGWWDRIGVGRVLGGNNGGRQRRSSSILVVMVSCCWVSRMRASSSLSEDPEDGLESSMAMKAPKLIGVATYPSAGGRRETRGMRVPRKEYARSRHQRLFEENVGKTGKDAIYELLSERFGSCIYARGRVFPFAPTYSSIWDEKIRPT

SEQ ID NO: 192291 - protein, 83 aa, Glycine max
  Coding DNA Sequence Number=SeqID_75513
MDNHPLPSPLHWEGLAPEESTWERWDELRHTHNLEDKVAFRDESVDSNDRLDDNQITGNNVVASSNNKPRRVIRKPTYLQEYM

SEQ ID NO: 192292 - protein, 174 aa, Glycine max
  Coding DNA Sequence Number=SeqID_75514
  Gene Ontology: Mol. function=RNA-directed DNA polymerase activity; Cellular component=chromatin; Biological process=RNA-dependent DNA replication
  Homolog annotation: Hit_ID=Q947Y6; Match level="QueryCoverage=72%, HitCoverage=8%, E-value=6e-36, Identity=55%"; Hit description =Putative retroelement
MEIEKQISAMLDANLIQPSHSPLSSPILLVKKKDDELLDDLGQASWFSKLDLRQGFHQIRMAKEDIHKLPFELTRVYEFRVMPFGLCNAPSTFQLAMNDTLRPFLRKYVAIFFDDILVYNSDLASHATHLESVLATLSDWQFLLRQSKCLFAQNQLNYLGHIISAKGIALCRRK

SEQ ID NO: 192293 - protein, 454 aa, Glycine max
  Coding DNA Sequence Number=SeqID_75515
MGWMREDSGKRANEPSLTPRPCGGGGVGESHAWPSEKLVSDQRPRWKKSLAGIGRPSTGEMKPLGGKLMNVCTKVLFQGPIKYLCLTIGLWVSTEMGSLGVTINDDHYYGEPMGGGKAHWTLSHESTNVCLDNGPIEVLAQAMKCLGHAGTLIVGEEIASQIRWLAPTPSVWHVRPSLSCRQAKRHDPELVNPGEFERQFMYVFLGHSDLVESLTTVFIGGGMGVIDEGDEGGCGWGGGGVCAKGNVLAHMNESHGQRLELGHARLNDVMHAAAVHENDHLVVAQRPKEAEGVLIVEPVCESRAEGPDEVAMQPLLIAMIAKPLITADRHFLYQERFPQRRSNILSSCNRASLVAWELPVDRHNMTERIAILAPATSPLRKGKIHFEPSTGGGPGDEDGDCVGAAMVANRSTRESNFVVSEPLSSLSVVTWRVWCSGMVDVVVVTIAVEGGGGG

SEQ ID NO: 192294 - protein, 359 aa, Glycine max
  Coding DNA Sequence Number=SeqID_75516
  Gene Ontology: Mol. function=chromatin binding; Cellular component =chromatin; Biological process=chromatin assembly or disassembly
  Pfam annotation: Domain name=rve; Domain location=68-210; Score=4.3; E_value=0.0026; Accession=PF00665.16; Description=Integrase core domain
MILSVPCLSFLKELRSQLDVYADYGQLRRDILDDPTKHPGFSLAQNLILHKGRIWVPRDLPIIATLLQEYHATPIGGHGNTTALVVVDHFSKGIHLGMLPISHTAHMVASLFMNTVVKLHGFPQSIVFDRDPLFISHFWQELFRLSGTLMQMSSAYHPQSDGQTEAGNLGKIPPLDGMVSQFLVVREHSARIVGGQRRDVPNHTSEASEGSRYNEKDKLFYGSFRVIERIGAAAYRLQLPDGAKIHSVFHCSLLKPFKGSPTQSEIASLPAQFINGQPMISPLAILNDHKVPGSTPDSWEVLVQWQGMSPDKTSWDDWTQLCQAYHLEDKVNFQGPGNDTSKLIIPEIEEAPATKVQRE

SEQ ID NO: 192295 - protein, 38 aa, Glycine max
  Coding DNA Sequence Number=SeqID_75517
MVQSNFNFQWISYLDLVKGLDQASLRLYEATMDAVSVT

SEQ ID NO: 192296 - protein, 281 aa, Glycine max
  Coding DNA Sequence Number=SeqID_75518
  Gene Ontology: Mol. function=hydrolase activity, acting on carbon -nitrogen (but not peptide) bonds, in cyclic amides; Cellular component=cytoplasm; Biological process=pyrimidine nucleotide biosynthetic process
  Homolog annotation: Hit_ID=Q3BSH3; Match level="QueryCoverage=88%, HitCoverage=55%, E-value=1e-101, Identity=73%"; Hit description =Dihydroorotase precursor
  Subcellular localization annotation: CTP_CleavageSite=27; ConfidenceScore=5.00e-01
MPSCACAAGAVNSGARPAAAPRTGIPCASAVVGHALAGRFTHQFAAVPHQLAVDPGRGHARTEGGAFERRPAALGQHVLALDGEWHVFHQHQVGEVAFAQEAAFFHVEQLCRRMREFLHHLLAGQLPFVHALQRGHQRVLHQRQARRRLRVGLLLLFPGVRGVVGGQHVQHVVGQRSGDCFAVGHFLDRRVALDQVALGRIVGAREVQEVHAGFGSDLLAAAVGADQWTLFEQRQLVGGGDVQYMQAGAVLARQRHRQAGRLDAGPRANGYPDACPGSASS

SEQ ID NO: 192297 - protein, 99 aa, Glycine max
  Coding DNA Sequence Number=SeqID_75519
  Gene Ontology: Mol. function=RNA-directed DNA polymerase activity; Cellular component=chromatin; Biological process=RNA-dependent DNA replication
MDLLEQFRNLSLACEVTPNNLEAIELGRDNSFNVGSNRALRLQDRICVPNVPELRKMILEEGHRSNLSIHPSATKMYQDLKMMFWWPNMKREDYLGPPE

SEQ ID NO: 192298 - protein, 355 aa, Glycine max
  Coding DNA Sequence Number=SeqID_75520
  Homolog annotation: Hit_ID=Q1XPH3; Match level="QueryCoverage=91%, HitCoverage=86%, E-value=2e-24, Identity=27%"; Hit description =Hypothetical protein precursor
MSATAEESKQYLFLADRLDEGEITVKGNGYETAGGTMYALNNKAVTFKYNRGDPGNAEAQDHLIAYNIGRSLTTPGTAYWVNIADNRVDKTLEVDQKLIYVDGKHIENYFGWPYAMFEFGDKIYAPLSPAYGGTGTQDKADYKDHAFVAIFDKNLKFEKTIEDKRMPFIGQYYNTIGLGQVSTGDIYAFSNGDVESSNNHSAFLKIKNDAFDKDYYWDVEAVANMRIRAGFFIKDNKFVLVMVPRDTKQAEASGVKLAIADVVKKEFKWISGVDTKITDPGYGFPLFTTDGKSYLPMQEGQSSISYLYVIDADNYTAKRGLKLTGIKDITGVGNQELVTDKLAQCQFVYSIDKHC

SEQ ID NO: 192299 - protein, 172 aa, Glycine max
  Coding DNA Sequence Number=SeqID_75521
MRRRHVAAYVGNGSTLVGFDLVPQEACKHAHAEGSGATLLYRIYGPKPIQRISVPSCSNLTVPQRKRGFCAVKVLKCRLLTTGSDEGIRKTAWIGERREKGESAHDAWKVGEESDSKPSAIDHAHQMQTWLLLALARPSTASTADAADLDLDVPSIAKEVAELVLWDLDSDF

SEQ ID NO: 192300 - protein, 165 aa, Glycine max
  Coding DNA Sequence Number=SeqID_75522
  Subcellular localization annotation: CTP_CleavageSite=34; ConfidenceScore=5.12e-01
MVGGPPKLSRSIDKFTLSPIHAVFRIPSSDPVVRSLHFRTCSYLQTKPSKDSSGYRILQRGKEGGVNGMKYIEPHDSPYPCVPIPPSQHKIPFSSGKWHGSERTRKAAWKARLVAPPRSGKGRDSYTPTKVLPFPTYAATCLRRILSCPVQNVTSYHDWWERGFS

SEQ ID NO: 192301 - protein, 94 aa, Glycine max
  Coding DNA Sequence Number=SeqID_75523
MLVHCWLWERVFCLYSVFLVEGSFMIVGIEFLGYCGSLEGLMGPGAERNEDKGYVEWYLEMCRGGQETLGTLGGVLLPKTKLDQSRPNPGIVSQ

SEQ ID NO: 192302 - protein, 107 aa, Glycine max
  Coding DNA Sequence Number=SeqID_75524
MEDESSEATIPEPFDIGEEAEETQLRQVAATTPEQSLEATSEPSAPVVNPPSPQPASHPSTPLLQILEYPTTPVLAVDTSPPTTPVLQLTDEEDGQTQKTQDQSQEF

SEQ ID NO: 192303 - protein, 125 aa, Glycine max
  Coding DNA Sequence Number=SeqID_75525
MHSLRELAQNRPIVPLEYFLEKVAWPEAQLPLVRTNEAAPSRPALAQVEPMPAEPRTPVVNPPLSLELEVVPPSPPLIIISDASSDEAATPPEETVDPPASPVGGIDDLSDSSSGEVVALTDSPV

SEQ ID NO: 192304 - protein, 259 aa, Glycine max
  Coding DNA Sequence Number=SeqID_75526
  Gene Ontology: Mol. function=DNA binding; Cellular component=nucleus; Biological process=regulation of transcription
  Homolog annotation: Hit_ID=Q6YXH5; Match level="QueryCoverage=86%, HitCoverage=87%, E-value=3e-60, Identity=52%"; Hit description =Putative ZF-HD homeobox protein
  Pfam annotation: Domain name=ZF-HD_dimer; Domain location=43-102; Score=131.4; E_value=2.5e-36; Accession=PF04770.3; Description=ZF-HD protein dimerisation region
MEFEDQEEQEEELCMGGGGAGYDPTRMKVPVAAEPVRSTNGGGGRARYRECLKNHAVGIGGHALDGCGEFMAAGMEGTLDALKCAACSCHRNFHRKEADSSAVVAFSGGDPYLIPHHHPPPQFAAYYRHPAGYLHVAGQQHRSAVGGTLALPSTSGGGGTQSTREDQEDISNNPSAGGTGSKKRFRTKFTVEQKEKMLELAEKLGWRIQKQDEAVVQAFCNETGVKRHVLKVWMHNNKHTLVCYNGGVVTRLEPFFSGG

SEQ ID NO: 192305 - protein, 155 aa, Glycine max
  Coding DNA Sequence Number=SeqID_75527
  Homolog annotation: Hit_ID=Q9FG36; Match level="QueryCoverage=23%, HitCoverage=25%, E-value=8e-11, Identity=70%"; Hit description =Thioredoxin-like 5, chloroplast precursor
MATWCRKCIYLKPKVKFYFVDVNKVPQTLVKRGNISVTTSAATTDVENQGYYIGAYLANDVENPCYNIGTSATTVVENPGYYIGAYLANDVENTGYNIGALATTVVETTTSVNYYPLLKNMEHATAVSKGRPTPALSGSAYIRSLNMEDFKYAHQ

SEQ ID NO: 192306 - protein, 178 aa, Glycine max
  Coding DNA Sequence Number=SeqID_75528
  Gene Ontology: Mol. function=protein serine/threonine kinase activity; Biological process=protein amino acid phosphorylation
  Homolog annotation: Hit_ID=Q5D875; Match level="QueryCoverage=89%, HitCoverage=28%, E-value=9e-31, Identity=58%"; Hit description =Calcium-dependent protein kinase CDPK1444
MFGHVGGCSIARAGDGTEETTIVGSTVASARGVAEEPTRQRQSGCTSARNPCSMWKANGFRVRERLREWVLVLEIVSCIPESILEFWWQMVLPITVEDVKREVKILKELIGHENVVKFFNAFEHDSYVYIVMELCEGGELLDQILAKTYSAFTLIRKDSCYTEKRCSCGCKADATGCD

SEQ ID NO: 192307 - protein, 147 aa, Glycine max
  Coding DNA Sequence Number=SeqID_75529
MAIETLEDTKPPLQDDDHEKLEIPKKRRDQRKQRGERRCQRQRIEEEEEDKAEEKEKEKGKGKKSKKDPVTSTLSERPTRERNTMKCFSVPSPTKSARSSTSKGLIIEKDRNSEVLQRHYYKNGLLRCWFYNNSNKTDVVSKAVAFL

SEQ ID NO: 192308 - protein, 119 aa, Glycine max
  Coding DNA Sequence Number=SeqID_75530
  Subcellular localization annotation: CTP_CleavageSite=52; ConfidenceScore=5.20e-01
MEHGFLADVHPLCLWRVGSSATPLALATVDPTMVVSSVPSPALAMLQPPTVVVATGVADLGGRETKAAGTTKKGRRKKEWLERVRERWVPLMGSGTKWMVRERVSREKGSVWGFRDEWE

SEQ ID NO: 192309 - protein, 239 aa, Glycine max
  Coding DNA Sequence Number=SeqID_75531
MGHEGEYTEADILDLSAENCQDLEFDSSTWLSSTLDSQKQKTENGKRDCHYVKNNWNILAVPISAEELKIRSELGMQIERDLEEEIKEGIYHLALRLHRIYQQKKERSAKEACELYNKQARAVSEVNISIRMEGATKVEIKEINKEAAEKDSRNSRPQNVKEVKKVDWVKTLRAGSSPVCATRSSCVSSKNKNKKLGTDPNVFSNWKIHGGRGKNAGSTELVKRNASVDKKILQLVWKV

SEQ ID NO: 192310 - protein, 176 aa, Glycine max
  Coding DNA Sequence Number=SeqID_75532
  Gene Ontology: Mol. function=6-phosphofructokinase activity; Cellular component=6-phosphofructokinase complex; Biological process=glycolysis
  Homolog annotation: Hit_ID=Q8VYN6; Match level="QueryCoverage=81%, HitCoverage=25%, E-value=7e-21, Identity=41%"; Hit description =Putative pyrophosphate-fructose-6-phosphate 1-phosphotransferase
  Subcellular localization annotation: CTP_CleavageSite=36; ConfidenceScore=5.65e-01
MSPVITLHCLTTSSTRCSYGFNNSNSRFNALVEPTRGSSVFAKVKSQSSASKFNNNPDWKTKFKDDSEDRFRLPHVTDIFPDAVSMPSTFSPNMRTPRTSDFPGYPLDEDWYGYINDNDRVLLKVFSLIDVITVDTVSRESLLHSCFKLRLRLRMSPLQLRQLRCLLRPLQCEFIL

SEQ ID NO: 192311 - protein, 242 aa, Glycine max
  Coding DNA Sequence Number=SeqID_75533
MWVLHPIIDYALRATQPVPCLFLPRPISALSIAGIYKFHIFDAASAIKHQLYNMGHEGEYPRADILDLSAENCQDFYSSTWLSSTLDSQKEKTENRKRESDYVKKKNCNILAVPISEEELKIRSELGMEIERDLEEEIKEGIYHLALRLHRIYQERKERSTKEACELDNDYQARAVSEVNISIRMEGATKVEIKEINKEEAEKGCAYSRNSRPQNVKEVKKVDWVKTLRAGSSPVCARRSSC

SEQ ID NO: 192312 - protein, 53 aa, Glycine max
  Coding DNA Sequence Number=SeqID_75534
MAFSNGALMLTNMDGEKLPSPVNSDDIKICMYVIYLFAHVTYAPELISKYAQS

SEQ ID NO: 192313 - protein, 151 aa, Glycine max
  Coding DNA Sequence Number=SeqID_75535
  Gene Ontology: Mol. function=ribonuclease H activity; Biological process=DNA integration
MKADKEVMKRHTTMMMEAMMSINKMMKELCEDFKIQHHDSTPYRSKMKGAVKDANKNIKKIIQKMIMTYKDWHEMLSFAWHDYQNSRRTFTGATLFLLVCRMEVVLFFEVEIPYLKVLSEAKVEEVEWAQVFFDWLNLIEGKILDAMSHGQ

SEQ ID NO: 192314 - protein, 74 aa, Glycine max
  Coding DNA Sequence Number=SeqID_75536
MLLYSLLKVIDKNVGRKIMSCGLYPVDKLQLCCFGDVAHPAWQSVGHEMAYATSEGIMVPIEVKQLMVGSCGQG

SEQ ID NO: 192315 - protein, 133 aa, Glycine max
  Coding DNA Sequence Number=SeqID_75537
MTKHLKPLYVKAQINGKTLARIFVDEGVILNIMPLTTLKKLGKSLFSFSKKELNSFQPMCTFYIASTIDVLERGPNRISESAIAEKYKSQIIEVITKYKDFLPGIIMKCQDLREIWWSIHNQLEKDLSHIRSL

SEQ ID NO: 192316 - protein, 168 aa, Glycine max
  Coding DNA Sequence Number=SeqID_75538
  Homolog annotation: Hit_ID=P50346; Match level="QueryCoverage=26%, HitCoverage=13%, E-value=7e-09, Identity=63%"; Hit description=60S acidic ribosomal protein P0
  Pfam annotation: Domain name=Ribosomal_60s; Domain location=78-163; Score=5.8; E_value=0.0035; Accession=PF00428.9; Description=60s Acidic ribosomal protein
MAPLVQGLVARGGHGAGDDTTMSMEEGPQVRSYHRIAANGGGDMDRDTAAKLIFTKGELKEVSEEVAKYKFTFIGFLIPNTCCCTTLFVNAYKNVLAVVVKIDFSFLEVDKIKQYLKDPSKFVVVVVVVVVAAALATEFGAPTTTKEKEKKEELGEESNDDITHPLGN

SEQ ID NO: 192317 - protein, 119 aa, Glycine max
  Coding DNA Sequence Number=SeqID_75539
MDQLKEEFQGSERAKKMQGLNLRREFEAVKMKKNEWLHKSDYLVKALVINELWIKSWCAFQGDMLKHQLLGMQVLNIQLALSMALYTLKPKFQEAPLSHIKPRLSVALPTLKLQLLEVH

SEQ ID NO: 192318 - protein, 87 aa, Glycine max
  Coding DNA Sequence Number=SeqID_75540
MEGLNAKNPFLQKNGSSNLANPSHRFNGELEKRKHGRCYISQVDIRDISHAPQTKLLCESVVGTQTMVNATATLIKVGGSFNFQNFE

SEQ ID NO: 192319 - protein, 465 aa, Glycine max
  Coding DNA Sequence Number=SeqID_75541
MMMKSKFECGNQDANVDDGEINMNNGQLLLQDIQEISKALYAPSRPSFSSVHNRSKSAGKTGLSKPQVALTPGFLKEDLLPKDKKLSSAWNWKKPMKALTHFGGQKFKCCFNLHVHSIEGLPLSFDGIRLCVHWKRKTNILQTCPARVFQGVVEFNETLSHGCSVYVSRTVSGHSVKYESKRFLIYASIVGAPEHDIGIHQVDLTRLLPLTLAELGGDRSSGKWSTSFRLAGKAVGASLNVSFSYQVMKDELMEFGGDNLNVFNLVNLKPGRPSSTSSVMDFSPIPFHSDDMILSCETLMNSSSSLSKSISFLYQKLDEGNIHNSARADSEHFEPLKSHGFTESESPLESNQDEPDDSEFSIIEQQVETLEGDSLELDQTGNQTVDLSTVDIINVDDIVKEDGIFVDKNTRFDLMDSICTSCVNGTMADDGKHKRSSSCVSITCIKDADMLPETSDFIDQGCYLN

SEQ ID NO: 192320 - protein, 152 aa, Glycine max
  Coding DNA Sequence Number=SeqID_75542
MPTRVNCVVKFVKLNYKHVVMGKVAAIGGGIEKGESITCYIWRNQFSDSTILRGEGKANTRRKIVITISSNLSVCFFLPMLDRAKKIRPKRKMLNAKIFTFSLLALEEIMPVEGEIHLAQRQWNEGSNLLSFSLTLGNPNTEQQPEEKFEES

SEQ ID NO: 192321 - protein, 57 aa, Glycine max
  Coding DNA Sequence Number=SeqID_75543
MAKTARKKLSNSSTWEDDIWVPNVYIFSWQLSTISPHDTINTRNAPQDILIQQRLGK

SEQ ID NO: 192322 - protein, 58 aa, Glycine max
  Coding DNA Sequence Number=SeqID_75544
  Subcellular localization annotation: CTP_CleavageSite=43; ConfidenceScore=5.22e-01
MGPKGGNTLGHASDSGGGNSGGMMSVVVEATTTRCGGGGCGMVAMEVVAARVMVVVVW

SEQ ID NO: 192323 - protein, 201 aa, Glycine max
  Coding DNA Sequence Number=SeqID_75545
  Gene Ontology: Mol. function=sequence-specific DNA binding; Cellular component=nucleus; Biological process=regulation of transcription
  Homolog annotation: Hit_ID=Q1SEX1; Match level="QueryCoverage=72%, HitCoverage=22%, E-value=8e-21, Identity=36%"; Hit description=Exo70 exocyst complex subunit
MINVEAFQNSISKLLIHPLLWRLTGFASSIAGFCCYAISPSFHDMFGQWNALKIIVYGVVSSLLSIFKLFIKRCNWVHGRSFLLKAQVEEGKVENAHGKMMNLTYSGAFALMAMSLSRQLQLGFEVGVFYFLVGCFLVTVMKMSLKLASLAALFCYLLVNIRSISEYIRKNRSEEDFDHYGYDAEELEDRVTDARFLDYDY

SEQ ID NO: 192324 - protein, 335 aa, Glycine max
  Coding DNA Sequence Number=SeqID_75546
  Gene Ontology: Mol. function=RNA-directed DNA polymerase activity; Biological process=RNA-dependent DNA replication
MAEIEEVQEQMKADMDALKDQMASMMEAMLSMKRMMESNATAVAATSAAVEADPTHPSTINQANQSIPDMVDQGEVLGSTDGPHVGHNRNTYLYDLPPNYTPPNAVPMPNKNANRVVPVLFEGQQPQPMGENREDPRDHAQVDFEPYTMFATKGPACSGREKWDLIEERLRAIEGFGDYPFTNMVELCLVPDVVISPKVYSRDEKLLMHFFQESLAKAAVTWQYQYNTNTAPKRTQLQNMSKREHESFKEYAQRWRDLAAQVMPPMMEKEMITMIVDTLPVFYYKKWGKFDYATSTSTNNRRFGASGAKKKEGATHMVTSAPTWPKTQQTPHNTY

SEQ ID NO: 192325 - protein, 116 aa, Glycine max
  Coding DNA Sequence Number=SeqID_75547
  Subcellular localization annotation: CTP_CleavageSite=51; ConfidenceScore=5.30e-01
MWDQHMLKGALKPGVFTPKADTPKSPSEPLPPDSVLSFCGKRKSYNTRGISLSSDSKISRRSNGECVRDRLFLRQVWWYAGKERVLGGEEGKTKLRGRGGVESIMSMKTDLRRLYL

SEQ ID NO: 192326 - protein, 192 aa, Glycine max
  Coding DNA Sequence Number=SeqID_75548
MGQTSNVEPAINMVMHRSGRTNHMTHKKLDQSFVYKVTIGNEECVDVKGKGVVAVETPAAVKLKTMSLEKEPFQNLKCDLNGPTTKVVEKMNLLAHNKHEEKKNNKLLNIVVSNDKQGDANACLLDGDPPYTLDVTSLHGYELVTTTPTWIRSWCHEFLSWMFLGDVDEDEHKVSSTCDIVLLFVCQQAFRF

SEQ ID NO: 192327 - protein, 67 aa, Glycine max
  Coding DNA Sequence Number=SeqID_75549
  Subcellular localization annotation: CTP_CleavageSite=27; ConfidenceScore=5.24e-01
MCKILKRRTKGSLLGHFSAPRPTRKLRAKVTSSPGRDELAWASKVTSGGSKQLAWASCCATSTPHFL

SEQ ID NO: 192328 - protein, 56 aa, Glycine max
  Coding DNA Sequence Number=SeqID_75550
MTNQSTRRTFFSESAIHAFLKEKFCTSALASIRGPGTLYLAYMSLYIFEAKWGPFL

SEQ ID NO: 192329 - protein, 96 aa, Glycine max
  Coding DNA Sequence Number=SeqID_75551
MAISLSSSKRKMLASVFLNSDQGVPMNPKRIKVIPEWPTPPTPLIELVRKHVPSWDDAQEMGVEEKSPEFQEPRDLRSNPFQGGGNDAILPHKGIG

SEQ ID NO: 192330 - protein, 140 aa, Glycine max
  Coding DNA Sequence Number=SeqID_75552
MPPTVPVNHYSDPEGQHNRIRILWCYPMLMYTERRLALSTLISSKSASPAEGTSRPVHTGGGPIDPTQAGITAAAGTRLALQWILVKGFRLYSFQLPDSMSPVLLFIVTTSPCQDWVICAPAAFLGCGSRFSRSLSGIEP

SEQ ID NO: 192331 - protein, 125 aa, Glycine max
  Coding DNA Sequence Number=SeqID_75553
PFHPGLLVGDAGGFQSPTREPLNVGGLVPPHCSLKSVVSEDACPGACFVQRDATTFIKKLVVGPWVGSIGPPPVCTGRLVPSAGDALLSLTGRVVPPDSDPIVLAFGIGVMINRDSRGHSYFIVR

SEQ ID NO: 192332 - protein, 56 aa, Glycine max
  Coding DNA Sequence Number=SeqID_75554
MNKLKRLLKRLALTDPLKLLQEYNKGLDETYLREVAKEKKHRLVTMLECDEHDARP

SEQ ID NO: 192333 - protein, 91 aa, Glycine max
  Coding DNA Sequence Number=SeqID_75555
ITPSRHPVDPKKSNRALGFPALIMGLCQFYGVPITPTKLIRPPISRAFIEKYCMPRQAQQQEEGQQQPATGAPSLPLQETQSLESISALKF

SEQ ID NO: 192334 - protein, 96 aa, Glycine max
  Coding DNA Sequence Number=SeqID_75556
HPMDPEKSNRVLGFPALITGLCQFYGVPVAPIKVIKPPINWAFIKKYYAPWAGAGRDTIAAWGWPAAGNRCIAATSRAPQFIYKGWRVAYNPWPTS

SEQ ID NO: 192335 - protein, 79 aa, Glycine max
  Coding DNA Sequence Number=SeqID_75557
  Homolog annotation: Hit_ID=Q5XM22; Match level="QueryCoverage=62%, HitCoverage=28%, E-value=1e-14, Identity=72%"; Hit description =Resistance-like protein HAAS-2
MNHMNICCTLVRKKGAIHQVKEVSTSCYNPPSGMTSTLIDLPKPRKSYICPMHPYDLSSSLLIRDLKQLHQQEDYLVHK

SEQ ID NO: 192336 - protein, 189 aa, Glycine max
  Coding DNA Sequence Number=SeqID_75558
  Gene Ontology: Cellular component=membrane
  Homolog annotation: Hit_ID=O24091; Match level="QueryCoverage=47%, HitCoverage=22%, E-value=6e-11, Identity=40%"; Hit description=MtN21 protein
MKKIDTGHQSVSLENKTGDSIVLKIGDSAKVVIKQDMKGGEHKYGFNKNKREKPQKNCFTFDILGLRRIEWNLQGSWSAATNTVPAITFIMAVLIRMESISIKRVHGLAKILGSVLSLAGAITFALVKGPHLGFMKWYPENQNHTSHPLTIVHSKGDTIRGSLLMLSATDCIFIPITESLVMLFQHPIL

SEQ ID NO: 192337 - protein, 109 aa, Glycine max
  Coding DNA Sequence Number=SeqID_75559
MKKIDTGHQSVSLENKTGDSTVLKIGDSVKVVIKQDIKGGEHKYGFNNNKREKPQKVRLVDDETGDKHELFEVLRMPSRCVFLKVFMLFLHHSTSSCHSFPESFKYSSK

SEQ ID NO: 192338 - protein, 121 aa, Glycine max
  Coding DNA Sequence Number=SeqID_75560
MYKDKWAHTEPMGPKYTLRLMRILGPSPASLAQSSWSLLSNALRDRIASENMHLFFNKYAIQRHLPPSVPKHDFEDFYKVEKKSQGPQVAWGLDVGTGCCRTSKEHLEKKLEEIEQAQMKN

SEQ ID NO: 192339 - protein, 412 aa, Glycine max
  Coding DNA Sequence Number=SeqID_75561
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=35%, E-value=1e-110, Identity=41%"; Hit description =Chromo
MEDDNEDPISTIVPQGTQEDEIVESEDHHLSFNALKGGRRVGTIRVAKFLKLPVEPATQFRVMVGNGNYMSTEGLVKQLKFLWKGKFTTLQGDCELVPEQAQLHCIRRMVATNSIAEVYSLQLMEPDVVPKSMLDLPITMEPELALLLHTYNVVFDTPSSLPPQRSHEHSIPLLSGSQPVKVKPYKYPHSQNEEIKRLVSGMLDEASYSLKDGSWRMYTDYRALNAITIKDSFPIPTVDELTDEIFGAYFFSKLDLRSGYHKILLNPDDRHKTAFRTHHGHYEWLVMPFGLTNAPATFQSLMNDIFAGILRKFVLVFFDDIFVYNANWKDHLYHLEVVLRVAIEGTKLEAIQKWPEPSNLKQLRAFLGLTGYYRRSVVASEAFQQLKIYMASAPVLAIPNFKEIFVLETDAS

SEQ ID NO: 192340 - protein, 192 aa, Glycine max
  Coding DNA Sequence Number=SeqID_75562
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=53%, HitCoverage=6%, E-value=2e-24, Identity=50%"; Hit description=Chromo
MAENKHLKDLQKEIRTHSDDIRHLGQTMDMRYQEKNDKMLHIQNSMGQIQLAMNLLLRNASQPPESSPNNGSPMVQPINASLPVKEISLGFPHFDGTTPVMEWIFKAENFFTYHNTPDASRVDIAAMHFDKDVVAWFQMLQKLSLVSTWSELTHALESQFSPSPFDCPMVELFKFQQTGSVSAYYLKVYVSS

SEQ ID NO: 192341 - protein, 487 aa, Glycine max
  Coding DNA Sequence Number=SeqID_75563
  Gene Ontology: Mol. function=nucleic acid binding; Cellular component= chromatin; Biological process=chromatin assembly or disassembly
  Homolog annotation: Hit_ID=Q1T2D5; Match level="QueryCoverage=38%, HitCoverage=19%, E-value=1e-35, Identity=32%"; Hit description=Chromo
  Pfam annotation: Domain name=zf-H2C2; Domain location=5-46; Score =12.3; E_value=0.0083; Accession=PF09337.1; Description=His(2)-Cys(2) zinc finger
  Pfam module annotation: Pfam domain module=RVT_2::zf-H2C2; Domain location=324-455::5-46
MEEFHSSKIGGHSRVHRTVARIGAQFYWNGMRSDISKFVRECAICQQAKVDHVLSAGLLQPLPIPQQIWEDIAMDFIFEFNNKVVAEVFIANIVKIHGTTLTMSSSYRPQSNGQTENLNKTIEMYLRPPPAVMHYEVDPKDPDPLKALLQLRDQLLSKLKVKLQPYKQHSVALRKHQKLGMRYFGPFLDKVVFDEEGNVTCIKKEGDVTRNSVRIEGHMAHDPQSEGDRRSTSLFLLPVIPFSHPSPFSQVILLPDSNEIRLRGDVVPNGQCQFPSLQFYSIVPSITIVSSVTPCINVVSIDDCNNKVPVNKSDALNVFRQFKSMVELQIGAGGPANVHPMVTRAKNGIDQPRIHPTLLLARAEPKYVKQALQGPKWAIYGLKQAPRAWFEWLKTTLLQLGFADSKCNPSLFTYKTKTATVYILLYADFIIIAGSSSSQIDVLESKPISSPMVSSCKLSKHDSDLLQDASFYSPLLVPYNMLLTLSS

SEQ ID NO: 192342 - protein, 214 aa, Glycine max
  Coding DNA Sequence Number=SeqID_75564
  Gene Ontology: Mol. function=protein dimerization activity
  Homolog annotation: Hit_ID=Q2R1C3; Match level="QueryCoverage=65%, HitCoverage=25%, E-value=3e-21, Identity=34%"; Hit description=HAT family dimerisation domain containing protein
MGSASPMVGTVPHDTSWEDWDQLRQDHHLENKVILQGPKEDDSIAEPITEREIGITTTNTGANGKDDEWSDPQRISLINFMFDTESGSIFLMVVNCSGDIKDKYFIAQHIKDAILEVGSSNVPMMLRKTMILMNNILGSNNTLGLKFLSWKTMRLSMYNNDNSLKLLSVAPIRFASTIVMLKRFRSLKEGLQKMVISPEWSTYKNDDVGKEKKK

SEQ ID NO: 192343 - protein, 285 aa, Glycine max
  Coding DNA Sequence Number=SeqID_75565
MWKIYPLEVLFCIQIASLEEDKNAFGMTQSKELATLLEAEKISCVEISKHRMYWFLRIVRFAFLAVLFCIQIASLEEDKKAFGTTQHCLKQRRFRVDNYIEYIIETNKEASGFSKIHPIIINIGTNNLETQKESDCTFLPLGFCGNPKQRFLPSTYPAEQIHSNMIKMSTTQSSTSSNVSIKIELSTQDDREKLAKATNGYDKVNDLISKFGKPIAQEESSEKYLVAQEEVLLAQLRPIQNKLNAVLQKITNIQSSKESNEKQKEMLFSVATSNAKFLKNIWKRS

SEQ ID NO: 192344 - protein, 94 aa, Glycine max
  Coding DNA Sequence Number=SeqID_75566
MVQWLFGRANLKKWRLVVAYWWFWGADLGKGRLVVVWAIGSSEREATGVRWCGLDLMNRRLLGGTMMVWVKRSNKGRLVVVLVSGSSEGRSVRV

SEQ ID NO: 192345 - protein, 380 aa, Glycine max
  Coding DNA Sequence Number=SeqID_75567
  Gene Ontology: Mol. function=RNA-directed DNA polymerase activity; Cellular component=chromatin; Biological process=chromatin assembly or disassembly
MPRHHPSTGHGRQWAVSGKHDSSWHFCVDYRALNSFTIKDKFPIPTIDELLNELGGAQCFSKLDLLQGYHQIRMHSDDIPKTAFRTHHGHYEFKTYLYIVGSVDDHLRHLDMTFQKEVEPVAEKVTAISNWPTPQSSKVVQSFLGLAGFYHWFIRGYAMIADPLVKSTTVEPFQWTSQAQEAFENLKHALSTALVLALPEFQVPFTVETDASGNGMGAVLTQRRHPIAYFSKAFNKKLLKASTYVRKLFAITSAVKKWCQYLLGHSFTIITDHMSLKELLTQVIQTPKQHMYLACLMGYDYQIQYRSGNHNKATDALSRLPETTSSLLMILSVPCLTFLEELHQQLASHPQYHSQCQAILDSSAAHPDYTITQDLIIKKG

SEQ ID NO: 192346 - protein, 64 aa, Glycine max
  Coding DNA Sequence Number=SeqID_75568
MKKIDTGHQSVSLENKTGDSIVLKIGDSAKVVIKQDMKGGEHKYGFNNNKREKPQKGFSFELCF

SEQ ID NO: 192347 - protein, 180 aa, Glycine max
  Coding DNA Sequence Number=SeqID_75569
  Homolog annotation: Hit_ID=O04892; Match level="QueryCoverage=38%, HitCoverage=18%, E-value=9e-14, Identity=47%"; Hit description =Cytochrome P450 like_TBP
RGGRCKTQGASPGGAVVGADLGGTGEARLIALCARTPKGNRVKIPEPDPAHLETAQPEVGSSGWKSTARRVVSGAPPAALENPEDRVPPTPGRTHNRIRSPRAGHGGPSPEPVGCRWTARAASAARAGRRVPVGGRIGNGPFGASSPGVEQSTQNCALNVKVKKFNQARVNGGSNYDSLK

SEQ ID NO: 192348 - protein, 691 aa, Glycine max
  Coding DNA Sequence Number=SeqID_75570
  Gene Ontology: Mol. function=RNA-directed DNA polymerase activity; Cellular component=chromatin; Biological process=chromatin assembly or disassembly
MDKSLKVGEDEWREKERRSTKFYASNEGGIDLGPTKIHHGQVRRLINTNRVAALFNIQLHTHDPPFPSLPSTPPSLRPLLTKYSNLFQTPTTLPPPRPTDHSIHLEPNSKPVNVHPYRYPYSQKREIERQVDDMLRRQLIRPSRSPYSSPVLLVKKKDGTWRFCVDYRALNSITVKDRFSLPTIDELLDELGNSSWFSKMDLAQGFHQIRMEEHDISKTAFRTHQGHYEYVVMPFGLCNAPSTFQATMNELFRPFIRKFVLVFFDDILGQFHLKPSKCIFGQRRIEYLDHFVSSQGVEPDPSKIKAMLQWPPPSTPKQLRRFLDLTGFYRRFVHRYAQIAEPLTQLLRKDNFKWTPEAQEVFVKLKEAMTATPVLALLDFIIPFIIETDASGSGMGAVLMQRGHPIAYFSKQFCPKLLCSSTYIRELHTITTAVKCWRQYLLGHAFVILTDHKSLRELMTQPVQTPEQHVYLAKLLGYNYSIQYKAGHNNVVVDAFSRLQEPEQTAEYFQIFSMPHPKFLDELKKELSGSEEFKTLMLQGNLFIPLLLEEYHKSPLGGHMGLAKTLGRLQQSFFWENMRRDTLDFIKQCPDCLQTKYNTKKPVGLLQPIPPPSRPWKDLALDFITGLPISNGATVIMTVVDKFSKGGHFGTLPSHFTAHMAAHLFIDLVCKLHGFPQSLISDRDPIFLRKF

SEQ ID NO: 192349 - protein, 93 aa, Glycine max
  Coding DNA Sequence Number=SeqID_75571
  Subcellular localization annotation: CTP_CleavageSite=64; ConfidenceScore=5.22e-01
MDSSASLSKNSPFTEKYPKYRLHCKRLQGSSVSGLCKMVQDKCRDNKSKGNLSQSGSPQGPLFLGGSGKGLSSSECNNMDTEEDKQSDCRNWK

SEQ ID NO: 192350 - protein, 213 aa, Glycine max
  Coding DNA Sequence Number=SeqID_75572
MDVDKILPSSSTLGWHSLKVKGEVQTKKGLWWIPRHPETRKGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSWVTDRKPPGAVAKASLHRAIVTAYGPEPGSEPTDVEESADELWLGVKCHSNPELAGSPRNALRRSS

SEQ ID NO: 192351 - protein, 1623 aa, Glycine max
  Coding DNA Sequence Number=SeqID_75573
  Gene Ontology: Mol. function=actin binding; Cellular component =cytoskeleton
  Homolog annotation: Hit_ID=Q5XPJ9; Match level="QueryCoverage=99%, HitCoverage=94%, E-value=7e-77, Identity=51%"; Hit description =Protein SCAR2
  Pfam annotation: Domain name=WH2; Domain location=1528-1547; Score =3.9; E_value=11; Accession=PF02205.10; Description=WH2 motif
  Pfam annotation: Domain name=WH2; Domain location=1561-1579; Score =14.2; E_value=0.39; Accession=PF02205.10; Description=WH2 motif
  Pfam module annotation: Pfam domain module=WH2::WH2; Domain location =1528-1547::1561-1579
MATAARGHGLMARVKQLEAEVPSLEKAFFSQTHHSSFYSNGGIDWHPNLHSEQNLVTRGDLPRFIMDSYEECRGPPRLFLLDKFDVAGAGACLKRYTDPSFFKIEPTSSVTATIEVQREKRIRKVKLKKGARLRDGETPNAVPSHAKLHQLLLEERIENGYSNPARLVKLKKRQLNGPAVETRAGKSYMEKFLETPSPDHKMVCETSIFPLPVKQTSDDASEAGIKILEISSISPVKKSLGNKNTYSSPDEKELELKPFSQMDGGTNGDLVKVKEQISDGVADKKSSNHLMLPDEAELAIDEQKKIEGSLDGYQSDDVTSEVDNYMDALTTMESELETDNEFKPKSSFLNIQKAANTNDKEEHQLQAQFSDSQSFGDSSMSDDCSSFKQDRNEEHIKVEAQLSDSQSTGTSSSLDDNSSFKRDGNGQHIELQAHLSDSQSVESSSTSDKNFKKDRSYLPHSDSLTTAVENMQSEPILFTNTKYCEPEVEDAPSNQLPHNVEFQHTDCERFVMHDDAPVHEEDISDLGQASSDLTTSGLVLCSDLVSTSPVILPSDETPSDPAELNLRLDDDDADRTGLVESITSKPVSLSLGTDDAHPLGSSDKTSLDNLDDDDPYIHSDDLLQVPNDLELAHGDECSDHSEIKISQAESPNENPSKILVNRDIGSPVEDPVSPSMEELNLNSGAMLARDCQDSKDEDCTVATQLNSVARVPPVSCFTGELSSDSTHNNTLNGPGSAEIEVSYSDLQSKAEEIPKMVHDDKINGSTFSANSVEGDAHFKHQSPDNHVMVNDLVTENVQSEDQAVYSVPSVDSAENDVGVVTCPASSQICSPSMGLSDLEEPLLSSHSYQMEIKSNEVELTQIAMDTNAEKRKNQSAPLLDVTSSDVVNSSMSNITKLEEPLSTFADSPKKEMEVDEAVARDSLTELEEQKIVDQPEIASVDVQLNLNKLVPCDLPDSEICNNNQKSSPREKFQHDAFVDDAEMVPEFSGLDDRQSESLSYGQHDPLQNGRDSFSSSSGNQLEPETDLDLLSKSQIGEQDAEFPVRDEKNFASEKSQCQQMQICQLEQESTHATSECASEIHADEPSSFYSFPQSSSQENNAAKHVMDPLKPLLPNLFPKATENNLDEMPPMPPLPPMQWRMGKVQHASLASQREELEVSPASVQPIRPDKQSLFGLPTSERDALLYQNPFLPVMAVESDKLQDSSGFPVDVSGHPVAIPFQFPVMVNESKGQYNYLLLDRNQIQNPFLTLPVASTAMPPQGFFVAPEGEMIQNSNPCAPIPSAAYDVSGHNSIPPQEKPTQPPNQLMMETSPDDKSLLQSMSNMVSMDRPPHGHAVASEGEKVLNSPTIPPAECAVSGHDSVSPQEKLTQHPSQLLTEHSSDDKTLLQSVTNVVSMDSSDSQIVSSEGEMEQSSNPNPPSPPVECAVPGPGHDSISSHESLTLPPSQLMSETSSEFKTLQQSISNVEGEQGRLPISFMSPSNMESMEPNQSFPPFEGGMSASLDTSDHTSDVESERTNGKPKNKLPRPRNPLIDAVAAHDKSKLRKVTERVMPQIAPKVDERDSLLEQIRTKSFNLKPAVTTRPSIQGPKTNLKLAAILEKANAIRQALAGSDEDDDADWSDS

SEQ ID NO: 192352 - protein, 132 aa, Glycine max
  Coding DNA Sequence Number=SeqID_75574
  Homolog annotation: Hit_ID=Q10NU0; Match level="QueryCoverage=57%, HitCoverage=17%, E-value=3e-21, Identity=53%"; Hit description =Glyoxal oxidase, putative, expressed
MVGGEGSGGEFELVTGDSGGGSVGGDRGRGAPGICLEEEGVEGVGGDVVFEGVGGAVGESEVDAFKDHHPVGVEELHVHRHNADALLEDLPVATTANFHYDQESYMKEDEKERSCHHFMNCVNDMSLDYETE

SEQ ID NO: 192353 - protein, 72 aa, Glycine max
  Coding DNA Sequence Number=SeqID_75575
  Homolog annotation: Hit_ID=Q5XPJ9; Match level="QueryCoverage=71%, HitCoverage=3%, E-value=3e-16, Identity=80%"; Hit description =Protein SCAR2
MPLSKYCVRNEYSLADPELCRAADKDDPEALLEAVAMAGLVGLLRQLGDLAESVSTSSSSYYFVTSVFLSLC

SEQ ID NO: 192354 - protein, 81 aa, Glycine max
  Coding DNA Sequence Number=SeqID_75576
MDRISPFEVEDVFYVNNKSETTIVAIKIEDKEEKMDTDAIEEKKKILDEKKGNPVCQKAHQIVMYLKLKRMNLSIELRELV

SEQ ID NO: 192355 - protein, 143 aa, Glycine max
  Coding DNA Sequence Number=SeqID_75577
  Subcellular localization annotation: CTP_CleavageSite=27; ConfidenceScore=5.03e-01
MPICRNLPFSGGVKRPKRLSPREKTSRVTTNVYLRKTLEKPKRQRSVDFENDGSGIVYARGRIINQGCFQYQFNKHSKVKHCFKIKTRLLQQTSIASRFIQDQLLPQNTLFPTCQGSGNQLPGSIIDYQKKSLQSSFLKGLEI

SEQ ID NO: 192356 - protein, 143 aa, Glycine max
  Coding DNA Sequence Number=SeqID_75578
  Homolog annotation: Hit_ID=Q9FMX9; Match level="QueryCoverage=41%, HitCoverage=12%, E-value=6e-14, Identity=73%"; Hit description =Serine carboxypeptidase II-like protein
MALCSVFLNLHLLLFVCLTIEALGVAKPSVASYLSQEILAEQKADRVHGLPAQPPVKFNNMVVISLSMKLKEEHCSIGFSRPLTNQNKNPFSYGSMEIGMLIKIKHLIFLDVKNHKPEGQEVSAAGVNIDNHMNEGSGWINSA

SEQ ID NO: 192357 - protein, 122 aa, Glycine max
  Coding DNA Sequence Number=SeqID_75579
IEVAGPTRLPPAMIEWEKFNHIEERLRAIEGGGDYAFVDMAELCLVPDVVIPPKFKVSDFDKYKRTTCPKNHLKMYSRKMGAYSENEKLLMHFFQESLIGAAVTCMNLSENTPKGGGIYQLK

SEQ ID NO: 192358 - protein, 45 aa, Glycine max
  Coding DNA Sequence Number=SeqID_75580
MLHSSRILRKLEVEEHLLGLWLPLHYRVDMGDCVGIGCAAGKLCS

SEQ ID NO: 192359 - protein, 83 aa, Glycine max
  Coding DNA Sequence Number=SeqID_75581
MYKDKWAHTEPMGPKYTLRLMRTLGPSPASLAQSSWSLLSNALRGRIASENMHLFFNKYAIQRRLPPSVPKHDFEVINLTIAL

SEQ ID NO: 192360 - protein, 170 aa, Glycine max
  Coding DNA Sequence Number=SeqID_75582
  Gene Ontology: Mol. function=chromatin binding; Cellular component =chromatin; Biological process=chromatin assembly or disassembly
  Homolog annotation: Hit_ID=Q1SAV4; Match level="QueryCoverage=88%, HitCoverage=38%, E-value=2e-46, Identity=58%"; Hit description =Integrase, catalytic region
  Pfam annotation: Domain name=rve; Domain location=52-170; Score=6.6; E_value=0.0017; Accession=PF00665.16; Description=Integrase core domain
  Pfam annotation: Domain name=zf-H2C2; Domain location=1-34; Score =17.0; E_value=0.002; Accession=PF09337.1; Description=His(2)-Cys(2) zinc finger
  Pfam module annotation: Pfam domain module=rve::zf-H2C2; Domain location=52-170::1-34
MGVAKMIARLSENFHWPGLWEDVIQFIAKCVECHITKYETKRVVGLLCPFPVPFCPWEDPSLDFITGLPPYQGKTTLLVVVDRFSKGIHLGILPQEHMAHMAASLFINIVMKLHGIPRSLVLDRDPLFISEFWQKLFRLNDMRLRMSSAYHPQSDGQTKVMNRMIVQYLR

SEQ ID NO: 192361 - protein, 169 aa, Glycine max
  Coding DNA Sequence Number=SeqID_75583
  Gene Ontology: Mol. function=RNA-directed DNA polymerase activity; Cellular component=chromatin; Biological process=chromatin assembly or disassembly
MTYLYIVGSVDDHLRHLDMTFQKEVEPVAEKVTAISNCPTPQSSKVVQSFLGLAGFYHWFIRGYAMIADPLVKSTTVEPFQWTSQAQEAFENLKHALSTALVLALPDFQVPFTVETDASGNGMGVVLTQRRHPIAYFSKAFSKKLLKASTYVRKLFAITSAVKKWCQYL

SEQ ID NO: 192362 - protein, 131 aa, Glycine max
  Coding DNA Sequence Number=SeqID_75584
MPRHHSSTGHGRQWAVSGVPLPKHRPGPQWLKSLGVVLTDYTTLCMQFIYDGHLNQGPGIYFHITVLSEEKSSSHLEDLLMQAPLELVGLGSSSSMDSFASWKINGSGMEKEEREETPLQGEDESRRSSPP

SEQ ID NO: 192363 - protein, 81 aa, Glycine max
  Coding DNA Sequence Number=SeqID_75585
MGWYWAKSGLSEAWSQLAIQSPAFENEDTDTVLWLELKEVSDAILPRKGPITRTMSKRLQEDWARAAEEGPRVLMNLRVDF

SEQ ID NO: 192364 - protein, 214 aa, Glycine max
  Coding DNA Sequence Number=SeqID_75586
  Gene Ontology: Mol. function=RNA-directed DNA polymerase activity; Cellular component=chromatin; Biological process=one-carbon compound metabolic process
MRPTYEFKEIWVGYRSGLSGGSRGGVLGGLGMGILWVVGSSSSAMRRKTLEAHRCPMWNFSSQLKQRPRSLREAISSGDKRFKASGWGWEGVGKRGGRGIEDIGDAYPGTSLLASERGRLPTPESLVDGPAPPCVSPGHRASLGELKQRTDGIIVLRWGKASVQGLKENGPGGELAIGVEEEAMVLAWMELSHCIDRLTKVQLLVGEANEGILK

SEQ ID NO: 192365 - protein, 113 aa, Glycine max
  Coding DNA Sequence Number=SeqID_75587
  Gene Ontology: Mol. function=polygalacturonase activity; Biological process=carbohydrate metabolic process
  Homolog annotation: Hit_ID=Q2KMJ7; Match level="QueryCoverage=93%, HitCoverage=31%, E-value=4e-29, Identity=59%"; Hit description=PGN
MTSHYWELRENGAHQTVEEICGGQGYARKITFKDIKLVEATNLVIIDQLYNPCDNVCAVRVNDVSYHNVRGISSSTHAIKLYFDKIIGYTNIVLKGVKVTTYTKKKTYASCKH

SEQ ID NO: 192366 - protein, 311 aa, Glycine max
  Coding DNA Sequence Number=SeqID_75588
  Homolog annotation: Hit_ID=Q4UVJ3; Match level="QueryCoverage=31%, HitCoverage=21%, E-value=2e-42, Identity=84%"; Hit description =Cysteinyl-tRNA synthetase
MSSRVGGSEPVGDGADRHPLLARGGVDLVVHVGDVARVAQATETAPQQVGQHAEHHRATGVADVHVVVDRGAAHIQGRTGRVERGERFELASQVVVQAQGHGAVAGGQACDFRTCRPPLGAPPATGGRRVRPRWGGQEQRGRAQEAEPRNRVVIVENVKFDYAQVLNVEPVFQTLRATRTEEHCEPVSTRTLAPVNVTGEEPVEDKGRISRFWDSVRSMFKRSDEEVSEDTAAESPAPAPAPANNGPMLTRDCRIVPVGREFRRPIAYDVDYVYKGTKYRSRLPEDPGNRLKIRVSITPWVGPEQGATGNP

SEQ ID NO: 192367 - protein, 115 aa, Glycine max
  Coding DNA Sequence Number=SeqID_75589
MGTFWDCGPGERMMARVELGSGGMAGARMGRGGEGGGAAALAAGAGGERGGGRRWVVVVVAVVGVVVVVEVTRVFHGCDRWWWRCCSASEGEEKKLNECVRGPGPVITLSFRKGL

SEQ ID NO: 192368 - protein, 57 aa, Glycine max
  Coding DNA Sequence Number=SeqID_75590
MERRFPPTCPGFQEFYGSITKAPKAIFQQRREVLAAYLAQVSWLLSQVERKGPESSR

SEQ ID NO: 192369 - protein, 143 aa, Glycine max
  Coding DNA Sequence Number=SeqID_75591
  Gene Ontology: Mol. function=ribonuclease H activity; Cellular component=intracellular; Biological process=DNA integration
  Homolog annotation: Hit_ID=Q1SAS4; Match level="QueryCoverage=98%, HitCoverage=8%, E-value=5e-45, Identity=47%"; Hit description=RNase H, putative
MGEMCEEFKIQYHNSKPYRPKMNGAVEAGNKNIKNIIQKMTLSYKDWHKMLPFALHGYRASVRTLSGATPFLLVRMRRFSEGDLVLKKVSQALKDNRGKWAPNNEGPFVVKRAFSGGALVLTNMDGEELPSPVNFDVVKRYYA

SEQ ID NO: 192370 - protein, 67 aa, Glycine max
  Coding DNA Sequence Number=SeqID_75592
  Gene Ontology: Mol. function=RNA binding; Cellular component=nucleus; Biological process=mRNA processing
  Homolog annotation: Hit_ID=Q5YJQ9; Match level="QueryCoverage=86%, HitCoverage=33%, E-value=7e-27, Identity=98%"; Hit description=Mago nashi-like protein
  Pfam annotation: Domain name=Mago_nashi; Domain location=1-67; Score =29.8; E_value=4e-06; Accession=PF02792.5; Description=Mago nashi protein
IMKEDDNNWPEPDRVGRQELEIVMGNEHISFTTSKIGSLVDVQSSADPEGLRIFYYLVQVRIMLLSF

SEQ ID NO: 192371 - protein, 43 aa, Glycine max
  Coding DNA Sequence Number=SeqID_75593
MVDDNDDTAGVLHDDTAGVIHDDNQLRETKLKGTTVLRNLHSM

SEQ ID NO: 192372 - protein, 144 aa, Glycine max
  Coding DNA Sequence Number=SeqID_75594
  Subcellular localization annotation: CTP_CleavageSite=26; ConfidenceScore=5.27e-01
MASVGTHLRLGMCSCTFTCGPSFGSSSSTKKRKLSNKANIGSRNKKFKNDDDDEVWKIKKVLEKSNIGTMRRLILRREMEEEFVLPVLGDDADQIDSGVSVQIWDVDTKSILSGFQEMGFFKKLCIHWCDILEISIRNFVSVIF

SEQ ID NO: 192373 - protein, 98 aa, Glycine max
  Coding DNA Sequence Number=SeqID_75595
MPTTQNIAAGKYTLQGNHMPSGTVLLVRKLISMDMKIMHYQSKIVIVIELRRLRKLSHENWCSSSHSSVSTQRILAQLLYESTILPGIQPDWRARLSQ

SEQ ID NO: 192374 - protein, 149 aa, Glycine max
  Coding DNA Sequence Number=SeqID_75596
MKPWNKKPRRPERKNTTKTSFEGLYRAAIVSSSSEEVKGIITGNTWAIIDKFKEKLNLAATHEQRLEDEYAKISVEREARERVIDSLHQEATMRMGRFAFTLNRSQELPRLLAKAKAMADTYSAPKEIHGLLSYCQHMIDLMDHMIRNR

SEQ ID NO: 192375 - protein, 77 aa, Glycine max
  Coding DNA Sequence Number=SeqID_75597
MVERKDKELRGSSNGVISGYHKWLKARTQGITWLPKLKSPSGGEAEVLEESEEVQALKVELERMRVVKEKLKMTVIR

SEQ ID NO: 192376 - protein, 216 aa, Glycine max
  Coding DNA Sequence Number=SeqID_75598
  Gene Ontology: Mol. function=calcium ion binding; Cellular component =extracellular region; Biological process=pathogenesis
  Homolog annotation: Hit_ID=Q8XQP2; Match level="QueryCoverage=94%, HitCoverage=83%, E-value=6e-25, Identity=35%"; Hit description =Probable hemagglutinin/hemolysin-related protein
MNQILNASYRYTDDPRRGYSGTSPQARNGFAEIAIDGQPPYTVKVDAEGRWSWTPPADWTPGEHIVSVRMIDAAGNIGNPAQFIQVVDYTAPDAPRLLNMYDDQGDITGSFDAGRMTDDRRPTLTGVAEKGTVVYLKEGDTVIGSAQADATTGIWTLEPDADLSDGTHQLTLVAVETFNGKLREGEPSAPFELLISRDGSAATVISHAVDDAGPVT

SEQ ID NO: 192377 - protein, 125 aa, Glycine max
  Coding DNA Sequence Number=SeqID_75599
MVICTLSEDVGIFWWRLFQVSQVIQNYVEAAGQMIHGDTLRVIRTLLSSRGGGPMTSRDKIWSFCTLVSSKGGGPDDTRRYLTVIRTLVSSRGGGPDDTRKYPSGYPYKHSFAICKTERLIACRG

SEQ ID NO: 192378 - protein, 73 aa, Glycine max
  Coding DNA Sequence Number=SeqID_75600
MVPGHWLLMSHDRIKVRVPMPDSLSWWNSHIQRKSEGKDNQSGGYNLLFNKDERVVLCKDGSPLFSAKRKGNL

SEQ ID NO: 192379 - protein, 333 aa, Glycine max
  Coding DNA Sequence Number=SeqID_75601
  Gene Ontology: Mol. function=nucleoside-triphosphatase activity; Cellular component=membrane; Biological process=amino acid transport
  Homolog annotation: Hit_ID=P45769; Match level="QueryCoverage=74%, HitCoverage=98%, E-value=1e-133, Identity=95%"; Hit description =Hypothetical amino-acid ABC transporter ATP-binding protein yhdZ
  Pfam annotation: Domain name=ABC_tran; Domain location=122-307; Score= 231.0; E_value=2.6e-66; Accession=PF00005.17; Description=ABC transporter
  Subcellular localization annotation: CTP_CleavageSite=62; ConfidenceScore=5.07e-01
RSGGITGARLLENAGAGHSSTSSQAGYPGTACNRPPWTLSGWACPQKDMSLQPLSTGSFVLACRATASIWKSALTPGVHRTEEIMSQITMTPADAMITLENVNKWYGQFHVLKDINLKVKQGERIVLCGPSGSGKSTTIRCINHLEEHQQGRIVVDGIELNEDIRNIERVRQEVGMVFQHFNLFPHLTVLQNCTLAPIWVRKMPKKEAEALAMHYLERVRIAEHANKFPGQISGGQQQRVAIARSLCMKPKIMLFDEPTSALDPEMVKEVLDTMIGLAQSGMTMLCVTHEMGFARTVADRVIFMDRGEIVEQAPPDEFFAHPKSERTRAFLSQ

SEQ ID NO: 192380 - protein, 176 aa, Glycine max
  Coding DNA Sequence Number=SeqID_75602
MVALDAFGVSSMTPMLPSSFAELHGAGSHELSSVLQSLSLDYKSPPIEWCRITIKGSLGASLLNQSRWMKDGDGHGSVDGTCLRRGKIKTTYSFSPILGLALVALFLMCLRIIEGMTNSRGLEAGGTFLALFGTGEIRATIFLFWKETCMKPSSSSLVLLRSFNLCGTEVVVRWTQ

SEQ ID NO: 192381 - protein, 137 aa, Glycine max
  Coding DNA Sequence Number=SeqID_75603
  Subcellular localization annotation: CTP_CleavageSite=36; ConfidenceScore=5.15e-01
MRVHCYQASRRPSMITDSPSLLMFPWTRSPVESPTVATYPSARGRHEGLRMRLPRKENARSCHQRLFEENVGKTGKGCGLRTLSVKGSGVVFTHGEGLWEFYGSITGVPEAPEAIFLTKRGRWLPPTSPRRARLLPP

SEQ ID NO: 192382 - protein, 141 aa, Glycine max
  Coding DNA Sequence Number=SeqID_75604
MYPPLELIHKRCTLSFLIQTQVDVPSTCTTKDVPSNVLRQKSQAVKPLILCEWGYKRILRREKGNTKEFRRLVLCSFGKGRREIQKEFRRLVLGEFFLAKGEENEKMNSTSFQGLENQKTSESFWYKEEEEVQRDSGLVKD

SEQ ID NO: 192383 - protein, 77 aa, Glycine max
  Coding DNA Sequence Number=SeqID_75605
MVGAFSQNIVTLTGLPMILLSESDLTNPLCGVSCYVLLSAPGWFFTDMECDNSLPVCYLCLDPVMILNFVFGGADDQ

SEQ ID NO: 192384 - protein, 56 aa, Glycine max
  Coding DNA Sequence Number=SeqID_75606
MDYSRSSKWMMGQPHASAARRRRPATLAAARAAAPARPGDAGADPGRRAQQDLPAL

SEQ ID NO: 192385 - protein, 79 aa, Glycine max
  Coding DNA Sequence Number=SeqID_75607
MDLGGLGVTNIEVVNDVLLGRWRWNLFHRSDGAWKDVLMSMCVGDLGKKNGLIMESGGKLEEVRKLDFGRTRAWKESVW

SEQ ID NO: 192386 - protein, 214 aa, Glycine max
  Coding DNA Sequence Number=SeqID_75608
  Gene Ontology: Mol. function=Rab escort protein activity; Biological process=intracellular protein transport
  Homolog annotation: Hit_ID=Q9C8Z5; Match level="QueryCoverage=59%, HitCoverage=26%, E-value=5e-16, Identity=34%"; Hit description=Rab escort protein, putative; 48705-51166
  Subcellular localization annotation: CTP_CleavageSite=44; ConfidenceScore=5.06e-01
FITSTTASTVGKTILHLDPNSFYGSHFASLSLHNLTSLHSLPFAAATTTNSDDVIVIDLIHQPLCSDVEIVTYDEYAFLNKKFSIDLGGLRALFYVDKMINLLMKSGTAQYLEFKGNDESFVYEANAETKPERVREIKVQCIGLLGDVAAVKGELWLLRCEHIGGEELKMKLGAPNFHMLDYADIFRATPNNDGSKFTTWMNRVELTYGDLWRN

SEQ ID NO: 192387 - protein, 161 aa, Glycine max
  Coding DNA Sequence Number=SeqID_75609
  Homolog annotation: Hit_ID=Q9XG10; Match level="QueryCoverage=90%, HitCoverage=89%, E-value=2e-70, Identity=89%"; Hit description=Lectin
MSLAKDVKEKVERGKDDGGKFEIQPRGLNIVWGNDSRYWKIPEQGPAELIQVSWLEVSGVVNLPGVKKYRVEFEVRVKDDGFGWSGTDVLVMAKIGKTGKYTYKVTKLNPGETLNIPKSTDPLEIQVNKQSEDLHFGLYEVWSGKWKGGLEIVRALIKPLT

SEQ ID NO: 192388 - protein, 290 aa, Glycine max
  Coding DNA Sequence Number=SeqID_75610
  Pfam annotation: Domain name=Transposase_23; Domain location=160-230; Score=-9.1; E_value=0.011; Accession=PF03017.5; Description=TNP1ENSPM transposase
EKLLGEKTKKKMQEGAQSGRVDGKPREVEDGPHEEERGETTEAAKEIAEKIATQGSFVSHGRQDVLAAAIGRPEHPGRVRAAGAGVTIKQYFGLAPRTDQLEESITEKVTRQVMESFSQLQSQMQSQGLAVPPEPVVGPSGPRVSTKGSCVDPSGNDPETGDFDRCGLYIEADPARLVAMGRVYEGSTVVHNTPLLPGQVKVSVEEVTDAYAPIPVPTNEVSLAGQALHTFFAWPTHLVKSLSQQVVVSPAKPPPKPDPEVDDPLYLMTLTIPELFLRPYQVRWDATVFG

SEQ ID NO: 192389 - protein, 93 aa, Glycine max
  Coding DNA Sequence Number=SeqID_75611
SSPSKVIRPSITRTFIEKYYTPRQAQGDAHQAAGALPPPRQADPFGAEVAWPRDWPDAQAGEEPAGSPGGADESHRDEDMTDLLGFLGGSGAT

SEQ ID NO: 192390 - protein, 170 aa, Glycine max
  Coding DNA Sequence Number=SeqID_75612
  Gene Ontology: Mol. function=protein-tyrosine kinase activity; Cellular component=cytoplasm; Biological process=protein amino acid phosphorylation
  Homolog annotation: Hit_ID=O49409; Match level="QueryCoverage=87%, HitCoverage=35%, E-value=1e-56, Identity=70%"; Hit description =Protein kinase-like protein
  Pfam annotation: Domain name=Ank; Domain location=28-60; Score=45.7; E_value=1.6e-10; Accession=PF00023.20; Description=Ankyrin repeat
  Pfam annotation: Domain name=Ank; Domain location=61-93; Score=12.3; E_value=0.53; Accession=PF00023.20; Description=Ankyrin repeat
  Pfam module annotation: Pfam domain module=Ank::Ank; Domain location =28-60::61-93
MYLANEGDSDGIKELLDAGSDVNFTDIDGRTALHVAACQGRTDVVGLLLRRGADVDPQDRWGSTPLVDAMYYKNHDVVKLLEKHGARPPMAPMHVQNAREVPEYEIDPSELDFTNSVCITKGTFRIALWRGTQVAVKTLGEELFTDDDKVWVGLLMQAVVSFMSIGLFNS

SEQ ID NO: 192391 - protein, 90 aa, Glycine max
  Coding DNA Sequence Number=SeqID_75613
MVSDLAVLLPTLTQLVVLHSAQQPILKLAHPWPEWFQLMKCLLDKGYFCREEGKMLCNAGMGMKDFNVIRTKFGRASELCQTVIFNWTRT

SEQ ID NO: 192392 - protein, 124 aa, Glycine max
  Coding DNA Sequence Number=SeqID_75614
MEDSIGKITKITFPSQEGPLLTVKNTLEIGGFNWENNKDHISQSRGSALDGSALDGEEHIGEWTNPIGKLTKITFPSQDGFALDGEEYIGDGGFNRENNKDNISQSRGSALVGEEHIGDWRIQL

SEQ ID NO: 192393 - protein, 233 aa, Glycine max
  Coding DNA Sequence Number=SeqID_75615
  Homolog annotation: Hit_ID=Q3RFW9; Match level="QueryCoverage=56%, HitCoverage=69%, E-value=2e-14, Identity=35%"; Hit description =Hypothetical protein precursor
KVNATPDATPAQATDDATMLADRDYPLVADADLYAWTAAGGPLPTLLASLLLALPLSLSAAPQTLNVPLPPPVPGSSPAATAPATTSTTPAAFAQLDAPQQRQRRADYAAWRALPEGERERIRQAAARFNALPADQQQRLRQQFQAQDQAFREGWRLGPQLGLEFPKLHGLFGFVPPQQREAALAVLRQLSPAQLAQLTLVAQRTPPQERDTVRSAFLAVPAAERDTWLKRQA

SEQ ID NO: 192394 - protein, 97 aa, Glycine max
  Coding DNA Sequence Number=SeqID_75616
MRAGNSVLYGFLEPQSIQRSGQSQFEAESYIKSSKRDVYLGAYLNGPDNYLKGIINSALKGLDGPHPKSKAPARWIVVKYFNDLRPLEPERLKVLQI

SEQ ID NO: 192395 - protein, 54 aa, Glycine max
  Coding DNA Sequence Number=SeqID_75617
MARSVSASCPYSRDLYGRELKRFTSTPYVPTNPGIGPFFNSLCVQIVLVFVCIK

SEQ ID NO: 192396 - protein, 149 aa, Glycine max
  Coding DNA Sequence Number=SeqID_75618
  Gene Ontology: Mol. function=transition metal ion binding; Cellular component=nucleus
  Homolog annotation: Hit_ID=Q9SK39; Match level="QueryCoverage=50%, HitCoverage=75%, E-value=3e-19, Identity=62%"; Hit description =Putative steroid-binding protein 3
  Pfam annotation: Domain name=Cyt-b5; Domain location=62-148; Score =11.0; E_value=0.029; Accession=PF00173.18; Description=Cytochrome b5- like HemeSteroid binding doma
MKYLRGTLHVDLWYPKGVEISLYRRAVGYPTVVASCVVRVRSRGLSRRGCQLCRESEKQRVTRKVKWFNDQKGVGRVYDVSTGKSFYGPSGPYAMFAVKDASRALAKMSKNDDDISPSLDDLSDKEIGVLNDWENKFQAKYPVVARVLN

SEQ ID NO: 192397 - protein, 572 aa, Glycine max
  Coding DNA Sequence Number=SeqID_75619
  Gene Ontology: Mol. function=phosphatidylinositol phosphate kinase activity; Cellular component=endoplasmic reticulum; Biological process=phosphatidylinositol metabolic process
  Homolog annotation: Hit_ID=Q2HW52; Match level="QueryCoverage=94%, HitCoverage=71%, E-value=0.0, Identity=68%"; Hit description =Phosphatidylinositol-4-phosphate 5-kinase
  Pfam annotation: Domain name=MORN; Domain location=116-138; Score =29.7; E_value=1.1e-05; Accession=PF02493.10; Description=MORN repeat
  Pfam annotation: Domain name=MORN; Domain location=139-161; Score =33.8; E_value=5.9e-07; Accession=PF02493.10; Description=MORN repeat
  Pfam annotation: Domain name=MORN; Domain location=162-184; Score =35.8; E_value=1.5e-07; Accession=PF02493.10; Description=MORN repeat
  Pfam annotation: Domain name=MORN; Domain location=185-206; Score =17.0; E_value=0.033; Accession=PF02493.10; Description=MORN repeat
  Pfam annotation: Domain name=MORN; Domain location=207-229; Score =27.9; E_value=3.6e-05; Accession=PF02493.10; Description=MORN repeat
  Pfam annotation: Domain name=MORN; Domain location=230-251; Score =7.5; E_value=0.75; Accession=PF02493.10; Description=MORN repeat
  Pfam annotation: Domain name=MORN; Domain location=70-92; Score=35.2; E_value=2.3e-07; Accession=PF02493.10; Description=MORN repeat
  Pfam annotation: Domain name=MORN; Domain location=93-115; Score =31.7; E_value=2.6e-06; Accession=PF02493.10; Description=MORN repeat
  Pfam annotation: Domain name=PIP5K; Domain location=468-571; Score= -77.8; E_value=3.5e-06; Accession=PF01504.9; Description =Phosphatidylinositol-4-phosphate 5-Kinase
  Pfam module annotation: Pfam domain module=MORN::MORN::MORN::MORN::MOR N::MORN::MORN::MORN::PIP5K; Domain location=116-138::139-161::162 -184::185-206::207-229::230-251::70-92::93-115::468-571
MMGRDSSVMKAWEATVRKTQAVAKKRANSIFGSTYVAHAEEEEDHKEDTNGSEASELYHAEKVLPNGDYYKGEWVDNFPHGMGKYLWTDGCMYVGEWFKGKTMGKGRFTWPNGPTYVGEFKSGYMDGTGTYVASNGDTYKGQWVMNLKHGHGVKNFSNGDKYEGEWRRGMQEGHGRYQWKDGSYVGEWRNGSIWGKGSFVWDDGNRYDGYWEDGLPKGNGTYKWDDGSFYVGNWSKDPTDQSGTYYPRGSSQEANLEWNPQEVFTKLSEYAICPGEKVSILPSQKRLAVWRSTKGGDGAKPRRKSVDGRVSVGLEKPNDRMQLWGGVEGDFSGTKTPTRGGVAVDDELLGLSIDGAISRETQLQTLKAPRKSKRQGETICKGHKNYELMLNLQLGIRHSVGRPAPSASLDLKPSAFDSKEKVWTRFPTEGSKYTPPHPSCEFKWKDYCPVVFRTLRKLFKVDVADYMISICGNDALRELSSPGKSGSFFYLTNDDRYMIKTMKKAEAKALLRMLPAYYNHFRAFENALVTKFYGLHCVKLTGPAQKKSKQKQRKSKETEPKPPYQAGRANLE

SEQ ID NO: 192398 - protein, 139 aa, Glycine max
  Coding DNA Sequence Number=SeqID_75620
  Pfam annotation: Domain name=zf-CCHC; Domain location=64-81; Score =11.9; E_value=0.011; Accession=PF00098.13; Description=Zinc knuckle
MRQEGIVECAFRSQLKIKNKGGKNKKKEEAEEGNQNNNPQSFLPCPYCKKANHSPKRCWWRPDAKCYKCGQLGNLEKICKSIINNKIYQNLLSVSQLLDRERLQDLNSMEVIKVQMKGKSFALNLMQEELTIDEEDKKE

SEQ ID NO: 192399 - protein, 110 aa, Glycine max
  Coding DNA Sequence Number=SeqID_75621
MRIESAHWSLKRLLQNSFGDICSVWEAMNMMTLQHTQIKASFETNKNPSRCRCVMRTTHGLSCACELSKYVVGSIPIETIHIFWRRLSFSDQGLCEAEVTITEEMEIISK

SEQ ID NO: 192400 - protein, 83 aa, Glycine max
  Coding DNA Sequence Number=SeqID_75622
MILHEIRRPNSLKTIPSGVANCRNLPFDERATRDSRVRLPWEENAQSRHQRLFEENVGKTEKSCAKPSVPELSALHCSNPWAK

SEQ ID NO: 192401 - protein, 69 aa, Glycine max
  Coding DNA Sequence Number=SeqID_75623
DCAHKTPSGPEEVQQGLGVASSDYGPLSSGPLLIELSSRSTAPPGKRRVKLHSSLGMAGSGQQTHYHHL

SEQ ID NO: 192402 - protein, 96 aa, Glycine max
  Coding DNA Sequence Number=SeqID_75624
  Subcellular localization annotation: CTP_CleavageSite=70; ConfidenceScore=5.35e-01
PCGVYPDLSSFTGSGVYPDLSSFTGSGVYPDLSSFTGSGVIQKLYSLYQAFRPVRFTSSGIRALALDTAYSNSVWGKNCLIAELLNCQICLMMIAY

SEQ ID NO: 192403 - protein, 431 aa, Glycine max
  Coding DNA Sequence Number=SeqID_75625
  Gene Ontology: Mol. function=chitin binding; Cellular component =extracellular region; Biological process=chitin metabolic process
  Homolog annotation: Hit_ID=UPI00006A17C9; Match level="QueryCoverage =63%, HitCoverage=100%, E-value=9e-35, Identity=33%"; Hit description= UPI00006A17C9 related cluster
GLHILAFKGQHILAFRGLHILTFRGLHALTLRGLHALAFSGLHALAFRGLNVLTFKVLCAFISKGLHVLAFRGLHALAFRGLLALSFRGIHALAFRGLHVLTFRGLHALAFGGLHVLIFRRLHILAFRGLHVLTFIGLHALTSRGLHVLPFRGLHVLAFRGLHALAFRGLHALAFRGLHVLTFWVLVPSPLEDYMSSPSEGLHILSFRGLHVLAFRGLQTLTLEDYTPPPSEGYASSPSVGYTPSPSDDYIPRLQRATCPRLQRTTHPRLQRAALVSFYQFLGHPRDLKGGPTVQCTTRGWGRDRARKTPSGPEEVQQGLGVLALIMGLCQFYGVPVAPNKVIRARHHGSLGTASSWRQMHHHHLQNPPQLIYKGWNIAYDTWPTIGRPTTQAGRAPLKRIPVWPHKLTQALTNTDSRAWNINSISRPSKD

SEQ ID NO: 192404 - protein, 60 aa, Glycine max
  Coding DNA Sequence Number=SeqID_75626
MGENEWSRHQRLFEENIRKTKKRSVNFENEGSGVVYAWGRKIDFNCEQKSFKALDLETMF

SEQ ID NO: 192405 - protein, 423 aa, Glycine max
  Coding DNA Sequence Number=SeqID_75627
  Gene Ontology: Mol. function=sequence-specific DNA binding; Cellular component=intracellular; Biological process=response to DNA damage stimulus
  Homolog annotation: Hit_ID=Q4UTB0; Match level="QueryCoverage=98%, HitCoverage=50%, E-value=9e-98, Identity=59%"; Hit description=DNA ligase
  Pfam annotation: Domain name=DNA_ligase_ZBD; Domain location=3-31; Score=49.3; E_value=1.3e-11; Accession=PF03119.7; Description=NAD -dependent DNA ligase C4 zinc finger domain
MPTRCPVCGSEIVREEGAAAWRCSGELSCPAQRKEAIAHFASRRAMDIDGLGDKYIETLVDAGIVKSVADLYRLSRDQLLHLKLVLDAEDPSALAAALKLHLSAEGSGAVLNAVLKLDGNDPGWRARALVQPASFEWNPKKIATKWADNLIAAIDASRAATLERLLFALGIEHVGESTAKALAQWFGDLELIRHLPWPLFKRVPDIGGEVARSLGHFFEQQGNQQAIDDLLQVGQVRISDVHAPSAKLREGLDLAQLLVESEIPGITRLRAEKLVAALPGAQAVLDAEHGQFVNAGLPDDTARGLAEWLDAEGHGAMLLAAEKCDAADPGQCAGAGRDRCGPAGRADRGTDRHPGAAHPRCRQGAPGGAGREGLRQRLEEDQLCGGRYRGRLQAGQGTVAGRAGVGRRPPAGLSCRTRMMTPP

SEQ ID NO: 192406 - protein, 100 aa, Glycine max
  Coding DNA Sequence Number=SeqID_75628
  Gene Ontology: Mol. function=unspecific monooxygenase activity
  Homolog annotation: Hit_ID=Q6I666; Match level="QueryCoverage=63%, HitCoverage=98%, E-value=3e-26, Identity=78%"; Hit description =Cytochrome P450 like_TBP
MNAWLHKPVSCDVPPQPNSPPDNVFRPDRPAEADLGSKKRGSAPLPIHGITPTYPTPLKSFHKVGLESSSTGSSFPADSAKPVPLAVVSLDSRQGQWESR

SEQ ID NO: 192407 - protein, 50 aa, Glycine max
  Coding DNA Sequence Number=SeqID_75629
VLCDFNVKVRFYPFLVLFDSQILDTDIAIDDGSVDLIASCKEGMTNSFDD

SEQ ID NO: 192408 - protein, 78 aa, Glycine max
  Coding DNA Sequence Number=SeqID_75630
EALEHTKKRDTGHQSVSFENKTGDSTVLKIGNSAKVVIKQDMKGRKHKYGFNNNKREKIVKKRVVDDETATNMSYMKS

SEQ ID NO: 192409 - protein, 750 aa, Glycine max
  Coding DNA Sequence Number=SeqID_75631
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q6RXY3; Match level="QueryCoverage=96%, HitCoverage=96%, E-value=0.0, Identity=70%"; Hit description=Beta xylosidase
  Pfam annotation: Domain name=Glyco_hydro_3; Domain location=73-322; Score=200.5; E_value=4.1e-57; Accession=PF00933.12; Description =Glycosyl hydrolase family 3 N terminal domain
  Pfam annotation: Domain name=Glyco_hydro_3_C; Domain location=372 -604; Score=287.0; E_value=3.5e-83; Accession=PF01915.12; Description= Glycosyl hydrolase family 3 C terminal domain
  Pfam module annotation: Pfam domain module=Glyco_hydro_3::Glyco_hydro_ 3_C; Domain location=73-322::372-604
MGSIFSPLTTIFLLLLLVLWGGEARDPFACDPKNTATKNLPFCKASLATGARVKDLIGRLTLQEKVNLLVNNAAAVPRLGIKGYEWWSEALHGVSNVGPGTKFGGQFPAATSFPQVITTAASFNASLWEAIGRVASDEARAMYNGGTAGLTYWSPNVNIFRDPRWGRGQETPGEDPILAGKYAASYVRGLQGTDGNRLKVAASCKHFTAYDLDNWNGVDRFHFNAQVSKQDIEDTFNVPFRMCVKEGKVASVMCSYNQVNGVPTCADPILLKRTVRGQWGLNGYIVSDCDSVGVFYNSQHYTSTPEEAAADAIKAGYEADVNGALLNTLTVQMRLGMYDGEPSSHPYNNLGPRDVCTQSHQELALEAARQGIVLLKNKGPSLPLSTRRGRTVAVIGPNSNVTFTMIGNYAGIACGYTSPLQGIGTYTKTIYEHGCANVACTDDKQFGRAINAAQQADATVLVMGLDQSIEAETVDRASLLLPGHQQDLVSKVAAASKGPTILVIMSGGPVDITFAKNDPRIQGILWAGYPGQAGGAAIADILFGTSNPGGKLPMTWYPQGYIKNLPMTNMAMRASRSKGYPGRTYRFYNGPVVYPFGYGLSYTHFVHTLTSAPKLVSIPVDGHRHGNSSNIANKAIKVTHARCGKLSINLHVDVKNVGSKDGIHTLLVFSAPPAGNGHWAPHKQLVAFEKVHIPAKAQQRVRVKIHVCKLLSVVDRSGTRRIPMGLHSLHIGDVKHSVSLQAETLGIIKS

SEQ ID NO: 192410 - protein, 180 aa, Glycine max
  Coding DNA Sequence Number=SeqID_75632
  Homolog annotation: Hit_ID=Q10MK8; Match level="QueryCoverage=92%, HitCoverage=92%, E-value=1e-19, Identity=34%"; Hit description =Expressed protein
MGNQVSEVRGKIVMWDGSVQEIEQPLTVAELMLEHPEQVVVELHSAVKQKRATPLPADNKLETNKVYLMLPIKRGKPVGLSGEDTRRILLILNSALHHSKFVPWLTRLCQNTTTIVEPQRKEITKQEQESCQLFFPEILEGRPEYLNRQVSGKGWKPTLDTIKENNIDRKLTHWLFLKTF

SEQ ID NO: 192411 - protein, 233 aa, Glycine max
  Coding DNA Sequence Number=SeqID_75633
MPKYDPEIVMEFYANAWPTKEGVMDKRSKVQGQPIPYDTDAINQLLGNPLILEEGQQCEYTARRRRDFVLSMAGKRLRVMHTNMMTLTQIWMTFLLSNILLSDHNSDLTLPKCQLVYNIMEHISVHVAQLILDAIHQFVGTKPPRHPVDPKNSNKALGFPALNIGLYHFYGAPITPTKHIRPPINRSFIEKYYMPRQEEARPADARGAAQGDGGRAEDDEDMVDLVHYFIGGD

SEQ ID NO: 192412 - protein, 351 aa, Glycine max
  Coding DNA Sequence Number=SeqID_75634
  Gene Ontology: Mol. function=RNA-directed DNA polymerase activity; Cellular component=extracellular region; Biological process=RNA -dependent DNA replication
  Homolog annotation: Hit_ID=Q1S4N5; Match level="QueryCoverage=50%, HitCoverage=35%, E-value=2e-44, Identity=51%"; Hit description =Peptidase M, neutral zinc metallopeptidases, zinc-binding site
MAFLQQEAQNIFKSLFQSIERCTPSSLVLHDIPKVSQDFHDSLLNLVTSEEVCFATFSMAPYKAPGVNGFQPIFYQSYWHIISDGVWRLVNKAFYTGSIPPKLDETLIVPVLKVDNPTSFRGFRSINLCNVIFNVICKVLVNRMRPHLGSIIGPLQSSFIPNGGTFDNAMITHYMHKKKGKYIGFTMLSGRVTSQDFAYVMDRINSKLAGWKGHCLNKAGMVTLAKSVLATSYTYTMQNLWFPEGICEEIDSIVRKFFLERYLQKEKCMLAPKVWSIIHQPHHLGVQMGEISLFFDKFMDDGPITQLIDYVHISCGRNVFQDYFDDVKESRVKQSIKQRFKNQVSSFKIQE

SEQ ID NO: 192413 - protein, 38 aa, Glycine max
  Coding DNA Sequence Number=SeqID_75635
  Homolog annotation: Hit_ID=Q1RUU7; Match level="QueryCoverage=97%, HitCoverage=6%, E-value=6e-14, Identity=97%"; Hit description =Tetratricopeptide repeat, putative
YLVLGKACCHLGLMEDAMVLLQTGKRLATAAFRRESVC

SEQ ID NO: 192414 - protein, 78 aa, Glycine max
  Coding DNA Sequence Number=SeqID_75636
  Homolog annotation: Hit_ID=Q1SDB1; Match level="QueryCoverage=41%, HitCoverage=5%, E-value=5e-08, Identity=75%"; Hit description =Tetratricopeptide repeat, putative
MHLDQTLEATEPGLLPLSKKEKEGDKIVHLYKKATKQRFLGGWRNQQLIASYFTGMERLNPDCESKFPTTAISRQNTP

SEQ ID NO: 192415 - protein, 346 aa, Glycine max
  Coding DNA Sequence Number=SeqID_75637
  Gene Ontology: Mol. function=heat shock protein binding; Cellular component=endoplasmic reticulum; Biological process=protein folding
  Homolog annotation: Hit_ID=Q1SDA8; Match level="QueryCoverage=99%, HitCoverage=99%, E-value=1e-154, Identity=77%"; Hit description=Heat shock protein DnaJ, N-terminal
  Pfam annotation: Domain name=DnaJ; Domain location=26-88; Score =138.5; E_value=1.8e-38; Accession=PF00226.21; Description=DnaJ domain
  Pfam annotation: Domain name=DnaJ_C; Domain location=224-345; Score =75.7; E_value=1.4e-19; Accession=PF01556.9; Description=DnaJ C terminal region
  Pfam module annotation: Pfam domain module=DnaJ::DnaJ_C; Domain location=26-88::224-345
MASPRANLLFLLWLLCYSLYAIAGKSYYDVLEIPKGASEEQIKRAYRKLALKYHPDKNPGNQEANKRFAEINNAYEVLSDSERRSIYDRYGEEGLKQHAAGGGRGGGGMGMEFQDIFASFFGGGPMEEEERIVKGDDVLVELDATLEDLYMGGSLKVWREKNVLKPASGKRLCNCRNELYHKQIGPGMFQQFTEQVCDKCPNVKYERDGHFITVDIEKGMQDGQEVLFFEDGEPIIDGESGDLRIRIRTAPHDLFRREGNDLHTTVTITLVQALVGFEKTVKHLDEHLVDISTKGITNPKQVRKFKGEGMPLHMSTKKGDLYVTFEVLFPNSLTEEQKTNIIAIID

SEQ ID NO: 192416 - protein, 1509 aa, Glycine max
  Coding DNA Sequence Number=SeqID_75638
  Homolog annotation: Hit_ID=Q1RUU9; Match level="QueryCoverage=41%, HitCoverage=46%, E-value=0.0, Identity=60%"; Hit description=BRCA1 C Terminus (BRCT) domain, putative
  Pfam annotation: Domain name=BRCT; Domain location=892-969; Score =16.6; E_value=0.061; Accession=PF00533.16; Description=BRCA1 C Terminus (BRCT) domain
  Pfam annotation: Domain name=BRCT; Domain location=989-1066; Score =32.4; E_value=1.6e-06; Accession=PF00533.16; Description=BRCA1 C Terminus (BRCT) domain
  Pfam annotation: Domain name=Lipase_3; Domain location=349-488; Score= 122.6; E_value=1.1e-33; Accession=PF01764.16; Description=Lipase (class 3)
  Pfam annotation: Domain name=Proteasome; Domain location=669-856; Score=262.6; E_value=8.1e-76; Accession=PF00227.16; Description =Proteasome A-type and B-type
  Pfam module annotation: Pfam domain module=BRCT::BRCT::Lipase _3::Proteasome; Domain location=892-969::989-1066::349-488::669-856
  Subcellular localization annotation: CTP_CleavageSite=61; ConfidenceScore=5.40e-01
METMCLKSGIVPTISISGSLDARANPSQVSTVGRSASDKPPQRSVFSRFSFWYPLESLWPRGNNSRYKGLALDDAVLSDNNAEAKAVGDDGTERQTGNWVLKILHVKSLWEGKQRDEEEGSVRDQTQTNYEEEEEVCECDACDEVEEAQFDRGSFSRMLRRVSLAESRLYAQMSHLGNLAYDIPRIKPGKLLKHYGLRFVTSSIEKKELAVAATAEKDPQKVQTDEKVDEKEERKDPKNGEYKISATAAYNIAASAATYLHSQTRSIFPLKSSNAVAGEGSLAGNNESLDSVNMLNTEVASLMATTDSVTAVVAAKEEVKQAVADDLNSSHSTPCEWFVCDNDQSGTRFFVIQGSETLASWQANLLFEPIKFEGLDVLVHRGIYEAAKGIYQQMLPEVHAHLKSRGSRATFRFTGHSLGGSLALLVNLMLLIRHEVPISSLLPVITFGSPSIMCGGDSLLEKLGLPKSHVQAITMHRDIVPRAFSCNYPNHVAELLKAVNGNFRSHPCLNKQKLLYAPMGNLLILQPDEKFSPSHHLLPSGSGLYLLCCPLSESNDTEKQLRAAQMVFLNSPHPLEILSDRSAYGSGGSVQRDHDMNSYLKSVRTVIRQELNQIRKAKREQRRKVWWPLLLPRGVDTSIVAGRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLTLQEAETIALSILKQVMEEKVTPNNVDIAKVAPTYHLYTPSEYYAGTFLVDDAVLCYTCGQVVHSTYSSRMFRGVRFVLRGFNPVAENQIRFKLVNGGGVDVGQYGGSCTHVIVDNIAYDDPVCVAARNDRKTVVTALWVEHSADIGMPVDATSVMYRPLKDLDGIPGAKDLIMCLTGYLRQDRDDIMTMVGLMGAQFSKPLVANKVTHLICYKFEGEKYELANKLGTIKLVNHRWLEDCAAVYFFSLKEWVLLPEDKYNKSGFELETMVEEAKDSEEEAEDSKLGQSGGRNRKQSPLGSKIGIAATPGLSKSVREASKALPDSTGLQVLPNVNNGENSLTIPGNKSRPDQDSSFHNVDDSKISYWASDVSRHSISCQLPDKYVKISESKNADSPKAPGCQDLGNMGNTNSSGQKPALHGDISESKKLTSDLRAPSASAVGVAHSNEKLRTVSYSTKNQNGFTLPRILDESSGREGNNCDNNKVKRASKGVKSISVEVSGKGNDFIKEDEPISLLPQKRINEASFTKLKSRKKTCVPSANGKSQGLKVTSQVDEPPEVDDYFSIGKDGINNSNTCLVLKPSGSTSNSLAFDELFSRNANPESVQCDNVCQNSPKTAVQSLSESKINGKPDITDSGMQQVDGDEAEQHNVTRNLDCSSLGNKKSCNVESAGCTKLDLITEESNKL

SEQ ID NO: 192417 - protein, 75 aa, Glycine max
  Coding DNA Sequence Number=SeqID_75639
CPGNDCSLFWVRSAGSGLDILQGGMGDTSLLGWLRRKVYQHGIIISIVIWNAWCARDRLIFENQARNLLWGVFAF

SEQ ID NO: 192418 - protein, 136 aa, Glycine max
  Coding DNA Sequence Number=SeqID_75640
MMYKKDILIKILVIRLYDSIKDQFFSTRHKKGSLTWNSITKAMDCLDEGFSIKMGERVWIFCMTLGFLRNRWLLRCLGWIFMMWGIQSKTFGRKMVGGWRSFNYTLLPDDVKQNILTLCPKFVPSMPDVWIWNWNT

SEQ ID NO: 192419 - protein, 94 aa, Glycine max
  Coding DNA Sequence Number=SeqID_75641
  Gene Ontology: Mol. function=DNA binding; Cellular component=nucleus; Biological process=regulation of transcription
  Homolog annotation: Hit_ID=Q1SDA6; Match level="QueryCoverage=92%, HitCoverage=24%, E-value=3e-43, Identity=89%"; Hit description=Myb -like DNA-binding domain, putative
  Pfam annotation: Domain name=Myb_DNA-binding; Domain location=14-61; Score=44.0; E_value=5.2e-10; Accession=PF00249.21; Description=Myb -like DNA-binding domain
MGRAPCCEKVGLKKGRWTAEEDEILAKYIQANGEGSWRSLPKNAGLLRCGKSCRLRWINYLRADLKRGNISAEEENTIVKLHASFGNRLVPVAY

SEQ ID NO: 192420 - protein, 129 aa, Glycine max
  Coding DNA Sequence Number=SeqID_75642
MEESQALGIIASNDFFLGVWNLYCRKLLPEVQQSRNNCCYHKLLSEIEEKRGWWLRLRKRGKSTVLIKCQKSQNCEFRELKLRNEVQDQTINQLFLNGLLGVKENTHHLQRQDTKACYALLFVKGFNKK

SEQ ID NO: 192421 - protein, 89 aa, Glycine max
  Coding DNA Sequence Number=SeqID_75643
MVKINPYFRNSNVKLKLKVTSIDETQLTYHFQNTPSANLTMIGPARLASREVAKKGSLKAMLDLRVRVGEEEGGVDVAKDERRLLNKNE

SEQ ID NO: 192422 - protein, 62 aa, Glycine max
  Coding DNA Sequence Number=SeqID_75644
  Subcellular localization annotation: CTP_CleavageSite=29; ConfidenceScore=5.26e-01
MQPWVHQKANLPMTRVNPLSAKSGNWAKRASTAKCNFSALSVKENLAKHQHQGHALSARSVR

SEQ ID NO: 192423 - protein, 193 aa, Glycine max
  Coding DNA Sequence Number=SeqID_75645
MGLKNRGVGHRAWSLLRASLLWARKGGLLRRRVAMELRLVPKYLKRLGHTAPPPSHIHYFERELSFDKTPIFHVKMYRPTSMRFHLPHIPCIKPHVDFDYDFNDDGNVEYDTGRKSALMDAGDSRDQEFCHDYYEGCQEMMGCGEEEEEQQADAQGIDKQAEEFIAKFYQQMRLQRQISLLEYNETPRSDTSC

SEQ ID NO: 192424 - protein, 570 aa, Glycine max
  Coding DNA Sequence Number=SeqID_75646
  Gene Ontology: Mol. function=CTP synthase activity; Cellular component=cellular_component; Biological process=pyrimidine nucleotide biosynthetic process
  Homolog annotation: Hit_ID=Q1T4Z9; Match level="QueryCoverage=92%, HitCoverage=90%, E-value=0.0, Identity=85%"; Hit description=CTP synthase
  Pfam annotation: Domain name=CTP_synth_N; Domain location=1-306; Score=641.9; E_value=5.4e-190; Accession=PF06418.4; Description=CTP synthase N-terminus
  Pfam annotation: Domain name=GATase; Domain location=330-549; Score =149.4; E_value=9.6e-42; Accession=PF00117.18; Description=Glutamine amidotransferase class-I
  Pfam module annotation: Pfam domain module=CTP_synth_N::GATase; Domain location=1-306::330-549
MKYVIISGGVVSGLGKGVTASSIGVVLKACGLRVTSIKIDPYLNIDAGTMSPFEHGEVFVLDDGGEVDLDLGNYERFLDVTLTKDNNITTGKIYQVLACFCFALLYVCNGYGIWNSLSVLEKERKGDYLGKTVQVVPHITDAIKDWIESVAVIPVDGKEGPADVCVIELGGTVGDIESMPFIEALRQLSFQVGPDNFCLIHVSLIPVLGVVGEQKTKPTQHSVRELRALGLTPHLLTSRSAEPLLESTKEKLSKFCHVPVENILNIHDVPNIWHIPLLLRNQNAHHSILHQLNLLSQATPPDLQQWTEMAETYDNLTESVRIAMVGKYVGLTDSYLSVVKALLHACVARSFKPSIDWIAASDLEDDSAESTPEAHAAAWKTLKSAACVLVPGGFGDRGVRGMMLAAKYARENNIPYLGICLGMQISVIEFARSVLGWERANSVEFDAQTPNPVVIFMPEGSRTHMGSTMRLGSRRTLLQTSNCITSKLYGNSEYVDERHRHRYEVNPDVIGTLEEAGLKFVGKDESGKRMEAEWKLIYDLLLEGSLLQYFSRVNWYSKGKIIGEREGSGN

SEQ ID NO: 192425 - protein, 195 aa, Glycine max
  Coding DNA Sequence Number=SeqID_75647
  Gene Ontology: Mol. function=cysteine-type peptidase activity; Cellular component=nucleus; Biological process=proteolysis
  Pfam annotation: Domain name=Transposase_21; Domain location=89-191; Score=-39.3; E_value=3e-11; Accession=PF02992.5; Description =Transposase family tnp2
MGDRLEEMIHDLGHESFHLVNVKAKYGWSDKSFTSLLQVVQDMLLEENTLPKKMSLKKCITTKCGVSWYKVKDDDECSSDESTKKVPPTKVLWNYNGMLHHPADSSQWKKINSLYSEFGKEARNLTLGISSDGMNPYGNPRQLGNDIDVYLTPLIEDLRKLWDEGVVVFDGTLLNIQGKTKDGLNTRQDLVEMGI

SEQ ID NO: 192426 - protein, 226 aa, Glycine max
  Coding DNA Sequence Number=SeqID_75648
MDFFSNESFECIQAFENSNLIPFMSLKLHVYTELVKAFYSNLEIQEGTLISKVYGIEMVIAQSHFYDLTQLSSKGVPFEGTLNDDWKFDFSVHDARRLVCTNQADMTERLLPSSLAFESHILHYLIVQILLPRSSNLAQYNRGYISCGSVQVKGTSTWLIQREQGRVHPLWIFACKGFYKVEKKSQGLQVAWGLEVGTGCYRTMITPRGNPTSCNEPQGTFLLCVQ

SEQ ID NO: 192427 - protein, 66 aa, Glycine max
  Coding DNA Sequence Number=SeqID_75649
MESRAMQSLLDLRVVREDTSRHQVIQQALQLLQEGLAVGCSSDTQRHKKRPNKDSGKGDKKGGRGG

SEQ ID NO: 192428 - protein, 137 aa, Glycine max
  Coding DNA Sequence Number=SeqID_75650
MKLAKYRLKARVEKDKAPEWRRMKAQVEKDEGPNNPCGVYPDLSSFTGSGVYPDLSSFTGSGVYPDLSSFTGSGVYPDLSSFTGSGVYPNLSSLFGSGVNQKLYSLYQTIHPVRFTSSGMRASALDTGSILSYYFSL

SEQ ID NO: 192429 - protein, 79 aa, Glycine max
  Coding DNA Sequence Number=SeqID_75651
SWAWYRMPFIAPRVPRPETTYPLAKRWSGDRLKYRVTPHGDLVRYRSRIDHMEGHEFSWVPYRGFEEQLSRHAYRDMEI

SEQ ID NO: 192430 - protein, 124 aa, Glycine max
  Coding DNA Sequence Number=SeqID_75652
  Pfam annotation: Domain name=DUF567; Domain location=2-113; Score =11.2; E_value=1.7e-05; Accession=PF04525.3; Description=Protein of unknown function (DUF567)
GGMLEALSIYKKWKGYSLDYEGSRKLMFSLRESNSCFVKNNAIRIFTRNRGCDFKISGCFPDKCCSIVDSKGNEVAQVRMMKEVEKLIESKDLYHVVVNPGMDQAFVFGVIAILDYIYGESTHC

SEQ ID NO: 192431 - protein, 57 aa, Glycine max
  Coding DNA Sequence Number=SeqID_75653
MKEGSRVQRFESPLGKASGKASDIWEITQVILGEAFGQEKLLLWKVHGGGWEGPVAS

SEQ ID NO: 192432 - protein, 143 aa, Glycine max
  Coding DNA Sequence Number=SeqID_75654
  Gene Ontology: Mol. function=DNA binding; Cellular component =mitochondrion; Biological process=DNA integration
MFRRAISRPLLKCVDEDHTEYVLNEVHRRICQMHTRGRSMATRVIRVGYYWVTLRVDNAEYIKTYKECQEFNNVHHAPPEALHNMTSPWPFAIMARINLKTWQEGSSLGLGLQLDVILTRNGSLDTGHRVWMTPLPERENKSG

SEQ ID NO: 192433 - protein, 283 aa, Glycine max
  Coding DNA Sequence Number=SeqID_75655
  Gene Ontology: Mol. function=transporter activity; Biological process= transport
  Homolog annotation: Hit_ID=Q1RF90; Match level="QueryCoverage=93%, HitCoverage=54%, E-value=4e-64, Identity=47%"; Hit description =Hypothetical protein ybaE
AGASVLPAAASGACRYRQRTVAPDALYPRAGAAGEPCALAPSASADSGGGILDYAAAIRSRAGHQLSPSGADRHWRSQRAGHAAAGGSQHQSRFLLPGAALNYTNRRAAARLAAARPAPPGGHTARNADAALSPAHRTARHGPGAGAAAGGTGLWRDDIDLSDADIIMGDRLIGDAPQFTLVNWLENDAAWQPLRPAVLQAPLHAIARQASPALRSAAIHQLFQQLMRDGHLLPLFNYRYQVFAPPGVEGIQLNSMGWFDFTRAWIPPPAAGGAVQPAPEPVP

SEQ ID NO: 192434 - protein, 813 aa, Glycine max
  Coding DNA Sequence Number=SeqID_75656
  Gene Ontology: Mol. function=peptidyl-prolyl cis-trans isomerase activity; Cellular component=integral to membrane; Biological process=protein folding
  Homolog annotation: Hit_ID=Q8ZRB8; Match level="QueryCoverage=50%, HitCoverage=65%, E-value=1e-146, Identity=64%"; Hit description =Peptidyl prolyl isomerase
  Pfam annotation: Domain name=4HBT; Domain location=519-603; Score =62.1; E_value=1.8e-15; Accession=PF03061.12; Description =Thioesterase superfamily
  Pfam annotation: Domain name=Acyl-ACP_TE; Domain location=379-612; Score=-121.9; E_value=0.05; Accession=PF01643.8; Description=Acyl -ACP thioesterase
  Pfam annotation: Domain name=Rotamase; Domain location=64-145; Score =70.1; E_value=7.2e-18; Accession=PF00639.11; Description=PPIC-type PPIASE domain
  Pfam module annotation: Pfam domain module=4HBT::Acyl-ACP _TE::Rotamase; Domain location=519-603::379-612::64-145
DDEINQYYQQHQSSFMAPEQFRVSYIKMDAASLQENASEADIQSWYDQHKADYSQPQRNRYSIIQTKTEADANAVLDALKKGEDFATLAKSKSIDPISARKGGDMGWLEPNTTPDELKNANLTQKGQLSGVIKSSVGFLVVRLDDIQPEQVKPLAEVHDAVADKVKQEKAVDAFYKMQQKVSEAASNDNESLAGAAQASGLKVVETGWITRDNVPADLDFDAVKQAIFNGGLTGQNGAPGNNSDIISVDGDRAFVLRISEHKPEAVKPLDQVKAQIADSLKHDKATQQAKAQADKLLTELKAGKQDALQAAGLTLSASKTVDRNAQDPVAQAAFNLPQPADNQPSWGVSEDMQGNVVLVALDKVSAGNMPQAQIDEMVKGVTQNNAQIAFEALLENLRKEAKIKYGAAAQNHAFLACATLQWLSNTRRNTACGLAAAESPSETQATQVSTPQPEQVSINQATAEQLAAAMNGIGLKKAQAIVSYREQYGPFSAIEQLKEVPGAIMQTTIKVRGYHLDVYQHVNNARYLEFLEEARWQWLEDADAFHWLLEQQLAFVVVNININYRRPAVLGDVLHIESEVSQLNGKSGIILQRVVLAVDNTLVADAALTFVCIDLRTQKTVPLEARQPAARPQSAQAAFLFHRRHHAGRIGLVIGQTARAQVAGRALTTAVAFNAVVAGFCFIQPHQRRFKTHVTRHAESNGVIQRFDELVTAIRVAGKSVSHTAGQRQKQDVTPRDKGAGQAAGLWIVGRHRNVIARQAADRQFIKQRYVQHFVRPRAQLVRQLCGDADLFAMALTIIKAPESDRWWSLVRH

SEQ ID NO: 192435 - protein, 600 aa, Glycine max
  Coding DNA Sequence Number=SeqID_75657
  Homolog annotation: Hit_ID=Q8ZRB4; Match level="QueryCoverage=40%, HitCoverage=51%, E-value=3e-66, Identity=55%"; Hit description =Putative ABC superfamily (Atp) transporter
  Pfam annotation: Domain name=AsnC_trans_reg; Domain location=223-299; Score=106.0; E_value=1.1e-28; Accession=PF01037.11; Description=AsnC family
  Pfam annotation: Domain name=HTH_11; Domain location=162-216; Score =3.2; E_value=0.041; Accession=PF08279.2; Description=HTH domain
  Pfam module annotation: Pfam domain module=AsnC_trans_reg::HTH_11; Domain location=223-299::162-216
MAVEFTRQTLGFAVQLARIGDEVALPAVKADQLDFAPCGTGWHHGDKRQAEQTGKIGFRHRGAAGGGFDDRRVFSNPAIGQTIEKQRTRQAMFQAAAWMGAFILKIKANAGEIVQRKTDQVRISGALKVGVNFIDSVANPGRLHGAIPAARLRSVWRMLDKTDRTLLALLQKDCTLSLQALADAVNLTTTPCWKRLKKLEDDGIIRARVALLDGEKLGLSLTAFMLIKTQQHSSAWFQQFVAVVQQMPEVMAFYRMAGEYDYLLRIQVADMKSYDAFYKRLVNGVPGLIDVTSSFAMEEIKYTTALPPVKLVFFARVAALSGRHQLADYHCAAATAASASVIVYLLRYVWRVLLFGASYQLAVELREDFYRQLSRQHPAGADAGGFAGDGAGRAGGNERADQLGADTAGADSHADYGAGDSERRRAPASALQSGAGGVLQPERSNAGESDQHPHDQSLWPGRSSVEPVCRYRQRHRPQKSARGARRCALRSHHLYCRGLFESAGDWRWRLDGLMIWPMLALAWMINIVERGSAAWSRIGALLAEAPAVEDGGDPRLPLSGEQRAGAEQRAFPATTGADAWAVRAYRLRQKHAAEPDSAPF

SEQ ID NO: 192436 - protein, 173 aa, Glycine max
  Coding DNA Sequence Number=SeqID_75658
  Gene Ontology: Mol. function=pyridoxal phosphate binding; Biological process=metabolic process
  Homolog annotation: Hit_ID=Q7CK24; Match level="QueryCoverage=98%, HitCoverage=49%, E-value=7e-56, Identity=59%"; Hit description =Putative cysteine synthase
MAHEPFPVPHTLIMSAGTGGTSATLGRYIRYQGHDTRLLVVDPQHSVFFDYWHSRDRTLRSERGSLIEGIGRPRVEPSFLPDVIDEMMKVPDGATVAAMLRLEQILGRRPGASTGTNFWGMLQVAKRLRAQGQSAALVTLLCDSGERYPDTYYNPQWVAEQIGDIQAWQRELQ

SEQ ID NO: 192437 - protein, 204 aa, Glycine max
  Coding DNA Sequence Number=SeqID_75659
  Gene Ontology: Mol. function=ATPase activity, coupled to transmembrane movement of substances; Cellular component=integral to membrane; Biological process=transport
  Homolog annotation: Hit_ID=P0AAG5; Match level="QueryCoverage=96%, HitCoverage=33%, E-value=3e-81, Identity=78%"; Hit description =Multidrug resistance-like ATP-binding protein mdlB
  Pfam annotation: Domain name=ABC_tran; Domain location=1-163; Score =105.1; E_value=2e-28; Accession=PF00005.17; Description=ABC transporter
MGYYPVTRGSIELDGRPLRQLTHDALRGSVAMVQQDPVVLADTLLANVRLGRDISEEDVWRALEKVQLAPLARAMRDGIHTRLGEQGNTLSVGQKQLLALARVLVSLPQILILDEATANIDSGTEQAIQQALRTLRQHSTLVVIAHRLSTITEADQILVLHRGQVVERGTHTELLAQQGRYWQMYQLQQAGDELAAGIPATAEG

SEQ ID NO: 192438 - protein, 108 aa, Glycine max
  Coding DNA Sequence Number=SeqID_75660
RQVQGDAPQAADAPPPHQAGPAGSFDTEQYLWHLVRQQAANHRAHSQGFTSFPCPTPDQFRAEIVWPGNWPEARAGEAPAEAPDEADEVREDEEMTDLLDFLGGSEAT

SEQ ID NO: 192439 - protein, 44 aa, Glycine max
  Coding DNA Sequence Number=SeqID_75661
MQVSSPGRATLARNGLKSGKGEGDGLRPRVHSEIMGHVALPPFP

SEQ ID NO: 192440 - protein, 59 aa, Glycine max
  Coding DNA Sequence Number=SeqID_75662
MAPRKLSAKRSRRDAAAEGTSATPEFDSHRFRSAEHQQRFEAIKGWSFHRERCVQLRDD

SEQ ID NO: 192441 - protein, 48 aa, Glycine max
  Coding DNA Sequence Number=SeqID_75663
MEKAHFIFLSSPKNASGEAHPNRGVRSYEHKLVPLISFLLQTKVKDDI

SEQ ID NO: 192442 - protein, 102 aa, Glycine max
  Coding DNA Sequence Number=SeqID_75664
  Gene Ontology: Mol. function=nucleoside-triphosphatase activity; Cellular component=membrane
  Homolog annotation: Hit_ID=Q4K586; Match level="QueryCoverage=58%, HitCoverage=25%, E-value=2e-09, Identity=51%"; Hit description=ABC transporter, ATP-binding protein
  Pfam annotation: Domain name=ABC_tran; Domain location=2-72; Score= -53.2; E_value=0.0088; Accession=PF00005.17; Description=ABC transporter
MQRRAGTLSVGQQQRVAAARALIGRPTLLLADEPTSALDREAASAFLQLMSAQCQAAGTTVLVPAQPRVERGPDRAGHHPQRGAAAGRRACTHAGARGFAST

SEQ ID NO: 192443 - protein, 60 aa, Glycine max
  Coding DNA Sequence Number=SeqID_75665
MWVQAIGLFAQATCAPKFGLPRPFNQRLLVLHVGGERSELSRIGCWTNGLSYLKKGGGVD

SEQ ID NO: 192444 - protein, 178 aa, Glycine max
  Coding DNA Sequence Number=SeqID_75666
MASRKCKSIGLGPTTQYDTRRFSSLNTWNRYTDNVLGRNIFPERKVELYHTKLNDFKTELERCNFRKCLTNLVNGSIDLALVKEFCANLYSSEGPSPKQSRVRGHLVKIDAGSINTFLETPVVLAEGETLPTYSRYYRLPTDYREIEAALCILGRGFILNTEGHPRKILKKDLTTLAQ

SEQ ID NO: 192445 - protein, 83 aa, Glycine max
  Coding DNA Sequence Number=SeqID_75667
MEVLRIYYLSLIKNEVRHKTVSQPTHRREGDARAHGCVFQGRKTHGVATNVYSRKMSEKPEKTWSMNFKCERFRSCIYMRGRY

SEQ ID NO: 192446 - protein, 186 aa, Glycine max
  Coding DNA Sequence Number=SeqID_75668
  Pfam annotation: Domain name=zf-CCHC; Domain location=119-136; Score =21.6; E_value=0.00027; Accession=PF00098.13; Description=Zinc knuckle
MERKTRKRRKRKREGIHRSHLRPHSHRREKERKPQEANINLPYFHGKDNVEANLDWEIRVEQQLKRKSTLKSYGSHSYPKKDQGQGILGVTPSKPKYDKGKTIEEQPLKASMQEKTSSMKCFKCLGRGHITSQCPTKKTMIMRSQEIYSSQDEATTSPSSSESEEAKEEESSEEIYPSRRRTTFNG

SEQ ID NO: 192447 - protein, 82 aa, Glycine max
  Coding DNA Sequence Number=SeqID_75669
MEEFDAQVAWLGDQPSSSGGGGASAAQEPDIEKPPAPAEEETTPEETQPSISVAEPEQAIKDSSAAPTLDLNEDQPQEEQDV

SEQ ID NO: 192448 - protein, 78 aa, Glycine max
  Coding DNA Sequence Number=SeqID_75670
MYIVVVKQGQDHLGLPSGVETKHERQKPIKALKDERKRGWGHDRPIVALLCAKQAGNVAARQPRILCILQLSFTICLF

SEQ ID NO: 192449 - protein, 363 aa, Glycine max
  Coding DNA Sequence Number=SeqID_75671
  Gene Ontology: Mol. function=nucleic acid binding; Cellular component= mitochondrion; Biological process=DNA integration
KAVGCKWVFRIKENADGSINKYKARLIITLALTNNWGLFQLDVNNAFLNDLLDEIVYMVQPSGFEVEDKSFVCKLNKALYGLKQAPRLWFDRLKITLIQFEFQASKCDPSFHQITTQLNSAFSLKQLGQLDYFLGFEIKYLPDRSFLMTQGKYIKDLLHRTHMAEAHSISSHMAFSCKLSKIGGDLFQDPTLYGSTVGALQYATLTRPKIAFAGTLSYGLLMKPAAVGKPLSITAMCDADWASDVDDRRSTSGSTIFLGPNLISWWSRKQQELQVPFSTPILLCDNQSAVASAHNPVFHSKTNHMEIDVFFVREKVLSKQLLIYQMPTLNQWTDILTKPLSSTRFELLRGKLNVQHFSSNPPP

SEQ ID NO: 192450 - protein, 37 aa, Glycine max
  Coding DNA Sequence Number=SeqID_75672
MFRNPNRAIEGGALESTRNITIDNGEGLSDYIKLMSQ

SEQ ID NO: 192451 - protein, 141 aa, Glycine max
  Coding DNA Sequence Number=SeqID_75673
MAIGRPEHPVRVRGAGTGVTITQYFGPSSRWSTTSSNITVEQLADIIAPLQPNDIQVLAARVSTKGSCATAETNALAKKPSQLNGDNVRLHVTAENSNKLVAVGKQCDSFGTIHNVPYADDVVHVSVVEVIFGDAEVPIPT

SEQ ID NO: 192452 - protein, 81 aa, Glycine max
  Coding DNA Sequence Number=SeqID_75674
MDIDYAIRKDESSAITDESSPAAVALYERCEQSNRLNVMFIKTKIPTRIRNSIDQHEKVHNVNARYFSSVMTRLVAMVSTL

SEQ ID NO: 192453 - protein, 176 aa, Glycine max
  Coding DNA Sequence Number=SeqID_75675
MNILTAHDQEWEKELSPYNQYEEERTLNLESVFEEFRAYHASSKANQNLMKNHEIHFGTSYSIENFQGRPELQPYYQNEVERGSNLDKLLMQFMETTKSTQQALQSVEIQVGELAEAVTQFMSRQEKSFVEVEANDLLHQWIPLLLGRGMAAEWRKEGREETPLQGEDESRRSSPP

SEQ ID NO: 192454 - protein, 140 aa, Glycine max
  Coding DNA Sequence Number=SeqID_75676
MTLVSACYRTLSLTDSEKLGISTCHLTSRVWMTETVCTDNCLGISVRYLTSWVRMTEGAEDDMTTLASACQSNLGSPNDAVWITGRCFRMLPDSWVMIEKGGVVDKSEVFAPMYPPFVMRNSGLRSSFKSETKIVSVFSH

SEQ ID NO: 192455 - protein, 170 aa, Glycine max
  Coding DNA Sequence Number=SeqID_75677
  Gene Ontology: Mol. function=helicase activity; Biological process =viral genome replication
  Homolog annotation: Hit_ID=Q6YTQ6; Match level="QueryCoverage=91%, HitCoverage=15%, E-value=1e-30, Identity=37%"; Hit description =Helicase-like protein
MFHPQTVLDSNGYPIYCRRNDGRTISRNGVINRYIVPYNEKLLRKYQAHINVEWCNQNTSIKYLFKYINKGYDRVTAVVIHDDNGTLENAISQNDEIKEYVDCRLIWVPPTTGELFYLRMMLTACKGATSFEDIRTVENVLYPTYREACFAMGFLQDDREFVEAIKEAKD

SEQ ID NO: 192456 - protein, 149 aa, Glycine max
  Coding DNA Sequence Number=SeqID_75678
  Gene Ontology: Mol. function=DNA binding; Cellular component =mitochondrion; Biological process=DNA integration
VEAANKVVLNALAACIEHTRMSWVDEGPWILWCYHTTLYSLTHELPYTLVYETDAMTPVKVVEPTFKVNIFHEEQSDVDQLVDLDMVGEVRGIMPVQEEAADLRAKQRYNSQVVPWEFKEGDLVMKRAQPNQIVNKLSPKWVGPYWVHQ

SEQ ID NO: 192457 - protein, 48 aa, Glycine max
  Coding DNA Sequence Number=SeqID_75679
  Gene Ontology: Mol. function=structural constituent of ribosome; Cellular component=ribonucleoprotein complex; Biological process =response to antibiotic
  Homolog annotation: Hit_ID=Q9XQE1; Match level="QueryCoverage=86%, HitCoverage=49%, E-value=1e-10, Identity=78%"; Hit description =Chloroplast 30S ribosomal protein S12
MTSKELNEEPYEVKISWGRVKDLPGVRYHIVRGTLDAVGVKDRQQGRS

SEQ ID NO: 192458 - protein, 137 aa, Glycine max
  Coding DNA Sequence Number=SeqID_75680
MLHPNFIRGPLLIASEGLTPIAVESVKFSEVSEGKQPKNTKMGGSNLARLGGNLLPIFYINRPRGAVPKENPSQGASITLPRRFREQFCEDFPSFFNRLPSLVTDAWGVSYPNFVRGPLLDDMRPFFGTCEVLGTHH

SEQ ID NO: 192459 - protein, 218 aa, Glycine max
  Coding DNA Sequence Number=SeqID_75681
  Gene Ontology: Mol. function=protein translocase activity; Cellular component=integral to membrane; Biological process=protein secretion
  Homolog annotation: Hit_ID=Q6D128; Match level="QueryCoverage=51%, HitCoverage=85%, E-value=3e-26, Identity=53%"; Hit description =Putative membrane protein
MKRSTALTSLLLSVGLLSTGAQSAELAPADRVTPLRGGAGHRPHRRPARRQLLPHPADGRTGAPAWLARLGHLIPLIAHASRIQHAAADGDAPQENPGGQVVRFDLVADAWHVDLHGREQQQLHHQRHHAPQQVIQQADRVDRRAGQRDHIPQASADESKGGGLVIGLDQRPFVVRGDAGIDEQKHQNHGETAEEVRGERRQRAENIHVHFPVRVRLN

SEQ ID NO: 192460 - protein, 342 aa, Glycine max
  Coding DNA Sequence Number=SeqID_75682
  Gene Ontology: Mol. function=ATP-dependent helicase activity; Biological process=regulation of transcription, DNA-dependent
  Homolog annotation: Hit_ID=Q4UWT9; Match level="QueryCoverage=99%, HitCoverage=29%, E-value=1e-130, Identity=72%"; Hit description =Transcription-repair coupling factor
  Pfam annotation: Domain name=CarD_TRCF; Domain location=180-277; Score=172.6; E_value=9.8e-49; Accession=PF02559.6; Description=CarD -likeTRCF domain
TGERYEQRRHDVERPLLPPSALYLSPELLRERLNDAPRIEVWSADHARIADAHALGDQPLPPLPVAAREAPAGDALKSFLGHYPGRVLIAADSPGRREALLEVLQAAELKPPVVADLPSFLADDARFAIAVAPLEDGFALDDPRIAVLTERQLFPERAGSTRRTRRAGREPEAIIRDLGELTEGAPIVHEDHGVGRYRGLIAMDVGGMPGEFLEIEYAKGDRLYVPVAQLHLISRYSGASAETAPLHSLGGEQWSKAKRKAAEKVRDVAAELLEIQARRQARAGLALQVDRAMYEPFAAGFPFEETPDQLAAIDATLRDLASSQPMDRVVCGDVGFGKTEVA

SEQ ID NO: 192461 - protein, 138 aa, Glycine max
  Coding DNA Sequence Number=SeqID_75683
  Gene Ontology: Mol. function=transition metal ion binding; Cellular component=endoplasmic reticulum; Biological process=electron transport
  Homolog annotation: Hit_ID=Q1SHH9; Match level="QueryCoverage=79%, HitCoverage=76%, E-value=3e-35, Identity=64%"; Hit description =Cytochrome b5
  Pfam annotation: Domain name=Cyt-b5; Domain location=8-77; Score =33.8; E_value=6.1e-07; Accession=PF00173.18; Description=Cytochrome b5-like HemeSteroid binding doma
MRMFWQKYLDIPPMLTQAYTTLFYLVYDVTPFLDDHPGGDEVLVTATEKDATTDFEDIGHSDSATEMMEKYFVGEVDTNTLPAQVTSSSSVRPPTQAPVYNNQSSGFVVKILQYIVPLLILAFAFGLQYYGKKSKSEN

SEQ ID NO: 192462 - protein, 119 aa, Glycine max
  Coding DNA Sequence Number=SeqID_75684
MYKTKSIISSLRLLRKTNHITVEETEMGSKTKTFTFEEVAKHNHRKDCWIIVKGKHDMYGCNDGVIGMPDKDEDETAITVGECNLKPYSEFDKICVYASPRRITKFKTDFIVTLVLNRI

SEQ ID NO: 192463 - protein, 108 aa, Glycine max
  Coding DNA Sequence Number=SeqID_75685
  Homolog annotation: Hit_ID=Q1SKD7; Match level="QueryCoverage=89%, HitCoverage=25%, E-value=6e-10, Identity=33%"; Hit description =Ankyrin
MAPRKLSAKRSRRDAAAEGTSAALEFDNHRFRSAEHQQRFEAIKGWSFHRERRVQLKDDEYTDFQEEIARRRWTSLVTPMAKFDPDIVLEFYANAWPTEEGVRDMRSG

SEQ ID NO: 192464 - protein, 286 aa, Glycine max
  Coding DNA Sequence Number=SeqID_75686
  Homolog annotation: Hit_ID=Q1XQD9; Match level="QueryCoverage=43%, HitCoverage=37%, E-value=2e-18, Identity=44%"; Hit description =Hypothetical protein precursor
MEGLANTDGVVAGFSTFGSMDYNDGTFLMQPGYDRGRTMTHEVGHFVGLRHIWGDSACGTDYCADTPTAHNANYTCNTTIPSCDDPAVFEMVQNYMDYTNDTCMNIYTNDQKIRIRAVMDNSPRRMELKTSTTDQAIPLFPNDAEIKYDGGCLVGGANCGAGVLRLVIYNRGTNNLTSAVVSYSFNGGAVQNYNWTAPEYFATTTVNFKLLRDKYGRETKWNLKNSAGQVIKSGAYSNTLAGQPSPTLITQTWTLPLDCYVFTISDDYGDGLSDGGYVDLSTSTGQ

SEQ ID NO: 192465 - protein, 152 aa, Glycine max
  Coding DNA Sequence Number=SeqID_75687
  Subcellular localization annotation: CTP_CleavageSite=90; ConfidenceScore=5.04e-01
MANPIPIRPWSRLASLRSSPAPESHPKPHTAEPSLKTTNIFSNDNNESATKSLSPTPPDVHIPIQQNLKPTTPITFPPTKLKAQAQLQTKISEEEGNIEKPNGNGNGIGQKNEKEMTTTENELKKEKGIQTKISGSGGQYGIRVITISGENK

SEQ ID NO: 192466 - protein, 243 aa, Glycine max
  Coding DNA Sequence Number=SeqID_75688
  Homolog annotation: Hit_ID=Q1SHI0; Match level="QueryCoverage=86%, HitCoverage=72%, E-value=1e-29, Identity=35%"; Hit description =Probable extensin [imported]-Arabidopsis thaliana, putative
  Subcellular localization annotation: CTP_CleavageSite=45; ConfidenceScore=5.37e-01
MANPIPIRAWSRLASLRSSSAPNPESHPKPHTSEPSLKATNTCSRDNNESATKSLPTSPNVHNPMHSQKLKLITPMTFPPAKLKVHPQPRVEVTIEKPNGNASLKTEPGEIQKQGNGPNEKQVTNIENETKGNGIQSKLSSSEGNGIRVITISGENRGAHMQITKSRKKQQQPIHHKMGNSDGEKVRTLSSPPMRGVYGNSNVQCVNNSMLFHTSLTNHDPGMHLIIPKKPIGQGFHLKERVG

SEQ ID NO: 192467 - protein, 111 aa, Glycine max
  Coding DNA Sequence Number=SeqID_75689
MTMMSMRKMMEDNIATVVAASTATEMDRIHPTSFNKVQSKHFFLPYRLPPNYTPPTVVNDSGENINNSAPLLIENQQPQSDHAHDSQPMGETHEVPQDIPLKGRHFLASLC

SEQ ID NO: 192468 - protein, 83 aa, Glycine max
  Coding DNA Sequence Number=SeqID_75690
  Gene Ontology: Mol. function=DNA binding; Cellular component=nucleus; Biological process=regulation of transcription, DNA-dependent
  Homolog annotation: Hit_ID=Q6R074; Match level="QueryCoverage=48%, HitCoverage=15%, E-value=3e-13, Identity=78%"; Hit description=MYB transcription factor
  Pfam annotation: Domain name=Myb_DNA-binding; Domain location=17-58; Score=19.5; E_value=0.012; Accession=PF00249.21; Description=Myb -like DNA-binding domain
MAGHMGRGVIEEQVWRKGPWTAEEDRLLVEYVRLHGEGRWNSVTRLATNKNSEYFNILTLTVARSRHHSKEHDFSYGGGGNNR

SEQ ID NO: 192469 - protein, 70 aa, Glycine max
  Coding DNA Sequence Number=SeqID_75691
ELEQENETLKGKIAQQSRELFIQNQRMIEKDDLLRRKDVLLHQDARRKRKFMDLFSRAHSDSEDPFTPGV

SEQ ID NO: 192470 - protein, 79 aa, Glycine max
  Coding DNA Sequence Number=SeqID_75692
  Subcellular localization annotation: CTP_CleavageSite=41; ConfidenceScore=5.15e-01
MILHKIRRPNFLKTVPSGVANCCNLSFGGRETRGSRVHLPRKENARSRHQCLFEENFRKTRKFFVVDKGVSLAPTYPQL

SEQ ID NO: 192471 - protein, 89 aa, Glycine max
  Coding DNA Sequence Number=SeqID_75693
  Gene Ontology: Mol. function=DNA binding; Biological process=DNA integration
  Homolog annotation: Hit_ID=Q1SEE1; Match level="QueryCoverage=93%, HitCoverage=9%, E-value=4e-13, Identity=36%"; Hit description =Integrase, catalytic region; Zinc finger, CCHC-type; Peptidase aspartic, catalytic
MSGCIMKQKYEVFEKFKLWKVEVENQTSIKIRYLSVAERMNMSVTERVCCMRLQASLSKDFWAKTVNMACYLLNESPRASLDGKVVEEV

SEQ ID NO: 192472 - protein, 103 aa, Glycine max
  Coding DNA Sequence Number=SeqID_75694
  Pfam annotation: Domain name=zf-CCHC; Domain location=1-18; Score =13.4; E_value=0.006; Accession=PF00098.13; Description=Zinc knuckle
MECRKCNQNGYFKRNCPELKKFSEGASRTTNVTKIDDSDYYTEGDANGFTYKTDRDRNTLRVCKWMLTLMKAQHIVRNIDRLLGSTIIGRVASVESDDDATIL

SEQ ID NO: 192473 - protein, 1069 aa, Glycine max
  Coding DNA Sequence Number=SeqID_75695
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q8VZX6; Match level="QueryCoverage=99%, HitCoverage=100%, E-value=0.0, Identity=84%"; Hit description=Type IIA calcium ATPase
  Pfam annotation: Domain name=Cation_ATPase_C; Domain location=863 -1059; Score=248.8; E_value=1.2e-71; Accession=PF00689.11; Description=Cation transporting ATPase, C-terminus
  Pfam annotation: Domain name=Cation_ATPase_N; Domain location=5-85; Score=113.7; E_value=5.2e-31; Accession=PF00690.16; Description =Cation transporterATPase, N-terminus
  Pfam annotation: Domain name=E1-E2_ATPase; Domain location=104-360; Score=379.9; E_value=3.8e-111; Accession=PF00122.10; Description=E1 -E2 ATPase
  Pfam annotation: Domain name=Hydrolase; Domain location=364-755; Score=79.3; E_value=1.2e-20; Accession=PF00702.16; Description =haloacid dehalogenase-like hydrolase
  Pfam module annotation: Pfam domain module=Cation_ATPase_C::Cation _ATPase_N::E1-E2_ATPase::Hydrolase; Domain location=863-1059::5 -85::104-360::364-755
MKVPMEEKPFPAWSWSIEQCLKEYGVKLDKGLSTYEVQKRHEKYGMNELAKEKGKPLWELVLEQFDDMLVKILLAAAFISFLLAYFHGSDSGESGFEAYVEPLVIILILVLNAIVGVWQENNAEKALEALKELQSESGKVLRDGYFVPDLPAKELVPGDIVELHVGDKVPADMRVAALKTSTLRVEQSSLTGEAMPVLKGTNPVFLDDCELQAKENMVFAGTTVVNGSCVCIVITTGMDTEIGKIHKQIHEASQEESDTPLRKKLDEFGNRLTTAIGLVCLIVWVINYKNFISWEVVDGWPSNINFSFQKCTYYFKIAVSLAVAAIPEGLPAVITTCLALGTRKMAQKNAIVRKLPSVETLGCTTVICSDKTGTLTTNQMAVTEFFTLGGKTTASRLISVEGTTYDPKDGGILDWGCYNMDANLQVMAEICAVCNDAGIYFDGRLFRATGLPTEAALKVLVEKMGVPDAKARNKIRNNTELAANNMMNGNTMVKLGCCEWWNKRSKKVATLEFDRIRKSMSVIVREPNGQNRLLVKGAVESLLERSSHVQLADGSLVPIDDQCRELLLRRLQEMSSKGLRCLGFAYNDELGEFSDYYADTHPAHKKLLDPTYYSSIESDLVFVGIVGLRDPPREEVHKAIEDCKEAGIRVMVITGDNKSTAEAICREIKLFSKDEDLTGQSLAGKEFISLSHSEQVKILLRPGGKVFSRAEPRHKQEIVRLLKEMGEIVAMTGDGVNDAPALKLADIGIAMGITGTENWSFILVISVTKVAKEASDMVLADDNFSTIVLAVAEGRSIYNNMKSFIRYMISSNIGEVISIFLTAALGIPECMISVQLLWVNLVTDGPPATALGFNPADVDIMQKPPRRSDDPLISSWVLFRYLVIGSYVGLATVGIFVLWYTQASFLGINLVSDGHTIIELSQLRNWGECPSWSNFTVAPFEVAGGRLITFSNPCDYFSVGKLKAMTLSLSVLVAIEMFNSLNALSEENSLRKLPPWRNPWLLVAMSISFGLHCLILYTPFLAEVFGVIPLSLNEWFMVLLISAPVILIDEILKLVVRSQRRLLTKEKEA

SEQ ID NO: 192474 - protein, 271 aa, Glycine max
  Coding DNA Sequence Number=SeqID_75696
  Gene Ontology: Mol. function=metal ion binding; Cellular component =intracellular; Biological process=protein kinase C activation
  Homolog annotation: Hit_ID=Q9LWW0; Match level="QueryCoverage=93%, HitCoverage=67%, E-value=6e-59, Identity=39%"; Hit description =Pentatricopeptide (PPR) repeat-containing protein-like
  Pfam annotation: Domain name=PPR; Domain location=149-183; Score =13.6; E_value=0.18; Accession=PF01535.11; Description=PPR repeat
  Pfam annotation: Domain name=PPR; Domain location=72-106; Score=20.8; E_value=0.0048; Accession=PF01535.11; Description=PPR repeat
  Pfam module annotation: Pfam domain module=PPR::PPR; Domain location =149-183::72-106
MDNHDIGLLVEQTLVQTFEHWRLGRGLKHTQGRMGSLRIYASNAVLEMYVKCGKIDAAWRVFNEIGSLRNLCSWNSMVVGLAVHGECCKALELYDQMLSLYKKTGEGTSPDDVTFVGLLLACTQGGMVKKGRHIFKSKTTSFYIIPKLEHYGCMVDLLGRAGQLREAYEVIQSMSMKPDSVIWGALLGACSFHAGQWDGVAKLRKVMKGSKITKSAGHSFIEEGAQLHKFIVKDRSHPKSNEIFALLDGVYEMVKLTRSAFECHLDLDLRN

SEQ ID NO: 192475 - protein, 1006 aa, Glycine max
  Coding DNA Sequence Number=SeqID_75697
  Gene Ontology: Mol. function=ubiquitin-protein ligase activity; Cellular component=ubiquitin ligase complex; Biological process =protein ubiquitination
  Homolog annotation: Hit_ID=Q1SHI6; Match level="QueryCoverage=99%, HitCoverage=100%, E-value=0.0, Identity=67%"; Hit description=U box
  Pfam annotation: Domain name=Arm; Domain location=527-567; Score =31.9; E_value=2.2e-06; Accession=PF00514.13; Description =Armadillobeta-catenin-like repeat
  Pfam annotation: Domain name=Arm; Domain location=664-704; Score =12.6; E_value=0.32; Accession=PF00514.13; Description=Armadillobeta -catenin-like repeat
  Pfam annotation: Domain name=Arm; Domain location=751-797; Score =11.1; E_value=0.49; Accession=PF00514.13; Description=Armadillobeta -catenin-like repeat
  Pfam annotation: Domain name=Arm; Domain location=874-914; Score =14.2; E_value=0.21; Accession=PF00514.13; Description=Armadillobeta -catenin-like repeat
  Pfam annotation: Domain name=Arm; Domain location=918-958; Score =12.9; E_value=0.3; Accession=PF00514.13; Description=Armadillobeta -catenin-like repeat
  Pfam annotation: Domain name=HEAT; Domain location=532-569; Score =12.0; E_value=1.5; Accession=PF02985.12; Description=HEAT repeat
  Pfam annotation: Domain name=HEAT; Domain location=669-706; Score =18.3; E_value=0.028; Accession=PF02985.12; Description=HEAT repeat
  Pfam annotation: Domain name=HEAT; Domain location=810-842; Score =1.8; E_value=26; Accession=PF02985.12; Description=HEAT repeat
  Pfam annotation: Domain name=HEAT; Domain location=923-960; Score =8.8; E_value=3.6; Accession=PF02985.12; Description=HEAT repeat
  Pfam annotation: Domain name=U-box; Domain location=262-331; Score =52.4; E_value=1.5e-12; Accession=PF04564.6; Description=U-box domain
  Pfam module annotation: Pfam domain module=Arm::Arm::Arm::Arm::Arm::HE AT::HEAT::HEAT::HEAT::U-box; Domain location=527-567::664-704::751 -797::874-914::918-958::532-569::669-706::810-842::923-960::262-331
MMVLDVLSGPTGTAISQTVETIADFLVTAKDVLVKKDSFKELAAYMERIKPVLEELRKGKVSDSETFNHAIEIMNKEIKDANQLRLDCSKKSKVYLLMNCRSIAKSLEDHTKQLSRALGLLPLATTGLSSGIVEEIEKLCEDMQTAGFKAALAEEEILEKIESGIREHNVDRSYANKLLILIADAVGIRNERLTIKKELEEFKSEIENARVRKDRAEAMQLDQIIALLERADAASSPKDKERKYFAKRQSLGSQILEPLQSFYCPITQDVMVDPVEISSGQTFERSAIEKWFAEGNKLCPLTLIPLDTSILRPNKKLKQSIQEWKDRNIMITIATLKEKILSGNDEEVLHDLETLQTLCEEKDQHREWVILESYIPTLIQILSRNRDIRKLSLVILGMLAKDNEDAKERISAIDHAIESIVRSLGRRPEERKLAVALLLELSKYDLALEHIGQVQGCILLLVTMSSGDDNQAARDATDLLENLSYSDQNVIQMAKANYFKHLLQRLSTGPDNVKMTMATNLAEMELTDHNRESLFDGGVLVPLLHMFSHNDLQVKTVAIKALRNLSSSKKNGQEMIRQGAARPLLNLLFNQSIHTASLWEDVAAIIMQLAASTISRDAQTPVLLLDSDDDVFDLFNLVSVTHLVVQVQQNIIQTFYSLCQTPSSSLIRSKLIECSAVPKLVQLCENENPNLRASAVKLFSCLVENCDEGIIQEHVNQKCINTLLQIIKPPSKSDEEEILSAMGIICYLPEIDQITQWLLDAGALSIIKSYVQDGKDRDHQKNNLLENAIGALSRFTVPTNLEWQKSAAGTGIITVLVQLLENGTNLTKQRVAQSLAQFSKSSFKLSRPIPKRKGLWCFSAPADIDCMVHGGICSVKSSFCLLEANAVGPLTRILGESDPGVCEASLDALLTLIEGERLQNGSKVLSEANAIPQIIRYLGSPSPGLQEKSLHALERIFRLVEYKQMYGASAQMPLVDLTQRGNGSVRSMSARILAHLNVLHDQSSYF

SEQ ID NO: 192476 - protein, 110 aa, Glycine max
  Coding DNA Sequence Number=SeqID_75698
MSRVGREKSNGEETEVNLYLLGFGVEAGKNGEFGAGFTYITNKGYAAEGPYRSYFLGGTEGRFLNGRASKLLQRLGNNLRRCNPCKNHECNSPRKEKVHLSQDYGKCLNI

SEQ ID NO: 192477 - protein, 106 aa, Glycine max
  Coding DNA Sequence Number=SeqID_75699
  Gene Ontology: Mol. function=isomerase activity; Cellular component =nucleus; Biological process=biological_process
  Homolog annotation: Hit_ID=Q9T096; Match level="QueryCoverage=96%, HitCoverage=69%, E-value=3e-35, Identity=65%"; Hit description =Protein yippee-like At4g27740
  Pfam annotation: Domain name=Yippee; Domain location=2-104; Score =167.5; E_value=3.4e-47; Accession=PF03226.5; Description=Yippee putative zinc-binding protein
MAELMASRAYCCFKCQNLVAFHDDIVSKDFQASNGRAFLFSHAMNIILGPKEDRQLITGLHTVADVYCSDCGEELGWKYIKAYEETQKYKEGKCVLEKFKIIKGNG

SEQ ID NO: 192478 - protein, 46 aa, Glycine max
  Coding DNA Sequence Number=SeqID_75700
MGDPFGWVLDLGSLPPTIVIECRFQLRSAFDSSFVQSQPFSIPTTN

SEQ ID NO: 192479 - protein, 639 aa, Glycine max
  Coding DNA Sequence Number=SeqID_75701
  Gene Ontology: Mol. function=protein serine/threonine kinase activity; Cellular component=cytoplasm; Biological process=protein amino acid phosphorylation
  Homolog annotation: Hit_ID=Q6EU49; Match level="QueryCoverage=98%, HitCoverage=95%, E-value=1e-150, Identity=48%"; Hit description =Putative MAP kinase
  Pfam annotation: Domain name=Pkinase; Domain location=3-260; Score =218.1; E_value=1.9e-62; Accession=PF00069.15; Description=Protein kinase domain
  Pfam annotation: Domain name=Pkinase_Tyr; Domain location=5-260; Score=45.7; E_value=2.8e-15; Accession=PF07714.7; Description =Protein tyrosine kinase
  Pfam module annotation: Pfam domain module=Pkinase::Pkinase_Tyr; Domain location=3-260::5-260
MKSWNNEILGRGAFKTVYRGFDEVDGIEVAWNQVKIDGLMHSVDDLAKLYSEVNLLKSLKHENIIKFYDSWIDDKKKTVNMITELFTSGNLRQYRKKHKYVEMKAIKGWARQILHGLVYLHSHKPPIIHRDLKCDNIFVNGNQGEVKIGDLGLAIVMQQPTAQSVIGTPEFMAPELYEEAYTELVDIYSFGMCILEMVTLEYPYSECQNPAQIFKKVTSGIKPASLNKVSDPQLKDFIEKCLVPASERLSADELLKDPFLQVENPKDPILYPLQPPSRTLRAYSFKSGSLSMDMDSDYKPFSMSIYSESNQENPHCPIFEVQRTYKNNKFRLKGTKNDVNSVSLTLRIADTCGRVRNIHFLFYPDTDTAVSVATEMVEHLELADHDVDFIAELIDYLIMKLLPWWKPSPDHCSCGELSPYCTNIDGQTLMAWPWGSVSTSIPSELVIGQDGFSGSDTTPKEDFVVSENSSVSKIANNATFEGDCNSSSLVKLEDRYSQGSRASEMIIENTSMKNDNCHDSNDDLSSKCFSSSMSELRDVYFEDCKLQQTEYCVGEGVVINEFPKNSGSVLGTSINVENLASSCSYVSSTEEDIDLGLKFKLDEIEAHYQHWIDELNEMMLEALESTRRRWMAKKKLAAQ

SEQ ID NO: 192480 - protein, 124 aa, Glycine max
  Coding DNA Sequence Number=SeqID_75702
  Gene Ontology: Cellular component=integral to membrane
  Homolog annotation: Hit_ID=Q9FHY3; Match level="QueryCoverage=48%, HitCoverage=39%, E-value=3e-25, Identity=81%"; Hit description =Arabidopsis thaliana genomic DNA, chromosome 5, P1 clone:MJC20
MTNFLATGELEQEYCRVTNFQDVRYNMSKIIEQTQQIAERERYSKVCEINDGPSDAGGATEDGENEDPRKEKDEDVSGPNARVREPLRVPVQIRRWHRLHVQFCHEFRRYPFNQKKPQLRDPRC

SEQ ID NO: 192481 - protein, 71 aa, Glycine max
  Coding DNA Sequence Number=SeqID_75703
MLTTASWLLSKDGNRSAYDIGIGVNSTGFLSGKFLRGLVFMLGLGIGFGQGALGRRGVGQGGGSILAEYWY

SEQ ID NO: 192482 - protein, 409 aa, Glycine max
  Coding DNA Sequence Number=SeqID_75704
MPGMWLLDQKNCVGEPFLRPCHGGDVKGVEFEQVREDDGEDVQEQEEVEEEEEEEDGEEDEHEGGFHLSPKCIPMEGMSSGNGGLIQVMEAGQMPFGSGIDLRDNPVGDFLSSRDEPQMISGSSLFGNGHKRDNLGLDNHHSLNGSNKRLRGDSPWNSKPMDFETCIEQMEHWMGKARMMFATKDQACEESTMNQQLLINELQKRDNMIEHLHKAKLEEAQKRQIEVYRFEKELYMMQSLVDGYRKALKETRKAFAEYRAQCPQGDNEPLYKDLPGSGGLVLTAVEVERERLKKEAEERAKLRDFMIDFEKKTTDFESTWFDKFEAHRSAVESLSERLLVLEDQVKHLNEVNANHKVSDPIECRVSDPIECKVSDHIESDPIECKVSDSIECKVSDPIECVPTTEGETA

SEQ ID NO: 192483 - protein, 72 aa, Glycine max
  Coding DNA Sequence Number=SeqID_75705
MSFNICVFEDRKWSQRSLPQRDPGKTKRLKEPVPLPNMTAIVLGALSTSSASRPSKDGHSSGTMSIPTSRKR

SEQ ID NO: 192484 - protein, 63 aa, Glycine max
  Coding DNA Sequence Number=SeqID_75706
MAARGGHQWSWEVEKERARLAKWESTFLAQHANSRSAQLPLHYGSLSGLILAQRNSLAGWNYT

SEQ ID NO: 192485 - protein, 62 aa, Glycine max
  Coding DNA Sequence Number=SeqID_75707
MAISNGHNFWLGCPIQANNLSRPSKLNNGSSREIEMAHNISTSSKLNIKVQLNERSFKALDH

SEQ ID NO: 192486 - protein, 84 aa, Glycine max
  Coding DNA Sequence Number=SeqID_75708
  Subcellular localization annotation: CTP_CleavageSite=48; ConfidenceScore=5.46e-01
MAKSATLIRAPPSLVTTKTFMVNKFLQQPNTTIQKLFATICNNNNPPNNQHDSTSNVEDLLYEYESCWVKDHGSDSDSSSRPEG

SEQ ID NO: 192487 - protein, 251 aa, Glycine max
  Coding DNA Sequence Number=SeqID_75709
  Gene Ontology: Mol. function=cysteine-type endopeptidase activity; Cellular component=endoplasmic reticulum; Biological process =proteolysis
  Homolog annotation: Hit_ID=Q1SLM3; Match level="QueryCoverage=98%, HitCoverage=99%, E-value=4e-80, Identity=51%"; Hit description =Peptidase C1A, papain
  Pfam annotation: Domain name=Peptidase_C1; Domain location=91-249; Score=149.4; E_value=9.7e-42; Accession=PF00112.13; Description =Papain family cysteine protease
MKTITTLTYTIFNLLIFCNAWISASECPPMHWYNSSNLEAMRSAKTLKNSYNLTDNKFADLTNEEFVSPYLGFGTRFLPHTGFMYHEHEDLPESKDWRKEGAVSDIKDQGNCVAAVEGINKIKSGKLVSLSEQEFRDCDVEDGNQGCEGVDGTCNKEKALHHAANISGHVKVPANDEAMLKAKAAAANQRQLNHGVTIVGYGKGTSDKYWIVKNSWGADWGESGYIRMKRDAFDKAGTCGIAMQASYPLKD

SEQ ID NO: 192488 - protein, 101 aa, Glycine max
  Coding DNA Sequence Number=SeqID_75710
MEDDDFGGEGRGIGAGSAIIEALDTGTIGAGTSKSLKDLSDDYKVFLISRLVSMCSVRNLLSIVSSRKPYPSSGNVIAALKYLCKSKTNQEQQGGISWIKH

SEQ ID NO: 192489 - protein, 106 aa, Glycine max
  Coding DNA Sequence Number=SeqID_75711
MTILVVEATMKDKELGVHILCGIHNFFEDPKLMVLELVREFWRTAKVYRNEDIGGYFGGKVPGIQVKLTAEMIVQAIGYERHRTKFMNNWENELKNHIGYSMWGPN

SEQ ID NO: 192490 - protein, 241 aa, Glycine max
  Coding DNA Sequence Number=SeqID_75712
MAFGTMAARLSELMLHPEVTGSPRQAGPDQEARSPQRKKSITFAKSPSSSSPGASAAGKGWGPGTAAAMYTDRSYRSTAPGPYGLLLAGQPNATCRAPSSACELRWTLEIVATVEVEVVRLRPTTTGPAPVSRRCDTYKLVDGIRDKLGYMNTNLGQDSVDQLTYRQREIKIMITGKDLVEEKRHLDLGQGGHGSAHDPHLPPCHNEVTARLGELPSSQMPCFAINRCEGRLRKRFQGPEV

SEQ ID NO: 192491 - protein, 74 aa, Glycine max
  Coding DNA Sequence Number=SeqID_75713
MEGVVVVYYDGDMVPSSEGVLFGCLNGPKFVKISEEMLLDFMRKAITNRGGYRDLELRTDLLSPWTLRIMNLFF

SEQ ID NO: 192492 - protein, 84 aa, Glycine max
  Coding DNA Sequence Number=SeqID_75714
MLHVGQKSDNFTYTFVPKACGDLLLRQIGRKISSKKRGDGSEFQIWSIKNVLAGILLILSKIDNTTMTETEFSMQMVSLMLVLL

SEQ ID NO: 192493 - protein, 42 aa, Glycine max
  Coding DNA Sequence Number=SeqID_75715
MHKSQVASDSGLWWPPVVMGGGKGVKISLSELIWLREIQLWV

SEQ ID NO: 192494 - protein, 189 aa, Glycine max
  Coding DNA Sequence Number=SeqID_75716
  Gene Ontology: Mol. function=binding; Cellular component =mitochondrial inner membrane; Biological process=transport
  Homolog annotation: Hit_ID=Q8L9F8; Match level="QueryCoverage=86%, HitCoverage=51%, E-value=3e-38, Identity=47%"; Hit description =Mitochondrial carrier-like protein
  Pfam annotation: Domain name=Mito_carr; Domain location=13-88; Score =15.9; E_value=0.00012; Accession=PF00153.17; Description =Mitochondrial carrier protein
  Pfam annotation: Domain name=Mito_carr; Domain location=89-184; Score= 62.6; E_value=1.2e-15; Accession=PF00153.17; Description =Mitochondrial carrier protein
  Pfam module annotation: Pfam domain module=Mito_carr::Mito_carr; Domain location=13-88::89-184
MSRAIMRCEGFRGFGTSLMGTISAQTNSIYLLKNCYRNGFEALRKILGVDGPRGFYRGFGVSIVTYVPSNAVWWASYSMVVVVIVGVQWLSAVMASGVSAVVAMPLDSIKTMWMLHKLQVLDSEEIKGQRRSLTLVQVVRNSVKKGGILGCYKGLGPRWASMSMSAATMITTYEFLKRVSAKNLDRLTV

SEQ ID NO: 192495 - protein, 77 aa, Glycine max
  Coding DNA Sequence Number=SeqID_75717
MTTVNNQSPPFDLLTPQLLFTSLQFRLYRYNKDAVGATTKAVEWQHGIGIPSCNCEDVVGAMTKAVAWHRERDERSK

SEQ ID NO: 192496 - protein, 166 aa, Glycine max
  Coding DNA Sequence Number=SeqID_75718
  Gene Ontology: Mol. function=zinc ion binding; Cellular component =integral to membrane
  Homolog annotation: Hit_ID=Q06A76; Match level="QueryCoverage=69%, HitCoverage=46%, E-value=4e-51, Identity=83%"; Hit description=PHD4
SIFPFNNTTPQTDIMEAGYNPRTVEEVFRDFKGRRAALIKALTTDVEEFYQQCDPEKENLCLYGFPSEQWEVNLPAEEVPPELPEPALGINFARDGMQEKDWLSLVAVHSDAWLLAVAFYFGARFGFDKADSPVMVAPKATMPYLCGGILAFGHIPPSAIGDTDLR

SEQ ID NO: 192497 - protein, 153 aa, Glycine max
  Coding DNA Sequence Number=SeqID_75719
  Gene Ontology: Mol. function=transporter activity; Cellular component= integral to membrane; Biological process=transport
  Homolog annotation: Hit_ID=Q2PF04; Match level="QueryCoverage=50%, HitCoverage=15%, E-value=3e-14, Identity=54%"; Hit description =Putative transporter-like protein
MVVWPRLDEWKAVPDIWRSSVEKYGDNVALVGPYHDPPTTMTEARLHGKTKADYVGNVPSYLEASVGPCNIPKPSTWELVEHNKWVRSCYSSLLAYPISIGAKSLWTCCSSSYRRGVIHTSLAMLSPHENVIRLHTGHSDQYCLHSEECFDCK

SEQ ID NO: 192498 - protein, 55 aa, Glycine max
  Coding DNA Sequence Number=SeqID_75720
MMFNHHYNDLKSNNAEDVDWLKHIPKQKRAQAFAEGVEDVEEMELHAQHVSACLV

SEQ ID NO: 192499 - protein, 622 aa, Glycine max
  Coding DNA Sequence Number=SeqID_75721
MSHLPLILPALKPFGFHNPRISTKRAGCTKHDVDGHSDHFGSAYDNNPIQASMSYYGVIEDIWELDYSEFRVAYNNDPFIMVAQAREVFYVQYSCDSKWLVVLQGRTTCIGDHIDGLTVDVSEMPPFCQQMPFINGEGEEDDVHANHNDHGEGLWENIPILMATPPRSPPHSDITSEATSRRTRQFTRLRRLIIRTLDQPRPTVNVNPATRKGSGKIPILYNNWNDVPDSLKNLVWEYILGKFDIPDGNNAKKKGMSMVATRWRQFKSSLTIKYVYADNDGVQKDHPFVKYGIDATTWVKFAKSRQTPNWQGIRKKAQEIQKYNDCPHLLSRGGMTISQYFGHASFDSDTSFALITQHQLVEINNNLKEEWWKEVEEENKNLQEAWRKKAPNIQVLAAHVSTKGSCAKADTNPLGKDPSNVHVDTMGLYLFGDQCTQLVPLGKLPFRTSELQFVRQAIGTFVGWPTHLVNVEESHNYLPKPVASGEMDNAVATVDPLGELVKNLYDVYQRPIQLMWDGAKFGIPDVKDGFFITHTDVTEIIVDNVVVWFCSLRKKSDVNIKATVNSAMKALTTTLEGKPGQVVHRWIEPKAHPWFKGVEWDKLYEMEAALNIKSTGNWGHKF

SEQ ID NO: 192500 - protein, 112 aa, Glycine max
  Coding DNA Sequence Number=SeqID_75722
MVGLELIPILHNIDCYVHQSWPLLPTDEVQIHRQESSTSHKGHLNVSAYAICHKIEVLSIIIDQDSRLQNEMKTIEFEASQSQLAIIHRLNHGIREKKLDQAFANDMLEELV

SEQ ID NO: 192501 - protein, 1267 aa, Glycine max
  Coding DNA Sequence Number=SeqID_75723
  Gene Ontology: Mol. function=RNA-directed DNA polymerase activity; Cellular component=chromatin; Biological process=RNA-dependent DNA replication
  Pfam annotation: Domain name=rve; Domain location=962-1117; Score =101.0; E_value=3.4e-27; Accession=PF00665.16; Description=Integrase core domain
MAEDRPPRVTLEDYSSSTMPQFFTSIARPKIAGVPKNAIRLNLFSFSLAGEAKRWLQSFKGNSLKTWEETTEGKAKISSFHEFPAGGKIELKTPDEAMELIENIVASDHAILRDMTHTPTKRIQPTHSTIMQVGGCNICGGAHESGACMTQDETSKEVHYMANQSRQGFHPGGYAGYQQGGNFSHNQDQRGPSNQPPNQGPNLYEQTTKLEDTLTQFMLVSMSNHKSTESTIKNMEMQVGQLAKQLAKKSFGNFGSNTRKNPKEECKVVITRSQGRVLVERRKKNSVENEEKNKKRDTKEIERQESDERAVNPYFGQGSPISFAAFKEGQGADLLTKKGKYINNESIVVEGNCSVVIQRILPQKFKDLGSVTIPCSIGAVSVGKALIDLGASINLMPLSMYRRIGNLRIAPIRMTLQLVDRLILRPYGVVEDVLVEVRQFTFPVDFVIMDIEEDSYIPLILGRPFMLTAKCVVDMGNAKANMGVQNMASHSPLEKALMNAIDCLTKEEERDLKAYLEVLDKLKVIPLGECVFEELKKNPTIEKPKVDLKVLLAHLKYVFLEENEAKSVVISNTLSSVQVVPKKGGMTVVRNEKNSLIPTRTILGWLTCIDYRKLKDATKKDHFSLPFMDHMLERLANQSFYCFLDGYSGCMMAIFADMVEKCFKVFMDDFSVFGSSFDCCLINLELVLQCCEETNLVLNWEKCHFMVQEGIVLGHKISVKGIEVDKAKIDVIEKLPPPVNVKGIRSFLGHAGFYRRFIKDFSKIAKPLSNILNKDVVFQFDEECLTAFETLKDRLVSALVITAPDWSKEFELICDANDYLVGSVLGQRKEKVFHSIYYASKIVLGWIKSNCVYRSCSHKVSSHKGILQTKAHQMDPLALGELEIPDEFLDESLLVVNERPWDDPYLFKIRANNLLRRCVTKEESRSILWHCHNSSCGGQYSGDKTTAKILQSRNEMPLQNIIEVEVFDCWGIDFFGHFPSSYGNEYLLLAIDYVSKWVEAIAAPKNDAKTVIKFLKKNIFARFGVLRVLINDGGLHFCNAQLQKVLGQYNVTHKVASPYHSQTNGQVEVSNRELKKISEKTVASTRKDWAAKLDDALWAYRIAFKTPIGLSPFKMVCGKGCHLPVEMEYKAYWALKFLNFYEVLSGEKQKLQLLELEEMRLNAYESSKLYKQKMKAYHDKKLLKKSFQPGQKDLLFNSRLKLFPGKLKSKWSRSFIIKDVKPYGAVELMDPTSDNPERSWVINGQRLKLYHGGNIERLTTILILQDP

SEQ ID NO: 192502 - protein, 91 aa, Glycine max
  Coding DNA Sequence Number=SeqID_75724
MDWYYGCESSDFLVPKDQEDLLERRPSPENWDSVLEDFPCVESLCKSFFYTKNHCSNTTGENCILVSEQVKGRKILQLQGLFHVTRTPRIA

SEQ ID NO: 192503 - protein, 260 aa, Glycine max
  Coding DNA Sequence Number=SeqID_75725
  Gene Ontology: Mol. function=actin binding; Biological process =cytoskeleton organization and biogenesis
  Pfam annotation: Domain name=Transposase_21; Domain location=98-231; Score=-40.1; E_value=3.4e-11; Accession=PF02992.5; Description =Transposase family tnp2
MSTAPNTDPVNVETSDRMEDMIRDLGQEAFQQAHAPYYGKLQIDSKMSLYLECTTFTQLSVVLGLGNLKARFGNQFAEMRNCPTCGVLCYKLNNGQSSDDATTNNSHPTKTIDQLYPEFGKDPRNLRLGLVSDGMNPFGNLSTSHTGPRQQGNDIDVYLTLLIEDLRKLWVDGVSLSAWCALSVIAIKIMLETFLGLARKIRSAQFALKATQRSFWAQCTLVLSEKFGHLAQGVCAYHACNEPTPTSRIQLPPNSYALHP

SEQ ID NO: 192504 - protein, 138 aa, Glycine max
  Coding DNA Sequence Number=SeqID_75726
  Homolog annotation: Hit_ID=Q19PN1; Match level="QueryCoverage=41%, HitCoverage=4%, E-value=3e-08, Identity=49%"; Hit description=NBS -LRR type disease resistance protein
MACHIMNQSHTCMVKCHEKLRKIPLMQEWTVDLEIVSLAGNMIEEIPKGISPNCPPIDFFTHECFRGSNESWISFTIHPASNYIRKVLHFSIVPPATWDLMIAPGTKVLQVSLKFESFTRLVYGICGRCQGHWFLLLA

SEQ ID NO: 192505 - protein, 1191 aa, Glycine max
  Coding DNA Sequence Number=SeqID_75727
  Gene Ontology: Mol. function=binding; Cellular component=nucleus; Biological process=signal transduction
  Homolog annotation: Hit_ID=O04390; Match level="QueryCoverage=94%, HitCoverage=99%, E-value=0.0, Identity=45%"; Hit description=Nuclear matrix constituent protein 1
  Subcellular localization annotation: CTP_CleavageSite=21; ConfidenceScore=5.10e-01
MFTPPRVWSGWSLTPNKSGVRGGTGSGSELGPNSGDGASAKGKGVVVVENGGNLDREVLVERVSSLEKELYEYQFNMGLLLIEKKEWSSKYTELSQDLVEVKDALEREKAAHLISLSEAEKREENLRKALGVEKECVLDLEKALREMRSEHAKIKFTADSKLAEANALVASIEEKSLEVEAKLHSADAKFAEISRKSSEFDRKSQELESQESTLRRDRLSFIAEQEVHESTLSKQREDLREWEKKLQEGEERLAKGQRIINEREQRANENDRLCRQKEKDLEEAQKKIDETNITLRNKEDDVNNRIVNITLKEKEYDSLRTNLDLKEKELSAWEEKLNAREKVEMQKLLDEHNAILDVKKQEFEVELDEKRKSFEDGLKNKLVEVEKKEAEITHMEEKVAKREQALGKKAEKLKEKEIEYEQKVKALREKEKLIKSEEKSLVTEKGKIESEREELLTHKAEVEKIRANNEEESLRINEEIDRLKVTEEERSEYLRLQSQLKHEVDQYRHQKELLLKEAEDLRQQKETFEREWDELDLKRTDVEKELKSVIQQKEEILKLQQYEEEKLRNEKQDTQAYVQRELETLKLAKESFAAEMELEKSSLAEKAQSERNQILLDFELQKKELEADMQNQLEQKEKDLIERKKLFEEKRESELNNINFLREVANREMDEMKLQRSKLEKEKQEADENKKHLERQRMEMQEDIDVLVDLNRKLKNQREQFIVERRRFIEFVEKLRSCQNCGEMISEFVLSDLQSSVDIENLEVPSLPKLAADIVQGVSNENLASSRQNTGLSPATDPKSPVSGGTVSWLRKCTSKIFKISPIRKIESEDSGTLRDVVTLSVEQTNVEDSPGRIPDAENEAELSFAVVNDSFDARRVQSGNDIIEVEADHDPSVENLNNVDSKAPEDLQAPDSKVGQQKSRKGGGRPRVKRTHTVKAVIKEARDILGESAEALPGESVDDHETEFPNGNAEDSANVNSESQKPYNRRIPANVRKRNRVQTSSQISVSGHDGDANEGHSDSLIPGQRKRRRQKAAAPPAQTAGESRYNLRRLKTGATTSSARAMSGGGKESQGEVDRVKDTEEGIIDSKTSHSHSVGITNENGESIHLEQSLKGVETRAGYGGDTTETFANNMALSEEVNGTADDVEENDAEYRSESRGEDAGGVDNEDDEEDYLQPGEASIGKKLWNFFTT

SEQ ID NO: 192506 - protein, 393 aa, Glycine max
  Coding DNA Sequence Number=SeqID_75728
  Homolog annotation: Hit_ID=Q84N89; Match level="QueryCoverage=90%, HitCoverage=92%, E-value=6e-94, Identity=60%"; Hit description =LEGCYC1A
  Pfam annotation: Domain name=TCP; Domain location=88-306; Score =130.0; E_value=6.8e-36; Accession=PF03634.4; Description=TCP family transcription factor
  Subcellular localization annotation: CTP_CleavageSite=18; ConfidenceScore=5.52e-01
MFPSTNYTSSGSYPRFPSSSSSSTSPYPSFTLLHPENSSSSNTFLCDPLALTYIPSHYHAPIIPETLANWAVADCAILNQDLGGALYGITNKPEKKATKKDRHSKIHTSQGLRDRRVRLSIEIARKFFDLQDMLGFDKASNTLDWLFTKSKKAIKELTRSKHSADSFEFSSSSDGEVVSTIHQDLHQQQGVDLEEGKLKEPAAYCVKAKMKESREKARARARQRTSSKVLCNISSEGKVQDLKKKCPATENPQILNQLRSPLQPPHPQDVGGEVPRDDDFNVIEESIVIRRKLKHTLMSSIHHQNAVIPKEASVNNSDYHSFPNLSPNWEANNNGANGRSTFCAIASMNLSTAHETACDLCDTYSPIYVLNFRASNFWKILGGVHQSSSKLIS

SEQ ID NO: 192507 - protein, 205 aa, Glycine max
  Coding DNA Sequence Number=SeqID_75729
  Gene Ontology: Mol. function=translation initiation factor activity; Cellular component=eukaryotic translation initiation factor 2B complex; Biological process=cellular metabolic process
  Homolog annotation: Hit_ID=Q9FFV8; Match level="QueryCoverage=67%, HitCoverage=20%, E-value=2e-45, Identity=67%"; Hit description =Similarity to guanine nucleotide exchange factor
MNEVTRVFLGASSVLSNGTIYSGVGTACVAMVALAFCVPILVCCEAYKFHERVPHDSICINELGDPDITSTVQSKEDANHLEAWANTENLQLLNLILTLHSLIDANYDATPSDYVSMIITDYSMVPPTSVPVIVREYTREQAHSTLVKSVILHRLWTDVVEDDVKRGWCFTTVVGNHVEWCEFYNGRLVGRCRLASILLRSLGMD

SEQ ID NO: 192508 - protein, 165 aa, Glycine max
  Coding DNA Sequence Number=SeqID_75730
  Gene Ontology: Mol. function=electron carrier activity; Cellular component=cytoplasm; Biological process=electron transport
MHKCPRCGVSRYKVKNDNECSSDKNKEGPPAKVLWYLLIIPRFKRLFANGDDAKDLTWHANGRNYDGMLCHPVDSSHNLQLASLVVHEVKIHDVVYNDIEPKTTRIDVYRKNCDSVIGTLLNIQGKTKDGLNTRQDLAEMGIRAQLHSRSNGKKIFLILCLERRR

SEQ ID NO: 192509 - protein, 134 aa, Glycine max
  Coding DNA Sequence Number=SeqID_75731
MTRTKKTDEMTFEAAKKIDDKIDSLEGACLTGFLCRPWTSGCTDCCHWVTRTLWSCSCCWSQCHDQTIFWTGSKDLSHVFVYGSQSPGAVDAKNQGPAGGVDHKKSDSKTNVVLQPYTIPISIIDTIIGTHSAS

SEQ ID NO: 192510 - protein, 250 aa, Glycine max
  Coding DNA Sequence Number=SeqID_75732
  Gene Ontology: Mol. function=DNA binding; Cellular component =membrane; Biological process=DNA integration
  Homolog annotation: Hit_ID=Q1SH28; Match level="QueryCoverage=96%, HitCoverage=31%, E-value=1e-46, Identity=40%"; Hit description =Integrase, catalytic region
MARPGLFYKPQRSLYGLKQASRQWYAKLSSFMFSHGYKQRASDHSLFIRHGSNRIFVLLVYVDDIVLLGNELSKIQRITYLLDDTLRIKDFGDLRHFLGFEVARSSNDWAGCIDTKQSIIGYAVYIGDLLISWKSKKQATISRSSTKVEYRALASATCELQRLTYLLEELKIQFQNPIVLYCDNKFALHIVVNHVFHERTKHIEIDYHIAHEKVLNGLVKLLPISSANQLADIYTKALMPDAFQFLYSKL

SEQ ID NO: 192511 - protein, 226 aa, Glycine max
  Coding DNA Sequence Number=SeqID_75733
  Gene Ontology: Mol. function=kinase activity
  Homolog annotation: Hit_ID=Q9SLC0; Match level="QueryCoverage=58%, HitCoverage=66%, E-value=7e-49, Identity=65%"; Hit description =Expressed protein
  Subcellular localization annotation: CTP_CleavageSite=54; ConfidenceScore=5.32e-01
MIASIKPALDKVKSSQQNPEPRKSKVNTLSSHSFSHKDMDSHCLLRFRFACFVLFASVACCFSHPSLLGIHPLDEKYYNSEVIKCRDGSKSFSRDRLNDNFCDCPDGTDEPGTSACPNGKFYCRNLGSKPQFIVSSHVNDHFCDCCDGSDEYDGIICCPNTCVMGGNAESTFSNCKSEASQNGVKSEESVHTGLKLVIILQVVLVIFLVFLWSFRCRTRSRRRHYR

SEQ ID NO: 192512 - protein, 187 aa, Glycine max
  Coding DNA Sequence Number=SeqID_75734
  Gene Ontology: Biological process=multicellular organismal development
  Homolog annotation: Hit_ID=Q9LNB9; Match level="QueryCoverage=73%, HitCoverage=62%, E-value=1e-29, Identity=45%"; Hit description =Putative LOB domain-containing protein 2
  Pfam annotation: Domain name=DUF260; Domain location=5-105; Score =121.7; E_value=2e-33; Accession=PF03195.5; Description=Protein of unknown function DUF260
GMHPACAACKHQRKKCSENCILEPYFPSNRSREFYAVHKVFGVSNITKLVKNAKEEDRRKVVDSLIWEACCRQRDPIQGPYGEYTKVYNEYKKVLDEIKRFRSQNQLLQIPSLGFKSVQDLIACNGTKGEHKASVNNASNYLHGKKNGIIDTNIYNTYCSNYLLEFQNIRPEVVIPFQQHSQPYYIT

SEQ ID NO: 192513 - protein, 154 aa, Glycine max
  Coding DNA Sequence Number=SeqID_75735
  Gene Ontology: Mol. function=nucleotide binding; Cellular component =intracellular; Biological process=small GTPase mediated signal transduction
  Homolog annotation: Hit_ID=Q40220; Match level="QueryCoverage=99%, HitCoverage=100%, E-value=8e-67, Identity=70%"; Hit description=Rac -like GTP-binding protein RAC2
  Pfam annotation: Domain name=Miro; Domain location=8-120; Score=19.7; E_value=6.7e-05; Accession=PF08477.3; Description=Miro-like protein
  Pfam annotation: Domain name=Ras; Domain location=8-136; Score=149.3; E_value=1e-41; Accession=PF00071.12; Description=Ras family
  Pfam module annotation: Pfam domain module=Miro::Ras; Domain location= 8-120::8-136
MSTTRFIKCVTVGDGAVGKTCMLISYTSNTFPTDYVPTVFDNFSANVVVDGSTVNLGLWDTAGQEDYNRLRPLSYRGADVFLLAFSLISKASYENISKKGEELKKAIGAAVYIECSSKTQQNVKAVFDAAIKVVLQPPKSKKKGKKKNTPCVFL

SEQ ID NO: 192514 - protein, 72 aa, Glycine max
  Coding DNA Sequence Number=SeqID_75736
MNGETQWRGGDMLATQQGRKGRVVSRRSRKAKEDLCPMNDVFHKKDETQGAPLQILTPNISLIRGVKKIGLD

SEQ ID NO: 192515 - protein, 69 aa, Glycine max
  Coding DNA Sequence Number=SeqID_75737
MEKTDPSLNKDEGIAQDADALREMEQELAFHLDPWSPTSNGYLEAVVINKKRKKNEEDIVNSTKQHKKN

SEQ ID NO: 192516 - protein, 99 aa, Glycine max
  Coding DNA Sequence Number=SeqID_75738
  Gene Ontology: Mol. function=translation elongation factor activity; Cellular component=intracellular; Biological process=translation
  Homolog annotation: Hit_ID=Q5JMX4; Match level="QueryCoverage=99%, HitCoverage=14%, E-value=1e-31, Identity=71%"; Hit description =Putative GTPase
  Pfam annotation: Domain name=GTP_EFTU; Domain location=1-99; Score= -9.2; E_value=1.4e-06; Accession=PF00009.17; Description=Elongation factor Tu GTP binding domain
MVDTPGHADFGGEVERVVGMVEGAILVVDAGEGPLAQTKFVLAKALKYGLRPILLLNKVDRPAVSEETCDEVESLVFDLFANLGATGTAIEISDSYIYA

SEQ ID NO: 192517 - protein, 92 aa, Glycine max
  Coding DNA Sequence Number=SeqID_75739
MNAKRREYMVGMLPKRIILMRHEKLQGNRDTITYTTTPITSFSQQQHKTWPRPSAPFYMFSYACTQSMLCELIQYFLKKRIIGVRKESQVRE

SEQ ID NO: 192518 - protein, 40 aa, Glycine max
  Coding DNA Sequence Number=SeqID_75740
MDAISKQFEELDVCGKVTLKSKLQKIVYHDQNSMCALPEK

SEQ ID NO: 192519 - protein, 285 aa, Glycine max
  Coding DNA Sequence Number=SeqID_75741
  Gene Ontology: Mol. function=translation elongation factor activity; Cellular component=intracellular; Biological process=translation
  Homolog annotation: Hit_ID=Q56YJ4; Match level="QueryCoverage=83%, HitCoverage=35%, E-value=1e-114, Identity=86%"; Hit description =Putative GTP-binding protein
  Pfam annotation: Domain name=EFG_C; Domain location=191-281; Score =76.0; E_value=1.2e-19; Accession=PF00679.14; Description=Elongation factor G C-terminus
  Subcellular localization annotation: CTP_CleavageSite=50; ConfidenceScore=5.52e-01
MAAPRSNQALPLILISTFTVTVSVKRLMIFMSRYQSCPLSTVFGRGSVVKLMKKKGTNMVLTDCAGAGDIISIAGLSSPAIGHTVATVEVMSALPTVELDPPTISMTFGVNDSPLAGRDGSHLTGGRIGDRLMAEAETNLAINVLPGLSESFEVQGRGELQLGILIENMRREGFELSVSPPKVMYKTENGQKLEPVEEVTIEVNDEHVGLIMEALSHRRAEVTDMGPVSGTVGRTRLCLTCPSRGLVGYRSVFSSDTRGTGFMHRAFHAYENFRGPLGNVRKGVL

SEQ ID NO: 192520 - protein, 135 aa, Glycine max
  Coding DNA Sequence Number=SeqID_75742
MLRYHIHKLVTLFFRHFQIPLNSEPNVPIKRSFLIGAAVIASFGYRKEHDGSWVKKGAPPTNDEGNLPVEDNSSLLRKLLEKFDGLQTFVGDKFDDMELQVDMRFNAIESRITKVEDVSFIRTCFDPPPSPPSSS

SEQ ID NO: 192521 - protein, 66 aa, Glycine max
  Coding DNA Sequence Number=SeqID_75743
  Subcellular localization annotation: CTP_CleavageSite=60; ConfidenceScore=5.83e-01
KAHPATPFSSFSANAFSSSSANASSSSANASSSSPLVLSSRLHLLELSVPLTTCIGAFCCCSAVEM

SEQ ID NO: 192522 - protein, 89 aa, Glycine max
  Coding DNA Sequence Number=SeqID_75744
MVRLKFRLGQEVPRQPRNLYKLHKIDMQGHSDKNWGQKHASQDVDELHQQIVDDGHNATQQQQQKQITHQNPPRNGRRRPCETGHHYEN

SEQ ID NO: 192523 - protein, 59 aa, Glycine max
  Coding DNA Sequence Number=SeqID_75745
MTKLKSRAYLGPKNQRFCGYCIAFYTPIIPQMTWIHGPLEIKRGDSGEDKGVEFPKDRS

SEQ ID NO: 192524 - protein, 243 aa, Glycine max
  Coding DNA Sequence Number=SeqID_75746
  Gene Ontology: Mol. function=nucleoside-triphosphatase activity; Cellular component=membrane; Biological process=protein catabolic process
  Homolog annotation: Hit_ID=Q6A167; Match level="QueryCoverage=100%, HitCoverage=33%, E-value=3e-49, Identity=46%"; Hit description=Ftsh -like protease
  Subcellular localization annotation: CTP_CleavageSite=77; ConfidenceScore=5.69e-01
MATLQASLLCRTSLPFSSHHPQLYKLHPHSFNFLSPCKMFQPRLHSSVSRSVASRSQSNPSGADSSVIENEATPSVVDAESSDPSIGEEKSESAKEEERLPIVALYEGARESVEKAFADFMTWLPLWQQERRLARLIVDAEANPNDVAKQTTLLIELNKHSPESVIKHFEGREGAVDSIGVVEYLRALVVTNAIAEYLPNEEYGKPSRLPTLLQELKQRASGKSDEPILSPGTSERQPLHVAM

SEQ ID NO: 192525 - protein, 296 aa, Glycine max
  Coding DNA Sequence Number=SeqID_75747
  Homolog annotation: Hit_ID=Q9FL61; Match level="QueryCoverage=98%, HitCoverage=99%, E-value=8e-78, Identity=50%"; Hit description =Genomic DNA, chromosome 5, P1 clone:MLE8
MVKLASARDFRTYGPGLAKNRCEYINAGLYLIASVVLVSGLVAQLSSLARSGLVLIIAALGIILLVNLHDFFAHLVGIDFRLPLMAFDLQLAFVEFAVPVIQMLGTLLTFLGVFFLFIQEEKGYGYFKLEKHALNMLVAGPVLWVIGSIHNSCQIYERADGHVQILQQCVNVPFLMGSLSFMLSAILNYHEKSKDIHHGLHLLSGTWIWLGIFGSLMFFIGGLTNLIKVFKMQQMNGIRLEKLRGGAHERLLSARERQIPLIMEHQTNISHQPQETKVTSPLPTPYKDVLIGQTKL

SEQ ID NO: 192526 - protein, 82 aa, Glycine max
  Coding DNA Sequence Number=SeqID_75748
  Gene Ontology: Mol. function=nucleoside-triphosphatase activity; Cellular component=membrane; Biological process=protein catabolic process
  Homolog annotation: Hit_ID=Q6A167; Match level="QueryCoverage=68%, HitCoverage=7%, E-value=7e-25, Identity=96%"; Hit description=Ftsh -like protease
FVPCKLQESHPTDLGSLMLNVKTFKDVKGCDDAKQELEEVVEYLKNPAKFTRLGGKLPKGILLTGPPGTGKTLLAKLFIMST

SEQ ID NO: 192527 - protein, 83 aa, Glycine max
  Coding DNA Sequence Number=SeqID_75749
PVMTEKLSRKGEKDCRQAEASCQNKCDDHKDLLESGNIGKKFSTKGVAGIKIHRGQQVPDGLSPVRNDFLYSLNLALELALIP

SEQ ID NO: 192528 - protein, 296 aa, Glycine max
  Coding DNA Sequence Number=SeqID_75750
  Gene Ontology: Mol. function=nucleoside-triphosphatase activity; Cellular component=membrane; Biological process=protein catabolic process
  Homolog annotation: Hit_ID=Q6A167; Match level="QueryCoverage=81%, HitCoverage=34%, E-value=1e-106, Identity=75%"; Hit description=Ftsh- like protease
  Pfam annotation: Domain name=Peptidase_M41; Domain location=105-271; Score=253.8; E_value=3.7e-73; Accession=PF01434.8; Description =Peptidase family M41
MPIPKKFVPNISKVCLGCLIGVQSVGTPLVLKAIKEHASEIVVPNPDLRGRQEILELYLQDKPLADDIDIKSIARGTPGFNGADLANLVNIAAIKAAVEGAENLAAAQLEFAKDRIIMGTERKTMSISEESKKLTAYHESGHAIVAINTEGAQPIHKATIMPRGSALGMVTQLPSGDETSISKKQLLARLDVCMGGRVAEEIIFGQDHITTGASSDLHTATELAQYMVVKLLREAYDRVKALLRKHEKALHALANALLEYETLNAEEIRRILRPYREGRLPKDQEQEAAEEELVLV

SEQ ID NO: 192529 - protein, 47 aa, Glycine max
  Coding DNA Sequence Number=SeqID_75751
MSIHTRDVQYLTRARTRGGNSFSRRAKDNSKAVAFESLYISPRLFDY

SEQ ID NO: 192530 - protein, 170 aa, Glycine max
  Coding DNA Sequence Number=SeqID_75752
MEASTISRSLNPFLNPSTTKLKESGADLECGLGEMRGLARAQVARGSGFEAVGVGVRVGGVGFRGVIGGATEAVVVSGGGGENERESEEAAQLKVEEGMWYGMEIRESWFDFILSFSLRVLLLKLGEKGKEVFAERAIATLGKLEAWILGFATIRANCNDEGLQCKVGVE

SEQ ID NO: 192531 - protein, 109 aa, Glycine max
  Coding DNA Sequence Number=SeqID_75753
MPVFVPMPFKDSRSTDVEGPMVFNDTGYHHWVLHAHQLMPSSSSNHTVLGESLIPAQPLDPSHSDVIRLGCYMSTSFCCALDYQLFTSLHYNTSHDNTSLNSSLVRTFH

SEQ ID NO: 192532 - protein, 224 aa, Glycine max
  Coding DNA Sequence Number=SeqID_75754
  Gene Ontology: Mol. function=calcium ion binding; Cellular component =nucleus; Biological process=regulation of transcription, DNA -dependent
  Homolog annotation: Hit_ID=Q9FYG2; Match level="QueryCoverage=93%, HitCoverage=21%, E-value=9e-59, Identity=58%"; Hit description =Calmodulin-binding transcription activator 4
  Pfam annotation: Domain name=IQ; Domain location=155-175; Score=20.4; E_value=0.0065; Accession=PF00612.17; Description=IQ calmodulin -binding motif
  Pfam annotation: Domain name=IQ; Domain location=178-198; Score=32.5; E_value=1.5e-06; Accession=PF00612.17; Description=IQ calmodulin -binding motif
  Pfam module annotation: Pfam domain module=IQ::IQ; Domain location =155-175::178-198
MVASLIGSGASAGAVTDPNAQDPIGKTAASIAVGSGHKGLAGYLSEIAVTSHLSSLTLEESELSKSFVELQADITVNSVSKENLTASEDQASLKDTLAAIRNVTQAAARIQFAFRSHSFRKRRAREAAANAGGIGTISEISAMLKLAFRNSREYNSAALSIQKKYRGWKGRKDFLALRKKVVKLQAHVRGYQVRKHYKVIWAVGILDKVVLRWRRKGAGLRGFR

SEQ ID NO: 192533 - protein, 77 aa, Glycine max
  Coding DNA Sequence Number=SeqID_75755
MKRQAAFCPRKSKGLLISLNPILTCGVNINFCDINGWTALHWAARFGRYRALKCKEKDKCFRYSSLKIKFLEMQTAG

SEQ ID NO: 192534 - protein, 166 aa, Glycine max
  Coding DNA Sequence Number=SeqID_75756
  Gene Ontology: Mol. function=RNA-directed DNA polymerase activity; Biological process=RNA-dependent DNA replication
  Homolog annotation: Hit_ID=Q1RV13; Match level="QueryCoverage=67%, HitCoverage=35%, E-value=7e-14, Identity=31%"; Hit description=IMP dehydrogenase/GMP reductase
MERSRFEDSKDHTEWLQKCYIATLHEPENFSKAKKMLILQGVEAMRVRYLGGNKGLRQGDPLALFLFLMVVEGLEGLMRQTMLANKFSGVKVGQEEVVVSVLQFVDDTLMFTDVTFENVLCMKRTVRCFEVILYLGIPIGTNSMKMTTWQPIIEKIIKTKLATWKQ

SEQ ID NO: 192535 - protein, 405 aa, Glycine max
  Coding DNA Sequence Number=SeqID_75757
MYHLEKPQRDDKQFLTPSFSSTLLDQIYRSIDEGERKNGEIKFYRHTTMSTSKRQSRSNSKSMDAGDRKIVRAKNGRKKLHCDEDIMFFSSTSISSTDSSSLGFSSSDTESISRASCFAPRVGRRGGGSASFRSEKQGMRVLDGFCRNSSHRSKHAHSPLPVSSRHHVSVSEQQRHEHVTACDEEALMIKSKSRALRIYNNLKKVKQPLSPGGRVTSFLNSLFANTKKTTSTTSRSCGEGNAPSSSSSCYYSSTCSSASSFSRSCLSKTMSSERDRLRNGVKRTVRFYPVSVIVDEDSRPCGDKRLCEEEEASGEFLREYNRHNSKIKSNDNLVLKDLPLRKTNLVEDGDDNDDHDDDASSYASSDLFELDHLAVFGSGRYSEELPVYETTHVSTNRAIANGLIV

SEQ ID NO: 192536 - protein, 83 aa, Glycine max
  Coding DNA Sequence Number=SeqID_75758
  Homolog annotation: Hit_ID=Q946Z2; Match level="QueryCoverage=47%, HitCoverage=7%, E-value=4e-11, Identity=80%"; Hit description =Putative acyl-CoA synthetase
IYCAVIPREGSNIDDAEVLRYCKKNLASFKVPEKVLNTNSRQDHAYAFLLSCSCSLPLVLMKPSIASLPFKLYIVAKRVHVKE

SEQ ID NO: 192537 - protein, 181 aa, Glycine max
  Coding DNA Sequence Number=SeqID_75759
VASTRHLVDPEKSDRALGFSALVTGLYQSYRVPVPTARSCHRDIGKGRVHKTPSGPEEVQQGPGVSSSDYGPLSDLQVPAIPNKVIRPPANRAFIKKYCDPRQADGETPQQPRDGRQQATDAPPPPLEFTSAQSQKGDQVQSQRKVKYLVRDRQVIRRPAQDVKEALLGGNLVPFKSLLVI

SEQ ID NO: 192538 - protein, 490 aa, Glycine max
  Coding DNA Sequence Number=SeqID_75760
  Gene Ontology: Mol. function=triacylglycerol lipase activity; Biological process=lipid metabolic process
  Homolog annotation: Hit_ID=Q8L570; Match level="QueryCoverage=96%, HitCoverage=88%, E-value=2e-58, Identity=31%"; Hit description =Lipase class 3-like protein
  Pfam annotation: Domain name=Lipase_3; Domain location=149-285; Score= 74.0; E_value=4.7e-19; Accession=PF01764.16; Description=Lipase (class 3)
MVLSKVVKKVTGRLEQMQPEAPKNTMQVVFMLAEAMRYGYTETLGTWNLFDLPTAIIHAVTDKDKKTVASECDERSDCVQLKAPGVLDELYEVKKLLTRAMLFSSRKRFGAFLFAAGFAKEDVLLRKRTARILKPAFTVIRDKESKCLFVFIRGTRSIKDTLTDAIAAPIPFSHRFISSDGKLRRNNTVSGHAHRGMVTAARWIRRHCTSTLLDALQENPDFKIKIIGHSLGGGTAALLTFMLREMKQFSSSACMTLELAEFGKPFITSIINGYDIVPTLSASSVHDVIYKGRIKDKNILTAVGSRLSFAKAITGHAVTRCTQVVKKHQQRTQSLLPCSQRENIETSDDLVKASQSWETSCETLLTEEHVIIESVSDDEEYNSSSEGSDGDDDDSDDDKDKLSNIHAKDKEATTTKNITEEESVCPVPTSVNLDRHPLYPPGKIMHIVPENNNSNRKYPDKKRIYLYETPTQFYGKLRFSRGIILDHLTK

SEQ ID NO: 192539 - protein, 671 aa, Glycine max
  Coding DNA Sequence Number=SeqID_75761
  Gene Ontology: Mol. function=metal ion binding; Cellular component =intracellular; Biological process=protein kinase C activation
  Homolog annotation: Hit_ID=Q9C6T2; Match level="QueryCoverage=84%, HitCoverage=94%, E-value=0.0, Identity=59%"; Hit description=PPR -repeat protein, putative
  Pfam annotation: Domain name=ESCRT-II; Domain location=572-671; Score= -27.0; E_value=2.8e-06; Accession=PF05871.2; Description=ESCRT-II complex subunit
  Pfam annotation: Domain name=PPR; Domain location=180-214; Score =16.2; E_value=0.09; Accession=PF01535.11; Description=PPR repeat
  Pfam annotation: Domain name=PPR; Domain location=282-316; Score =44.8; E_value=3e-10; Accession=PF01535.11; Description=PPR repeat
  Pfam annotation: Domain name=PPR; Domain location=317-351; Score =13.9; E_value=0.17; Accession=PF01535.11; Description=PPR repeat
  Pfam annotation: Domain name=PPR; Domain location=353-387; Score=9.4; E_value=0.57; Accession=PF01535.11; Description=PPR repeat
  Pfam annotation: Domain name=PPR; Domain location=419-453; Score=1.0; E_value=5.7; Accession=PF01535.11; Description=PPR repeat
  Pfam annotation: Domain name=PPR; Domain location=79-113; Score=34.0; E_value=5.2e-07; Accession=PF01535.11; Description=PPR repeat
  Pfam module annotation: Pfam domain module=ESCRT-II::PPR::PPR::PPR::PP R::PPR::PPR; Domain location=572-671::180-214::282-316::317-351::353 -387::419-453::79-113
PPQSSELNAKFNEQGWLSLLKRCKSMEEFKQVHAHILKLGLFYDSFCGSNLVASCALSRWGSMEYACSIFSQIEEPGSFEYNTMIRGNVNSMDLEEALLLYVEMLERGIEPDNFTYPFVLKACSLLVALKEGVQIHAHVFKAGLEVDVFVQNGLISMYGKCGAIEHAGVVFEQMDEKSVASWSSIIGAHASVEMWHECLMLLGDMSGEGRHRAEESILVSALSACTHLGSPNLGRCIHGILLRNISELNVVVKTSLIDMYVKCGSLEKGLCVFQNMAHKNRYSYTVMIAGLAIHGRGREAVRVFSDMLEEGLTPDDVVYVGVLSACSHAGLVNEGLQCFNRMQFEHMIKPTIQHYGCMVDLMGRAGMLKEAYDLIKSMPIKPNDVVWRSLLSACKVHHNLEIGEIAAENIFRLNKHNPGDYLVLANMYARAKKWANVARIRTEMAEKHLVQTPGFSLVEANRNVYKFVSQDKSQPICETIYDMIQQMEWQLKFEGYTPDMSQVLLDVDEDEKRQRLKHHSQKLAIAFALIQTSEGSPIRISRNLRMCNDCHTYTKFISVIYEREITVRDRNRFHHFKDGTCSLVIVPVTLASTFQFAARSLTHEAREAFLSALVSEGRAEWMDKGHRKCLILWYRLQDWADILIQFAKNNGLEDGVVTVEEIRTGTESQGT

SEQ ID NO: 192540 - protein, 102 aa, Glycine max
  Coding DNA Sequence Number=SeqID_75762
MTNSSFHVVVGLVEVHCRGDSFVVRIEFMIIVMVDVSEESPSEGLFGLPQTRLFNDLLGCYFCSPHVALCTPQIGHSRMYLHSGLRIPKGKKGVPGHIWFQK

SEQ ID NO: 192541 - protein, 381 aa, Glycine max
  Coding DNA Sequence Number=SeqID_75763
  Gene Ontology: Mol. function=protein serine/threonine kinase activity; Cellular component=membrane; Biological process=protein amino acid phosphorylation
  Homolog annotation: Hit_ID=Q67UT0; Match level="QueryCoverage=99%, HitCoverage=98%, E-value=1e-105, Identity=53%"; Hit description =Putative serine/threonine protein kinase
  Pfam annotation: Domain name=Pkinase; Domain location=105-376; Score =174.7; E_value=2.3e-49; Accession=PF00069.15; Description=Protein kinase domain
  Pfam annotation: Domain name=Pkinase_Tyr; Domain location=105-372; Score=102.3; E_value=1.5e-27; Accession=PF07714.7; Description =Protein tyrosine kinase
  Pfam module annotation: Pfam domain module=Pkinase::Pkinase_Tyr; Domain location=105-376::105-372
MEVADLEKEVQKQTELGVMYRKRMERTQDYLRYCLQIAQANGILDLIVNCKGEFQQSPVSVPTISSITSPQIHIPTPPNHGHHPNLAAIIDQAKINGWYIDPNEIQLEEKIGQGSTAEIHRGTWRGFEVAVKCISEDFFRTNQNGVAYFSQELETLSRQRHRFVLHLMGACIHPPRRAWVVTEHLSTTLKEWLHGPGTRRRERMVPLPPFKDRVIRALEIAQAMQYLHEQKPKLVHRDLKPSNIFLDDAMHVRVADFGHARFLGDEEMALTGETGTYVYMAPEVIRCEPYNEKCDVYSFGIILNELLTGNYPYVETEYGPTKIAMEVVEGKLRPKLPCDDVGQLGELIDLICLCWDKNPSTRPSFATITLCLKSYVKKNLL

SEQ ID NO: 192542 - protein, 78 aa, Glycine max
  Coding DNA Sequence Number=SeqID_75764
MAHQAAAIKLRERRWGRVERERENGDDENVPEKRDRMKANPILKSKVLLLLSSKRQKTELSQKPPPPLMKEKREKGKG

SEQ ID NO: 192543 - protein, 162 aa, Glycine max
  Coding DNA Sequence Number=SeqID_75765
  Homolog annotation: Hit_ID=Q8S8M7; Match level="QueryCoverage=98%, HitCoverage=84%, E-value=3e-27, Identity=43%"; Hit description =Expressed protein
DEREVMPPNPEAVAAVASAATATSHGIEVAVEFKPVEHPIEPLDNDRPIQCPLPEPSILNCLLGKIPQTVSPYMVHYSMDYLSEAFSEHKNPKDGRIWKERVSATVGRRGDLPVMKEGGTLESEDAGARPRTSRSNRMILPSVSAPEHNILKLLDECNASGI

SEQ ID NO: 192544 - protein, 67 aa, Glycine max
  Coding DNA Sequence Number=SeqID_75766
  Subcellular localization annotation: CTP_CleavageSite=25; ConfidenceScore=5.25e-01
MLNAKWCCTTLYASSANFESTLTPNAESAPTLTTTQSAPTPCVEISFIPALLSTMFRPPPVRFSVPI

SEQ ID NO: 192545 - protein, 709 aa, Glycine max
  Coding DNA Sequence Number=SeqID_75767
  Homolog annotation: Hit_ID=Q9FK80; Match level="QueryCoverage=38%, HitCoverage=43%, E-value=6e-53, Identity=44%"; Hit description =Arabidopsis thaliana genomic DNA, chromosome 5, P1 clone:MRA19
MEKMSDDILLDDWEDALLEQLIQTEEQFVLTSSSSAPKPLPPPPPPPPSAVVSFSPPRELSQRPTTSITVDSPSPSPTPNPISDNKDLEIDRLKGAGTSGEADCKSGMLVQLYILVAVDWLRTRFCLICSHFAAAGNFDFEKERVKLKKERDKKEDQLKSISSRNEENACTKFSKSKSSDTGQNDRDFGTHAPNSHKISSKFQNGVSSNDPIVETTFKAKGVEIATVSHQEAQGALPLHDDLSAYLDLSQKLLAIWGSPTDNKMGTNVISKLLVGVAFHYLKDRFHTPEAAKLSNFYLALTKIADGTGVLETLIEPLLDLSGMENLSMCTAYGSEAPTGIGKECWKEVDVWSGFDNYDENTRKWNVFSRALMTWEGMKNNVFIEGLCVGKGYVDSGVKDGNIFNEEIVSRQECQSQQNSLQPRVNWIYLFEIMHQIAMKITEERVRVEVVSIMKLHFLRSNAYFERERFSQKIVFETISELLKKDAGLSVKKHALRLLYLVLNCPKLLAAFCCGCKEGDDSSAMDVNGLALHFQNFKIILQGLSDCVATCRGGLLELKVSRNAILVLAFLASSGQLGFEIFVGHKLSCRGVNYLMLILQLLVSEMDLEAGAHEQQPEIFRERTFLIREILILLNRLVSNPSYSATVLRGLMTTRDMAGLTIDVASRLSRKEKKTEQQDSMVKHIRETEIVDLARLFKKRVGVGAEMVGS

SEQ ID NO: 192546 - protein, 59 aa, Glycine max
  Coding DNA Sequence Number=SeqID_75768
MEGTARHWVTLGIWLMDIGPQLLTNAQATTTPQKVGLVYLVVGGNGVVGSIKVHGEWRN

SEQ ID NO: 192547 - protein, 802 aa, Glycine max
  Coding DNA Sequence Number=SeqID_75769
  Gene Ontology: Mol. function=protein binding; Cellular component =membrane; Biological process=defense response
  Homolog annotation: Hit_ID=Q19PK7; Match level="QueryCoverage=96%, HitCoverage=81%, E-value=0.0, Identity=54%"; Hit description=NBS-LRR type disease resistance protein
  Pfam annotation: Domain name=LRR_1; Domain location=450-472; Score =10.2; E_value=3.5; Accession=PF00560.23; Description=Leucine Rich Repeat
  Pfam annotation: Domain name=LRR_1; Domain location=474-495; Score =9.2; E_value=5.4; Accession=PF00560.23; Description=Leucine Rich Repeat
  Pfam annotation: Domain name=LRR_1; Domain location=702-724; Score =7.8; E_value=9.9; Accession=PF00560.23; Description=Leucine Rich Repeat
  Pfam annotation: Domain name=NACHT; Domain location=40-200; Score= -35.4; E_value=0.033; Accession=PF05729.3; Description=NACHT domain
  Pfam annotation: Domain name=NB-ARC; Domain location=2-313; Score =280.8; E_value=2.7e-81; Accession=PF00931.13; Description=NB-ARC domain
  Pfam module annotation: Pfam domain module=LRR_1::LRR_1::LRR _1::NACHT::NB-ARC; Domain location=450-472::474-495::702-724::40 -200::2-313
NAWHDQRGDALLLDNTDLVGIDRPKKKLIGWLINGCPARKVISVTGMGGMGKTTLVKKVFDDPEVRKLFKACVWVTVSQSCKIEELLRDLARKLFSEIRRPIPEGMESMCSDKLKMIIKDLLQRKRYLVVFDDVWHLYEWEAVKYALPNNNCGSRIMITTRRSDLAFTSSIESNGKVYNLQPLKEDEAWDLFCRNTFQGHSCPSHLIEICKYILRKCGGLPLAIVAISGVLATKDKRRIDEWDMICRSLGAEIQGNGKLDNFKTVLNLSFNDLPYHLKYCFLYLSIFPEDYLIQRMRLIRLWIAEGFIEAREGKTKEDVADNYLKELLNRNLIQVAEITFDGSVKTLRIHDLLREIIILKSKDQNFVSIVKEQSMAWPEKIRRLSVHGTLPYHRQQHRSGSQLRSLLMFGVGENLSLGKLFPGGCKLLGVLDYQDAPLNKFPVAVVDLYHLRYLSLRNTKVTMVPGYIIGKLHNLETLDLKKTCVRELPVDILKLQKLRHLLVYQFKVKGYPQFYSKHGFKAPTEIGNLKSLQKLCFVEANQDCGIITRQLGELSQLRRLGILKLREEDGKAFCLSIEKLTNLHALSVASEGENKVIDLAFLCSPPPFLQRLYLSGRLQELPSWIQSLHSLARLFLKWSCLKYDPLVYLQDLPSLAHLELLQVYDGDTLHFVCGKFKKLKVLGLDKFDGLKQVTVGEDAMPCLERLSIGRCQLLKKVPSGIEHLNKLKVLEFFDMPDELMKTICPHGPGKDYCKVSHIPNVYSTYWRDDGWDVYALDSFSRNCSPRSGTVMRSHEPRTLWKV

SEQ ID NO: 192548 - protein, 76 aa, Glycine max
  Coding DNA Sequence Number=SeqID_75770
MGETHEISHHNLADFEPCLGYASEGQVVGGILLQNTLEGPQFRPQSQPLHSTIGKIPPIMEGMGKVGSSRGKAQGR

SEQ ID NO: 192549 - protein, 139 aa, Glycine max
  Coding DNA Sequence Number=SeqID_75771
  Gene Ontology: Cellular component=chloroplast thylakoid membrane
MTKKGKKQLMSSAPWRGEESEESFKEGKLKVTRQGDGTSTMHVPASKSKHHHHDLHDDLGIEIDPELRYSFQRNFQVPIARKLGPPSIAIVGFWFLQFLQRVFSIDTMVKPLPPVMAYNVSRNLNFFTRIFTQFFAEVE

SEQ ID NO: 192550 - protein, 57 aa, Glycine max
  Coding DNA Sequence Number=SeqID_75772
MTVEEGAMPGLKKLIIQRCDSLKQHCVQMEVRIIGEYNMSQQFISPIGGMGVGMSTH

SEQ ID NO: 192551 - protein, 156 aa, Glycine max
  Coding DNA Sequence Number=SeqID_75773
MEIKPSHDLWNKIEAGLDEADISVENLAVSSPYKWWKYAAIILFLLSSGILVYFNIDRIKTAHIIAHDKSNEKTETLDNNPELAFRNEHLDHSAISSDIVDRSIATNGKEKERVDSITSNRDHNRAITKDIKVSNYEADHDLHPIASGVQIKPVDL

SEQ ID NO: 192552 - protein, 229 aa, Glycine max
  Coding DNA Sequence Number=SeqID_75774
  Homolog annotation: Hit_ID=UPI0000503967; Match level="QueryCoverage =83%, HitCoverage=74%, E-value=6e-07, Identity=28%"; Hit description =UPI0000503967 related cluster
MRSDCLVQVSILTLFRNPMNCGFFHVSSTIEFGAMRIDCLVQFSILTLFRSPINCVFVHVSSTLEFGAMRSDCLVQFSILTLFRSPMNCVIVHVSSTFEFGAIRGDCLVQFSILTLFRSPINCVFVHVSSTFEFGAIRSDCLVQFSILTLFRSPINFVFVHVSSTFEFGAIRSDCLVQSSILTLFRSPMNCLFVHVSSTFEFGAMRSDCLVQFSILTLFRSPMNCVFDH

SEQ ID NO: 192553 - protein, 192 aa, Glycine max
  Coding DNA Sequence Number=SeqID_75775
  Homolog annotation: Hit_ID=Q9FH41; Match level="QueryCoverage=14%, HitCoverage=10%, E-value=7e-07, Identity=82%"; Hit description =Arabidopsis thaliana genomic DNA, chromosome 5, TAC clone:K2N11
MNLEMSIVTLALLPAPDVPIIHCSESGLERPAPPIDEKCGNWKRSEAVAAAASGGGDGEKREMKMWDNWALLVKANTLDYVARPWRHTKRKFCFFFLEPLCFFFAFLLLLHSSSSSSPPKSTSEHFFFFLVEEIVAIAAIVAVIRRKMSWCIFGGFRKEQRCCPSSRELCHRPQSSKRREPFLFPPVLPAMA

SEQ ID NO: 192554 - protein, 697 aa, Glycine max
  Coding DNA Sequence Number=SeqID_75776
  Gene Ontology: Mol. function=amylo-alpha-1,6-glucosidase activity; Cellular component=membrane; Biological process=carbohydrate metabolic process
  Homolog annotation: Hit_ID=Q5JLH8; Match level="QueryCoverage=88%, HitCoverage=92%, E-value=0.0, Identity=57%"; Hit description =Putative ERD4 protein
  Pfam annotation: Domain name=DUF221; Domain location=204-630; Score =586.1; E_value=3.3e-173; Accession=PF02714.6; Description=Domain of unknown function DUF221
MATLADIGVSAAINILSAFAFLLAFALLRIQPINDRIYFPKWYISGDRSSPRRSGGNFVGKFVNLNFRTYLTFLNWMPQALRMSESEIISHAGLDSAAFLRIYTLGNIPHMSGHTISDTVDSFFQTNHPEHYIGHQAVYNANKFAKFAKRRDRLQNWLDYYQLKFERHPDKRPTVKNGFLGFWGGKVDAIEYYKHSIKELDTMMTMERQKIIKDPKSILPVAFLSFKSRWGASVCAQTQQSKNPTLWLTDWAPEPRDVYWQNLAIPFVSLNIRKLIISLSVFALVFFYMIPIAFVQSLANLEGLERVAPFLRPVIELKFIKSFLQGFLPGLALKIFLYILPTVLMIMSKIEGYIALSTLERKTAAKYYYFMLVNVFLGSIVTGTAFQQLHAFLHQSPTQIPRTIGVSIPMKATFFMTYIMVDGWAGIAGEILRLKPLVIYHLKNMFLVKTERDRGKAMDPGSVDFPETIPSLQLYFLLGIVYAVVTPILLPFVLVFFAFAYLVYRHQIINVYNQQYESAAAFWPLVHSRIIASLLISQLLLLGLLSTKKAAKSTPLLVILPILTFAFHKFCQRRFEPAFRKYPLEEAMSKDLLEKSTEPDLNIEAYLADAYLHPIFRSFEVDDELVEVRVDNHQTNVADSQPSEPSSPSPPHHVQQPSPPHHIHEPSPPQYSEYQTSPPSYYYQYHPPSPPHYVYQY

SEQ ID NO: 192555 - protein, 604 aa, Glycine max
  Coding DNA Sequence Number=SeqID_75777
  Gene Ontology: Mol. function=catalytic activity; Cellular component =peroxisome; Biological process=metabolic process
  Homolog annotation: Hit_ID=Q84P24; Match level="QueryCoverage=97%, HitCoverage=95%, E-value=1e-170, Identity=53%"; Hit description=4 -coumarate-CoA ligase-like protein
  Pfam annotation: Domain name=AMP-binding; Domain location=67-523; Score=380.1; E_value=3.5e-111; Accession=PF00501.18; Description=AMP- binding enzyme
MATNANCEMPLTHHPHWFSPKSGIYHSKHAPVDLPNDPFLDLVSFIFSHRHNGVSALVDSSSGCSISYPKLLPLVKSVASGLHRMGVSQGDVVLLLLPNSIYYPIVFLAVLYIGAIVTPLNPLSSVYEIRRQVSECGVSLAFTVPENEKKLEPLGISVIAVPENEKGLKDGCFSCFCDLISCDFDLPKRPVIKQDDTAGILYSSGTTGVSKGVVLSHKNLVAMVELFVRFEASQYEGSCLRNVYLAVLPMFHVYGLSLFAVGLLSLGSTVVVMRKFDIDEVVRVIDEYKVTHFPVVPPMLTALIKRAKGVNGGEFQSLVQVSSGAAPLSMGVINEFIRAFPNVDFIQLNADAISFNKLYQIVVNEKKHWKYLNELLRFSLKVIQAKSMLDGYGMTESTAVGTRGFNTEKFRNYSSIGLLAPNMEAKVVDWNTGAFLPPGSSGELRLRGPSIMTGYLNNEEVTMSTIDKDGWLHTGDVVYFDHDGYLHISDRLKDIIKYKGFQIAPADLEAVLILHPEVVDVAVTRAMDEETGEIPVAFVVRKVGSVLSPKHIMDFVAEQKHLCIMIKVAPYKKVRKVFFTDKIPRSATGKILRKQLRNYLTSNL

SEQ ID NO: 192556 - protein, 264 aa, Glycine max
  Coding DNA Sequence Number=SeqID_75778
  Gene Ontology: Cellular component=integral to membrane; Biological process=protein transport
  Homolog annotation: Hit_ID=Q9C6X2; Match level="QueryCoverage=94%, HitCoverage=89%, E-value=1e-99, Identity=70%"; Hit description =Secretory carrier membrane protein, putative
  Pfam annotation: Domain name=SCAMP; Domain location=90-264; Score =386.5; E_value=3.9e-113; Accession=PF04144.4; Description=SCAMP family
MNGTTAPASKSRIPPLASESLGFGQRHDATVDIPLDTTNVMSSLIQGLPLKTDSKKKGQELAAWEADLKRREKEIKRREEAVSRAGVPVDDKNWPPFFPIIHHDIANEIPVHAQRLQYLAFASWLGIVLCLGFNVVAVTVCWIRGGGVKIFFLAVIYALLGVPLSYVLWYRPLYRAMRTDSALKFGWFFMLYLLHIGFCIFAAIAPPIVFHGKSLTGILAAIDVFSDHVLVGIFYLIGFGMFCLEALLSFWVLQKIYMYFRGHK

SEQ ID NO: 192557 - protein, 537 aa, Glycine max
  Coding DNA Sequence Number=SeqID_75779
  Pfam annotation: Domain name=MFS_1; Domain location=62-478; Score= -5.0; E_value=0.00054; Accession=PF07690.6; Description=Major Facilitator Superfamily
MKEVTVEAEGGAPGVVQEGGKGTTVRPDIHNSAMKILRAREPYNGYTEEVGEKPSGFEVMGWYLYEFCFYFVQTVLVPVVFPLIISQLQPLPAADSLQEWNKNHPTKHCSQKEFHLYSKLTNHTIRTSGGSNFSALEWTSIAWATGLALAAPILGFISFHLDGHFPKLITAAATGIGVFFCLPAGFFKVTAIFIPYIAGIVAASTVASAAHTHHLGLMIRCFTGPTLKRSEFSIRQAVSSRLSLHATAAGCLGAALISSFTYHMLRELNYNDRDVMSLWVVSIFSGLIWLVGVLHIVTAIGRTTDSISFSSRLHPFSIFKYPHAIGGLAGVFLSSFTTMSIFTGGVIFIVGQLCIKPLHLLYLWLTYFLFPLVSLSLLQPLLHVIKMNSVKMQIVGFLLSLLSSGFGFYYGHSHWKWGHLVLFGAVQSTATGILYAFGRLLVLDCAPSGKEGAFSIWYAWMRAAGLCVGFTVGSVAPGRVRTSFGVAFCTAIAGIVVLLFGNISDVGGAVAAGHVRDECERSSAVLPGLDSKESARV

SEQ ID NO: 192558 - protein, 812 aa, Glycine max
  Coding DNA Sequence Number=SeqID_75780
  Gene Ontology: Mol. function=protein binding; Cellular component =membrane; Biological process=defense response
  Homolog annotation: Hit_ID=Q19PK7; Match level="QueryCoverage=100%, HitCoverage=87%, E-value=0.0, Identity=52%"; Hit description=NBS-LRR type disease resistance protein
  Pfam annotation: Domain name=LRR_1; Domain location=563-584; Score =6.1; E_value=20; Accession=PF00560.23; Description=Leucine Rich Repeat
  Pfam annotation: Domain name=LRR_1; Domain location=586-607; Score =7.8; E_value=10; Accession=PF00560.23; Description=Leucine Rich Repeat
  Pfam annotation: Domain name=LRR_1; Domain location=609-630; Score =9.8; E_value=4.2; Accession=PF00560.23; Description=Leucine Rich Repeat
  Pfam annotation: Domain name=LRR_1; Domain location=762-784; Score =1.8; E_value=1.3e+02; Accession=PF00560.23; Description=Leucine Rich Repeat
  Pfam annotation: Domain name=NB-ARC; Domain location=136-447; Score =323.1; E_value=4.9e-94; Accession=PF00931.13; Description=NB-ARC domain
  Pfam module annotation: Pfam domain module=LRR_1::LRR_1::LRR_1::LRR _1::NB-ARC; Domain location=563-584::586-607::609-630::762-784::136 -447
MADSSVSFLLDKLTLLLQAEVNLQRGVREDVQHIKYELERHRGILRVADALEDKDPELKAWVKRVRDVAHDMEDAIDEFSLRLVDQHGQGNSSSFHVNFFIRHRIASNIQNIKSRVDIISQGRPNIAGIGSGSSQRLRLDSQGDALLLEEADLVGIDKPKRQLSDLLFNEEAGRAVIPIYGMGGLGKTTLAKQVYDDPKVKKRFRIHAWINVSQSFQLEVLLKDLVQQLHNVIGKPSPEAVGQMKSDQLKELIKNLLQQSRYLIVLDDVWHVKVWDSVKLALPNNNRGSRVMLTTRKKDIALYSCAELGKDFNLEFLPEEESWYLFCKKTFQGNPCPPYLEAVCRNILKMCGGLPLAIVAIGGALATKNRANIEEWQMVYRSFGSEIEGNDKLEDMKKVLSLSFNELPYYLKSCLLYLSIFPEFHAIEHMRLIRLWIAEGFVNGEDGKTLEEVADSYLKELLDRSLLQVVAKTSDGRMKTCRMHDLLREIVNLKSKDQNFATIAKDQDIIWPDKVRRLSIINTLNNVQQNRTTFQLRSLLMFASSDSLEHFSIRALCSSGYKLLRVLDLQDAPLEVFPAEIVSLYLLKYLSLKNTKVKSIPGSIKKLQQLETLDLKHTYVTVLPVEIVELQRLRHLLVYRYEIESYAYLHSRHGFMVAAPIGLMQSLQKLCFIEANQALMIELGKLTQLRRLGIRKMRKQDGAALCSSIEKMINLRSLSITAIEDDEIIDIHNIFRPPQYLQQLYLGGRLDNFPQWISSLKNLVRVFLKWSRLEEDPLVHLQDLPNLRHLEFLQVYVGETLHFKAKGFPSLK

SEQ ID NO: 192559 - protein, 269 aa, Glycine max
  Coding DNA Sequence Number=SeqID_75781
MDPKSTLRLMRILGPSLASLTQSSWSLLSNVLWGGHLVSLLLDHFPNKVIRKLVPYMSHFDQEDMTILYRFLKVITTKFDYKFFKKAQVEKVERAKAIEAQAEKAKGKHKAQVEDKWVPHPSPPINSGVIKRVKLGPQDEGPSKRQRPPRFPIDEGKCLFFMGIVEFWVDEFEKANIESQNSLINCVKDEQALAKATKANETLLSSWLLQRIQPKFSKKRLSVSKRILFSSRDVDYSLFAVDKGVNHQGELVNKARMSADEVLTMSTLV

SEQ ID NO: 192560 - protein, 43 aa, Glycine max
  Coding DNA Sequence Number=SeqID_75782
MKQFVFFMPNVGECHDCQMGDDQQVIIKLLTRGTHHMLGSYLR

SEQ ID NO: 192561 - protein, 87 aa, Glycine max
  Coding DNA Sequence Number=SeqID_75783
MGSMRLFKGVSMKAAHLVCLLVCLLFAAFVHAQEKDDLVKEAQIKQQILKDVKKTCTPQKKQSDKAWQEMILSSEANQLLIKNAITA

SEQ ID NO: 192562 - protein, 185 aa, Glycine max
  Coding DNA Sequence Number=SeqID_75784
  Gene Ontology: Mol. function=N-acetyltransferase activity; Biological process=metabolic process
  Homolog annotation: Hit_ID=Q8ZNY6; Match level="QueryCoverage=69%, HitCoverage=92%, E-value=2e-38, Identity=61%"; Hit description =Putative acetyltransferase
  Pfam annotation: Domain name=Acetyltransf_1; Domain location=41-117; Score=55.8; E_value=1.4e-13; Accession=PF00583.14; Description =Acetyltransferase (GNAT) family
  Pfam annotation: Domain name=FR47; Domain location=37-127; Score= -3.7; E_value=0.029; Accession=PF08445.1; Description=FR47-like protein
  Pfam module annotation: Pfam domain module=Acetyltransf_1::FR47; Domain location=41-117::37-127
MQLSITNTVTQQEKEELFVGLRAYNAQFLDMANFSGDIGVYVRDEKGVMLGGLIGVRKGDWLNIDYLWVSDTVRGTGVGSQLIKAAEEEARRKGCKHALVDTASFQARPFYEKQGYQLQMSLQDYPYQGILLFIASRFPNLKRVACLLFRPRRMLWPGQENHGDGNGTYSKTLQKGAKSGSDAAC

SEQ ID NO: 192563 - protein, 159 aa, Glycine max
  Coding DNA Sequence Number=SeqID_75785
MTDLVSAEDDVNLRVSTGLLAAIDEGRRRRHSKKVYTDDHSGIFARQRDSKVSMTDLVSAEDDVNLRVSTGLSAAIDEGRRRRHSKKVYTDDHSGISARQRDSKAWFEQNRGGGCRPARPGELSSPRRAGLLPPEATAFWRNIPEGPSGPGCYLHPHFY

SEQ ID NO: 192564 - protein, 42 aa, Glycine max
  Coding DNA Sequence Number=SeqID_75786
FGSSEVILFAEAGVRIRASRPEMKFSRVVLNSNGPWCLHEEK

SEQ ID NO: 192565 - protein, 102 aa, Glycine max
  Coding DNA Sequence Number=SeqID_75787
MSNADELLFLKICALIVPELDASLSVERPSFDGLETLLVFSAPETMAVKLGSGTGPFRRGVPPRSLFGKLSRSHFLRGQTFGNMKIKGMGAMWHAPLSQNAP

SEQ ID NO: 192566 - protein, 234 aa, Glycine max
  Coding DNA Sequence Number=SeqID_75788
MAKFDPDIVLEFYANAWPTEEGEGQEYEFTQTRNRADGFDEEAIAQLLCIPGQDFSRTVAGRQVQIMRTSMTTLTQMWMTLLLSNVLPSDHNSDLPLPKCMPPTMHPLNLDTSNRALGFPVLITGLCQSFGVPVTPSKVIRPPITRAFIEKYCTPRQAQGDAPQAADAAPPPHQADPAGSFGTERYLQHLVRQQAANHRGQVQIHECLYQLSLNQQSQGFTPFACPTLDQFRAE

SEQ ID NO: 192567 - protein, 185 aa, Glycine max
  Coding DNA Sequence Number=SeqID_75789
  Homolog annotation: Hit_ID=Q47522; Match level="QueryCoverage=19%, HitCoverage=45%, E-value=3e-14, Identity=97%"; Hit description=LacZ protein
DLPSQWLLFLSAVPPVQLLTGWCVTAKAPPDISAGKCSGRVPFAIQAAQLLGRAIGAGLFAITPAGERGMCCKAIKLGIRCILLSVQAILKFSKFHFDGGDQTFGFINISSILLKAVKIKLIDTVDLEGGPVGKPVVPAALMNRPTRGERRFAYWALAECILAYYVGTDEGVSEVLHVAGEKRLH

SEQ ID NO: 192568 - protein, 36 aa, Glycine max
  Coding DNA Sequence Number=SeqID_75790
MGALYVPPLAFSSPGPLLDQGKIPKKCGEQNSSIML

SEQ ID NO: 192569 - protein, 277 aa, Glycine max
  Coding DNA Sequence Number=SeqID_75791
  Gene Ontology: Mol. function=RNA-directed DNA polymerase activity; Cellular component=mitochondrion; Biological process=RNA-dependent DNA replication
  Homolog annotation: Hit_ID=Q1SYR3; Match level="QueryCoverage=99%, HitCoverage=14%, E-value=1e-135, Identity=71%"; Hit description =RNase H, putative
  Pfam annotation: Domain name=rve; Domain location=47-203; Score =128.4; E_value=2.1e-35; Accession=PF00665.16; Description=Integrase core domain
MARKLLRAGYYWMSMETDCCKHARKCHKCQIYADRIHVPPTTLNVLSSPWPFSMWGIDMIGRIEPKASNGHHFILVAIDYFTKWVEAASYANVTKQVVVRFIKNQIICRYGVPNRIITDNGTNLNNKMMKDLCEEFKIEHHNSSPYRPQMNGAVEAANKNIKKIVQKMVVTYKDWHEMLPYALHGYRTSVRTSTGATPFSLVYGMEAVLPVEVEIPSMRVLMEAQLSEAEWGKWTPNYEGPYVVKRTFSGGALILTTMDGDELPRPVNADAVKKYFV

SEQ ID NO: 192570 - protein, 171 aa, Glycine max
  Coding DNA Sequence Number=SeqID_75792
MGAYTKDEKLLMHFFQESLTGVAVTWYTNLESSREYESFKEYAQRWRDLTAQVAPPMMEREMLTMIVDTLPMFYYEKMVGYMPSSFIDLVFAGERIEVGLKRGKFDYVASTSSGNRRLGTDEENKKEGETHVVIVVPTWPNFPLAQQYQYSANISPSYYPPPYQPRTPNHP

SEQ ID NO: 192571 - protein, 48 aa, Glycine max
  Coding DNA Sequence Number=SeqID_75793
MEHETFHATWLAEIDFSPNGLRFSNLQPQPRLINHEKPMLCRWHRLNP

SEQ ID NO: 192572 - protein, 252 aa, Glycine max
  Coding DNA Sequence Number=SeqID_75794
  Homolog annotation: Hit_ID=Q47522; Match level="QueryCoverage=16%, HitCoverage=53%, E-value=7e-19, Identity=100%"; Hit description=LacZ protein
RVPFAIQAAQLLGRAIGAGLFAITPAGERGMCCKAIKLGNARVFPEFDALAFRGLYVVTFRWLHVLTFRGLQALTFRGLHVLTFRGLHALAFKGLHVLAFKGLHVLTFRGLHIYSFRGLKSLGHPPDLGGGPTMRAQPEGGYRATTVHTGTRFHPCRYKDMSADHAHQHDHSYTDMDQAYRYRRPRGGARYQLLFPLVRVNFELGVIMVIAVSFGKPVVPAALMNRPTRGERRFAYWALAECILAYYVGTDE

SEQ ID NO: 192573 - protein, 177 aa, Glycine max
  Coding DNA Sequence Number=SeqID_75795
MTETNMRAGNSDVHGFLEPQSIQRSGQSQFEPKNYIKNWMQKSKRDVYLAAYLNGAHWQMVIILSKENVVIWFCSLHNRLDNYLKGIINSALKGLDPYSKSKATARWIVVKSNRKKGSTEYGYYVMQWMSTIILGSFKNNWEMYFNDARSLEPERLKALRIQWATYYLKVKNKTISV

SEQ ID NO: 192574 - protein, 80 aa, Glycine max
  Coding DNA Sequence Number=SeqID_75796
MDDFSEDEDQQFFDHINHQSDDQTDDEGIGRPMTPLSPPLQYQQPRCLVDLNFDHLPHYIDRHHFFHQQHNVQPPVGILK

SEQ ID NO: 192575 - protein, 57 aa, Glycine max
  Coding DNA Sequence Number=SeqID_75797
MHSGIVQEVFWTSPHDFVNVSLECRPREARSFPSKIMLDGVWKNHETSNCQTREGDA

SEQ ID NO: 192576 - protein, 114 aa, Glycine max
  Coding DNA Sequence Number=SeqID_75798
  Homolog annotation: Hit_ID=Q10MM9; Match level="QueryCoverage=53%, HitCoverage=50%, E-value=1e-10, Identity=50%"; Hit description =Expressed protein
MDYGSGQRQVEIMSGKSYGCSQSYMAAIPSEVTRASHSGAATAAKPWSFGDPESKRRKRIAKYNVYAVEGKVKATLRDGIRWIKHTCSRIFFLIWGLFSVVICIGLDCGIKGHP

SEQ ID NO: 192577 - protein, 211 aa, Glycine max
  Coding DNA Sequence Number=SeqID_75799
  Homolog annotation: Hit_ID=Q1T502; Match level="QueryCoverage=99%, HitCoverage=100%, E-value=9e-26, Identity=35%"; Hit description =Calcium-binding EF-hand
MEAKAENSMIVSIDQKAIITPHEEPNNNITRSSLKKGKRQKNFFKVALFMMRGRSRKSKMLAVDDESKSIWRKLVGSMRPLHLQSNQSPSHDIDNNNNNNNIPPHQSKMMKITSAPSENGDDGFDSASEFTYSPSPASSRYASAVGLNEMVQEEEEEVAKEKINNDDGDGDEMIDAKAEEFIAQFYHQMRLQSLDVTDDHYQEISMRSLGL

SEQ ID NO: 192578 - protein, 149 aa, Glycine max
  Coding DNA Sequence Number=SeqID_75800
  Homolog annotation: Hit_ID=Q1RV57; Match level="QueryCoverage=96%, HitCoverage=35%, E-value=4e-50, Identity=61%"; Hit description =ENSANGP00000004406, related
MYQRPVYIRKKECSVNSPDYGPLPPDPPGWCLAPFDPDGPQAEGILWSVFSFSLLLVGYILEILGMPLSKALYTLSYMCITAGASGLVVTAIYYIVDIEHLRKPTVLLQWMGMNALVVYALAACDIFPAVIQGFYWHSPENNLVMFVSQ

SEQ ID NO: 192579 - protein, 131 aa, Glycine max
  Coding DNA Sequence Number=SeqID_75801
  Subcellular localization annotation: CTP_CleavageSite=39; ConfidenceScore=5.15e-01
MSSRSSVPGDGRPGGDSSKQSTPPPPHGGFGGGGHSTTTGGGGGSGSGFGGGGHLITGGGGDGGNGGGGDGGIGGGGDGGGGHSIGLGGGGGGGSLHSSHIMRGTWCFSSVEVDETVEGSTVVTRKIMEDK

SEQ ID NO: 192580 - protein, 51 aa, Glycine max
  Coding DNA Sequence Number=SeqID_75802
MVFNFSWRVLRVNSLGLDVVPVKEGERGAKLAGFVVAEDKVEGFVGDGKTS

SEQ ID NO: 192581 - protein, 179 aa, Glycine max
  Coding DNA Sequence Number=SeqID_75803
  Pfam annotation: Domain name=GRP; Domain location=1-86; Score=-18.8; E_value=0.0061; Accession=PF07172.2; Description=Glycine rich protein family
MGVAVVVVVQVVVMVVVEPVVVVMVDLAAKEMAGGGGDSGIGGGKGGGGDGGNGGGGDGGNGGGGDGGNGGGGASGIGGGGHSLGGGGGSSHSLHIMCGTWSSFPTVKVVWVAVAVTETVEDRSKITKHIRGKGAMFFELEMAFGYEGDRYIICLCIGGPWPHHLLLFYLLRYRLIIIE

SEQ ID NO: 192582 - protein, 437 aa, Glycine max
  Coding DNA Sequence Number=SeqID_75804
  Gene Ontology: Mol. function=ATPase activity, coupled to transmembrane movement of substances; Cellular component=integral to membrane; Biological process=transport
  Homolog annotation: Hit_ID=Q2SPD0; Match level="QueryCoverage=99%, HitCoverage=81%, E-value=1e-125, Identity=49%"; Hit description=ABC -type multidrug transport system, ATPase and permease components
  Pfam annotation: Domain name=ABC_tran; Domain location=226-409; Score= 223.4; E_value=5e-64; Accession=PF00005.17; Description=ABC transporter
MLLDKLSRIRMQLYESLGAGQVTARLLTDIETLDKFLGETIAQSRLGNSVKNSAFEMLSQSVTETLEVMQQLRASNSDKRFLDKAKQAAEAVRVAATASGWKSDALSRLSFGVFLFGFEVFRAVAMLMVVFSNLSVGQMIAVFGYLWFMMGPVQELLSVQVSYYAAKAALGRINQVLAAEEEPHYPAAVYAFSGQAPAAISLQQVTFAYGEGDAILADVSLNIAPGEQVALVGVSGAGKSTLVQLLLGLYAPNQGQILFNGQAIEQLGYAQVREHIGVVLQHPMLFNDSVRQNLSLDLPYADADLWQVLEVAQLAQFVRDLPQGLDTPLGRSGVRLSGGQRQRLAIARMMLKKPQVVILDEATSMLDTHTEALLHQAMRKFLRGRTTIIIAHRLSAVKEADRVLVFDGGHIIEEGQHETLVKRTGSVYQRLYGQQTA

SEQ ID NO: 192583 - protein, 182 aa, Glycine max
  Coding DNA Sequence Number=SeqID_75805
  Gene Ontology: Mol. function=monooxygenase activity; Biological process=electron transport
  Homolog annotation: Hit_ID=Q1T1B4; Match level="QueryCoverage=74%, HitCoverage=29%, E-value=2e-16, Identity=36%"; Hit description =Cytochrome P450
MPGMYGHAVVIDGRPEEAIQSRLPVKWMPPSKGRMKCNIDAAFREGGRRMGIGACLRDDRGHCVHAFTTLKPYLPTMKEDEALAILHTLEYLKNNGFHDTLIWWKLPVRWWLETFSVGTMTIWNLAASLINKCRRFLLDILNVSIGFIRRQANSVAHSLAKAQDDDPSRCSSKNQNYCSLSS

SEQ ID NO: 192584 - protein, 163 aa, Glycine max
  Coding DNA Sequence Number=SeqID_75806
  Gene Ontology: Mol. function=ATPase activity, coupled to transmembrane movement of substances; Cellular component=integral to membrane; Biological process=transport
  Homolog annotation: Hit_ID=Q9LZJ5; Match level="QueryCoverage=82%, HitCoverage=8%, E-value=6e-33, Identity=51%"; Hit description =Multidrug resistance-associated protein 10
MVSAEAFETLELVSSFDITSQRKYPVHFDAFFVLTAFCQENIDKVNASLRMDFHNNGANEWLCFRLDYMGVVFLCIATSFMIFLPSAIIKPEYVGLSLSYGLALSSLLAFTISMTCSVENKMVSVERIKQFTNLPSEAPWKIADKTPPQNWPSQGTIVLSNLQ

SEQ ID NO: 192585 - protein, 564 aa, Glycine max
  Coding DNA Sequence Number=SeqID_75807
  Gene Ontology: Mol. function=ATPase activity, coupled to transmembrane movement of substances; Cellular component=integral to membrane; Biological process=transport
  Homolog annotation: Hit_ID=Q7DM58; Match level="QueryCoverage=99%, HitCoverage=38%, E-value=0.0, Identity=58%"; Hit description =Multidrug resistance-associated protein 4
  Pfam annotation: Domain name=ABC_tran; Domain location=256-414; Score= 76.8; E_value=6.8e-20; Accession=PF00005.17; Description=ABC transporter
SSRQAHGTGQIVNHMSVDAQQLADLMMQFHPIWLMPLQVTAALVLIYSNIGVSAFAALLGSSIVFVFTLIRTKRTNSYQFMIMKSRDLRMKATNELLNNMRVIKFQAWEEYFGNKIGKFREAEHGWIGKFLYYFAVNMGVLGSAPLLVTVLTFGSATLLGVPLNAGSVFTITSVIKILQEPVRTFPQALIVISQAMISLGRLNEFLTSKEMDEGAVERVEGCDGDTAVEIKDGEFSWDDADGNVALRVEEMKIKKGDHAAVVGTVGSGKSSLLASVLGEMFKISGKVRVCGSIAYVAQTSWIQNATIQDNILFGLPMNREKYREAIRVCCLEKDLEMMEHGDQTEIGERGINLSGGQKQRVQLARAVYQDCDIYLLDDVLSAVDAQTGSFIFKASTELQTLMTSSISLNVMREGKIVQSGKYDELLKAGLDFGALVAAHESSMGIAESSDTGGENSAQSPKLARIPSKEKENADEKQPQEQSKSDKASAKLIEDEERETGRVNLKVYKHYFTEAFGWWGVVLMLAMSLAWILSFLASDYWLAIGTAEDSAFPPSTFIIVYACIA

SEQ ID NO: 192586 - protein, 90 aa, Glycine max
  Coding DNA Sequence Number=SeqID_75808
MSKAVGEDESMSKVEHEGEVSQEGEKEGDMFQMMSMEFSCDVTSSEGCKCNMLLTRFRFIHDDEGGGRGGEKYEDGGKNKEEQKEIKKWE

SEQ ID NO: 192587 - protein, 132 aa, Glycine max
  Coding DNA Sequence Number=SeqID_75809
  Gene Ontology: Cellular component=plastid; Biological process =peroxisome organization and biogenesis
  Homolog annotation: Hit_ID=O24405; Match level="QueryCoverage=78%, HitCoverage=23%, E-value=1e-49, Identity=82%"; Hit description =Lysine and histidine specific transporter
MLTFPEIEFREECIVTCKEKSERERRIDEWLPITSKRNGKWWYSAFHNVTAMVGAGVLGLPYAMSELGWGPGVTILILSWIITLYTLWQMVEMHEMVPGKRFDRYHELGQYAFGEKLGLYICGASTACCEIW

SEQ ID NO: 192588 - protein, 69 aa, Glycine max
  Coding DNA Sequence Number=SeqID_75810
  Homolog annotation: Hit_ID=Q1SGA7; Match level="QueryCoverage=58%, HitCoverage=6%, E-value=7e-11, Identity=75%"; Hit description =BTB/POZ; NPH3
MDMYGQWSHWHCPKKNSRVLHSVNLVFSMWESESESAATHKYGGGLLTSTNDGVKTEGFVQRGHSWYVS

SEQ ID NO: 192589 - protein, 49 aa, Glycine max
  Coding DNA Sequence Number=SeqID_75811
MVSVDFLAVISFADLGSNVAARNMLSEATAEALAAVVPLNATGLRERER

SEQ ID NO: 192590 - protein, 143 aa, Glycine max
  Coding DNA Sequence Number=SeqID_75812
  Gene Ontology: Mol. function=protein kinase activity; Biological process=protein amino acid phosphorylation
  Homolog annotation: Hit_ID=Q8LI36; Match level="QueryCoverage=59%, HitCoverage=9%, E-value=1e-13, Identity=43%"; Hit description =Putative receptor-like protein kinase
  Pfam annotation: Domain name=LRR_1; Domain location=101-125; Score =10.1; E_value=3.6; Accession=PF00560.23; Description=Leucine Rich Repeat
  Pfam annotation: Domain name=LRR_1; Domain location=44-68; Score=4.0; E_value=51; Accession=PF00560.23; Description=Leucine Rich Repeat
  Pfam annotation: Domain name=LRR_1; Domain location=70-91; Score =18.1; E_value=0.031; Accession=PF00560.23; Description=Leucine Rich Repeat
  Pfam module annotation: Pfam domain module=LRR_1::LRR_1::LRR_1; Domain location=101-125::44-68::70-91
MKFGRGEEERIVLYKLQLLLGPTNQHSPPDLSLAVENVSSLANTVHFLNLSCNNLNGRFFTISTIGLFHNLQVLDLSDNFITGQLPSFGSVPEELLQTSMPLEELDLSFNGFTSNCWRIDPFLSLSSFVGAELPLYKALVMGN

SEQ ID NO: 192591 - protein, 47 aa, Glycine max
  Coding DNA Sequence Number=SeqID_75813
MSAMFIIQRINVGGDDIDNNNDNGHVGTWQHVVGMAVDRWSWWGGLE

SEQ ID NO: 192592 - protein, 110 aa, Glycine max
  Coding DNA Sequence Number=SeqID_75814
MGVIKYLTMNELKILRIPSEMLKLFEHSIFPHKGHSTRSAHPEHTQHTTYVKYMTMDELKLLSIPSEMLKFFNHSSFPRKGHPTRKISMQQGHAYILVARFPDPNYGVKT

SEQ ID NO: 192593 - protein, 216 aa, Glycine max
  Coding DNA Sequence Number=SeqID_75815
  Gene Ontology: Mol. function=protein phosphatase type 2C activity
  Homolog annotation: Hit_ID=Q9LUS8; Match level="QueryCoverage=89%, HitCoverage=44%, E-value=2e-16, Identity=34%"; Hit description =Similarity to protein phosphatase-2c
MDFLNQEMSMLSPEARGMPCNEIHRTSSFSCLSGAALSANATLANTNICNGVIGEDKSFRFWTLLNHFVGPSTPSNMLEYDPCTFTSMSAPSRSEGFLNGMEVPVAGGAAGEDRVQAVCSEDEWLFCEIYDDSIKASNIASMGGSFQYNFDDSLNLQEHQSLSSFKGSDSSLDCFTDSTPHSNSEASPKSFSQTTVLNGLQHVLSQVENDFLYMVE

SEQ ID NO: 192594 - protein, 400 aa, Glycine max
  Coding DNA Sequence Number=SeqID_75816
  Homolog annotation: Hit_ID=Q84WQ7; Match level="QueryCoverage=38%, HitCoverage=32%, E-value=3e-13, Identity=34%"; Hit description =Putative copper chaperone (CCH) protein
  Pfam annotation: Domain name=CS; Domain location=131-200; Score=-4.6; E_value=0.063; Accession=PF04969.6; Description=CS domain
MQEGEGRKNHALILQNNAVGEVCPSVIVTLYFDSHPSLPAQFAPQQSAHPQVHSWHFLPFFLLYAPHSLLLSLLPSLKSLQSFNSSFNFPLSMDAKRPQLATQPLNYQTWFLKVSIHCEGCRRKVKKVLKSIDEISVEVYVNKGNSYTIHELSFVIELGSNPNFKSECYTFVGVFTATIDQQQQKVTVTGSVGVEILLRKLVRAGKHAEMWPENLNRDKKISGKGHKKNEAREPQSLENKGTENATTANCNSGNKSSNNSPEKSPSGDHVPAESGGGGSGKKKKKKVQSGDGNGRSSLSSEAAASTGAPANTGLQFEDLVGQVNVSPPRQQSLSYPETAYYPSMVYVSVYDRFYPSYYYVPSSPYIRAGLDQDGYYHVQSAPLVSFEIFSDENANGCSVM

SEQ ID NO: 192595 - protein, 71 aa, Glycine max
  Coding DNA Sequence Number=SeqID_75817
MSAKNLVGRLGVYDKTNHALRPVGVTLFCKNAPIMWDRHILKGALKPGVFTLKAYTSKSPLGSFPPDSGLT

SEQ ID NO: 192596 - protein, 115 aa, Glycine max
  Coding DNA Sequence Number=SeqID_75818
  Gene Ontology: Mol. function=protein serine/threonine kinase activity; Biological process=protein amino acid phosphorylation
  Homolog annotation: Hit_ID=Q1SF47; Match level="QueryCoverage=69%, HitCoverage=12%, E-value=4e-18, Identity=55%"; Hit description =Protein kinase; EGF-like, subtype 2; S-locus glycoprotein; Curculin- like (Mannose-binding) lectin; Apple-like
MSTEYLYGWRFEPKDSGTPYLTYNFGVLTISPHGTLKLVDFFNKKIFLELEVDQNKSDLYGTSVLRGLRPEIQRNGTGKIGGVDLFIHVPANLLVVDWKILASNKSNFKYKQISQ

SEQ ID NO: 192597 - protein, 422 aa, Glycine max
  Coding DNA Sequence Number=SeqID_75819
  Gene Ontology: Mol. function=signal transducer activity; Cellular component=membrane; Biological process=response to light stimulus
  Homolog annotation: Hit_ID=Q1SGA7; Match level="QueryCoverage=93%, HitCoverage=59%, E-value=1e-178, Identity=78%"; Hit description =BTB/POZ; NPH3
  Pfam annotation: Domain name=NPH3; Domain location=255-422; Score =78.0; E_value=2.9e-20; Accession=PF03000.5; Description=NPH3 family
MDMYGQWSHWHCPKKNSRVLHSVNLVFSMWESESESAATHKYGGGLLTSTNHGVKTEGFVQRGHSWYVATDIPSDFLVQIGEANFHLHKYPLVSRSGKLSRVIYESHDPDLNKIVMDDIPGGEEAFELAAKFCYGIAVDLTAGNISGLRCAAEYLEMTEDLEEGNLIFKAEAFLSYVVLSSWRDSIVVLKSCEKLSPWAENLQIVRRCSESIAWKACANPKGIRWSYTGRTAKISSPKWNDMKDSSPSRNQQVPPDWWFEDASILRIDHFVRVITAIKVKGMRFELVGASIMHYATKWLPGLISDTATPGDEASNCSLSNSSSSGGGSWKSGLHMVVTRTKDDNTSSLQAKEQRMIIESLVSIIPPQKDSVSCSFLLRLLRMAIMLKVAPALVTELEKRVGMQFEQATLADLLIPSYNKGET

SEQ ID NO: 192598 - protein, 118 aa, Glycine max
  Coding DNA Sequence Number=SeqID_75820
  Homolog annotation: Hit_ID=Q10PS1; Match level="QueryCoverage=44%, HitCoverage=16%, E-value=8e-08, Identity=45%"; Hit description=UDP-3- 0-acyl N-acetylglucosamine deacetylase family protein, expressed
MYKEFSKNTFLSSFDAFMQTGRLQQTLADCVERQGKALHSGKVSTVRLCPERASRGRRVPNSNVEEVGLTVATDLDGKSVEKMAPHVNEPVYAWRNDSFVAAFPSEVVRITYGVNFSQ

SEQ ID NO: 192599 - protein, 95 aa, Glycine max
  Coding DNA Sequence Number=SeqID_75821
MGAATNVYSRKTVEETKKGSIDFKNKGSGVVYARGSNHARPSELVTSPLSYLRAQASQRLAWASQAYGFLIGVIGNLRRCCECICCMKILMMTKD

SEQ ID NO: 192600 - protein, 98 aa, Glycine max
  Coding DNA Sequence Number=SeqID_75822
MEREARERVIESLHGEAMKWMDRFTLTLNRSQELPRLLARAKCFQDIQGFGNRLPGNVSQPTLRQEGDARLATASSKKGKCAESPPTFIRGKRRKTGK

SEQ ID NO: 192601 - protein, 212 aa, Glycine max
  Coding DNA Sequence Number=SeqID_75823
  Pfam annotation: Domain name=Wzy_C; Domain location=58-120; Score =8.0; E_value=0.078; Accession=PF04932.5; Description=O-Antigen Polymerase
LLYALIGFDPGPQLTQFGKEYGLLLRTIQGQLRAFGLLTGPFSLSEYLFFALENAYAENSILLRTVNIEAVRADSEYSPFIGAGYAVNGNAVVGDDNTNSIPLDSMYIYMLSNYGNVGIILLVIVATIILGILYQRTRLGLNPSVYLYWMISLSMNFNAGDGFRESLKKEWVQRFAQEICLALSKIRHDIVFVSPPNIIHHDIASQLNVQVV

SEQ ID NO: 192602 - protein, 182 aa, Glycine max
  Coding DNA Sequence Number=SeqID_75824
  Homolog annotation: Hit_ID=O04892; Match level="QueryCoverage=44%, HitCoverage=15%, E-value=3e-21, Identity=75%"; Hit description =Cytochrome P450 like_TBP
  Subcellular localization annotation: CTP_CleavageSite=57; ConfidenceScore=5.33e-01
MDGAKRATIPGRRGKDQAPMSRRARRSLQNPGREPGRSGRRCRSWCLPTLETAQPEVGSSGWKSTARRVVSGAPPAALENPEDRVPPTPGRTHNRIRSPRQGKSAKWIRNLGKRIGSEGWARGSQSRTRRLSVDCSSCFRGESGSSRAGRGTDWERALRGLFPGRRTVNSELVRTRGIRLSN

SEQ ID NO: 192603 - protein, 68 aa, Glycine max
  Coding DNA Sequence Number=SeqID_75825
MKRKYLVEVSLGGMGKEDHFTEICSDELNAAVVWNMEDKWILTLLVNSIQLQQNYTMVYIEHSNCRSS

SEQ ID NO: 192604 - protein, 121 aa, Glycine max
  Coding DNA Sequence Number=SeqID_75826
MTKSKGKDPLEGLGGPMTRARARKAKEALQQVLSILFEYKPKFQGEKSKVVSGSLLKSAVKLLYKLNHFINKHKLSFIQKIRVYLFYLSESDSPKFLSDSRTPWLYQRTFTTFVCCPRWKE

SEQ ID NO: 192605 - protein, 162 aa, Glycine max
  Coding DNA Sequence Number=SeqID_75827
  Gene Ontology: Mol. function=transferase activity; Biological process= DNA integration
  Homolog annotation: Hit_ID=Q1SXA8; Match level="QueryCoverage=87%, HitCoverage=11%, E-value=2e-12, Identity=31%"; Hit description=Zinc finger, CCHC-type; Polynucleotidyl transferase, Ribonuclease H fold
  Pfam annotation: Domain name=zf-CCHC; Domain location=96-113; Score =15.1; E_value=0.0031; Accession=PF00098.13; Description=Zinc knuckle
MGHSGYNIQRHVIALKNLDSISLEELVGTLKVHEQEVQQDEALKVNDESEEESDEDELTFISQKIHKMWRRKNDPKWRSFSRRMPRDKKDKNKSFIVCYECKNPRHFKCECPNLEKIQDKKKFFEPKEKKGLMSMWKDLDEDDKEANMCLMADTTSKESKSD

SEQ ID NO: 192606 - protein, 123 aa, Glycine max
  Coding DNA Sequence Number=SeqID_75828
  Gene Ontology: Mol. function=DNA-directed RNA polymerase activity; Cellular component=DNA-directed RNA polymerase III complex; Biological process=transcription
  Homolog annotation: Hit_ID=Q9FKF1; Match level="QueryCoverage=97%, HitCoverage=10%, E-value=1e-35, Identity=65%"; Hit description=DNA -directed RNA polymerase subunit
LCGNKRLELSGQLISLLFEDLFKSMTTEVKNLTDKMLEKPDKAKNFDICTLLTRTRSIITLGLERTLSTGNFEIKRFRMERKGMTQVLQRLSFIGALGHMTRVSPQFEKSRKVSGPRALQPSQ

SEQ ID NO: 192607 - protein, 146 aa, Glycine max
  Coding DNA Sequence Number=SeqID_75829
  Gene Ontology: Mol. function=exonuclease activity; Cellular component= intracellular
  Homolog annotation: Hit_ID=Q5N739; Match level="QueryCoverage=74%, HitCoverage=10%, E-value=7e-38, Identity=63%"; Hit description =Putative 5'-3' exoribonuclease
MTFFSKRRTIAVAAAIELHYSFQMHEIVKFVYFMDTCSGGMNGYISLYGGEPCPPIFRSLIASMEDIMDNHVICAIYRLPDAHKHISRPPQGVKFLKKIVEIGDLKPEPVLWHEDSGRRHHSENGRKNPPGSISSQELGDATHRLM

SEQ ID NO: 192608 - protein, 89 aa, Glycine max
  Coding DNA Sequence Number=SeqID_75830
MSMRIWIWVHGGGWLCGGVCLRLDLVPWRRLVAQQCTEHNGDNAWWLVVMVHVWVEFMEILEEGFITLGTSVVILSSLIPRAGGILELN

SEQ ID NO: 192609 - protein, 200 aa, Glycine max
  Coding DNA Sequence Number=SeqID_75831
GLTLHAIEPPSSMNELRKQAKGSIQMEEMLRFKNKVRQIGRKKEKGESNAKVDSHKSDTLHKSDKCQPLLKRPRYKRYTPLTTNNVNINHFKSKRTNLPSRLEESSIPLWENFHMAGCLASLKSAISMPSEILTPTMSTYTIRGDQDDVFDVDPRDNTVDKGPKPIEELVKLELGPKLRQCTQLSRDLSNHEYRHIDEVL

SEQ ID NO: 192610 - protein, 124 aa, Glycine max
  Coding DNA Sequence Number=SeqID_75832
MAERGGEGNRSPRRTLGDYAYQQGPKHHNNIVIPPFSNKVVELNTRLLNLIGKAKTWLQSNPNKSLNTWEEVEEKFMERFFPLSRFISAKSTIAIFSKGYDEPDVAPLELVGHESSSLMDNFAS

SEQ ID NO: 192611 - protein, 133 aa, Glycine max
  Coding DNA Sequence Number=SeqID_75833
MEKMNSTIFKIWKPETLEPLTKEEEEEEDEEVQRDSKVVKEYVEKLFVKVVDPPLGWKPLKLERNDKTTDSYEHLDAFVTEANLYTNDDVILCQVFPTSLKGATLTWYGGLPPRSIDNLNTIIKCLSSKYATS

SEQ ID NO: 192612 - protein, 270 aa, Glycine max
  Coding DNA Sequence Number=SeqID_75834
  Gene Ontology: Mol. function=heat shock protein binding; Biological process=protein folding
  Homolog annotation: Hit_ID=Q850Z3; Match level="QueryCoverage=69%, HitCoverage=75%, E-value=8e-29, Identity=36%"; Hit description=DnaJ -like protein
  Pfam annotation: Domain name=DnaJ; Domain location=41-102; Score =89.8; E_value=8.4e-24; Accession=PF00226.21; Description=DnaJ domain
MGQESDYKTQLVLEVCSISTRSVVCVHRHVSNHHVKPPFIDWYCILGVEENAGVSTIRKQYHKLALQLHPDKNTHPKAEIAFKLVSEACICLSDAAKRKAFDLKRHKNFCFECNRIPYTSKRVPNNSNGSSFKTWNIIWDSRSYKVWRNIRDMKDRLKEEAKVIENCLRKNSMAKKESPLYNPDDYRHGSSFKHKVEREIPVFNPLKNLHKGYPHLRGNVYKNSETCWWYLHTQNLVHNDKGEAKYASPVFEVRSQRSMLSTSKFAYVPS

SEQ ID NO: 192613 - protein, 101 aa, Glycine max
  Coding DNA Sequence Number=SeqID_75835
  Gene Ontology: Mol. function=unfolded protein binding; Cellular component=endoplasmic reticulum; Biological process=protein folding
  Homolog annotation: Hit_ID=A0A762; Match level="QueryCoverage=55%, HitCoverage=16%, E-value=3e-19, Identity=72%"; Hit description =Calreticulin-1
MAVLITYNEHGGFYDHVATPMKGVPNPDGIVGPHPYYFWFDRLGTDGKIVGLNQIGKKDENLVGEWNHTSGQWNRDTNDKAEYPEFSNKDKTLVFKFSVKQ

SEQ ID NO: 192614 - protein, 124 aa, Glycine max
  Coding DNA Sequence Number=SeqID_75836
  Gene Ontology: Mol. function=RNA-directed DNA polymerase activity; Biological process=RNA-dependent DNA replication
MWSIWNARNNRAFRQQAVKVPIKLKGKFYRTAVRPAILYGTECWAVKSQHENKVGVAEMRMLRWMCGKTRQDKIRNEAIRERVGVAPIVEKMVENRLRWFGHVERRPVDSVVRRVDQMERRQTI

SEQ ID NO: 192615 - protein, 115 aa, Glycine max
  Coding DNA Sequence Number=SeqID_75837
MGMGQLVEGLLLKKFVRGGVGFALGGRALGKQVSGDAEEAPQCRRPTTSTCRQRATAIVAEDVNHVDHVADEVHEQPQELVTDHVGVDTKGFPDESHDTLVLTSYADHVAAKVWA

SEQ ID NO: 192616 - protein, 37 aa, Glycine max
  Coding DNA Sequence Number=SeqID_75838
MEMKPKTSYILLNPATRQGRPLAYPKFIISYRHIIDL

SEQ ID NO: 192617 - protein, 62 aa, Glycine max
  Coding DNA Sequence Number=SeqID_75839
MATGGDLTMDLESRIGYDTILVTGLRLDPTSKNQLVRLQLRQSPKKAATKVAIQQHIIPSSN

SEQ ID NO: 192618 - protein, 133 aa, Glycine max
  Coding DNA Sequence Number=SeqID_75840
  Gene Ontology: Mol. function=actin binding; Cellular component=actin cytoskeleton; Biological process=actin cytoskeleton organization and biogenesis
  Homolog annotation: Hit_ID=Q1S181; Match level="QueryCoverage=99%, HitCoverage=100%, E-value=6e-56, Identity=76%"; Hit description =Plant profilin
  Pfam annotation: Domain name=Profilin; Domain location=2-128; Score =240.2; E_value=4.5e-69; Accession=PF00235.9; Description=Profilin
MSWQTYVDDHLMCDIDGTGHHLSSSAIIGQDGSVWAQSSSFPQIKSDEINGIMKDFDEPGHLAPTGLHLAGTKYMVIQGEPGAVIRGKKGSGGITIKKTGQALVFGIYDEPVTPGQCNMVVERLGDYLVDQGL

SEQ ID NO: 192619 - protein, 51 aa, Glycine max
  Coding DNA Sequence Number=SeqID_75841
MTFNTSTNLWRMRYISSVRHNFPFHAPYRIEVSPIVLIRFATSQSHSNTHP

SEQ ID NO: 192620 - protein, 59 aa, Glycine max
  Coding DNA Sequence Number=SeqID_75842
  Homolog annotation: Hit_ID=Q1SPK9; Match level="QueryCoverage=86%, HitCoverage=8%, E-value=4e-08, Identity=56%"; Hit description =Arginyl-tRNA synthetase, class Ic; DALR anticodon binding
MAYVEVDCPASVKKQLAKVFEESLRTTVPDEPDVVPSIDPCAANKAGVKFADYQWLVAK

SEQ ID NO: 192621 - protein, 138 aa, Glycine max
  Coding DNA Sequence Number=SeqID_75843
  Homolog annotation: Hit_ID=Q8VX11; Match level="QueryCoverage=43%, HitCoverage=9%, E-value=2e-17, Identity=70%"; Hit description =Diphosphonucleotide phosphatase 1 precursor
MKDIVVLAGGGEGSVLAGSALWITFWSLGSMLQKARLKNQWEGRTFNISNRSIRLTYQCMDMSITMKGLTLCIRKSNWLHHLETTWGMGSTYKTIPNLDNNSIINIMLRSCNWFDWDQNMSSEIHKLSLKLSEKVLTS

SEQ ID NO: 192622 - protein, 707 aa, Glycine max
  Coding DNA Sequence Number=SeqID_75844
  Gene Ontology: Mol. function=nucleic acid binding; Cellular component= beta-galactosidase complex; Biological process=DNA integration
  Homolog annotation: Hit_ID=Q1ST43; Match level="QueryCoverage=95%, HitCoverage=67%, E-value=1e-125, Identity=40%"; Hit description =Integrase, catalytic region; Peptidase aspartic, catalytic
  Pfam annotation: Domain name=zf-CCHC; Domain location=59-76; Score =7.2; E_value=0.063; Accession=PF00098.13; Description=Zinc knuckle
  Pfam module annotation: Pfam domain module=RVT_2::zf-CCHC; Domain location=364-619::59-76
MQQATIHRILGLHVPIVGKIITIDRCYRKNGPPQNYPSKGGNRTQRNFGKGNFGAKGNKVCTHCGLSNHTIDDCYKKHGYPPRHKFYKVQNPNMNNVNTIKEEGDGSPLDRNQDTQNEDDMNQQKIGTVEMVERLYRLEMILIKSKYKSDFAGSSISNFYAFSWSLQCNFIKWLQSKAETQSHLKNFVANVERQFETKVKVIRSDNGAEFIMRQFFDDTANRKKLDPKAVTSVFLSFKLNTKGFIMFDLKTKAISAFRNVIFYKDFFPFIGQDKPDVVIVLPIPSSHAIDQPDGVSSKLPVDHIMHVPNNVDSDPLTLEQSSNTTRRSLRQKHRPSKYKDFHVSYLSSTVASHSTASKDVWIEAMNAEIKALELNDTWISTDMPQHKNVIGYKWVYKIKHRSDGSVERHKARLVAKGYTQVEGQDYLDTFSPIAKLTTVRLLLALATINKWHLKQLDVNNAFLHGDLNEEVYMMLPQGMQVAKPGQVCKLQRSLYGLKQASRQWYAELSSFLISHGYKQCDSDHSLFLKHGFNTAIALLVYVDDIVLSGNYLIEIQAITQLLDNAFKIKDLGDLRYFLGFEVARKPTVINLCQRKYVLDILSDAGMLGCKPVSTPLDYATKLHQQSMTPLSLENASSFRRLIGRLIYLTNTRPDITYVMQHLSQFVVAPTLSHQQVVVQILRYIKGSLGARIFLSAASKIHLKGFSD

SEQ ID NO: 192623 - protein, 225 aa, Glycine max
  Coding DNA Sequence Number=SeqID_75845
  Homolog annotation: Hit_ID=Q1SU13; Match level="QueryCoverage=96%, HitCoverage=53%, E-value=2e-54, Identity=48%"; Hit description=IMP dehydrogenase/GMP reductase
  Pfam annotation: Domain name=DUF1005; Domain location=52-220; Score =365.0; E_value=1.2e-106; Accession=PF06219.3; Description=Protein of unknown function (DUF1005)
MSKKSLPSDFAKNPSRWRRTLKGVRERHGRERKGWMIIIHDLSGSPVAAASMITPFVPSPGSDRVSRSNPGAWLILRPNGACVSSWKPWGRLEAWRERGPVDGLGYKFELVIENGPTNGIPIAEATMNVKKGGQFCIDYKVMRDSGLLGSRLQGKGFVMGSTVEGEGKVSKPVVQVGAQHVTCMADAALFIALSAAVDLSMDACQLFSHKLRKELCHHEEQVSFP

SEQ ID NO: 192624 - protein, 96 aa, Glycine max
  Coding DNA Sequence Number=SeqID_75846
  Gene Ontology: Mol. function=endopeptidase Clp activity; Biological process=proteolysis
  Homolog annotation: Hit_ID=Q67XY5; Match level="QueryCoverage=55%, HitCoverage=16%, E-value=7e-12, Identity=62%"; Hit description=ClpP protease complex subunit ClpR3
  Subcellular localization annotation: CTP_CleavageSite=61; ConfidenceScore=5.69e-01
MIGGTMMAAYLCVPMPTSPQSPTTMRNSCKNLKTSCSVNKAKITMPPFNPKDLFLSKLSIVAASSPKMLLNTPKISYTPPYLDFFDSPKLMALPLK

SEQ ID NO: 192625 - protein, 411 aa, Glycine max
  Coding DNA Sequence Number=SeqID_75847
  Gene Ontology: Mol. function=protein binding; Cellular component =cellulose and pectin-containing cell wall; Biological process =protein amino acid phosphorylation
  Homolog annotation: Hit_ID=Q1S176; Match level="QueryCoverage=87%, HitCoverage=83%, E-value=1e-162, Identity=78%"; Hit description =Leucine-rich repeat
  Pfam annotation: Domain name=LRRNT_2; Domain location=52-91; Score =26.1; E_value=0.00013; Accession=PF08263.3; Description=Leucine rich repeat N-terminal domain
  Pfam annotation: Domain name=LRR_1; Domain location=132-154; Score =11.9; E_value=1.7; Accession=PF00560.23; Description=Leucine Rich Repeat
  Pfam annotation: Domain name=LRR_1; Domain location=156-179; Score =15.5; E_value=0.19; Accession=PF00560.23; Description=Leucine Rich Repeat
  Pfam annotation: Domain name=LRR_1; Domain location=180-199; Score =9.8; E_value=4.1; Accession=PF00560.23; Description=Leucine Rich Repeat
  Pfam annotation: Domain name=LRR_1; Domain location=203-225; Score =11.9; E_value=1.7; Accession=PF00560.23; Description=Leucine Rich Repeat
  Pfam annotation: Domain name=LRR_1; Domain location=226-248; Score =8.3; E_value=8.1; Accession=PF00560.23; Description=Leucine Rich Repeat
  Pfam annotation: Domain name=LRR_1; Domain location=251-273; Score =4.2; E_value=47; Accession=PF00560.23; Description=Leucine Rich Repeat
  Pfam annotation: Domain name=LRR_1; Domain location=275-297; Score =9.8; E_value=4.2; Accession=PF00560.23; Description=Leucine Rich Repeat
  Pfam annotation: Domain name=LRR_1; Domain location=299-321; Score =10.8; E_value=2.7; Accession=PF00560.23; Description=Leucine Rich Repeat
  Pfam annotation: Domain name=LRR_1; Domain location=323-344; Score =3.2; E_value=71; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1; Domain location=52 -91::132-154::156-179::180-199::203-225::226-248::251-273::275 -297::299-321::323-344
AFSVGGGVGVGVGVGIGVGVGVGNGNGGSGGVVWVGGGINSPEPPRSSVPKLEGAYTALQAWKSAVTEDPLKILSSWIGPNVCAYKGVFCAANPQDETVGASAAFPVVVAGIDLNHANLKGTLVKELSLLSDLSLLHLNSNRFTGTVPETFSDLVFLEELDLSNNQLSGPFPSATLYMPGLIYLDLRFNYFSGSLPQELFSKNLDALFLNNNQFEGEIPQNLGSSPASVINLANNKLSGSIPASLGFMGSKIKEILFLNNQLTGCIPEGVGLFTEMQVLDVSFNSLMGHLPDTLSCLQDIEVLNLAHNKLSGELSDVVCSLRSLANLTVAYNFFSGFSQECSRLFFRNVGFDFSLNCIPDRDMQRPPPECSGIPGGSLSCLRIPTPRPLVCGSMAVSKSKNIIDPTSSSPP

SEQ ID NO: 192626 - protein, 189 aa, Glycine max
  Coding DNA Sequence Number=SeqID_75848
  Gene Ontology: Mol. function=acid phosphatase activity; Cellular component=cellulose and pectin-containing cell wall; Biological process=translation
  Homolog annotation: Hit_ID=Q1S177; Match level="QueryCoverage=62%, HitCoverage=47%, E-value=7e-42, Identity=69%"; Hit description=Plant acid phosphatase
  Pfam annotation: Domain name=Acid_phosphat_B; Domain location=1-147; Score=98.7; E_value=1.7e-26; Accession=PF03767.5; Description=HAD superfamily, subfamily IIIB (Acid
MALTSMEIGGLMNRFYYAVVITSRKSEIFNETSFDNWVDLAAAPALPAILSLYNELKELGFKIFFLTGRSEFQRNATETNLLLSGYRDWERLILRGSSDQGKPATTYKSEKRAELENEGYRIHGNSGDQWSDLWGYAVSARIAKPQWQSHAILTCIIEVELGQVDLSKALSNAVSEVVEGIIGEPVIKQ

SEQ ID NO: 192627 - protein, 266 aa, Glycine max
  Coding DNA Sequence Number=SeqID_75849
  Homolog annotation: Hit_ID=Q1S177; Match level="QueryCoverage=29%, HitCoverage=30%, E-value=1e-11, Identity=51%"; Hit description=Plant acid phosphatase
  Pfam annotation: Domain name=Acid_phosphat_B; Domain location=18-179; Score=-76.7; E_value=0.031; Accession=PF03767.5; Description=HAD superfamily, subfamily IIIB (Acid
MAGVGLNNELHFFGIGPETPVIIGNLHTAKVLYSLRLAVETNNAGAWDCVPRRCMGFVERYIRGVRYLRDSKVIAKFSSDFVKSVLPLVGDVRDASLVFDIAETLLCNADLFFNMANNDIINSGDDNDGGDINSGSGYNNVNDNNGGALLTMILVVAPSGGGDSCYDIGDDCSNGNGGGGDDIGDNNSSDDCVSGVVGSCVSAAVNVERERASKEQAFRMNREQEGKSDSFRFSSNTWIFLEASNLVPNSCCILLFKASMINKTFP

SEQ ID NO: 192628 - protein, 382 aa, Glycine max
  Coding DNA Sequence Number=SeqID_75850
  Gene Ontology: Mol. function=transferase activity, transferring nitrogenous groups; Cellular component=membrane; Biological process =biosynthetic process
  Homolog annotation: Hit_ID=Q1Z5I6; Match level="QueryCoverage=96%, HitCoverage=93%, E-value=1e-122, Identity=57%"; Hit description =Aminotransferase, class I and II
  Pfam annotation: Domain name=Aminotran_1_2; Domain location=25-373; Score=74.3; E_value=3.7e-19; Accession=PF00155.11; Description =Aminotransferase class I and II
MAFNFDQWVDRSHSDSVKWDKYRGSDIIPLWVADSDFTSPPAVIEALQRRVAHGVFGYTHPSPDLIEVFTRRMVERYGWHIKPEWIIFLPGLVCGLNLCVRACTEEHQSTLAPSPIYPPFRKAAKFAGREHLAVPLKATGQRWVLDFSSLHDRLSGNEKLLLLCNPQNPGGTVYRRDELLQHHQFAREHDLIVCSDEIHCELLLEPGVRHIPFATLNDDAAQRSVTLMSPSKTFNLAGLGASLAIVPNEALRQKLKRARSGIVPEVNLLALVAAQAAYQYGQPWLDEQLIYLRANRDRLIKRINAMPGLTLLPVEATYLAWIDCSALPVDNPHQFFERAGVGLSAGLDFGDRRFVRLNFGCRWALLDEALDRMARACAALPG

SEQ ID NO: 192629 - protein, 597 aa, Glycine max
  Coding DNA Sequence Number=SeqID_75851
  Gene Ontology: Mol. function=gamma-glutamyltransferase activity; Cellular component=integral to membrane; Biological process =glutathione biosynthetic process
  Homolog annotation: Hit_ID=Q9M0G0; Match level="QueryCoverage=93%, HitCoverage=88%, E-value=0.0, Identity=60%"; Hit description=Gamma -glutamyltransferase-like protein
  Pfam annotation: Domain name=G_glu_transpept; Domain location=60-592; Score=743.2; E_value=1.7e-220; Accession=PF01019.11; Description =Gamma-glutamyltranspeptidase
MSKHNSFPVVGLVVRGNTSYGILSGAEKYNDGIATNQGDIVESDVGVVATDDARCSAIGVSMLRQGGHAVDAAVAAALCIGVVFSASSGIGGGAFMVVRSSSSSQTQAFDMRETAPLAASQNMYQNNPKGKTLGPLSMGVPGELAGLHAAWLKHGRLPWKTLFQPAIELAGKGFVVTPTLGEYMAADANKILDDPGLRKLYAPNGTLLKAGDVCRNVELGSTLEVVAEQGPQAFYNGTIGENLVKDVRDAGGILTMEDLHNYKLEVTDATTVNVMGYTIYGMPPPSSGTLALSLVLNILGSYGGSNAARGNLGLHRLIEALKHMWAVRMNLGDPNFVNIDDTISKMLSPSFAKDIQHMILDNTTFPPEYYMNRWSQLSDHGTSHMCIVDADRNAVSLTTTVNYHFGAGFRSTSTGILVNNEMDDFSTPTDISPDKLPPAPANFIEPNKRPLSSMTPLIVTKDDQLVGVLGGSGGMNIIAAVVQVFLNHFILGMKPLDAVVSPRIYHKLIPNVVRYENLTAHNGDHIELSKESRLFLEERGHQLRGSEALAVTQLIVQTLKTPMNFNRKVGENTKSLTKHGTLTAVSDPRKGGCPAAV

SEQ ID NO: 192630 - protein, 107 aa, Glycine max
  Coding DNA Sequence Number=SeqID_75852
MGMETLGMSGGELLPKTKLDQSRPNPGIACVAAGQLCILGGIWKLASGNRLPRIAMAAQLIHDRVVMECLEGVLETLEGNERCRFRGTIRLIATSLVHPEEPARTLQ

SEQ ID NO: 192631 - protein, 164 aa, Glycine max
  Coding DNA Sequence Number=SeqID_75853
  Gene Ontology: Mol. function=oxidoreductase activity; Cellular component=proton-transporting two-sector ATPase complex; Biological process=ATP synthesis coupled proton transport
  Homolog annotation: Hit_ID=Q1SMV3; Match level="QueryCoverage=89%, HitCoverage=46%, E-value=3e-40, Identity=48%"; Hit description=2OG -Fe(II) oxygenase
FCQFPSMQVTTTSYQLELKTGKDSTCDRIAEVKDFDKTKIGVKGLLDSGITEIPRMFHHAKVEDHTETTPNGSNFSVPIIDLQDIDTNSSLRVEALDKIRSACKEFHEQDAEVRKSFYSRDMNKKVRYFSNNSLYRDPAANWRDSIGFFLTPDPPNPEEIPAVC

SEQ ID NO: 192632 - protein, 93 aa, Glycine max
  Coding DNA Sequence Number=SeqID_75854
MEYVDHEWVMVGEQSTTTHVDLVEEEAQQELTPQWNPFESLMIQRMDVQSQDSSNALNVVFKFGIIKAKMGEIVRDKGVATWKNLRLKLEAQG

SEQ ID NO: 192633 - protein, 44 aa, Glycine max
  Coding DNA Sequence Number=SeqID_75855
MVKEKLKNDRKKAIIPSSLLQVQGDREASTVAFASENHRFRMSS

SEQ ID NO: 192634 - protein, 213 aa, Glycine max
  Coding DNA Sequence Number=SeqID_75856
MEEEKTEIERNKGESQKTRNELKVSNLETYPLKNEERRKIFMDLLTETSRKRYGSTSAWIFFTETRKKGEEIAAQLAQASWVASSRSNPASKNTLEGPIQNFKIAISTPHFDKFTPSFVIYEKGYGNFTKALCDVSSIGACRPRIFFINGFLCFLEDEWQRNGERERERRRHFKEKMSLEEAHHHRRPWIRAWRKKEMNEGRGREEHEILCSK

SEQ ID NO: 192635 - protein, 71 aa, Glycine max
  Coding DNA Sequence Number=SeqID_75857
MGSKIYPKVHENPKAFFINSSPILLEPLAHGSARERTLHNMTTHADMMQAKACHDIGVVDNTYRKHVHAYC

SEQ ID NO: 192636 - protein, 105 aa, Glycine max
  Coding DNA Sequence Number=SeqID_75858
MLVTHVWAIRQGQCTLPPMTYTPYDVCSWPKASAKDPGRSVHSAPHEHTHHPTYERGQKLVPKTLEGQCTVPSTNIHNMHMPMHFQHQSTFHFHVIHNINIISSQ

SEQ ID NO: 192637 - protein, 72 aa, Glycine max
  Coding DNA Sequence Number=SeqID_75859
MKNGRRTMKNDHEIDHGNYQVLSPSPQPPSCLFIGNEGRRLHSSSPRRAGYFKPKLSGGLGEPKASLGEPGA

SEQ ID NO: 192638 - protein, 73 aa, Glycine max
  Coding DNA Sequence Number=SeqID_75860
MMGAVLEHQLELRRSLKYERRCKVATTIMKLHSRQFCKNLLWYNGRTLTKQETNGCGVRATNGGALHPRHMRH

SEQ ID NO: 192639 - protein, 137 aa, Glycine max
  Coding DNA Sequence Number=SeqID_75861
MQSQVLTLPPEPVDGRSATHVSTKENVVIWFCSLHNRLDFLKGIIIRSDIFFNTFTLALFGNINILIVQFTSMFVLNNALKGFDDTPQSKSKATARWIVVKCNRQKGSTACEYYVMHRMSTIILGSFKNNWKMVNLG

SEQ ID NO: 192640 - protein, 187 aa, Glycine max
  Coding DNA Sequence Number=SeqID_75862
  Gene Ontology: Mol. function=transcription factor activity; Biological process=regulation of transcription, DNA-dependent
  Homolog annotation: Hit_ID=Q47522; Match level="QueryCoverage=28%, HitCoverage=66%, E-value=4e-25, Identity=100%"; Hit description=LacZ protein
MKHFTDTLISANIRIALSELAEESLILYRRHSGPGLYDAIISGCRAAGFSPRVAQEAPRVLSTLSLVAAGLGVSLVPASLRRVNIEGVVESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 192641 - protein, 125 aa, Glycine max
  Coding DNA Sequence Number=SeqID_75863
  Homolog annotation: Hit_ID=Q9LZ20; Match level="QueryCoverage=32%, HitCoverage=7%, E-value=1e-08, Identity=65%"; Hit description=Amino acid transport-like protein
MESRKGKSQNRRIIDQSTNESIEADFRSGLEKQIEQCSSLSFIDSDITTILLNFTGGSAAPVADDESDEQNDGDNDEVYFVEAFGKRRHCEAPFGGGDSDCGAKVRRQASGDGDIGKHGPKVTRR

SEQ ID NO: 192642 - protein, 62 aa, Glycine max
  Coding DNA Sequence Number=SeqID_75864
MSVKNLIERLGVHDRKHHMGCLLGFQALESSRRDLSLHFSVSMQGTFLSPHTILTNPNGGDM

SEQ ID NO: 192643 - protein, 110 aa, Glycine max
  Coding DNA Sequence Number=SeqID_75865
  Gene Ontology: Mol. function=thymidine kinase activity; Cellular component=membrane; Biological process=DNA metabolic process
  Homolog annotation: Hit_ID=P23331; Match level="QueryCoverage=97%, HitCoverage=52%, E-value=2e-50, Identity=88%"; Hit description =Thymidine kinase
  Pfam annotation: Domain name=TK; Domain location=1-90; Score=51.3; E _value=3.3e-12; Accession=PF00265.9; Description=Thymidine kinase
VHELSEVVDELDIPVLCYGLRTDFRGELFSGSQYLLAWSDKLVELKTICFCGRKASMVLRLDQEGRPYNEGEQVVIGGNERYVSVCRKHYKEALSTGSLTQVQSKLRHGE

SEQ ID NO: 192644 - protein, 179 aa, Glycine max
  Coding DNA Sequence Number=SeqID_75866
  Homolog annotation: Hit_ID=Q47522; Match level="QueryCoverage=28%, HitCoverage=64%, E-value=6e-24, Identity=100%"; Hit description=LacZ protein
MAAQNSDFYSEYPPMPSDILTVQKSNCPLSLKHKALGELDNNYYQEVPSHPASESNIFLNPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 192645 - protein, 103 aa, Glycine max
  Coding DNA Sequence Number=SeqID_75867
  Subcellular localization annotation: CTP_CleavageSite=43; ConfidenceScore=5.52e-01
THPEQSLPVQQCPAPPPLPLSLLVPDPVGSTFLQTPTLTQLNRAMKRGERGQLTTAKSQTTSTLCMIENCRCVLPGACRSDWCLLSNSCFNLKSDYSACLTQV

SEQ ID NO: 192646 - protein, 188 aa, Glycine max
  Coding DNA Sequence Number=SeqID_75868
MLTRLASPCAKRVIRNCQQIRQLPQAGYDGSRFVSQEAWDRYSNNVLARNILRERNVKLHINEFDDFRRQLIRRNWHKQLTNLTEGSIEVAIVKEFYANLYVPEDKFPKQVRVRWHLIKFDADSFNTFLETLVVMEQGESLPSYSRFARLRHDPQELAARLCILGRGFVLNAEGLSWKLLMKDLTTLA

SEQ ID NO: 192647 - protein, 117 aa, Glycine max
  Coding DNA Sequence Number=SeqID_75869
MKKWDVIAIVSTPHLKMKFPTLMGEIISVKADQKHSRQCYAGSLKVVPYPPNRESGNPHPTSHGSENQVMSMDEESTIQTLTVYKAIMGDQDYLFDVDPHDDIVDKGPKPIKELVKL

SEQ ID NO: 192648 - protein, 278 aa, Glycine max
  Coding DNA Sequence Number=SeqID_75870
NNETFSSLTSYPELRRSEFLMGGYVGAKASLLSTTPPFVAMTQELVARGDTLRLSAPFLSSRGGGPDDKQRPKTKFGHSAPMIRGDTLWLFAPFCHPEAAGPMTSRDQVWSFCTHDTRRYLMVIRTLLSSRGGGPDDKQRPKAAGPMTSRDQVWSFCTLVSSRGGGPMIRGDTLRLFAPFLSSRGGGPDDKQRPKTKFGHSAPLYHPEAAGPMILGDTLRLFAPFCHPEAAGPIDKQRPSLVILYPLYHPEAAGPMIRGNTRVVIRINILLLSVRQNA

SEQ ID NO: 192649 - protein, 106 aa, Glycine max
  Coding DNA Sequence Number=SeqID_75871
MACTSGDPTQPSPKTARLMAEIIKLGDQMRRMSCENKERMERMRKENEEKYEGYEDDEGGRINERYKERRNHRRYGEMKVEQVYACYNYNEEKKIKLASLEFEDMP

SEQ ID NO: 192650 - protein, 71 aa, Glycine max
  Coding DNA Sequence Number=SeqID_75872
MTHVHACDRASSLEGVREGEQGVLRGIHEEQSRESFGERDKAKDPERGFRFFQRTNLDFRRNQIKANRQIN

SEQ ID NO: 192651 - protein, 220 aa, Glycine max
  Coding DNA Sequence Number=SeqID_75873
MDMACDSKKPLYLGCNKSLTLLSSVLSQVNVKARYGWSDKNFSSLLQVVRDMLPEENKLPKSYYQEKKILCPMGMEYQKKDDDECNNDENSEKGPPTNVSKMLRKYSFNTKSQGDNVTMQNGGAHGYTTQLPPPPESETHSPSTLKRTKKETRVRSLATRPIWVERPLVHVDPATRKANGPHRKKLRTYMGIVARDKVDVTYDNWKQVPAIQKDLIWEDI

SEQ ID NO: 192652 - protein, 90 aa, Glycine max
  Coding DNA Sequence Number=SeqID_75874
MGGLGRRGGRVVGSQGSARSGSGPGWYGPSEQGFGPNDVERPELTCLTAGTKMKRKNFPVEDMRVNGLSNARPVSLHDSMTKIQRFLRAK

SEQ ID NO: 192653 - protein, 184 aa, Glycine max
  Coding DNA Sequence Number=SeqID_75875
  Gene Ontology: Mol. function=DNA binding; Cellular component =chromatin; Biological process=chromosome organization and biogenesis (sensu Eukaryota)
  Homolog annotation: Hit_ID=Q941Y9; Match level="QueryCoverage=78%, HitCoverage=58%, E-value=7e-15, Identity=31%"; Hit description=DNA -binding protein-like
  Pfam annotation: Domain name=DUF296; Domain location=52-161; Score =68.5; E_value=2.1e-17; Accession=PF03479.5; Description=Domain of unknown function (DUF296)
MVEPRTIVPLSSIVHHHYLASPLAKKKVGRPLGSKNKPKLSHVISQANVQVQKPIYIEVPNNLDVIEAMVQFAHHHKVSITVLSASGTIASVTLNYTDSYASTFTLYGPFSLISLTGTYINNTAISSSSSSCQSIIGFVRGKLVAANGVIVMATIVNNLEVHKDVINNNSKEWDDDNNNPNTYI

SEQ ID NO: 192654 - protein, 269 aa, Glycine max
  Coding DNA Sequence Number=SeqID_75876
  Homolog annotation: Hit_ID=Q1SQV4; Match level="QueryCoverage=19%, HitCoverage=16%, E-value=2e-15, Identity=82%"; Hit description =PspA/IM30; Prefoldin
MTQIQAIIDPAARPKPKNNTLIIPVVSACCNFTILGIKIINTLEYNSLVNPKQPLAKNQINTRASSASDDSLHIPLWQLVGTTHNGALHQRIGHGGKSNGTFGTLIEEISCTFGTSAGEGCGFERKRKRRGKRIWSARENGTKKGSVSERRNGSRRGKRSERRSQKWNWRESDDLAQLLESKIQEAKSNKDTLKARAQSAKTSTIVSEMVGNINTSNALAAFDKMEEKGAYDDEETAARAYDLAALNYQIMRRSSRRWKARQKKNTLDP

SEQ ID NO: 192655 - protein, 148 aa, Glycine max
  Coding DNA Sequence Number=SeqID_75877
MYKDKWAHTYHMGPKSTLRLMSTLGPSLAIPLEGKIALSGRWYLADGGSVPGDLLLLIGKALIHATVGLCPTASYIASPDYFLSPNGGGRYFLELRNCRTSLAYRLMPQGNAILDYSPIAAAGHGRTLKVLLHAQNKCPIMFDSASYI

SEQ ID NO: 192656 - protein, 375 aa, Glycine max
  Coding DNA Sequence Number=SeqID_75878
  Gene Ontology: Mol. function=catalytic activity; Cellular component =intracellular; Biological process=metabolic process
  Homolog annotation: Hit_ID=Q2QUQ5; Match level="QueryCoverage=98%, HitCoverage=86%, E-value=1e-122, Identity=35%"; Hit description =Pentatricopeptide, putative, expressed
  Pfam annotation: Domain name=PPR; Domain location=193-227; Score =34.2; E_value=4.7e-07; Accession=PF01535.11; Description=PPR repeat
  Pfam annotation: Domain name=PPR; Domain location=228-262; Score =25.0; E_value=0.00026; Accession=PF01535.11; Description=PPR repeat
  Pfam annotation: Domain name=PPR; Domain location=31-65; Score=10.1; E_value=0.48; Accession=PF01535.11; Description=PPR repeat
  Pfam annotation: Domain name=PPR; Domain location=329-363; Score=5.3; E_value=1.7; Accession=PF01535.11; Description=PPR repeat
  Pfam annotation: Domain name=PPR; Domain location=92-126; Score=41.7; E_value=2.6e-09; Accession=PF01535.11; Description=PPR repeat
  Pfam module annotation: Pfam domain module=PPR::PPR::PPR::PPR::PPR; Domain location=193-227::228-262::31-65::329-363::92-126
MIANFAQNRLEYEAVELVRQMQAKGETPNNVTFTNVLPVCARSGFLNVGKEIHAQIIRVGSSLDLFVSNALTKCGCINLAQNVLNISVREEVSYNILIIGYSRTNDSSESLSLFSEMRLLGMRPDIVSFMGVISACANLASIKQGKEVHGLLVRKLFHIHLFAVNSLFDLYTRCGRIDLATKVFDHIQNKDAASWNTMILGYGMQGELNTAINLFEAMKEDSVEYNSVSFIAVLSACSHGGLIGKGRKYFKMMRDLNIEPTHTHYACMVDLLGRADLMEEAADLIRGLSIVLDTNIWGALLGACRIHGNIELGMWAAEHLFELKPQHCGYYILLSNMYAEAVRWDEANKVRKLMKSRGAKKNPGCSWVQIGDQKP

SEQ ID NO: 192657 - protein, 35 aa, Glycine max
  Coding DNA Sequence Number=SeqID_75879
MAKRLQEDKTKDAGEGPRIFMSVRGSIVLGGYPQV

SEQ ID NO: 192658 - protein, 230 aa, Glycine max
  Coding DNA Sequence Number=SeqID_75880
  Gene Ontology: Mol. function=metal ion binding; Cellular component =intracellular; Biological process=metabolic process
  Homolog annotation: Hit_ID=Q2QUQ5; Match level="QueryCoverage=99%, HitCoverage=68%, E-value=2e-41, Identity=34%"; Hit description =Pentatricopeptide, putative, expressed
  Pfam annotation: Domain name=PPR; Domain location=173-207; Score =30.3; E_value=6.8e-06; Accession=PF01535.11; Description=PPR repeat
  Pfam annotation: Domain name=PPR; Domain location=70-104; Score=21.0; E_value=0.0043; Accession=PF01535.11; Description=PPR repeat
  Pfam module annotation: Pfam domain module=PPR::PPR; Domain location =173-207::70-104
MVRAGVKPDECTYTFVPKVRKGREVHGVAFKLGFDGDVFVGNTLLSIYGNCGLFGDAMKVFDEIPEGDKVSWNTVIGLCSLHGFYEEALGFLRKMVAVKPGIQPDLVTVASVLPVCAETEDEVMVRIVHCYAMKVGLLGHVKVGNALVDVYGKCGSEKASKKVFDDIDERNVVSWNPIITSFSFRGKYMDALDVFRLMIDVGMGPNFVTISSMLHVLGELGLFKLGAEVH

SEQ ID NO: 192659 - protein, 142 aa, Glycine max
  Coding DNA Sequence Number=SeqID_75881
  Gene Ontology: Mol. function=binding
  Homolog annotation: Hit_ID=Q2QYL5; Match level="QueryCoverage=86%, HitCoverage=23%, E-value=1e-12, Identity=37%"; Hit description =Pentatricopeptide, putative, expressed
MKRTQPNNSIPRHLIPLRNFIKHLHRITKKPTIPINGQKGIPNKDIPIKAKLKRNPMNLPTLANLHKIRTPSGQKCAKSIKHTSNGIGSYKGVRQEGTSGICNAVLEEKNGIYGVSKGGILKNERGAERDMRGRKPWRREKG

SEQ ID NO: 192660 - protein, 64 aa, Glycine max
  Coding DNA Sequence Number=SeqID_75882
  Gene Ontology: Mol. function=nucleic acid binding; Cellular component= intracellular
  Homolog annotation: Hit_ID=Q1RZD5; Match level="QueryCoverage=95%, HitCoverage=13%, E-value=7e-12, Identity=55%"; Hit description=Zinc finger, C2H2-type
AKLDADDYGAKRKAITPPVVDESESMEKKPKQEWSCSLCQITASREKQLNGHRQGKKYKAKKHP

SEQ ID NO: 192661 - protein, 145 aa, Glycine max
  Coding DNA Sequence Number=SeqID_75883
MEARACGKSLRQICLYVGNKRWSRCLCSQVTRLVDVERFIQEYTNKIDVLFKDKSEAQNEEKAKEKEDKELLPLALPTPLMQGMGGGYAPSPPPPMGGIGMLMQAPLELVGLGSSSSMDSFASWKMNGSGMEKGRERGDATSRRR

SEQ ID NO: 192662 - protein, 175 aa, Glycine max
  Coding DNA Sequence Number=SeqID_75884
MCNGKHLQEICTEEAITIFSLCQRKRRKVAPPLSDKILVPQTKKVRQTQQAPPPLTHTRSSKREKRGTQRPKHLECEKSSIQDDVANDPLYLQRTETICLTKKKQTESTADMDDEVQHKDIKAPLSHIYLDRFQHQGPPTRDPNLSNDTIARLLRRIHQQGSKFFLFQSGSDFTP

SEQ ID NO: 192663 - protein, 188 aa, Glycine max
  Coding DNA Sequence Number=SeqID_75885
  Gene Ontology: Mol. function=identical protein binding; Biological process=Mo-molybdopterin cofactor biosynthetic process
  Homolog annotation: Hit_ID=O22827; Match level="QueryCoverage=98%, HitCoverage=92%, E-value=4e-71, Identity=68%"; Hit description =Putative molybdopterin synthase large subunit
  Pfam annotation: Domain name=MoaE; Domain location=11-127; Score =182.7; E_value=8.9e-52; Accession=PF02391.7; Description=MoaE protein
MAAEEDKNLVEILENQNPIDVAKYMNFVSAPQAGAIATFSGTTRDTFEGKTVMELRYEAYVPMAIRCIKSICSSARASWNLHSIAAAHRLGTVPVGETSVFVAVSSVHRADALEACRFFIDEIKAQVPIWKKEVYSNGEVWKENSEFLERRSELGNKDAGCCEKKVEIKEHSKKSCCGTKVRVDNEGI

SEQ ID NO: 192664 - protein, 141 aa, Glycine max
  Coding DNA Sequence Number=SeqID_75886
  Gene Ontology: Mol. function=binding; Cellular component=COPI vesicle coat; Biological process=protein targeting
  Homolog annotation: Hit_ID=Q9SV20; Match level="QueryCoverage=99%, HitCoverage=12%, E-value=1e-52, Identity=74%"; Hit description=Beta -COP-like protein
  Pfam annotation: Domain name=Coatamer_beta_C; Domain location=1-136; Score=-28.0; E_value=9.4e-08; Accession=PF07718.3; Description =Coatamer beta C-terminal region
MDYISPASCADVAFRTMWAEFEWENKGYMPQLISLLGVGEEFGYFVAVNTVLQDERDFLNHIIKSTNMKCLTPPSALEGDCGFLAANLYAKSVFGEDALVNVSIEKQSDGKLSGYIRIRSKTQGIALSLGDKITLKQKGAA

SEQ ID NO: 192665 - protein, 744 aa, Glycine max
  Coding DNA Sequence Number=SeqID_75887
  Gene Ontology: Mol. function=binding; Cellular component=endoplasmic reticulum; Biological process=ER to Golgi vesicle-mediated transport
  Homolog annotation: Hit_ID=Q9SV20; Match level="QueryCoverage=100%, HitCoverage=78%, E-value=0.0, Identity=75%"; Hit description=Beta -COP-like protein
  Pfam annotation: Domain name=Adaptin_N; Domain location=12-530; Score= 226.5; E_value=5.9e-65; Accession=PF01602.10; Description=Adaptin N terminal region
  Pfam annotation: Domain name=HEAT; Domain location=126-162; Score =19.9; E_value=0.0093; Accession=PF02985.12; Description=HEAT repeat
  Pfam module annotation: Pfam domain module=Adaptin_N::HEAT; Domain location=12-530::126-162
MEKSCTLVVHFDKGTPALANEIKEALEGNDVAAKIDALKKAIMILLNGETIPQLFITIIRYVLPSEDHTIQKLLLLYLEIIDKTDSRGKVLPEMILICQNLRNNLQHPNEYIRGVTLRFLCRLNESEIIEPLIPSILANLEHRHPFVRRNAVLAVMSVYKLPQGEQLLDSAPEIVDKFLSTEQDPSSKRNAFLMLFSCAQDRAINYLFTNIDRIIDWGEQLQMVVLELIRKVCRSNKGEKGKYIKIIISLLNAPSTAVIYECASTLVSLSSAPTAIRAAASTYCQLLLSQSDNNVKLIVLDRLNELKTSSREIMVEMVMDVLRALSTPNHDIRRKTLDIALELITPRNIDEVVMMLKKEVVKTQSGEHEKNGEYRQMLVQAIHTCAIKFPEVASTVVHLLMDFLGDTNVASAMDVVVFVREIIETNPKLRISIITRLLDTFYQIRAARVCSCALWIIGEYCLSLSEVESGIATIKQCLGDLPFYTVTEEGDGQEASKPIQQVNSTTVSSRRPAILADGTYATQSAALETAMSPPTLVQGSLSSIGNLRSLILSGDFFLGAVVACTLTKLVLRLEEVQTSKAEVNKATTQALLIIVSMLQLGQSSILPHPIDNDSYDRIVLCIRLLCNTGDEIRKIWLQSCRQSFVKMLADKQRRETEEIKAKAQISNAQPDDLIDFYHLKSRKGMSQLELEDEVQDDLKRATGEFTKDADDANKLNRILQLTGFSDPVYAEAYVTVHHYDIVLD

SEQ ID NO: 192666 - protein, 428 aa, Glycine max
  Coding DNA Sequence Number=SeqID_75888
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q9LU41; Match level="QueryCoverage=98%, HitCoverage=38%, E-value=1e-173, Identity=74%"; Hit description =Putative calcium-transporting ATPase 9, plasma membrane-type (EC 3.6.3.8) (Ca(2+)-ATPase isoform 9)
  Pfam annotation: Domain name=Hydrolase; Domain location=3-249; Score =13.3; E_value=0.0038; Accession=PF00702.16; Description=haloacid dehalogenase-like hydrolase
MDFDVIRSNSTVLHVFPFNSEKKRVGVALKLGDSGVHIHWKGAAEIVLGTCTQYLDSDGQLQSIEEEKGFFKDAIDDMAARSLRCVAIAYRSYELDKVPSSEQDLDQWSLPEHELVLLAIVGIKDPCRPGVKDAVKVCTDAGVKVRMVTGDNLQTAKAIALECGILASIEDAVEPNIIEGKKFRELSEKEREDIAKKITVMGRSSPNDKLLLVQALRKGGEVVAVTGDGTNDAPALHEQQIVAINIEIPTADIGLSMGIQGTEVAKESSDIIILDDNFASVVKVVRWGRSVYANIQKFIQFQLTVNVAALVINVVAAITSGDVPLNAVQLLWVNLIMDTLGALALATEPPTDRLMHRSPVGRRESLITNIMWRNLIVQAVYQIAVLLVLNFCGESILPKQDTKADAFQVKNTLIFNAFVLCQLLWGLS

SEQ ID NO: 192667 - protein, 205 aa, Glycine max
  Coding DNA Sequence Number=SeqID_75889
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q9LU41; Match level="QueryCoverage=83%, HitCoverage=18%, E-value=3e-46, Identity=52%"; Hit description =Putative calcium-transporting ATPase 9, plasma membrane-type (EC 3.6.3.8) (Ca(2+)-ATPase isoform 9)
  Pfam annotation: Domain name=E1-E2_ATPase; Domain location=1-131; Score=-102.7; E_value=0.0015; Accession=PF00122.10; Description=E1 -E2 ATPase
VTGVGINTEWGLLMASISEDTGEETPLQVRLNGVATFIGVVGLTVAVLVLAVLLGRYFSGHTKDIDGNVEFVAGKTSVSNAVDDVIKIFTIAVTIVVVAVPEGLPLAVTLTLAYSMRKMMADKALMTVVEAYVGSTKVYSPDDSSKLHPKALSLINEGIAQNTTGNVFVPKTAACSIDMLTSTDKVHMCYVHLSFGRSEANTVLC

SEQ ID NO: 192668 - protein, 253 aa, Glycine max
  Coding DNA Sequence Number=SeqID_75890
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q9LU41; Match level="QueryCoverage=86%, HitCoverage=19%, E-value=2e-66, Identity=58%"; Hit description =Putative calcium-transporting ATPase 9, plasma membrane-type (EC 3.6.3.8) (Ca(2+)-ATPase isoform 9)
  Pfam annotation: Domain name=Cation_ATPase_N; Domain location=73-156; Score=53.1; E_value=9.2e-13; Accession=PF00690.16; Description=Cation transporterATPase, N-terminus
MESMKILRCFCGAGRRASVILTRCISVAAALLFRLAGERELVISTAVSPPTPVGDYDIGLEQLVSMSKDQNISALQQYGGASLQHIRGLSNLIKSNPDKGISGDDADLLKRKNAFGTNTYPRKKGRSFWRFLWEAWQDLTLIILIIAAAVSLALGIKTEGLAEGWYDGGSIAFAVLLVIVVTAVSDYRQSLQFQNLNAEKQNIQLEVIRGGRTIKISIFDIVVGDVIPLKIGDQYFLFTDYSMGILRFLLMEY

SEQ ID NO: 192669 - protein, 129 aa, Glycine max
  Coding DNA Sequence Number=SeqID_75891
MVGSLGTPTMARKVGCDKKKTKMDHYMDKFLDELQRYIISIKDVTSDGNRGYRGIATLLGHAKWMTIPDMGYFIASWYNVVLVHLFRLQSWTFFPLRSLAPVSSHLIFVGPCGLNNLKKDMLRMQKKQQ

SEQ ID NO: 192670 - protein, 127 aa, Glycine max
  Coding DNA Sequence Number=SeqID_75892
DFAQVQKNTRHLLVVERAVQNEFWMFASRSQRSNLGRIDGDPVLRETRRWATWEYVSSVGGGQQGMSGTWRYVAGVRRPWGRQASSWQSTDKRKTRPQSKEACGGWPAEAKMVSGNRLPRGVIDYQA

SEQ ID NO: 192671 - protein, 47 aa, Glycine max
  Coding DNA Sequence Number=SeqID_75893
MGAKDMSFIHKGNKNPVSDPGHVVVVGPDPWPPCSKSSAGVPAEYPL

SEQ ID NO: 192672 - protein, 382 aa, Glycine max
  Coding DNA Sequence Number=SeqID_75894
  Gene Ontology: Mol. function=protein serine/threonine kinase activity; Cellular component=beta-catenin destruction complex; Biological process=protein amino acid phosphorylation
  Homolog annotation: Hit_ID=Q53VM1; Match level="QueryCoverage=93%, HitCoverage=71%, E-value=1e-167, Identity=89%"; Hit description =Ser/Thr protein kinase
  Pfam annotation: Domain name=Pkinase; Domain location=184-382; Score =155.4; E_value=1.4e-43; Accession=PF00069.15; Description=Protein kinase domain
  Pfam annotation: Domain name=Pkinase_Tyr; Domain location=184-382; Score=-56.2; E_value=5e-09; Accession=PF07714.7; Description=Protein tyrosine kinase
  Pfam module annotation: Pfam domain module=Pkinase::Pkinase_Tyr; Domain location=184-382::184-382
MEKPTATIARLTEGLGCWVVSGISNYEYDAEVEEHCFWEDFHFFRSFGSYVILLSYMYPLFRVLGGDSNSKRAKFEPETEGKADEKTNTIETICTDQEQPIDTSKETSNVGTSDVSTVARTEKSGFDELPKELNEMKIRDEKSKNNNEKDIEATVVSGNGTETGQIITTAIGGRDGQPKQTISYMAERVVGTGSFGVVFQAKCLETGESVAIKKVLQDRRYKNRELQVMRTVDHPNVVKLKHYFFSTTDKDELYLNLVLEYVPETVYKVSKHYVRMHQHMPIIYVQLYTYQICRALNYLHQVIGVCHRDIKPQNLLVNPQTHQLKICDFGSAKVLVPGEPNISYICSRYYRAPELIFGATEYTIAIDMWSVGCVLAELLLGQ

SEQ ID NO: 192673 - protein, 95 aa, Glycine max
  Coding DNA Sequence Number=SeqID_75895
MHYLFLEEFVILKSFKVVGHSSKASNIKEVRWDLPLSGWVKCNTMVWRAAPSVLQLVEVCLETQGVTMIFCTVQAAMEALEIAKGRGWDQLWLEC

SEQ ID NO: 192674 - protein, 143 aa, Glycine max
  Coding DNA Sequence Number=SeqID_75896
LSLDAYTAAYNDLAVFEASTADEGGDGRRRQLQNVKGLGSGIVLEITVISCENLRVMEDPYVVVRAESLNCCTTKMAKDSGSNKTSLFSWNEKIAVSDFLGGGVSGNFMHVELPVEGLGRERKRGDSFRGEGGGGAGEGDGGQ

SEQ ID NO: 192675 - protein, 133 aa, Glycine max
  Coding DNA Sequence Number=SeqID_75897
MTIRFLASSTRSLTATWFGFGGIFISESPRNSEKQNSIQINLIGKGIRLKMLMKNWRERGSFHTKNSPPLFPPRSISDPKFRACPCIVIELNNQESRSDGSKTREDTTKQKIRINSDSAECGMCMKLVPFFLD

SEQ ID NO: 192676 - protein, 492 aa, Glycine max
  Coding DNA Sequence Number=SeqID_75898
  Gene Ontology: Mol. function=protein serine/threonine kinase activity; Cellular component=membrane; Biological process=protein amino acid phosphorylation
  Homolog annotation: Hit_ID=Q94JZ6; Match level="QueryCoverage=78%, HitCoverage=59%, E-value=1e-155, Identity=69%"; Hit description =Protein kinase-like protein
  Pfam annotation: Domain name=Pkinase; Domain location=97-370; Score =116.4; E_value=8.1e-32; Accession=PF00069.15; Description=Protein kinase domain
  Pfam annotation: Domain name=Pkinase_Tyr; Domain location=97-370; Score=144.7; E_value=2.5e-40; Accession=PF07714.7; Description =Protein tyrosine kinase
  Pfam module annotation: Pfam domain module=Pkinase::Pkinase_Tyr; Domain location=97-370::97-370
  Subcellular localization annotation: CTP_CleavageSite=81; ConfidenceScore=5.45e-01
MSPADIAGGTLQNWQDSVPPTTDGKVGFSPKPPPGGLVNQQQSSAALLTLVVNSSNTSSSLGSEKAKSYISPSPGTSLALSQSTFTYDELSMATDGFSRSNLLGQGGFGYVHKGVLPNGKIVAVKQLKSESRQGEREFHAEVDVISRVHHRHLVSLVGYCVSDSQKMLVYEYVENDTLEFHLHGKDRLPMDWSTRMKIAIGSAKGLAYLHEDCNPKIIHRDIKASNILLDESFEAKVADFGLAKFSSDTDTHVSTRVMGTFGYMAPEYAASGKLTEKSDVFSFGVVLLELITGRKPVDKTQTFIDDSMVEWARPLLSQALENGNLNGLVDPRLQTNYNLDEMIRMTTCAATCVRYSARLRPRMSQVVRALEGNISLEDLNDGIAPGHSRVFGSFESSSYDSVQYREDLKNFKKLALESQEQGISEYSGPSSEYGRHPSVSTSSDQQNTQEMEMGNKKGSNHDSGIQISVCKCTYESGTGTVVQCTNWLAHDE

SEQ ID NO: 192677 - protein, 189 aa, Glycine max
  Coding DNA Sequence Number=SeqID_75899
MPPMISIPTEPNTAPITIPLTVPVDNPLLTVLVGGEAASGGGGETVALMVEGGGGERAVELGEGVVSDGGEAVKEGASAGADIAGEDSGATVRARVLKKKERSYFFYSTYSQFITCGNKRRGPPHSVVSLASSCVLLQLPTPVAFFSGKVGARPIVAHFKLVRDQLALAEEPSQVHALQNSSILPINLG

SEQ ID NO: 192678 - protein, 72 aa, Glycine max
  Coding DNA Sequence Number=SeqID_75900
MGSLASHCHERLTITKWNEDGGKEWRGSERIASNGAPSRDVWLPHGFFALSEGCTLNGRVALSECGALSETF

SEQ ID NO: 192679 - protein, 467 aa, Glycine max
  Coding DNA Sequence Number=SeqID_75901
  Gene Ontology: Mol. function=protein serine/threonine kinase activity; Cellular component=membrane; Biological process=protein amino acid phosphorylation
  Homolog annotation: Hit_ID=Q9ARH1; Match level="QueryCoverage=82%, HitCoverage=55%, E-value=1e-103, Identity=54%"; Hit description =Receptor protein kinase PERK1
  Pfam annotation: Domain name=Pkinase; Domain location=40-285; Score =106.6; E_value=7.1e-29; Accession=PF00069.15; Description=Protein kinase domain
  Pfam annotation: Domain name=Pkinase_Tyr; Domain location=40-338; Score=93.2; E_value=7.7e-25; Accession=PF07714.7; Description =Protein tyrosine kinase
  Pfam module annotation: Pfam domain module=Pkinase::Pkinase_Tyr; Domain location=40-285::40-338
MAGGTLQLQPQQQSPAVLTRIVISCIEFSREELYVATDGFYDVLGEGGFGHVYKGRLPNGKFVAVKKLKSGSQQGDREFQAEVEAISRVNHRYLVTLVGYCTSDDERMLVYEFVPNNTLKFHLHEKDKPSMDWSTRMKIALGSAKGFEYLHVYCDPIIIHRDIKASNILLDKDFEPKVADFGLAKFLSDTESHVSTRVMGTNGYVDPEYRDSGRLTAKSDVYSFGVVLLELITGRKPIDEKKPFKERDLVKWASPFLLQALRNITVVPLDSRLQETYNPEEFLCQALKNGRFDGLIDSRLQETNYNPEEMIRMITCAAACVLNSAKLRPRMSLVVLALGGFIPLKFLKPEITPGTSNVSEYLSDSIQSYEDLKKIFMNMAQKGRENVIDENEYSDPRSKYGQDQCASSMAGPSNVSDSFNNGVQSMNMEQKDKEKVINENIDPSSKYDSVSTHGQQNTKEMGKVNGS

SEQ ID NO: 192680 - protein, 231 aa, Glycine max
  Coding DNA Sequence Number=SeqID_75902
  Gene Ontology: Mol. function=phosphoinositide binding; Biological process=intracellular signaling cascade
  Homolog annotation: Hit_ID=Q75HY6; Match level="QueryCoverage=81%, HitCoverage=19%, E-value=1e-53, Identity=52%"; Hit description =Unknow protein
  Pfam annotation: Domain name=PXA; Domain location=41-197; Score= -20.2; E_value=0.0027; Accession=PF02194.6; Description=PXA domain
MKRKAAAYNNKAGSTNVQSSKKPVENPKVIAKFEWRTKVNSPVVEDAIDNFTRHLISEWVTDLWYSRLTPDKEGPEEDLINLICSHLELFRAAHSKIEKRHTGSLTIESRDMELKNVLAAENKLHPALFSAEAEHKVLQHLMTGLMHVTFKSEDLQCSFFRYTVRELLACAVIRPVLNLANPRFINERIESVVVNKTKVNKGVAAAQEASHTKADEIQISSDDFFKSSDPS

SEQ ID NO: 192681 - protein, 674 aa, Glycine max
  Coding DNA Sequence Number=SeqID_75903
  Gene Ontology: Mol. function=microtubule motor activity; Cellular component=microtubule associated complex; Biological process =microtubule-based movement
  Homolog annotation: Hit_ID=Q9AVP4; Match level="QueryCoverage=98%, HitCoverage=98%, E-value=0.0, Identity=69%"; Hit description=BY-2 kinesin-like protein 10
  Pfam annotation: Domain name=Kinesin; Domain location=164-482; Score =438.6; E_value=8.1e-129; Accession=PF00225.13; Description=Kinesin motor domain
MSRQGQRSGATGVHHNRQYSEHYLDASSKWFNNSSSNHIPPLQDYNLYGGGGRMYRSNAQRSFNEYCLDPSTPPRSYAVKKNGNGYGEEDDSPRDFSPGLLDLHSFDTELLPQITSSNLYDSEPYIFGKQPVRARASENNVSNSVAAADNVKSSNVAKIKVVVRKRPLNKKETAKHEEDIIDTVSNSLTVHETKLKVDLTQYVEKHEFVFDAVLNEEVTNDEVYRETVEPIVPIIFQRTKATCFAYGQTGSGKTYTMKPLPLKASRDILRLMHHTYRNQGFQLFVSFFEIYGGKLFDLLNDRKKLCMREDGKQQVCIVGLQEYRVSDVETIKELIEQGNATRSTGTTGANEESSRSHAILQLAIKRSVDGNVSKPPRVVGKLSFIDLAGSERGADTTDNDKQTRIEGAEINKSLLALKECIRALDNDQGHIPFRGSKLTEVLRDSFVGNSRTVMISCISPSSGSCEHTLNTLRYADRVKSLSKGNNSKKDVLSSNFNLKESTTIPLSSINTYTYEDRAADTWPEENDGDEFSSPEDYCEPVKPSWKKNGKVEPYGATDDKFKKPNGQIKWKDIPKVEPKTVHSDDDDLTALLQEEDDLVNAHRKQVEETMNIVREEMNLLVEADKPGNQLDDYIAKLNAILSQKASGIMQLQTRLAHFQKRLKEHNVLASSAGY

SEQ ID NO: 192682 - protein, 912 aa, Glycine max
  Coding DNA Sequence Number=SeqID_75904
  Gene Ontology: Mol. function=hydrolase activity, acting on acid anhydrides, in phosphorus-containing anhydrides; Cellular component =nucleus; Biological process=nucleobase, nucleoside, nucleotide and nucleic acid metabolic process
  Homolog annotation: Hit_ID=Q9CA92; Match level="QueryCoverage=98%, HitCoverage=98%, E-value=0.0, Identity=54%"; Hit description =Putative helicase; 55525-51977
  Pfam annotation: Domain name=DEAD; Domain location=18-397; Score= -41.9; E_value=0.019; Accession=PF00270.19; Description=DEADDEAH box helicase
  Pfam annotation: Domain name=DEAD_2; Domain location=207-395; Score =243.7; E_value=4e-70; Accession=PF06733.6; Description=DEAD_2
  Pfam module annotation: Pfam domain module=DEAD::DEAD_2; Domain location=18-397::207-395
MEAKEGTPKFPGFPFEPYSIQIDFMNSLYESLNQGGVSMLESPTGTGKTMSVICSALQWVLDRRLQQDEAACGEDRGNGGDGGVGSDDEPDWMRDFVIDKEEKKKEEKCGSVWGKPHSKKKSKEIPKDFRVMGVGEEKGRESLQKKIDAVEIGDKEFLLEEYESEDEKGLGSVVSKRKAVKTSFSSSSEDESGEEEEEEEKKLKVYFCSRTHSQLSQFIKELRRTVFANEMNVVSLGSRKNLCINEEVVALGNSTRINERCLELQKKKKNEATKVKNLKVGAGVCRTKASSGCPMLRKHRVQQEFRNEVSQQGPLDIEDLANLGRTMGACPYYGSRSLVQGADLVVLPYQSLLSKSSRETLGLNLKSNIIIIDEAHNLADSLINMYDSKITSSQLEIVHRHVERYFERFRNLLGPANRRYIQTLMVLMRAFLRALLDDKDGNLKDSCRDTAQASEESGACDFTMAINDFLFELNIDNINLVKLLKYIKESNIMHKVNGYGEKVATLAKIPAIHIIGEQAEEGSCISAFQALADILLSLTNNDGDGRIIISRSRSTSFKKQGGHIKYVMLSGEKIFSEIVDEAHAVVLVGGTLQPIEETRERLFPWLPPNQLHFFSCGHIVPPDSIMPIAVTRGPTGRSFDFSFSSRSSPDMMRELGLLLCNLVTVVHEGIVVFFPSFDYENRVYEHWKSSGILERIIKRKRVFREPRNNMDVESVLKEYKDTIDTISVMNSEVNQASHNGAILLAVVGAKLSEGINLSDGMGRCIVMVGLPYPSPSDIELLERIKHIEGFRNLKLPENPSVSSSYDLYSGDVQGGFDILRSCSHRGKEYYENLCMKAVNQSIGRAIRHINDYAAILLVDTRYASDSSKRSFSHPVTKLPQWIKDRFVSSTINYGEVHRLLHQFFKLKKTCCH

SEQ ID NO: 192683 - protein, 825 aa, Glycine max
  Coding DNA Sequence Number=SeqID_75905
  Gene Ontology: Mol. function=phosphoinositide binding; Biological process=intracellular signaling cascade
  Homolog annotation: Hit_ID=Q75HY6; Match level="QueryCoverage=98%, HitCoverage=65%, E-value=1e-141, Identity=38%"; Hit description =Unknow protein
  Pfam annotation: Domain name=Nexin_C; Domain location=615-754; Score =74.9; E_value=2.6e-19; Accession=PF08628.2; Description=Sorting nexin C terminal
  Pfam annotation: Domain name=PX; Domain location=315-454; Score=51.0; E_value=3.9e-12; Accession=PF00787.14; Description=PX domain
  Pfam module annotation: Pfam domain module=Nexin_C::PX; Domain location=615-754::315-454
MPANSLTNDNLGLQRHRSGGEWGDILDVISHRKTQALAPEHFENMWTKGKNYKKKDGENQSNEHVSQHSQVGKLSMVDHMKEISGPNERDTNSKLMLPPKGRHINSGHNSQFSVENTSIHADKNGSTSVTSYKDDKSVTSYKDDEHSHIYGQMSDSASSTSYSSEDNESSTVTGLDSPVTKVWDGKSNRNQAVSYVHHPLENFDNHSAKKRNKSHSRYPRLSRAQSGSKRSWPGGQKIQTWQEVERTSFLSGDGQDILNSSKSHINSEESSDDADMESLGRLYSGAAASSSAYSISKSESCSLSVGPLKNSSAVDSFYKLRCEVLGANIVKSGSKTFAVYSISVTDVNHNSWSIKRRFRHFEELHRRLKEFAEYNLHLPPKHFLSTGLDVPVIQERCELLDKYLKRKKLSAFGTVIEPRSPILCYQQDRYWILKLMQLPTVSESIEVWDFLSVDSQTYIFSNSFSIMETLSVGLNSKPFEKTKNTSNLSAPASDPVSFWRENCSAESKEAVLGARNNVVANGMRSKVNSTPLSLPKKSTHEPRKSFDNSSSNTNILARKSVPSPKTVKGRNNSDEVSEVHHDTSDAFPTEWVPPNLSVPILDLVDVIFQVQDGGWIRRKAFWVAKQILQLGMGDAFDDWLIEKIQLLRKGSVVASGVQRVEQILWPDGIFITKHPNRRPPPPTSPSQNSPHGNQPTQVSSPRLDDEQQQEADRRAKFVYELMIDHAPPAIVGLVGRKEYEQCARDLYFFLQTLCSSKTHFRHSLCLSIIWSCKYFLLTSLQSSVILKQLVFDILELLLTSAFPELDNVFKQLHEEKHKFGEFRTE

SEQ ID NO: 192684 - protein, 51 aa, Glycine max
  Coding DNA Sequence Number=SeqID_75906
MWLLEIFLRIQIRWKLITDFMQEIFLPKKIARKSAGHKRPPAEENNTKITN

SEQ ID NO: 192685 - protein, 181 aa, Glycine max
  Coding DNA Sequence Number=SeqID_75907
  Pfam annotation: Domain name=C2; Domain location=10-91; Score=17.1; E_ value=0.0073; Accession=PF00168.20; Description=C2 domain
MEAKSHSRILEITVMSGENISVDRSSVAANVYVVVRAESLNSCTTKMVNGDGGVHAWNEKFLLGIPSYARSVTFEVQCMNYKGVRPIGVARIALSDLLSNNTKIVSESVPQMLCYGLRNWEGRRNGVIHFSVRMVAPGDNLCSETKQEKEITTVNYRGIEHEVMGIQVEAKNSTHVAIGIP

SEQ ID NO: 192686 - protein, 214 aa, Glycine max
  Coding DNA Sequence Number=SeqID_75908
  Homolog annotation: Hit_ID=Q9LW80; Match level="QueryCoverage=85%, HitCoverage=99%, E-value=1e-15, Identity=29%"; Hit description =Arabidopsis thaliana genomic DNA, chromosome 3, P1 clone: MSL1
  Subcellular localization annotation: CTP_CleavageSite=44; ConfidenceScore=5.15e-01
MLLRETFRKTKAFFNKSFRNFWSFFFGEYQKLPRTLSFNPFLCRVGNARTHTSDQLYSEFYDMLQSDLGRIKMHGNYNMSMSAMEDDAACSRSFMCCAKQSPQKSIHEERAQEKKNKGSSQLSIKEDLKSQNMMNKKAHVLEQKMKAMDMMNAGDLEHVLDIEEALHYYSRLQSPVYLDIVDKFFKDMQSELSVPQPCVSLKPSKERLGPIRLR

SEQ ID NO: 192687 - protein, 35 aa, Glycine max
  Coding DNA Sequence Number=SeqID_75909
MARRITMVVVFTIVIVVGEISTGRSVNDYIDFKKD

SEQ ID NO: 192688 - protein, 302 aa, Glycine max
  Coding DNA Sequence Number=SeqID_75910
  Gene Ontology: Mol. function=binding; Cellular component =mitochondrial inner membrane; Biological process=transport
  Homolog annotation: Hit_ID=Q1SK80; Match level="QueryCoverage=74%, HitCoverage=94%, E-value=1e-101, Identity=53%"; Hit description =Mitochondrial carrier protein
  Pfam annotation: Domain name=Mito_carr; Domain location=103-196; Score=82.1; E_value=1.7e-21; Accession=PF00153.17; Description =Mitochondrial carrier protein
  Pfam annotation: Domain name=Mito_carr; Domain location=203-294; Score=112.1; E_value=1.6e-30; Accession=PF00153.17; Description =Mitochondrial carrier protein
  Pfam module annotation: Pfam domain module=Mito_carr::Mito_carr; Domain location=103-196::203-294
GVALGGVLFFVTLASIPTGTSSNDFPFSMMSNLEMLENNTYSLWVPLGHIYRPLKATETSKESFELFYVNGVLEYKPNAMVFQTYAVLSRAFDSSVSAKDPPSYKGVALGGTGTGAIQSLLISPVELTKVRLQLQNAGQMTETAKGPLMLAKNIWRKEGLRGIYRGLGVTVMRDGPSHGLYFWTYEYMREQLHPGCRKSGEESLNTMLIAGGLAGVTSWISCYPFDVVKTRLQAQTPSSIKYKGIIDCFKKSVNEEGYGVLWRGLGTTVARAFLVNGAIFSAYEISLRLLFNNGNIQMQETL

SEQ ID NO: 192689 - protein, 68 aa, Glycine max
  Coding DNA Sequence Number=SeqID_75911
MEAGNHGSAAYGGRKSRQRRIWRSEIAAAPLHGGSRQLMCVNVARVILSSDREGWSMRAVSEIDKFQI

SEQ ID NO: 192690 - protein, 56 aa, Glycine max
  Coding DNA Sequence Number=SeqID_75912
  Gene Ontology: Mol. function=binding; Cellular component =mitochondrial inner membrane; Biological process=transport
  Homolog annotation: Hit_ID=Q1SK80; Match level="QueryCoverage=99%, HitCoverage=24%, E-value=2e-09, Identity=86%"; Hit description =Mitochondrial carrier protein
MDFWPEFLASSSGREFVAGGFGGLAELEKWLCLHNPLDQWCLGKDLLLCTVAWAHH

SEQ ID NO: 192691 - protein, 95 aa, Glycine max
  Coding DNA Sequence Number=SeqID_75913
  Subcellular localization annotation: CTP_CleavageSite=47; ConfidenceScore=5.72e-01
MAMALVSLNTIHTSPSSFSFSSPKPYSSSNYAPPLTLLPRFRRHLVRMAPDEEKMTRRSPLDFPIVCKCCEFGFGFAVTLLCLLPDYLNSLLKDN

SEQ ID NO: 192692 - protein, 165 aa, Glycine max
  Coding DNA Sequence Number=SeqID_75914
  Pfam annotation: Domain name=TMA7; Domain location=113-164; Score =56.5; E_value=8.6e-14; Accession=PF09072.1; Description=Translation machinery associated TMA7
MATVSGYIPVGVLTFEILGVIRMSSNYGRIMLWSSGYMSLEYAINGVVPVKTDVYGSGEGKVALCCVVSCAVPLFLVFVFRPNPSSASQPCRPSKTKILWFAIYLIDFFFPSLGLLGGKAKPLKKPKSDKKDYDEIDVANIQKKKEEEKALKELKAKAQQKGSFG

SEQ ID NO: 192693 - protein, 227 aa, Glycine max
  Coding DNA Sequence Number=SeqID_75915
  Gene Ontology: Mol. function=structural constituent of ribosome; Cellular component=ribonucleoprotein complex; Biological process =translation
  Homolog annotation: Hit_ID=P36688; Match level="QueryCoverage=56%, HitCoverage=68%, E-value=2e-38, Identity=68%"; Hit description=50S ribosomal protein L12, chloroplast precursor
  Pfam annotation: Domain name=Ribosomal_L12; Domain location=122-191; Score=119.6; E_value=8.6e-33; Accession=PF00542.9; Description =Ribosomal protein L7L12 C-terminal domain
  Subcellular localization annotation: CTP_CleavageSite=54; ConfidenceScore=5.73e-01
MASTTLTTLSLRNLSYPTPSSSSYPTHLSANPSSLQFPNFSHRATTTRRARVVVVSAVEAPEKITKLGDEIAGLTLEEAKNLVDFLQDKLGVSAAAFAPVAVAAGAVGAVADAPAAVEEKTEFDVLIEEVPSNARIAVIKAVRALTNLALKEAKELIEGLPKKFKEGISKDEAEDAKKQLEEAGAKVKGFKLLNWKLEIGNMVLNYLLNTWSDKTSSVWTMMFGYAP

SEQ ID NO: 192694 - protein, 362 aa, Glycine max
  Coding DNA Sequence Number=SeqID_75916
  Homolog annotation: Hit_ID=Q3LHL2; Match level="QueryCoverage=41%, HitCoverage=30%, E-value=1e-20, Identity=32%"; Hit description =Hypothetical protein PPS5
  Pfam annotation: Domain name=DUF292; Domain location=1-129; Score =117.7; E_value=3.3e-32; Accession=PF03398.5; Description=Eukaryotic protein of unknown function, DUF292
MKTRLEIIQNRKKAEQKLMKSDIAELLKSGLDYDAYIRAERLLFEQNMLSCYELVEKFVGCISDHVEDLTKQKDCPDECKEAVPSLMYAAARFGDLPELRNLRTLFTEKFGNSLEPCINKEFVEKLRRDPPTREMKIGLLYDIAQEFSVEWNDNALRQILYTQSSLCEERPNPGGDFNTSKGKEKDTDTLPLGRKDFNDDSLIHQNSSDDETSTELSSHDGRKGSSSSSLGSFSEDEAETKRPISSYWIIPPPYLKQKTNTGESNSKKTTHSEAGGMKSGKGKPYPSQQPDHDTGQNRRRTTSHVRGKSLSSEPTTAVETSKGHTRTISLESGIRGGGSWRVHPNLPDYDDLRARLLALRQR

SEQ ID NO: 192695 - protein, 327 aa, Glycine max
  Coding DNA Sequence Number=SeqID_75917
  Gene Ontology: Mol. function=small conjugating protein ligase activity; Cellular component=protein complex; Biological process =protein modification process
  Homolog annotation: Hit_ID=Q1S8S1; Match level="QueryCoverage=99%, HitCoverage=80%, E-value=4e-73, Identity=77%"; Hit description =Ubiquitin-conjugating enzyme, E2
  Pfam annotation: Domain name=UEV; Domain location=27-148; Score =218.9; E_value=1.1e-62; Accession=PF05743.3; Description=UEV domain
MTQFLNSVLSQRGPSAVPYSEDTKWLIRQHLVALTTAFPSLEPKTASFTHNDGRSVNLLQADGTIPMTFQGVTYNIPVVIWLMESYPRHPPCVYVNPTRDMIIKRPHPHVNPSGLVSVPYLQNWTYPSSNLVDLILNLSLHFGRDPPLYSQRRPNPNPNPNPHPPPNYGNSPSNLSSSSSSSSGYPHAHAHAHPPPRTYPPSPYPASSSRVQSSEDPSEVFKRNAINKLVEMVHGDVAALRKTREGEMEELFSLQGVLKQREESLNKGVKEMQEEMEALEQQLQMVLMNTDVLEGWLRDNQGKKMAGLENPEDAFECADVLSKQMLD

SEQ ID NO: 192696 - protein, 312 aa, Glycine max
  Coding DNA Sequence Number=SeqID_75918
  Gene Ontology: Mol. function=nucleotide binding; Cellular component =cytoplasm; Biological process=response to unfolded protein
  Homolog annotation: Hit_ID=Q96269; Match level="QueryCoverage=99%, HitCoverage=37%, E-value=1e-156, Identity=85%"; Hit description=Heat- shock protein
  Pfam annotation: Domain name=HSP70; Domain location=3-312; Score= -28.6; E_value=1.4e-14; Accession=PF00012.10; Description=Hsp70 protein
MSVVGFDFGNESCVVAVARQRGIDVVLNDESKRETPAIVCFGDKQRFIGTAGAASTMMNPKNSISQIKRLIGRKFADPELQRDLKSLPFLVTEGSDGYPLIHARYMGEAKTFTPTQVFGMMLSNLKEIAEKNLTTAVVDCCIGIPVYFTDLQRRAVLDAATIAGLHPLRLIHEMTATALAYGIYKTDLPENDQLNVAFVDVGHASLQVCIAGFKKGQLKVLAHSYDRSFGGRDFDEVLFHHFAEKFKDEYKIDVFQNARACIRLRAACEKIKKMLSANPEAPLNIECLMDEKDVRGFIKRDEFEQLSLPILE

SEQ ID NO: 192697 - protein, 288 aa, Glycine max
  Coding DNA Sequence Number=SeqID_75919
  Gene Ontology: Mol. function=metalloendopeptidase activity; Cellular component=outer membrane; Biological process=proteolysis
  Homolog annotation: Hit_ID=Q9PC41; Match level="QueryCoverage=99%, HitCoverage=39%, E-value=1e-106, Identity=63%"; Hit description =Peptidyl-dipeptidase
  Pfam annotation: Domain name=Peptidase_M3; Domain location=1-288; Score=138.7; E_value=1.6e-38; Accession=PF01432.10; Description =Peptidase family M3
FYAANLLYGISFKEAQGHPGLSAGRQGVRSVRQGRQSLALFYTDYFKRDNKGGGAWMSNFVDQSKLNGTKPVIYNVANFTKPAPGQPALLSYDDVITMFHEFGHALHGMFADQEYPSLSGTNTARDFVEFPSQFNEHWVSDPKVFSHFAKHYQTGEAMPQELVDKIKKADKFNKGYSMTELLSAALLDMHWHMLTADQPQQDVDKFEAESLQKDKVDLSYVPPRYRSSYFQHIWGNGYAAGYYAYLWTEMLADDAFQWFTEHGGLTAENGQRFRDMILSRGNSQDLEK

SEQ ID NO: 192698 - protein, 93 aa, Glycine max
  Coding DNA Sequence Number=SeqID_75920
LERIDGDPVLRETRIWATWEYVSSDGGGQQGMSGTWRYVAGVRRPWGRQASSWQSTDKRKTRPQSKEACGGWPAEAKMVSGNRLPGGVIDYQA

SEQ ID NO: 192699 - protein, 483 aa, Glycine max
  Coding DNA Sequence Number=SeqID_75921
  Gene Ontology: Mol. function=sulfate porter activity; Cellular component=integral to membrane; Biological process=sulfate transport
  Homolog annotation: Hit_ID=Q6ZXB7; Match level="QueryCoverage=99%, HitCoverage=83%, E-value=1e-171, Identity=61%"; Hit description =Plasma membrane sulphate transporter
  Pfam annotation: Domain name=STAS; Domain location=353-471; Score =118.2; E_value=2.3e-32; Accession=PF01740.11; Description=STAS domain
  Pfam annotation: Domain name=Sulfate_transp; Domain location=87-330; Score=207.9; E_value=2.3e-59; Accession=PF00916.10; Description =Sulfate transporter family
  Pfam module annotation: Pfam domain module=STAS::Sulfate_transp; Domain location=353-471::87-330
  Subcellular localization annotation: CTP_CleavageSite=52; ConfidenceScore=5.10e-01
MVLDDGISYAKLANLPPILGLYSSFVPPLIYSLLGSSRHLGVGPVSIASLVMGSMLSETVSYSQDPILYLKMAFTATFFAAFDDPYRLGFVIDFLSKATLVGFMAGAAIIVSLQQLKGLLGIVHFTNKMQITPVLISVFKQRDEIGGLPKGLNPPSSNMLYFNGPYLALAIKTGLVTGILSLTEGIAVGRTFAALKNYQLALVLHAMSQQAMTLPSFDHVTSGSFSRSAVNYNAGAQTAVSNIIMASAVLVTLLFLMPLFYYTPNVVLAAIIITAVSGLIDYQAAYKLWKVDKLDFLACLCSFFGVLFISVPLGLGIAVAISVFKILLHVSRPNTLVLGNIPGTPIFHNLNQYREALRIPSFIILAVESPIYFANSTYLQERILRWVREEEERVKANNESTLKCIILDMTAVTAIDTSGIDTLCELRKVLEKRSLQLVLTNPVGNVMEKLHQSNILDSFGLKGVYLSVGEAVADISSSWKAQP

SEQ ID NO: 192700 - protein, 461 aa, Glycine max
  Coding DNA Sequence Number=SeqID_75922
  Gene Ontology: Mol. function=nucleotide binding; Cellular component =cytoplasm; Biological process=response to unfolded protein
  Homolog annotation: Hit_ID=Q96269; Match level="QueryCoverage=83%, HitCoverage=45%, E-value=1e-138, Identity=62%"; Hit description=Heat- shock protein
  Subcellular localization annotation: CTP_CleavageSite=62; ConfidenceScore=5.16e-01
SGPDAQDNGPENQQSSLVFPKGNPIPSIKALTFYRSGTFSVDVQFGDVSGLQTPAKISTYTCCDSFECNQIGPFQTTNGEKAKVKVKVRLNLHGIVSLESATLLEEEEVDVPVSKEAAGENTKMDIDEVPAEAAAPPSSNDTGANMENGKASIDASGVEDGIPESGGKPLQTDTDTKVQAPKKKVKKTNIPVVELIYGAMVPVDVQKALEKEFEMALQDRVMEETKDKKNAVEAYVYDMRNKLNDKYQEFVTASERDDFTAKLQEVEDWLYGEGEDETKGVYTAKLEELKKHGDPIDERYKEFMERGTIIEQFVYCINSYRQVAMSNDPRFEHIDINEKQKVINECVEAEKWFNEKQQQQNSLPKYANPVLLSAEIRKKAEAVDRFCKPIMATPRPTKATTPPGPATHPSSQSDEQQQQQQPPQGDADANSNENGGNSSSQAAPASTEPMETDKSEKTASA

SEQ ID NO: 192701 - protein, 83 aa, Glycine max
  Coding DNA Sequence Number=SeqID_75923
MVMSKKTLGLGIVAEKRIENRTTEEEEERGIRVLLGVADDEREIFIVARDAEVTVRLEHVAGVSGADPRSLTDMLVIMPMTFT

SEQ ID NO: 192702 - protein, 176 aa, Glycine max
  Coding DNA Sequence Number=SeqID_75924
  Gene Ontology: Mol. function=aminoacyl-tRNA hydrolase activity; Cellular component=mitochondrion; Biological process=apoptosis
  Homolog annotation: Hit_ID=Q9Y3E5; Match level="QueryCoverage=57%, HitCoverage=58%, E-value=3e-24, Identity=58%"; Hit description =Peptidyl-tRNA hydrolase 2, mitochondrial precursor
  Pfam annotation: Domain name=PTH2; Domain location=85-167; Score =81.0; E_value=3.7e-21; Accession=PF01981.7; Description=Peptidyl -tRNA hydrolase PTH2
MELSWLSAILVGAGYLALGYFIGSQYPPRFLFSHKLSTKQKDASLLNDSDNKKRNTKSKLEDPLEIEQLAEILDDFKMILVVRNDLKMGKGKIAAQCSHATLGLYKKILRRAPKALNRWEMSAQPKVVVKIECEEDMLALQERAKSLKLPTHITIDAGRTQIAPSAYLKLPLSSCL

SEQ ID NO: 192703 - protein, 969 aa, Glycine max
  Coding DNA Sequence Number=SeqID_75925
  Gene Ontology: Mol. function=structural constituent of ribosome; Cellular component=intracellular; Biological process=translation
  Homolog annotation: Hit_ID=Q1S8S2; Match level="QueryCoverage=91%, HitCoverage=96%, E-value=0.0, Identity=55%"; Hit description =Tetratricopeptide-like helical
  Pfam annotation: Domain name=PPR; Domain location=119-153; Score=3.5; E_value=2.9; Accession=PF01535.11; Description=PPR repeat
  Pfam annotation: Domain name=PPR; Domain location=171-205; Score=4.6; E_value=2.1; Accession=PF01535.11; Description=PPR repeat
  Pfam annotation: Domain name=PPR; Domain location=206-240; Score =22.1; E_value=0.002; Accession=PF01535.11; Description=PPR repeat
  Pfam annotation: Domain name=PPR; Domain location=241-275; Score=6.5; E_value=1.3; Accession=PF01535.11; Description=PPR repeat
  Pfam annotation: Domain name=PPR; Domain location=276-310; Score =33.9; E_value=5.4e-07; Accession=PF01535.11; Description=PPR repeat
  Pfam annotation: Domain name=PPR; Domain location=311-345; Score =35.5; E_value=1.8e-07; Accession=PF01535.11; Description=PPR repeat
  Pfam annotation: Domain name=PPR; Domain location=346-380; Score =17.3; E_value=0.055; Accession=PF01535.11; Description=PPR repeat
  Pfam annotation: Domain name=PPR; Domain location=381-415; Score =38.0; E_value=3.2e-08; Accession=PF01535.11; Description=PPR repeat
  Pfam annotation: Domain name=PPR; Domain location=416-450; Score =38.8; E_value=1.8e-08; Accession=PF01535.11; Description=PPR repeat
  Pfam annotation: Domain name=PPR; Domain location=451-485; Score =42.1; E_value=1.8e-09; Accession=PF01535.11; Description=PPR repeat
  Pfam annotation: Domain name=PPR; Domain location=486-520; Score =48.5; E_value=2.2e-11; Accession=PF01535.11; Description=PPR repeat
  Pfam annotation: Domain name=PPR; Domain location=521-555; Score =42.4; E_value=1.6e-09; Accession=PF01535.11; Description=PPR repeat
  Pfam annotation: Domain name=PPR; Domain location=556-590; Score =57.7; E_value=3.7e-14; Accession=PF01535.11; Description=PPR repeat
  Pfam annotation: Domain name=PPR; Domain location=591-625; Score =29.5; E_value=1.1e-05; Accession=PF01535.11; Description=PPR repeat
  Pfam annotation: Domain name=PPR; Domain location=626-660; Score =33.1; E_value=9.6e-07; Accession=PF01535.11; Description=PPR repeat
  Pfam annotation: Domain name=PPR; Domain location=661-695; Score=6.1; E_value=1.4; Accession=PF01535.11; Description=PPR repeat
  Pfam annotation: Domain name=PPR; Domain location=696-730; Score =40.1; E_value=7.5e-09; Accession=PF01535.11; Description=PPR repeat
  Pfam annotation: Domain name=PPR; Domain location=731-765; Score =46.5; E_value=9.2e-11; Accession=PF01535.11; Description=PPR repeat
  Pfam annotation: Domain name=PPR; Domain location=766-799; Score=9.1; E_value=0.62; Accession=PF01535.11; Description=PPR repeat
  Pfam annotation: Domain name=PPR; Domain location=800-834; Score =46.9; E_value=6.9e-11; Accession=PF01535.11; Description=PPR repeat
  Pfam annotation: Domain name=PPR; Domain location=835-869; Score =39.2; E_value=1.4e-08; Accession=PF01535.11; Description=PPR repeat
  Pfam annotation: Domain name=PPR; Domain location=870-904; Score =44.8; E_value=2.9e-10; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR::PPR::PPR::PP R::PPR::PPR; Domain location=119-153::171-205::206-240::241-275::276 -310::...
  Pfam module annotation: Domain location=311-345::346-380::381 -415::416-450::451-485::486-520::521-555::556-590::591-625::626 -660::661-695::696-730::731-765::766-799::800-834::835-869::870-904
MPIPISSGERDYVNELSEIACKGNWFAPAHYPPPLLLFTDTSPHPTRTKKTTVVFVSLLCDIVRGKQSWKVAFNDASISSTLRPHYVEQVLMNTLDDAKLALRFFNFLGLHKNMNHSTTSYAIMVHALVHSRLFWPANSLLHTLLLRESHPKCVFSHFLDSYKRCKFSSTLGFNLLVQNYVLSSRIFDAVVIVKLMFANNLLPEVRTLSALLNGLLKVRKFITVWELFDESVNAGVRPDPYTCSAVVRSMCELKDFLRAKEKIRWMEANGFDLSIVTYNVLIHGLCKGDRVSEAVEVKRSLGGKGLAADVVTYCTLVLGFCRLQQFEAGIQLMDEMVELGFSPTEAAVSGLVDGLRKQGKIDDAYELVVKVGRFGFVPNLFVYNALINSLCKGGDLDKAELLYSNMSLMNLRPNGITYSILIDSFCRSGRLDVAISYFDRMIQDGIGETVYAYNSLINGQCKFGDLSAAESLFIEMTNKGVEPTATTFTSLISGYCKDLQVQKAFKLYNKMIDNGITPNVYTFTALISGLCSTNKMAEASELFDELVERKIKPTEVTYNVLIEGYCRDGKIDKAFELLEDMHQKGLVPDTYTYRPLISGLCSTGRVSKAKDFIDDLHKQNVKLNEMCYSALLHGYCQEGRLMEALSASCEMIQRGINMDLVCHAVLIDGALKQPDRKTFFDLLKDMHDQGLRPDNVIYTSMIDTYSKEGSFKKAFECWDLMVTEECFPNVVTYTALMNGLCKAGEMDRAGLLFKRMQAANVPPNSITYGCFLDNLTKEGNMKEAIGLHHAMLKGLLANTVTHNIIIRGFCKLGRFHEATKVLSEMTENGIFPDCVTYSTLIYEYCRSGNVGASVKLWDTMLNRGLEPDLVAYNLLIYGCCVNGELDKAFELRDDMLRRGVKPRQNLHAFLKGWVKPRQNIQNLLRLSYLEKRSVLEVLRIMIDYLSSLAENKSFMPRLENLHGCLEAWC

SEQ ID NO: 192704 - protein, 275 aa, Glycine max
  Coding DNA Sequence Number=SeqID_75926
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=O24470; Match level="QueryCoverage=99%, HitCoverage=36%, E-value=3e-81, Identity=59%"; Hit description =Lipoxygenase
  Pfam annotation: Domain name=Lipoxygenase; Domain location=2-275; Score=-116.1; E_value=1.1e-10; Accession=PF00305.9; Description =Lipoxygenase
MELGSARNETEFMIMMFTMIWAIPTVMKDSNSERPGKVYVPRDENFGDFLIYGIKSLSRKVLPALKSVFDIKFTPNEFDIFEEVQLSCLQKYSAKLVPYLCSRKSSVLMVKSMSSQFSIPHLIKVNKSAWMTDEEFAREMIAGVNPCVIRLLQEFPPQSKLDPSVYGDQTSKLTEEHLEINLEGLMAIEGQRLFILDHHDVFMPFLTRLNESKSTKAYATRTILFLKDDGTLKPLAIELSLPYSGGQQLGADSRVILPANQGVESTIWLLAKAYV

SEQ ID NO: 192705 - protein, 257 aa, Glycine max
  Coding DNA Sequence Number=SeqID_75927
  Gene Ontology: Mol. function=calcium ion binding; Cellular component =endoplasmic reticulum
  Homolog annotation: Hit_ID=Q5Z9P6; Match level="QueryCoverage=76%, HitCoverage=77%, E-value=4e-40, Identity=44%"; Hit description =Putative SSR alpha subunit
  Pfam annotation: Domain name=TRAP_alpha; Domain location=1-253; Score= -84.6; E_value=2.1e-05; Accession=PF03896.7; Description=Translocon -associated protein (TRAP), alpha subunit
MACIDKFWVFALALLLLASPLLQVARCQSDSDDVVEAAEESGDIGIVGDDVQDFGDGTFPSAPGIETISVFPKNSARLITAGEESELLVGVKNDGDSSLNVIAIKASVHLPFDHRMLVQNLTAQGFNNGSVPASAQATFPYLFAVMSKASQGKGLLYSLCLMIDEHPFQSTFFNGTVEVVESGAFLSMESVFLVTLGVALLVLLGLWIHGQIQHLSKVLKSLFFHIMCYQGLPSLLEFANGTPHNMCPNLYSDFALV

SEQ ID NO: 192706 - protein, 811 aa, Glycine max
  Coding DNA Sequence Number=SeqID_75928
  Gene Ontology: Mol. function=hydrolase activity, acting on glycosyl bonds; Cellular component=membrane; Biological process=metabolic process
  Homolog annotation: Hit_ID=Q9SW48; Match level="QueryCoverage=67%, HitCoverage=97%, E-value=0.0, Identity=76%"; Hit description =Invertase-like protein
  Pfam annotation: Domain name=ER_lumen_recept; Domain location=614 -797; Score=-29.7; E_value=9e-12; Accession=PF00810.9; Description=ER lumen protein retaining receptor
  Pfam annotation: Domain name=GDE_C; Domain location=139-525; Score= -219.8; E_value=0.0051; Accession=PF06202.4; Description=Amylo-alpha -1,6-glucosidase
  Pfam annotation: Domain name=Invertase_neut; Domain location=89-552; Score=1087.3; E_value=0; Accession=PF04853.3; Description=Plant neutral invertase
  Pfam module annotation: Pfam domain module=ER_lumen_recept::GDE _C::Invertase_neut; Domain location=614-797::139-525::89-552
MDWCQNQNGSFKSTDALCIAAEADEEELDFTKVDKPRPIERCKSCEVRSLSELSKVSENSSYSIDHLDKAASLQPKSGMNTPGSLVLDPQSHPIVSEGWEALMRSLVYFRGQRVGTIAAMDSSDEKINYDQVFVRDFVPSALAFLMKGEPEIVRNFILKTLRLQSWEKMIDKFHLAEGVMPASFKVLHDPVRNHETLIADFGESAIGRVAPIDSGFWWIILLRAYTKSTGDNSLAELPECQKGMRLILNLCLSEGFDTFPTLLCADGCCMIDRRMGVYGYPIEIQALFFMALRCALILLKEDAEGEEFRERITKRLHALSYHLRSYFWLDLKQLNNVYRFKTEEYSHTAVNKFNVIPDSLPDWIFDFMPLKGGYFIGNVSPARMDFRWFCLGNCIAILSSLATPEQSIAIMDLIESRWQELIGEMPLKVCYPALENHEWRIITGCDPKNTRWSYHNGGSWPVLLWLLAAASIKTGRPQIAKRALEIVETRLFKDNWPEYYDGKLGRYIGKQARKCQTWSIAGYLVAKMLLDDPSHLGMVALEEDKHQKPVLRRSNSLIGIGIGISDPMRPQRTSIHAVTTWVRRQPPKVKAFLAVVSGMAALVLLRFIVHDHDNLFVAAEAVHSLGISVLIYKLMKERTCAGLSLKSQELTAIFLAVRLYCSFVMEYDIHTLLDFATFVTTLWVIYMIRFKLKASYMEEKDNFAIYYVDFLGILCISRSCLSPAPTAGHAEHQAHYVFALGVARFLSCAHWVLQVLDSRGHLLVALGYGLWPSMVLISEIVQTFILADFCYYYVKSVFGGQLVLRLPSGVV

SEQ ID NO: 192707 - protein, 111 aa, Glycine max
  Coding DNA Sequence Number=SeqID_75929
MGYYYCKPRPCDTHTPNVVLILAVALILLCAPKFFSGEAEEEEDETNNTSPFQVQEEGFVSSHHIVSVRMPATVTDSVIDVIIASISMFSTHDTGAPHLLSAWWKPGREIN

SEQ ID NO: 192708 - protein, 378 aa, Glycine max
  Coding DNA Sequence Number=SeqID_75930
  Gene Ontology: Mol. function=transferase activity, transferring groups other than amino-acyl groups; Cellular component=cellular _component; Biological process=biosynthetic process
  Homolog annotation: Hit_ID=Q460T8; Match level="QueryCoverage=96%, HitCoverage=96%, E-value=1e-155, Identity=74%"; Hit description =Chalcone synthase family protein
  Pfam annotation: Domain name=ACP_syn_III_C; Domain location=275-375; Score=-23.9; E_value=0.0043; Accession=PF08541.1; Description=3 -Oxoacyl-[acyl-carrier-protein (ACP)
  Pfam annotation: Domain name=Chal_sti_synt_C; Domain location=226 -377; Score=230.4; E_value=3.8e-66; Accession=PF02797.6; Description =Chalcone and stilbene synthases, C-te
  Pfam annotation: Domain name=Chal_sti_synt_N; Domain location=5-216; Score=304.3; E_value=2.2e-88; Accession=PF00195.10; Description =Chalcone and stilbene synthases, N-te
  Pfam module annotation: Pfam domain module=ACP_syn_III_C::Chal_sti _synt_C::Chal_sti_synt_N; Domain location=275-375::226-377::5-216
MGNEGIMNGVIKQRVNPGKATILALGKAFPHQLVMQEYLVDGYSQTVTILNSSRSSLDFVSKTTTVKTRYVVMSEEILKKYPELAAEGIPTVKQRLEICNEAVTEMAIEASQTCIKNWGGSLSDVTHLVYVSFSEARLPGGDLYLEKGLGLSPDTQRVMLYFADIAENNPGSRVLLATSETTIIGSKPPSVDRPYDLVGVALFGDGAGAMIIGSDPILESERPLFELHTAVQEFLRHTEKKIDGRLTEEGISFKLARELPQIIEDNVEGFCDKLMSVVGFENKEYNKLFWAVHPGGPAILNRIEKRLDLLPEKLSASRRALMDYGNASSNTIVYVLEFMIEESLKIRKDGRGDLEWGLILAFGPGITFEGILARNLCA

SEQ ID NO: 192709 - protein, 221 aa, Glycine max
  Coding DNA Sequence Number=SeqID_75931
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=Q43440; Match level="QueryCoverage=97%, HitCoverage=25%, E-value=3e-92, Identity=73%"; Hit description =Lipoxygenase
  Pfam annotation: Domain name=Lipoxygenase; Domain location=1-201; Score=-136.1; E_value=5.8e-10; Accession=PF00305.9; Description =Lipoxygenase
IWNAIKTWVHDYVSLYYATDDAIEEDHELQAWWKEVVEKGHGDLKDEPWRPKLLHTREELIQSCRTIIWIASALHAAVNFGQYPYGGFILNRPTLSRRLIPEKGTAEYDEMVNSHQKAYLKTITPNLSVIEILSRHASDEFYLGQRDNPNWTPNPRAIEAFKKFGNKLAEIETKISERNHDPNLRNRTGPAKLPYTVLLPTSEPGLTFRGIPNSISIKRWA

SEQ ID NO: 192710 - protein, 219 aa, Glycine max
  Coding DNA Sequence Number=SeqID_75932
  Gene Ontology: Mol. function=transporter activity; Cellular component= integral to membrane; Biological process=transport
  Homolog annotation: Hit_ID=Q5DVT5; Match level="QueryCoverage=80%, HitCoverage=59%, E-value=2e-14, Identity=33%"; Hit description =Plasma membrane intrinsic protein 2;5
  Pfam annotation: Domain name=MIP; Domain location=1-168; Score=-72.5; E_value=4.5e-05; Accession=PF00230.10; Description=Major intrinsic protein
MSPVFTFIAALKGVVTLTRALIYVLAQLCIGSIIGFFILKCVMDPKLAYTYSLGGCAIDGQGANSGFKPQDALLVEFTCTFVVLFGAVTLAFDKKRSRDLGLLMVCLLVAGAMALAAFVSITLTGQASYAGVGLNPARCLGPALLHGGSLWEGHWVLWLGSFLACVVYYAVSINLAKEGLVWVDGEYDMLALGSCGNVYNTSVLKDQLEERSAGFQVQV

SEQ ID NO: 192711 - protein, 119 aa, Glycine max
  Coding DNA Sequence Number=SeqID_75933
MGWFYTKKKSAEWKQGCTLQEQTIDTASLSPTLHLLVILGIVLSLLWLSRYTTYKAQQNHTVIYYQLFLFLSPVIFIFLLLSYYTCGRLNFCFMSSRHESFQRAVVSPLKLERTHLAAL

SEQ ID NO: 192712 - protein, 107 aa, Glycine max
  Coding DNA Sequence Number=SeqID_75934
  Homolog annotation: Hit_ID=Q53PH5; Match level="QueryCoverage=36%, HitCoverage=7%, E-value=1e-14, Identity=84%"; Hit description =Invertase, putative
MATTYTPAEGSQANSAFNYLPSSSFSNIKAHLKAMKKSNIKAHLSVLLEEDAEGKELKAKIVKHFLATPEQSIAIMDLIESRWQELIGEMPLKVCYPALENHEWNWM

SEQ ID NO: 192713 - protein, 159 aa, Glycine max
  Coding DNA Sequence Number=SeqID_75935
  Gene Ontology: Mol. function=galactosyltransferase activity; Cellular component=Golgi stack
  Homolog annotation: Hit_ID=Q2MGS1; Match level="QueryCoverage=78%, HitCoverage=22%, E-value=1e-20, Identity=41%"; Hit description =Glycosyltransferase sugar-binding region containing DXD motif; Alpha 1,4-glycosyltransferase conserved region
MERRGKVGATVSSIRSHTFPIKYDRTTHIQGDAVTDLKNMLKLPRDRSKTAFGSNDFAVEENVRSKAIQVQGVEDALLLKIMGSRVSPLREGDFLRKDKMLRSNMEGLNPLRNPILQDPDAVGLTRITKADKIIRNYLLRDLKRLPFPSRKITQYHNNL

SEQ ID NO: 192714 - protein, 297 aa, Glycine max
  Coding DNA Sequence Number=SeqID_75936
  Gene Ontology: Mol. function=transporter activity; Cellular component= integral to membrane; Biological process=transport
  Homolog annotation: Hit_ID=Q9XF75; Match level="QueryCoverage=59%, HitCoverage=63%, E-value=1e-15, Identity=30%"; Hit description=Water channel protein MipI
  Pfam annotation: Domain name=MIP; Domain location=23-255; Score=45.4; E_value=8.3e-13; Accession=PF00230.10; Description=Major intrinsic protein
MPRGLVHEKSSEPKFLAYIGAHEFFTIETWKAALVELIATAALMFTLTSCNIACLESQDVNPKLILPFAVFIIVFLFLIVIVPLSGGHMNPIFTFIAALKGVVTLSRALLYVSAQCIGSIIGFFVLKSVMEPKLADTYSLGGCALGDKGQSSGLRPQDALLLEFSCTFLVLFVGLTLAFDKKRCKELGLPMVCLVVAASLALAVFVSITVTGRPGYAGAGLSPARCLGPALLHGGPLWNGHWVFWLGPFLACIIYYSVSINLPKKGLNWVDGEYDVLRLALGSCRTISNNTDLNDLS

SEQ ID NO: 192715 - protein, 95 aa, Glycine max
  Coding DNA Sequence Number=SeqID_75937
MAFLPLPFIRVLSEVCYPESWIDIAPLSATPGSKQPHPMESSLLKGLGEFAPAFPPEKYHETPRKMKISDKINRTGYGRGFRVKPSKTEEALLLP

SEQ ID NO: 192716 - protein, 617 aa, Glycine max
  Coding DNA Sequence Number=SeqID_75938
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P24095; Match level="QueryCoverage=99%, HitCoverage=71%, E-value=0.0, Identity=75%"; Hit description=Seed lipoxygenase
  Pfam annotation: Domain name=Lipoxygenase; Domain location=182-617; Score=743.1; E_value=1.8e-220; Accession=PF00305.9; Description =Lipoxygenase
  Pfam annotation: Domain name=PLAT; Domain location=66-170; Score =139.9; E_value=6.8e-39; Accession=PF01477.13; Description=PLATLH2 domain
  Pfam module annotation: Pfam domain module=Lipoxygenase::PLAT; Domain location=182-617::66-170
MLGLFDKSHKIKGTVVLMPKNVLDVNELNSVRSGGVGGVVSGLFGAVADVTGQVVDTATAILSRNVSFKLISATSTDAKGNGKVGKETYLEKHLPTLPTLGDRRDAYGIHFEWDANFGIPGAIYIRNYTYDEFFLVSVTLEDIPNQGTIHFVCNSWVYNFKDYDKKDRIFFANKTYLPSATPGPLVKYREEELEILRGNGTGERKEHERIYDYDVYNDLGNPDKDVKLARPVLGGSSTYPYPRRVRTGRKATKKDPKSERPASELYMPRDEKFGHLKSSDFLTYGIKSLSQTLLPSLENIFDSDLTWNEFDSFEEVRDLYEGGIKVPTDVLSDISPIPVFKEIFRSDGESVLQFPPPHVVQVSKSAWMTDDEFAREMIAGVNPNVIRLLKEIPPQSKLDPTLYGDQSSTISKEHLEINMGGVTVEEALNGQRLFILDYHDAFMPYLTRINALPTAKAYATRTILFLKDDGTLKPLAIELSKPHPSGDNLGAESKVVLPADQGVESTIWLLAKAHVIVNDSGYHQLMSHWLNTHAVTEPFIIATNRRLSVLHPIYKLLYPHYRDTININGLARNALINAGGIIEESFLPGRYSLEMSSAVYKNWVFTDQALPADLIKR

SEQ ID NO: 192717 - protein, 283 aa, Glycine max
  Coding DNA Sequence Number=SeqID_75939
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P24095; Match level="QueryCoverage=58%, HitCoverage=49%, E-value=3e-33, Identity=65%"; Hit description=Seed lipoxygenase
  Pfam annotation: Domain name=PLAT; Domain location=3-101; Score=78.1; E_value=2.8e-20; Accession=PF01477.13; Description=PLATLH2 domain
MGFVRNGRGKVGKETYLESHLPTLPTLGARHDAFSVYFEWDDKFGFPGAFYIQNFIKTDEFFLVSVTLEDIPNHGTIHFVCNSWVYITLGNAERIAFSLSSYYHDAFFPYLTRINSLPSAKTYATRTILFLKDDGSLKPLAIELSKPHPGGDNLGPVCEVVLPAAEGVETHKPLLRIVKSSLYSLGLWCLPVSTYSLICSSQLAFNAFFSYFLNSFKFTPYIINSLVLLTISSTLLVFQNESSSDDDDDSDSTKISTKKYAIEFICTVGASAGYGLLSKWSWI

SEQ ID NO: 192718 - protein, 296 aa, Glycine max
  Coding DNA Sequence Number=SeqID_75940
  Gene Ontology: Mol. function=pantothenate kinase activity; Biological process=coenzyme A biosynthetic process
  Homolog annotation: Hit_ID=Q8L5Y9; Match level="QueryCoverage=100%, HitCoverage=31%, E-value=1e-115, Identity=74%"; Hit description =Pantothenate kinase 2
MEEPSAYGKLGLANLLEMREECLREFQFADAYRSIKQSANCPKAIYLAQKKLAAFVLAMGSGENEASLAVLPDLLVELDSMDEESRLLTLIEGVLAANIFDWGSRACVDLYHKGTIIEIYRMSRNKMRRPWRVDDFDEFKERMKMPCHKRALLFVDNSGADIVLGMLPLARELLRRGTEVVLVANSLPALNDVTAMELPDIVAEAAKHCDILRRAAEAGGLLVDAMINTSDSSKKNSSSVPLMVVENGCGSPCIDLRQVSSELAAAAKDADLIILEGMGRALHTNLNALFKQDALK

SEQ ID NO: 192719 - protein, 441 aa, Glycine max
  Coding DNA Sequence Number=SeqID_75941
  Gene Ontology: Mol. function=pantothenate kinase activity; Cellular component=cytosol; Biological process=coenzyme A biosynthetic process
  Homolog annotation: Hit_ID=Q8L5Y9; Match level="QueryCoverage=85%, HitCoverage=49%, E-value=1e-134, Identity=61%"; Hit description =Pantothenate kinase 2
  Pfam annotation: Domain name=Fumble; Domain location=94-384; Score =486.5; E_value=3.2e-143; Accession=PF03630.5; Description=Fumble
MAGSVQNQQQQQQLLLGIIEEEKLQKQKEETEGNNNNNNNTRTQLGSDMAPTAGNSIHRSGSRPQLDVSKAEIQGNVEEKYPTILLPNQSDDLSHLALDIGGSLIKLVYFSRHEDQSADDKRKRSVKERLGLSNGNRRSFPILGGRLHFVKFETRKINECLDFIYSKQLHCGGLESHYSDGVTDQNGIIKATGGGAYKYADLLKERLGVSLDKEDEMNCLVAGANFLLKAIRHEAFTHMEGHKEFVQIDPNDLFPYLLVNIGSGVSMIKVDGDGKFERVSGTNVGGGTYWGLGRLLTKCKSFDELLELSQKGDNRTMDMLVGDIYGGLDYSKRIFFGGFFIRGHAYTMDTISFAVHFWSNGEAQAMFLRHEGFLGALGAFMSYEKHGLDDLMVHQLVERFPMGAPYTGGKIHGPPLGDLNEKASDRDGKYLIYVRCLLTLP

SEQ ID NO: 192720 - protein, 76 aa, Glycine max
  Coding DNA Sequence Number=SeqID_75942
MDLQQGVIDHASKVADPAKITQINDLLTQPRVPLPILGMSLVLDLGRIDLELKILLQDPVVKMLLWTLPITSTSGT

SEQ ID NO: 192721 - protein, 82 aa, Glycine max
  Coding DNA Sequence Number=SeqID_75943
  Homolog annotation: Hit_ID=Q2HUH8; Match level="QueryCoverage=79%, HitCoverage=20%, E-value=1e-07, Identity=35%"; Hit description =Histidine triad (HIT) protein; Homeodomain-like
MDPIVGDGQARGHFWMRVIENYNNFRGNLDERTLNQFKGHYKQVVGLKKNGYTKNDVMVHAYSIWKEDEGNDFTLEHAWSEK

SEQ ID NO: 192722 - protein, 61 aa, Glycine max
  Coding DNA Sequence Number=SeqID_75944
MKKGILEQQAKGLEVESITLEARRRRFGRKERWSHRRGGRGGLGRRRGRGVMVGGGGEKET

SEQ ID NO: 192723 - protein, 147 aa, Glycine max
  Coding DNA Sequence Number=SeqID_75945
  Homolog annotation: Hit_ID=Q9LE80; Match level="QueryCoverage=96%, HitCoverage=75%, E-value=2e-28, Identity=39%"; Hit description =Arabidopsis thaliana genomic DNA, chromosome 3, P1 clone: MJK13
MLGIFKEKLVKAPKELNSPASLNSCTKPKPSHEILKDFMPCNSSNAFSMCFGNDALLAYSPSNKPSIHHRGPYPADQVLKELEGSFGFVIYDNKDGTIFVASGSNGQIGLYWGVAIDSSIVISENMEHIKASCAKSFAPFPSGSVLL

SEQ ID NO: 192724 - protein, 105 aa, Glycine max
  Coding DNA Sequence Number=SeqID_75946
  Gene Ontology: Mol. function=DNA binding; Biological process=DNA integration
  Homolog annotation: Hit_ID=Q1SIT1; Match level="QueryCoverage=75%, HitCoverage=28%, E-value=3e-16, Identity=49%"; Hit description =Integrase, catalytic region
MDQAGEERKLQLSELDEIRLEAYENAKFYKEKTKKFHDSIIIKKDFMVGQKVLLYNSKLGLMSVEIKSDSTNKSFKVNGHRLKPFLTNPYGYVQVMGNCSENKVS

SEQ ID NO: 192725 - protein, 657 aa, Glycine max
  Coding DNA Sequence Number=SeqID_75947
  Homolog annotation: Hit_ID=Q1SSZ2; Match level="QueryCoverage=98%, HitCoverage=99%, E-value=1e-62, Identity=50%"; Hit description=C2 calcium/lipid-binding region, CaLB
  Pfam annotation: Domain name=C2; Domain location=11-95; Score=46.5; E_ value=9.2e-11; Accession=PF00168.20; Description=C2 domain
  Pfam annotation: Domain name=Extensin_2; Domain location=255-511; Score=-101.9; E_value=0.0023; Accession=PF04554.4; Description =Extensin-like region
  Pfam module annotation: Pfam domain module=C2::Extensin_2; Domain location=11-95::255-511
MSQILAPFQLLELNVISAQDLAPVSRNMRTYAVSWVHPERKLSTRVDTEGHTHPTWNDKFVFRVDEEFLYSDTSAIMIEIYALHWFKDIHVGTVRVLVGNLAPPPSKPFHNNRTPLGMRFVALQMRRPSGRPQGILNIGFTVLDSSMRSMPLYTHNASAVGYRHLMGEKDAYDSHNHLSPRVRAAAAGATPMPELRRTKSETSSMLGATEVVARHHQAVAGANSSISGSEVSVKRKKGKNKKTKTKKSSSVVSSVNEINSVLSETILPWKVKSGKASPDDIVHNHNDVVEEVHYDDNENAHSTINSIYDKEEEEHIHVNNNVQYEVCASPKSQFQNPPASQYKNSPTPQYMNLSKPQFKNSPTPQYMNSPTPHYKNSPASQFKNSPTPQFKNSLPPQFKNSPMPQYKSSPVPQFNNSPAPQFKNSPAPQYMNSPKLQFKNSPMSQYMSTPKPQFRNSPAVGVLQYRASPVVTKFNPMVGFNGSQRGTPMHPFGKVNNGGGFEYMTPRRSNLANMGHVVITESELGPSASEVAAVIAQKPVIDEAENSTVGGWSLDAESMEGLESKLERWQTKLPPVIDHGELSSYPTTSTTKTSRHSRRHTDGGSIGSGSGSGLFSCFSNICGVECYVGCGGDPKGKKNRIRSRRRTPSADDSSSLL

SEQ ID NO: 192726 - protein, 64 aa, Glycine max
  Coding DNA Sequence Number=SeqID_75948
MMSNDAKSMTRTQIHCVVDGKGEVSLELQQEQHGCRGHGGGKDEVRITNKSVTKLTIKLTRTLR

SEQ ID NO: 192727 - protein, 83 aa, Glycine max
  Coding DNA Sequence Number=SeqID_75949
MEEMRLRLRVREGVALAVVVEEGGLDMKRRGKGRGRNLSPNNTKLERPFICFQRLVLTVVFAKLSSKPDCITGPHLPFWNMFH

SEQ ID NO: 192728 - protein, 72 aa, Glycine max
  Coding DNA Sequence Number=SeqID_75950
MVMKGVSLGVHVQPLNSLVLNANPLSLNEEESSLVSKTTMKQENDQTHVLIRSLHSGTKLQQMVRNDEDSLW

SEQ ID NO: 192729 - protein, 146 aa, Glycine max
  Coding DNA Sequence Number=SeqID_75951
  Homolog annotation: Hit_ID=Q1STT2; Match level="QueryCoverage=84%, HitCoverage=22%, E-value=2e-10, Identity=28%"; Hit description =Lipocalin
MDGILWRIDGSSINIWSQPWVQASTSSYITSSTPLGLEDLKVSPLIKHQQQCWHQVVVRQISNDNDQRNVASHPLLNSEVDDKIIWRLTANGEYNIKSSYHNVMETMMQSYPARALDRRLQEDWARDAREGPRVLMSLRVDFAPIG

SEQ ID NO: 192730 - protein, 44 aa, Glycine max
  Coding DNA Sequence Number=SeqID_75952
MKYRKINIDATFFINENKVGIGHCLHRRPQAKEAKAWALLHAIK

SEQ ID NO: 192731 - protein, 494 aa, Glycine max
  Coding DNA Sequence Number=SeqID_75953
  Gene Ontology: Mol. function=zinc ion binding; Biological process =metabolic process
  Homolog annotation: Hit_ID=Q8RWG0; Match level="QueryCoverage=89%, HitCoverage=45%, E-value=1e-134, Identity=49%"; Hit description =Putative PHD-type zinc finger protein
  Pfam annotation: Domain name=PHD; Domain location=139-182; Score =41.9; E_value=2.1e-09; Accession=PF00628.19; Description=PHD-finger
  Pfam annotation: Domain name=PHD; Domain location=227-286; Score =12.3; E_value=0.0034; Accession=PF00628.19; Description=PHD-finger
  Pfam module annotation: Pfam domain module=PHD::PHD; Domain location =139-182::227-286
MDTNWDGSETSVISKSLVIQTVGKIEDCTNYFKVFISTKQKYQRLHKLIFEEDGLPNGAEVAYYARGQKLLEGIKTRCGIVCRCCNTEVSPSQFEVHAGWASRRKPYAYIYTSNGVSLHELAIFLSKDHKCTTKQNDYVCVVCWDGGNLLLCDGCPRAFHKECASVSSIPRGEWYCQICQHTFLRERPVLYNADAVAAGRVEGVDPIEQIAKRCIRIVKDIGAEMGGCVLCRSSDFSRSGFGPRTIIICDQCEKEYHVGCLRDHKKAYLKELPEGDWFCCNDCTIIHSTLENLLIRVAERLPEALLDVIKKKQVERCLEPLNEIDVRWKLLNGKIASPETRPLLLEAVSMFHECFDPIVDPAAGRDLIPAMKEFADSGFWRNVLCIIDCQGYFQTLFACIERLLAFLNVKNLVLPAAEEAESIWTEKFGFSKMKLDQLAALFVTKTHPSSKNDRSLIVLQLTNYRMNCHQIMAFKGTNMLHKTVPRCRVTNSQA

SEQ ID NO: 192732 - protein, 199 aa, Glycine max
  Coding DNA Sequence Number=SeqID_75954
  Homolog annotation: Hit_ID=UPI00005BFC28; Match level="QueryCoverage =58%, HitCoverage=90%, E-value=1e-38, Identity=72%"; Hit description =PREDICTED: similar to germinal histone H4 gene
  Pfam annotation: Domain name=CBFD_NFYB_HMF; Domain location=124-187; Score=5.0; E_value=0.053; Accession=PF00808.13; Description=Histone -like transcription factor (CBFNF-Y) and archaeal histone
  Pfam annotation: Domain name=Histone; Domain location=121-190; Score =67.1; E_value=5.7e-17; Accession=PF00125.14; Description=Core histone H2AH2BH3H4
  Pfam annotation: Domain name=TAF; Domain location=124-188; Score= -6.7; E_value=0.023; Accession=PF02969.8; Description=TATA box binding protein associated factor (TAF)
  Pfam module annotation: Pfam domain module=CBFD_NFYB_HMF::Histone::TAF ; Domain location=124-187::121-190::124-188
MEEKGATVVAEALRWRYNVVEVKIMEVQSASVAIPVTYTMSNPTVHILKYFLDADRETIQRQRTLPLILYNQKPQQHEVQNKCTRVQPFQLRRRATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 192733 - protein, 276 aa, Glycine max
  Coding DNA Sequence Number=SeqID_75955
  Gene Ontology: Mol. function=transferase activity, transferring glycosyl groups; Cellular component=integral to membrane; Biological process=metabolic process
  Homolog annotation: Hit_ID=Q8S995; Match level="QueryCoverage=45%, HitCoverage=27%, E-value=8e-13, Identity=31%"; Hit description =Glucosyltransferase-14
MEKTPGCSLHFVFIPLMVPCHIPPMVDMTKLIARRNVKVTIVTTPRGETQFRAIIDRDIQSKSPIQTQLVTLHNENYQREYVEEYYRVTGHNVWCVGPLSLSNKDDWDKAWRVSKNINASEIETNQYVKWLNSWPQSSEIYVVSIFSHKEVGAFFTHGGWMSTLDAICAAVPLVALPVSVVEMLYNEKLLAHVAEIGVAMRAEIAMHCGEDEYGECVDEYGQCFKEVIEKVMREGTKEDKAKKYADMATKAIEGGSYRNMSMLIDDIIHAQLLNQN

SEQ ID NO: 192734 - protein, 1403 aa, Glycine max
  Coding DNA Sequence Number=SeqID_75956
  Gene Ontology: Mol. function=zinc ion binding; Cellular component =cytoplasm; Biological process=intracellular protein transport
  Homolog annotation: Hit_ID=Q8H7Q9; Match level="QueryCoverage=99%, HitCoverage=99%, E-value=1e-163, Identity=31%"; Hit description =Putative kinesin-related protein
  Pfam annotation: Domain name=M; Domain location=1099-1119; Score=3.3; E_value=46; Accession=PF02370.7; Description=M protein repeat
  Pfam annotation: Domain name=M; Domain location=1206-1226; Score=4.9; E_value=29; Accession=PF02370.7; Description=M protein repeat
  Pfam annotation: Domain name=M; Domain location=592-612; Score=1.7; E_ value=74; Accession=PF02370.7; Description=M protein repeat
  Pfam annotation: Domain name=M; Domain location=768-788; Score=11.3; E_value=3.6; Accession=PF02370.7; Description=M protein repeat
  Pfam annotation: Domain name=M; Domain location=959-979; Score=0.9; E_ value=95; Accession=PF02370.7; Description=M protein repeat
  Pfam annotation: Domain name=Strep_SA_rep; Domain location=1022-1046; Score=4.0; E_value=22; Accession=PF06696.2; Description=Streptococcal surface antigen repeat
  Pfam annotation: Domain name=Strep_SA_rep; Domain location=1216-1240; Score=6.4; E_value=9.2; Accession=PF06696.2; Description =Streptococcal surface antigen repeat
  Pfam annotation: Domain name=Strep_SA_rep; Domain location=194-218; Score=0.4; E_value=87; Accession=PF06696.2; Description =Streptococcal surface antigen repeat
  Pfam annotation: Domain name=Strep_SA_rep; Domain location=358-382; Score=8.2; E_value=4.7; Accession=PF06696.2; Description =Streptococcal surface antigen repeat
  Pfam module annotation: Pfam domain module=M::M::M::M::M::Strep_SA _rep::Strep_SA_rep::Strep_SA_rep::Strep_SA_rep; Domain location=1099 -1119::1206-1226::592-612::768-788::959-979::1022-1046::1216 -1240::194-218::358-382
MFRLHKHRIAKSGDKIEFRISHLKALQLSCNSSVASVLVECRTTIRYKAIKETQVLSKMNADSNLFVSVVSVETGKTIAKSSKVSVRNGGCQWSDTFSESILVSRDNSSKEIDDYVLKLIVAMGSSRSGILGEATVSLTSYRSSGAAIPLSIPLNKCNHGTVLHVTVQCLTPRTKLRDQESSETKFHLKAINESDYDLAVKSNESDCSNVQSIESSSVEDFDSILSPGEIETMATSFSGSVSNCSHNSTEGSTGRGNISPSISDGQSPTARQDSTSSQKSVSHHDYPVNDSSQSNNSSFNSQNMQDISTLSSKKTNASNNHLEAAEDTSEELRAEAKMWEMNARKLMGDLDMLRTEFSDQSKKMAGMEMDLSAAQVERDSLKKEAEQLKLSFEDPIVRQKALEDSMSQVEGIPEIENALKEELKFEKEFNANLSLQLKRSQEANIELVSVLQELEDTIEQQKVEIENLSSLPSKFSDLEKSFQQSIEGNKHLMQQLEQLEESKKNLLIKVQELEGTLEDKMRGAEHAKIQNNKTLSDIEMESESKIYSKDKEILSLKAKLLESIPESYNNAETVSRNLDDADLLREIKVLKQKVQELEMDCNELTEENLELVFKLKEAKKNSKDGGASEDLLSDKLKDQTSTSFGSEVRNNLFRIFHSEDMLQGKKDIKICNDDHFSIQELETSKLALEVRITDLNKELTNKTSVIGNLEANLSGKEKEIGVLQKLLSELEANVYHLEQEKSQLEKHMEALIKENKHELELHILDIEQEKQQLSIRVSVLEAQLRDLTNEQEFRLSELESSRSQAARLQEKITELQSETDSSTEDLKQKLRVAQIHWSEAQEECEYLRGANQKLQITVENLAEECSYFEKLNGDLKQQNLKLEEYCSHMEARLRESDERFAKCSEGVELLEKKFDLKLEDIASKEKHLTSDFDGIFYENRKHMEQAHFLLNQMQMEMMVETQNLELEVEKLSAAYDEKERIASNAMLEVSTLRADKAKLESAFEEAQSKVILAKNEVDMMQSQYEQKLKDLTTQLSKYKIKIEMLMTEHEKLLKLVEDYKSRELKFKSTINALELKLTVTEYERQQVMDESGNLKVQLQQTQQFENEIIALKNELNASNSKKERLEASLRLTSELCEDLKEEKTSSELKILALETAESELEDCKRTRTSLEEKLLLLENDLKARESRCVQDTELSHSKRINRQHQQTIQLLEQEKAEFQTKAQVLEEELKLIKEQRRNQQNPVVKNTNQHRSNRKKSLKNDREIMKDQQDPGYSIKHQSEVETELGLLDENVHAVEVDPLPKTQLLENELAKEKEVKNIYEVQLDRSPSQDRNNQANGPVKSMAEELVTKEKFERTKSMLEAELRDIQERYFHMSLKYAEVEAMREELVMKLKATRKQKGWLS

SEQ ID NO: 192735 - protein, 66 aa, Glycine max
  Coding DNA Sequence Number=SeqID_75957
MSHSRASSSRWTNLNKELEQLLANVPKLTIEEHREWREMENMMQNVAAPPEAFSRPFTPRTRSCSF

SEQ ID NO: 192736 - protein, 163 aa, Glycine max
  Coding DNA Sequence Number=SeqID_75958
  Gene Ontology: Mol. function=oxidoreductase activity, acting on single donors with incorporation of molecular oxygen, incorporation of two atoms of oxygen; Biological process=fatty acid biosynthetic process
  Homolog annotation: Hit_ID=Q43817; Match level="QueryCoverage=53%, HitCoverage=10%, E-value=4e-39, Identity=85%"; Hit description =Lipoxygenase
  Pfam annotation: Domain name=PLAT; Domain location=64-159; Score =111.0; E_value=3.5e-30; Accession=PF01477.13; Description=PLATLH2 domain
MAQSRRHETEEGGRAQKKKKLNSDSYGQVTIWLLYERVKGIFALSPGLLSIPTKNAGRPKQQPFKKYGIGKGKVGKQTFLEGLVTSLPTLGAGQSAFNVHFEWDSDMGIPGAFYIENFKQVEFFLVSLTLEDIPNHGSIHFLCNSWVYNSKKYKSGRIFFANK

SEQ ID NO: 192737 - protein, 118 aa, Glycine max
  Coding DNA Sequence Number=SeqID_75959
MEDQCSFLFTLFAPLWLRSLIFTSKVLDRRVQRKSHTKVELLSPILKPPAEEEKKPQKEEKPKSEEKKLLNKVFTKLLDKVLLELLDRVVKSLNVCNPDTLSLDAVKNPWRCSCSYRV

SEQ ID NO: 192738 - protein, 355 aa, Glycine max
  Coding DNA Sequence Number=SeqID_75960
  Gene Ontology: Mol. function=lipoxygenase activity; Cellular component=cytoplasm; Biological process=electron transport
  Homolog annotation: Hit_ID=Q1S0A0; Match level="QueryCoverage=99%, HitCoverage=65%, E-value=2e-92, Identity=75%"; Hit description =Lipoxygenase
  Pfam annotation: Domain name=Lipoxygenase; Domain location=3-355; Score=384.9; E_value=1.2e-112; Accession=PF00305.9; Description =Lipoxygenase
EKPGPLVKYREEELKTLRGDGTGERKEHERIYDYDVYNDLGDPDSNARLARPVLGGSTTLPYPRRGRTGRKKSRKDESFGHLKSSDFLVYILKSASQNVIPQLQSALSLQFNQPEFNSFYDVRGLDDGGIKLPTNTLSQLSPIPLFKELFRTDGEQALKFPTPKVIQAVEQSAWMTDEEFAREMTAGVNPHIIKRLQFPPKSKLDSQLYGDNTSTITKQHLEPNLGGLTVEQDPASPHGLRLLIKDYPYAADGLEIWAAIKSWVQEYVSFYYKSDAAVAQDAELQAFWKELVEVGHGDKKNEPWRGKMKTRQELIDSCTILIWTASALHAAVNFGQYPYGGYILNRPTLSRRFMP

SEQ ID NO: 192739 - protein, 1224 aa, Glycine max
  Coding DNA Sequence Number=SeqID_75961
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q1SSN5; Match level="QueryCoverage=99%, HitCoverage=99%, E-value=0.0, Identity=83%"; Hit description=ATPase, E1-E2 type
  Pfam annotation: Domain name=Hydrolase; Domain location=418-904; Score=6.2; E_value=0.015; Accession=PF00702.16; Description=haloacid dehalogenase-like hydrolase
MTRGRIRAKLRRSHLYTFGCLKPSTTEEAPHPLQGPGFSRTVYCNQPLLHDKRPLLYCKNDISTTKYNVITFFPKALFEQFRRVANIYFLLAACLSASPISPFSPLSMIAPLAFVVGLSMAKEALEDSRRFVQDVKVNRRKVNRHKGDGIFGPRSWQNIMVGDVVKVNKDQFFPADLLLLSSSYEDGICYVETMNLDGETNLKVKRSLEATMTLDNDEVFKDFTGTIQCEDPNPNLYTFVGNLDYECQIYPLDPSQILLRDSKLRNTDYIYGVAIFTGHDSKVMQNSTKSPSKRSTIEKKMDYIIYTLFTVLILISVISSIGFIFKTKYQAPKWWYLRPDNIEYQYDPNKVGVAGMSHLITALILYGYLIPISLYVSIEVVKVLQATFINQDIQMYDEETGTPADARTSNLNEELGQVDTILSDKTGTLTCNQMDFLKCSIAGTAYGVRSSEIEVAAAKQMASDHEDQESDLSNFPMPKSKARISWDNVRKAEEIELETVVTSKGDEDQKHAIKGFGFEDDRLMNCNWLQEPNADDLLMFFRILAVCHTAIPELNEETGVYTYEAESPDEGAFLVAAREFGFEFCRRTQSSIFIHERFSASRKVVEREYKLLNLLDFTSKRKRMSVIVRDEEGSLFLFCKGADSIIFDRLSKNGKHYLEATTRHLNEYGEAGLRTLALAYRKLDEQEYTAWNNEFQKAKAAVGADRDSMLERVSDMMEKGLILVGATAVEDKLQKGVPQCIDNLAQAGLKIWVLTGDKMETAINIGFACSLLRQGMKQICITTPVSDSVATDVKQGIKDNILNQITNGSQMIKLEKDPHAAFALIIDGKTLTYALEDDMKLLFLGLAVDCASVICCRVSPKQKALVTRLVKQGSGKTTLAIGDGANDVGMIQEADIGVGISGVEGMQAVMASDFAIAQFRYLERLLVVHGHWCYKRIAQMICYFFYKNITFGLTIFYFEAFTGFSGQSVYDDWYMILFNVVLTSLPVISLGVFEQDVPSEVCLQFPALYQQGPKNLFFDWYRILGWMGNGLYSSLIIFLLIVTIFYDQAFRADGQVADMAAVGTTMFTCIIWTVNCQIALTMSHFTWIQHLFVWGSIATWYVFLSLYGMLSPEYSRSAYQILVESLGPAPIYWVTTLLVTVTCNLPYFAHISFQRCFNPMDHHIIQEIKYYKKDIEDQHMWTRERSKARQETKIGFTARVEAKIRQLKGRLQKKQSTLAISAPS

SEQ ID NO: 192740 - protein, 34 aa, Glycine max
  Coding DNA Sequence Number=SeqID_75962
  Homolog annotation: Hit_ID=UPI000034EE1D; Match level="QueryCoverage =98%, HitCoverage=9%, E-value=6e-10, Identity=79%"; Hit description =oxidoreductase, acting on paired donors, with incorporation or reduction of ...
  Homolog annotation: Hit description=molecular oxygen, 2-oxoglutarate as one donor, and incorporation of one atom each of oxygen into both donors
MGEEIRQAMAEEFQEVPPTEYSVFGLAKACSISD

SEQ ID NO: 192741 - protein, 557 aa, Glycine max
  Coding DNA Sequence Number=SeqID_75963
  Gene Ontology: Mol. function=oxidoreductase activity; Cellular component=membrane; Biological process=electron transport
  Homolog annotation: Hit_ID=Q2MJ00; Match level="QueryCoverage=94%, HitCoverage=89%, E-value=0.0, Identity=81%"; Hit description =Cytochrome P450 monooxygenase CYP97C10
  Pfam annotation: Domain name=p450; Domain location=82-552; Score =233.6; E_value=4.3e-67; Accession=PF00067.12; Description=Cytochrome P450
  Subcellular localization annotation: CTP_CleavageSite=74; ConfidenceScore=5.78e-01
MPSSLSLSLTPLSVFPPRRVPTPSPKPYRLSVKSSINKPPDAGTTKPSSWLSPDWLTSLSRSLTAGNDVSGIPVASAKLDDVSDLLGGALFLPLFKWMQDYGPIYRLAAGPRNFVVVSDPAIAKHVLRNYGKYAKGLVAEVSEFLFGSGFAIAEGPLWTARRRAVVPSLHKRYLSVIVDRVFCRCAERLVEKLQPDALNGTAVNMEAKFSQLTLDVIGLSVFNYNFDSLNTDSPVIEAVYTALKEAEARSTDLLPYWKASFFQSYFHDMDFLSLFVMSCVHFKFLCKIIPRQIKAEEAVSVIRKTVEDLIEKCREIVESEGERIDVEEYVNDSDPSILRFLLASREEVSSVQLRDDLLSLLVAGHETTGSVLTWTLYLLSKDSSSLAKAQEEVDRVLQGRRPTYEDIKDLKFLTRCIIESLRLYPHPPVLIRRAQVPDELPGGYKLDAGQDIMISVYNIHRSSEVWDRAEEFVPERFDLDGPVPNETNTDFRFIPFSGGPRKCVGDQFALMEAIVALAIFLQHMNFELVPDQNISMTTGATIHTTNGLYMKLSRRLK

SEQ ID NO: 192742 - protein, 1503 aa, Glycine max
  Coding DNA Sequence Number=SeqID_75964
  Gene Ontology: Mol. function=protein binding; Cellular component =membrane; Biological process=defense response
  Homolog annotation: Hit_ID=Q2HVE0; Match level="QueryCoverage=57%, HitCoverage=92%, E-value=1e-138, Identity=35%"; Hit description =Disease resistance protein; AAA ATPase
  Pfam annotation: Domain name=LRR_1; Domain location=548-569; Score =6.0; E_value=22; Accession=PF00560.23; Description=Leucine Rich Repeat
  Pfam annotation: Domain name=LRR_1; Domain location=571-591; Score =6.4; E_value=18; Accession=PF00560.23; Description=Leucine Rich Repeat
  Pfam annotation: Domain name=LRR_1; Domain location=595-616; Score =2.4; E_value=1e+02; Accession=PF00560.23; Description=Leucine Rich Repeat
  Pfam annotation: Domain name=LRR_1; Domain location=618-637; Score =0.9; E_value=1.9e+02; Accession=PF00560.23; Description=Leucine Rich Repeat
  Pfam annotation: Domain name=LRR_1; Domain location=639-660; Score =7.0; E_value=14; Accession=PF00560.23; Description=Leucine Rich Repeat
  Pfam annotation: Domain name=LRR_1; Domain location=662-683; Score =8.2; E_value=8.5; Accession=PF00560.23; Description=Leucine Rich Repeat
  Pfam annotation: Domain name=LRR_1; Domain location=685-710; Score =6.9; E_value=15; Accession=PF00560.23; Description=Leucine Rich Repeat
  Pfam annotation: Domain name=LRR_1; Domain location=712-734; Score =5.2; E_value=31; Accession=PF00560.23; Description=Leucine Rich Repeat
  Pfam annotation: Domain name=LRR_1; Domain location=736-757; Score =9.2; E_value=5.4; Accession=PF00560.23; Description=Leucine Rich Repeat
  Pfam annotation: Domain name=LRR_1; Domain location=780-801; Score =2.5; E_value=97; Accession=PF00560.23; Description=Leucine Rich Repeat
  Pfam annotation: Domain name=LRR_3; Domain location=525-544; Score =27.1; E_value=6.2e-05; Accession=PF07725.3; Description=Leucine Rich Repeat
  Pfam annotation: Domain name=LRR_3; Domain location=736-755; Score =4.6; E_value=6.9; Accession=PF07725.3; Description=Leucine Rich Repeat
  Pfam annotation: Domain name=LRR_3; Domain location=999-1018; Score =3.8; E_value=8.9; Accession=PF07725.3; Description=Leucine Rich Repeat
  Pfam annotation: Domain name=NACHT; Domain location=173-323; Score= -41.2; E_value=0.094; Accession=PF05729.3; Description=NACHT domain
  Pfam annotation: Domain name=NB-ARC; Domain location=136-426; Score =78.1; E_value=2.7e-20; Accession=PF00931.13; Description=NB-ARC domain
  Pfam annotation: Domain name=TIR; Domain location=11-113; Score=39.0; E_value=1.1e-08; Accession=PF01582.10; Description=TIR domain
  Pfam module annotation: Pfam domain module=LRR_1::LRR_1::LRR_1::LRR _1::LRR_1::LRR_1::LRR_1::LRR_1::LRR_1::LRR_1::LRR_3::LRR_3::LRR _3::NACHT::NB-ARC::TIR; Domain location=548-569::571-591::595 -616::618-637::639-660::...
  Pfam module annotation: Domain location=662-683::685-710::712 -734::736-757::780-801::525-544::736-755::999-1018::173-323::136 -426::11-113
MSSSFLSKFEVFVSYRGADTRTNFTSHLYSALTQKSIKTFIDQQLNRGDYIWPTLAKAIKESHVVLERAGEDTRMQKRDIRNQRKSYEEAFAKHERDTNNRKHVSRWRAALKEAANISPAHTGRPNMDESHVIENVVNDVLQKLHLRYPTELKSLVGTEKICENVELLLKKFRVIGIWGMGGIGKSTIAKFLFAKLFIQYDNVCFVDSSKEYSLDKLFSALLKEEVSTSTVVGSTFDMRRLSNKKVLIVLDGMCNVDNQGRYRLDLLEYLCKEFGDLHHESRLIITTRDKQLLVGKVECIHKVKKLKSPESLELFCLEAFKRKHPHKGYESLSESAVKYADGVPLALKVLGSYLHTKNINFWKCTLEKLSEYPNEKIQNVLKESYTGLDDLEKNIFLDIAFFFKEKKKDHVIRILDACDFAATSGIEVLEDKALITVSNSNIIQMHDLMQKMGLEIVREECKGDPGQRTRLKDKEAREVIEKNKRSSSTYLDLPATLEPFSDKLRYLEWIGYPFESLPSCFCAKLLAEIHMPHSKLKRLWQGMQELDNLEGIELRECKQFEEVPDLSKAPRLKWVNLSCCESLQYLHPSVLSSDTLVTLILDGCTNLKRVKGEKHLKSLEKISVKGCSSLEEFALSSDLIENLDLSNTGIQTLDTSIGRMHKLKWLNLEGLRLGHLLKELSCLTSLQELKLSDSGLVIDKQQLHTLFDGLRSLQILHMKDMSNLVELPDNISGLSQLQELRLDGSNVKRLPESIKILEELQILSVENCKELLCLPTLPSRIKYLGATNCISLVSVSNLNTLATKMLGMTKHITFKNNLNLDGPSLKLIMESLHLTMMSAAFDNVLVRIRGAVNGHNYNSVELCLPGSRVPWKIQDRTTKSSISIELPKRSNFLGFIYWVVLSPAGGMKKHGTKIKCICHLPGKGTKATWLCSDIRGLNSDHVYVWYDPFHCDSILKYYEPKVSFEFCVANENDEAEVDGSICIKECGINLIRVSDVLSVLEELDLDSNKKKDLEKGVKWETERYAEEESNGIRNQIANQQWKMSEHSTSDGIVGIFQEGRNWESDDEESLKTSRKRKGRAKSKSLVTSKKSSDYSTVHPETGFEQESTTTANGSEPTQFEAKFASSSGAKGTIKQPKESHKRMKVKVKIPSPLPSAFEKVDMESVSEPAQEKSQPQEEESILNQETEESYSSSSSEEESKDALRVLYKTSSFDFNQQEKWSNSPNRGKAQNSSESFSSKDQLEVGSSKVVSEYTPMEIDDYLNKLNDDPFALFDFLSSNVSLSSKLSETTIQQSRSTEKVSNILEELRSLAFSQSLLCNIQRVEYREQVEVTLKKLDNYIRDLSESQSKGLNKFNDFYNKVVTICKDKSLNEEKAKKIEAEKKQAFDKLKDYKSKVQKLDDVVATNKGKIETVEKRQRMIQETIKKLQQENEGLNKEKTKLQTANSKQLANKQEILESVKYVSTSLSKAMKHHAELDKERSGLNADFENLKELYKKMKRSPPF

SEQ ID NO: 192743 - protein, 188 aa, Glycine max
  Coding DNA Sequence Number=SeqID_75965
  Gene Ontology: Mol. function=structural molecule activity; Cellular component=coated vesicle membrane; Biological process=intracellular protein transport
  Homolog annotation: Hit_ID=Q9MAZ9; Match level="QueryCoverage=84%, HitCoverage=88%, E-value=8e-75, Identity=91%"; Hit description =Nonclathrin coat protein zeta1-COP
  Pfam annotation: Domain name=Clat_adaptor_s; Domain location=23-162; Score=25.0; E_value=2.6e-09; Accession=PF01217.10; Description =Clathrin adaptor complex small chain
MEEKLLIFVQGIGDKYSAPLTTCVYVVMPRVAVKYYSDDWPTNNAKLAFEKFVFTKTVKTNARTEAEVTLLENNIIIYKFVQDLHFFVTGGEDENELILASVLQGFFDAVTLLLRSNVDKREALENLDLILLCLDEIVDGGMILETNGPLIAEKVTSHSLDADAPLSEQTLTQAWATAREHLTRTLLK

SEQ ID NO: 192744 - protein, 123 aa, Glycine max
  Coding DNA Sequence Number=SeqID_75966
  Homolog annotation: Hit_ID=Q1PEY6; Match level="QueryCoverage=45%, HitCoverage=32%, E-value=8e-07, Identity=42%"; Hit description =Allergen-like
MIGRLFCFLLALQIVSLVSAVRKPFLPAKEEALQSPPPHTIEPKKGLMGIEGTSETMKEAYEGGVSKIGSSPPSCEHKCYGCVPCEAIQVPSTSTRRSHLGIQYANYEPESWKCKCGLSFYSP

SEQ ID NO: 192745 - protein, 101 aa, Glycine max
  Coding DNA Sequence Number=SeqID_75967
MGEVFDFLCWNFGFQKKKVKTPNIFERAKEEIEAVFHRDKSPHHHKETHGTSDDIDEGTSPDEIKAPGVFERVKEEIEAVAEAIHPKKESESGTRDVSSPK

SEQ ID NO: 192746 - protein, 102 aa, Glycine max
  Coding DNA Sequence Number=SeqID_75968
MGGNGAVWGEVNGAARSKARSEVNEAGTRWAEEMILVPILAVPVAKYLSSSPRENIPCLRGLEQDSPFRDPHLWYKLIPLLQSGNQMLITEGQFQVLPYVWV

SEQ ID NO: 192747 - protein, 290 aa, Glycine max
  Coding DNA Sequence Number=SeqID_75969
  Gene Ontology: Mol. function=pyridoxal phosphate binding; Cellular component=mitochondrion; Biological process=electron transport
  Homolog annotation: Hit_ID=Q4BD33; Match level="QueryCoverage=98%, HitCoverage=85%, E-value=1e-51, Identity=42%"; Hit description =MOSC:MOSC, N-terminal beta barrel
  Pfam annotation: Domain name=MOSC; Domain location=147-286; Score =81.1; E_value=3.4e-21; Accession=PF03473.7; Description=MOSC domain
  Pfam annotation: Domain name=MOSC_N; Domain location=2-120; Score =157.7; E_value=3e-44; Accession=PF03476.6; Description=MOSC N -terminal beta barrel domain
  Pfam module annotation: Pfam domain module=MOSC::MOSC_N; Domain location=147-286::2-120
MSARILSLHIYPVKSCAGIDLSESPVDRAGLAHDRRWMLVGADGHFMTQRQWAAMALIRTALTADALRLSAPGMPDLDVPLDGSALQPGVESVGVWKDTLDARRESEAAAQWCSDFLKTPCRLYKVDAGATRPAKPEWVDKWAESHPDLAQTFGGDHFFGFADGFPLLVANQASLDDLNARLRAKGVAPVPMDRFRPNIVVQGEWEAFEEDHTAMITTGAVSMAFVKPCTRCSIPDIDQRTAVQHDEPGRTLAGYRNLEIGVVFGQNAIVDAPAGARLKVGDAVDIELDF

SEQ ID NO: 192748 - protein, 94 aa, Glycine max
  Coding DNA Sequence Number=SeqID_75970
VFTKTYGIDYSETFAPIAYTEEVYMDSPPGSEHRFGTKENDKLIQRKLLQPRYVHCYINMKAARCFVSHLDVTLTSSVGPECAELISIVQRAIS

SEQ ID NO: 192749 - protein, 66 aa, Glycine max
  Coding DNA Sequence Number=SeqID_75971
MAMTPVPVGWGVGAGDWGGNTRPRLAPLPCLLLTHIEPKNVKHTLTSRNWLSVMQLEYEALMKNNT

SEQ ID NO: 192750 - protein, 179 aa, Glycine max
  Coding DNA Sequence Number=SeqID_75972
ENDKLIQRKLLQPRYVHCYINMKAARCFVSHLDVTLTSSVGPECAELISIVQRAISEQCRDILYDICPQYQNFTTEPSSSPTFIFPSIPIINNQPPHQANFSYSSSSQSPQNNQVKTTTDTAFKSNSDIVGQSASIVVSLQSLDTTHTSLLIADNNTAHSPNTTDISSSYTSSFSLSPS

SEQ ID NO: 192751 - protein, 192 aa, Glycine max
  Coding DNA Sequence Number=SeqID_75973
  Gene Ontology: Mol. function=DNA binding; Cellular component=oxygen evolving complex; Biological process=DNA integration
  Homolog annotation: Hit_ID=Q1SD84; Match level="QueryCoverage=95%, HitCoverage=13%, E-value=2e-65, Identity=64%"; Hit description =Integrase, catalytic region
MSMGCLKYLGAQVFTKTYGIDYSETFAPVTNTVRILLSLDANLDWFLHQLDVKNAFLDNGLEEEVYMDSHPGSKHKVGTKLKKQGYSHGQSDHTLFTKFSSKGKFAALIVYVDDIILTRDDEVELARLKKNLAEKFEIKDLGSLRYFLGMEVACSKRGIVVSQQKYILDHLKETGMSGCRPADTPMDLNGKL

SEQ ID NO: 192752 - protein, 130 aa, Glycine max
  Coding DNA Sequence Number=SeqID_75974
MTLHSFSDLQDPLMIRCRCMHVYDQTLNIITNGCCCVQLYLTLMEPLLNMPNGSRISVIHEDPNESLRRPIHGAFELPQALRVIPLDDVRIHRRRQLFIIHDHKQQCSSGEILLHNKRPFIVDRGRTRIK

SEQ ID NO: 192753 - protein, 55 aa, Glycine max
  Coding DNA Sequence Number=SeqID_75975
MEVILKIVITLTTSRRARDSLGLKPNTRGGKQHFSGHCHWKFVVPQLDANIVVGG

SEQ ID NO: 192754 - protein, 332 aa, Glycine max
  Coding DNA Sequence Number=SeqID_75976
  Gene Ontology: Mol. function=transmembrane receptor activity; Cellular component=membrane; Biological process=signal transduction
  Homolog annotation: Hit_ID=Q6D4S3; Match level="QueryCoverage=83%, HitCoverage=47%, E-value=4e-24, Identity=28%"; Hit description =Methyl-accepting chemotaxis protein
  Pfam annotation: Domain name=HAMP; Domain location=237-307; Score =34.7; E_value=3.3e-07; Accession=PF00672.15; Description=HAMP domain
  Pfam annotation: Domain name=TarH; Domain location=94-218; Score =28.2; E_value=2.9e-05; Accession=PF02203.6; Description=Tar ligand binding domain homologue
  Pfam module annotation: Pfam domain module=HAMP::TarH; Domain location=237-307::94-218
  Subcellular localization annotation: CTP_CleavageSite=39; ConfidenceScore=5.07e-01
MCCLPHIARTVTGLSRIKPILRLFFAELFDVSPVCNLPAAAAATSFTLRLPVWLSSLRSQFMLFIVLFCLLQFAGVLLLNQHVNQTQHSLQQASQLRERLALLDKARIELLTASDNSHRAGIYLMQDQQSGSVDSWKSLAAAATTSLQQAQQLFAAYQAKSDSPLAQGFVLLAGGLQEQLKGLAANDINAFFMVPMQAFQQQFNDAWFSEIEQANQQLGSVNQHSLSTLKQSRNLALAIAALLMALLLLAAALLMRGVLLPLRHANAQLAQIATGDLVASPAPTRRQSLETRQLLLSIDTMRQGLQQIVSDITTVATRVAAGADEMQQHNQQ

SEQ ID NO: 192755 - protein, 433 aa, Glycine max
  Coding DNA Sequence Number=SeqID_75977
  Homolog annotation: Hit_ID=Q2HVD0; Match level="QueryCoverage=98%, HitCoverage=99%, E-value=4e-90, Identity=48%"; Hit description=IQ calmodulin-binding region
  Pfam annotation: Domain name=IQ; Domain location=109-129; Score=20.9; E_value=0.0045; Accession=PF00612.17; Description=IQ calmodulin -binding motif
  Pfam annotation: Domain name=IQ; Domain location=87-107; Score=31.4; E_value=3.2e-06; Accession=PF00612.17; Description=IQ calmodulin -binding motif
  Pfam module annotation: Pfam domain module=IQ::IQ; Domain location =109-129::87-107
MGGSGRWLKSLISLRKPSTIDQEKGGDKSKRKWKLWKSTSEGFGIGSSMQKGHGGGGSFVVDDGAFAAALAAVVRTPLKDFMVIKQEWAAIRIQAVFRGFLARRALRALKAVVRLQAIFRGWQVRKQAAVTLRCMQALVRVQARVKARNVGNSQEGKSAGEHCNEADPVKQAEQGWCDIPGTVEEVKEKLQMRQEGAIKRDRTKAYSQSKKKSTERASPNSRAAKSVIPLKNRNLDSKSSGWNMLDLWMAAKPWESRSMVEMYLDSPDMTPVTSKSDHLVLPFNSDQQNGSVKSRSNGVTTRISTNSLTTSQSTPSSSAISSECMHDDSPMSTSCTSGSPSRPSNNNVTVEATEERNACKPSYMNLTASTKAKLKPYRCFSQNAKRIFMDDCVSLSGVTRSSSGFYPSANTWKNLYATPLRTSYQKRYTMEYK

SEQ ID NO: 192756 - protein, 34 aa, Glycine max
  Coding DNA Sequence Number=SeqID_75978
MWCYEWKKIETLRVGRLSLNAVELICARLDERNV

SEQ ID NO: 192757 - protein, 44 aa, Glycine max
  Coding DNA Sequence Number=SeqID_75979
MDIEVPQVVLPGPELLVLEGESIKPDKPLTSNPNVSGFVLGMQK

SEQ ID NO: 192758 - protein, 93 aa, Glycine max
  Coding DNA Sequence Number=SeqID_75980
MPSYFADLVFTGERIEVCLKRGKFDYVSPAGTNNRRIGAVGAKRKEGDAYAVTSAPAWPKPQQASHGHFWWKQPSSLGRAGRAGWQPPPFFPL

SEQ ID NO: 192759 - protein, 78 aa, Glycine max
  Coding DNA Sequence Number=SeqID_75981
MEVEQSNVGGDRVLGVERCGGKRKRRVLESAEKLGHAFQWCTGLFVFDTRRLGMDDALAGFLIACVDPLHAAPLSALC

SEQ ID NO: 192760 - protein, 369 aa, Glycine max
  Coding DNA Sequence Number=SeqID_75982
  Homolog annotation: Hit_ID=Q9M3G7; Match level="QueryCoverage=95%, HitCoverage=9%, E-value=1e-106, Identity=56%"; Hit description =Serine/threonine-protein kinase ATM
MAKVTSRDVQEIVEKLSSDKAKAREEGIKLLNTWLEGERSYNFCKFIGSNTAKLRPDEVPHSETWPFLISLLIKSASAEISSSKRRNPKMIYAKTLRIVVQRAEDAKCSGKMLPLSSVVKPLFNHVWDVLSNVPSFQSEYGIILRHLLSVRDYSFQMRKRIYCNLVFLYIEKVEASLNGKNISNCTSKEEVFRYILTLHSLLKYPPGDYPDNAREDIVKGFVRICSFIREEGKISRKLVECINTYLLNDGPNLGFQLFEIHNAMQQFVFRSWLTTHDRVLKDSLVFYARIQLNLISGAADRCLLVEQLLDVICKDLDQGSMSSTSMLRGDGNKDDKLGALSSSQCGLVELAAVLFYRVVTKNSAADSWI

SEQ ID NO: 192761 - protein, 159 aa, Glycine max
  Coding DNA Sequence Number=SeqID_75983
  Homolog annotation: Hit_ID=Q1SSM9; Match level="QueryCoverage=66%, HitCoverage=25%, E-value=8e-07, Identity=39%"; Hit description =Homeodomain-related
MESLFPFTANPNVILNFHHHTDQLYLPTTPSSIPQGFDHINNDVKLDINNYNANNFLHIQNIPTPEIQYEGPLVEPIVPKVSKSIEDYVCSIPYSSTSQEQHEATTTKFQCYPEDLTVAANQLEYVEAFMSSLPSSTTSSSASSNQIVSNLIIPSGWEP

SEQ ID NO: 192762 - protein, 109 aa, Glycine max
  Coding DNA Sequence Number=SeqID_75984
MAQMYSHIQPNNLFITKVLEYSWLFLCYLFTYANKLSESNRSHRVCCRMVTFSARVLKFTKFDTHVEEKEGLTTNKPSFLLLFLMINEHITKKDKGLTEQKIHGSSFVE

SEQ ID NO: 192763 - protein, 280 aa, Glycine max
  Coding DNA Sequence Number=SeqID_75985
  Homolog annotation: Hit_ID=Q9M3G7; Match level="QueryCoverage=70%, HitCoverage=5%, E-value=5e-72, Identity=68%"; Hit description =Serine/threonine-protein kinase ATM
MEPPTVFETEACCSVHFQHNFLINRVFAIDLFMQCFLSLGNVVHKLSEVDLNWFGRVKLIDCICNLVLLHPQIGQTMIERLLLMLKDMDYRVRLFLARRIGVLFQTWDGHEELFQDICLNFGVQMVVYSKGKVINAMEVLAAGPQPQPIMETVVITLMHLALHSEKIELEAVFMICVVSAIDPYHRELVCAVLDNLSRELQYRTRMKYLEQLLGSILFCWVACGVSLAALVEILNEVKCKVPWFCLMNNVKKPVVNGKGCLCYLYTEHQPARHYILNSSF

SEQ ID NO: 192764 - protein, 162 aa, Glycine max
  Coding DNA Sequence Number=SeqID_75986
  Homolog annotation: Hit_ID=Q1T4T1; Match level="QueryCoverage=84%, HitCoverage=31%, E-value=2e-46, Identity=66%"; Hit description=IMP dehydrogenase/GMP reductase
MVLFIPRAVYALCVGHVPFTRCFKELPLVHNYFDVADAQDDSHKFEEPKHQCLLEFLDCSVEVLTEIEKISKVEASQVKICPHVRVPREISDQLLHEMETSILGALVEEEINERRLPDTFLICSLLSNLLYGSFFTRVRVRHSWNPESGSGMECALVRKFAC

SEQ ID NO: 192765 - protein, 318 aa, Glycine max
  Coding DNA Sequence Number=SeqID_75987
  Gene Ontology: Mol. function=RNA-directed DNA polymerase activity; Cellular component=nucleus; Biological process=RNA-dependent DNA replication
MGFCSKWINWIDGCLKSASIFVLVNGSPSAEFIPQKGLRQADPLVPFLFNIVAEGLIGLMREALHKNQFKTFSIGRNLVDISILQYADDTIFFGEASMENVRAIKVMLRSFELVSGLRINFAKSNFRAIGMSEQWTAKQKKIVWISWGSACLSEEKEGKLVQKGNKMDFGVWVKGEVFGGRDEGRRYSVDGQIPRLYLISNQQNKPIQQMGTLSDTAWEWNLQWRRFLLESETIMGANFLEDLQDLSIDPNHQDQWIWKGDASGRYIVGSAYKLLDSDARDENQDGAFRELWKLKIPAKAAFFAWRLLRDRLPTKNNL

SEQ ID NO: 192766 - protein, 94 aa, Glycine max
  Coding DNA Sequence Number=SeqID_75988
MAWQIFCQPPWAVCEGRPALMLNGVFIWWNFVLPPSAIENTVCCIPNSLTNGDGVVSRVIAVAGSRGGWSLGEWHRASGDKIEREKIISYPTNY

SEQ ID NO: 192767 - protein, 79 aa, Glycine max
  Coding DNA Sequence Number=SeqID_75989
  Homolog annotation: Hit_ID=Q1T4S5; Match level="QueryCoverage=84%, HitCoverage=16%, E-value=3e-21, Identity=82%"; Hit description=IMP dehydrogenase/GMP reductase
MQNLIISFNIVVHGYFLLFLSMKTVPISIGLPSKKPGSEKGTLVLQSSILHFAQISEKERDKLIKRHMSDPRPVQSSSQ

SEQ ID NO: 192768 - protein, 497 aa, Glycine max
  Coding DNA Sequence Number=SeqID_75990
  Gene Ontology: Mol. function=hydrolase activity; Cellular component =membrane; Biological process=intracellular signaling cascade
  Homolog annotation: Hit_ID=Q9SK32; Match level="QueryCoverage=97%, HitCoverage=95%, E-value=1e-137, Identity=52%"; Hit description =Expressed protein
  Pfam annotation: Domain name=DUF1723; Domain location=72-121; Score =83.3; E_value=7.7e-22; Accession=PF08330.1; Description=Protein of unknown function (DUF1723)
MELNEDPGPIDNYVLYDQDNHVSSAVWDGHERGVLRCHEHTSMLDQWKLTPKQIKLVEKAGFGHLRLLPAMSLDNALIAALVERWRRETNSFHLTVGELTITLEDVSLLLGLAIDGEPVIGPISAPSSGCEKLLGRVPEDLNGGMVKLTWLKEFFSECPEDASQEEIERCTRAYLLYLVGSTIFSTTTGNKVPVMYLSLFEDFDKAGKFAWGAGALAFLYRALGNASLKSQSTISGCLTLVQCWCYSRLNVGLPKFNQEPDNNCFPFVLKWKGKSGARTKCNVVSYRKALDSLNPCDVQWLPYKDMDCTAIPEDIKASLILRASRTMLLCFDKAERHLPDRCLRQFAMHQTIPKDVERWERKSRIVDHGVDLMGKMDLALKEWSERWVHVVEGGDIVDEGEYMQWYQKITRKYIGRVTSSLESEYQRTVTAMREIANIADIVSAEGLDSYNRELLDEVKNIVHKCLTEQFEEIPNEKVKKKGNRKRRQKDHLSMEYE

SEQ ID NO: 192769 - protein, 177 aa, Glycine max
  Coding DNA Sequence Number=SeqID_75991
GERETKKDTWGEGEYKMEHPMVLGLRGGDIGGWRNLMESELALASNFMAEVEDLGGEYSVISTYKILSEEGGDWGEAGDDNGVFRRLGKLKVPSKESRCPLCMLEEEDASHLFFKCDRILPMWWECLSWPGVSTVLPQTPNEHFLQHSYCCLEGVVQNRWQTMWVALTWRIWHQGTG

SEQ ID NO: 192770 - protein, 417 aa, Glycine max
  Coding DNA Sequence Number=SeqID_75992
  Gene Ontology: Mol. function=hydrolase activity, hydrolyzing O -glycosyl compounds; Cellular component=apoplast; Biological process =carbohydrate metabolic process
  Homolog annotation: Hit_ID=Q7XA49; Match level="QueryCoverage=94%, HitCoverage=70%, E-value=0.0, Identity=96%"; Hit description=Beta -fructofuranosidase
  Pfam annotation: Domain name=Glyco_hydro_32N; Domain location=45-359; Score=619.8; E_value=2.3e-183; Accession=PF00251.10; Description =Glycosyl hydrolases family 32 N termi
MAMSTILLLTFFSFIYGSAATHHVYRNLQSLSSDSSNQPYRTAYHFQPPKNWINGPLRYAGLYHLFYQYNPKGAVWGNIVWAHSVSKDLVNWTPLDPAIFPSQPSDINGCWSGSTTLLPGNKPVILYTGIDLLNQQVQNLAQPKNLSDPFLREWVKSPKNPLMAPTSANKINSSSFRDPTTAWLGKDGHWRVLVGSKRRTRGIAILYRSKDFVNWVQAKHPLYSILGSGMWECPDFFPVLNNDQLGVDTSVNGYDVRHVLKVSLDDKKHDYYMIGSYNAAKDAFIPDEESNEFVLRYDYGKYYASKTFFDDGKKRRILLGWANESSSVAADIKKGWSGIHTIPRALWLHKSGKQLVQWPVVEVEKLRAYPVNLPPQVLKGGKLLPINGVTATQDHACNNFKKTIYTIILLKIRVKCA

SEQ ID NO: 192771 - protein, 131 aa, Glycine max
  Coding DNA Sequence Number=SeqID_75993
MAKSVEDDVSHFASTGSFTLVDERCGLVCPRLTKGAGNHKSLRINGLVCPRLTKGAGNHKVVCAEDDINLRVSTGLLAAIDKVVCTEDDVNLRVPTGLLAAIDKVVCTEDDVNLRVPTGLLAAIDKVCRDD

SEQ ID NO: 192772 - protein, 92 aa, Glycine max
  Coding DNA Sequence Number=SeqID_75994
MPERGEARGNSVSLRIAGARGRVLSGRCGCSVEPRHGIESSKWAIFGKQNWRCGMNRKLGYGAQLRANLDPTKGVGRLRQQTVGHGSRNPLR

SEQ ID NO: 192773 - protein, 197 aa, Glycine max
  Coding DNA Sequence Number=SeqID_75995
  Gene Ontology: Cellular component=mitochondrion
  Homolog annotation: Hit_ID=Q41658; Match level="QueryCoverage=59%, HitCoverage=79%, E-value=2e-33, Identity=65%"; Hit description=Vicia faba NADH ubiquinone oxidoreductase subunit 5
MALACSIPIAFCARADDGAVPSPSDLLTYTSDMLEDSASSGRSSSTSAVNQPLPGEQAMPPALPVMQEAANRALPYPYQNNEIIGGDSVESIQRRLLGRFPSPSAHEIQMARIEAEDLFEVKVDICQVMAGLHPSGDWMGRGARALDNLRTATGEESLSKLLRMREDLQTAGLQSATFRQLADRVAFRADGDQHSAT

SEQ ID NO: 192774 - protein, 70 aa, Glycine max
  Coding DNA Sequence Number=SeqID_75996
MSKYDTHPRNAPFAENDANKCPRSSRYGFSVNGPSFYPVVNGAKDTKVHQRGKVVQPTCGVVVLETQVHF

SEQ ID NO: 192775 - protein, 56 aa, Glycine max
  Coding DNA Sequence Number=SeqID_75997
MADSTMTDNEVAEAARKKEYVKMKETGGVKRTHLTESRKITRDTDVEHLRDRLRAM

SEQ ID NO: 192776 - protein, 133 aa, Glycine max
  Coding DNA Sequence Number=SeqID_75998
  Gene Ontology: Mol. function=hydrolase activity; Cellular component =cytosol
  Homolog annotation: Hit_ID=Q1SK24; Match level="QueryCoverage=99%, HitCoverage=38%, E-value=5e-31, Identity=54%"; Hit description=Beta -lactamase-like
  Subcellular localization annotation: CTP_CleavageSite=43; ConfidenceScore=5.22e-01
MVVASIRLLPSPLLSFAPRRSPYSYSWRSHPSLTIPFSSIHSKASTKGDGGAVELGGDQTELIFLGTGTSEGVPRVSCLTNPLLKCEVCSKAAQPGNKNRRLNTSILIRHPNSSGTHNNILIDAGKYVSNSPM

SEQ ID NO: 192777 - protein, 161 aa, Glycine max
  Coding DNA Sequence Number=SeqID_75999
  Pfam annotation: Domain name=B3; Domain location=35-152; Score=14.4; E_value=0.0017; Accession=PF02362.12; Description=B3 DNA binding domain
MAGSSNSRKGKSVVEGNKTVKEILFKDELQLEFILNVGIVKDSELSMPYRTKLSNDKWNLFLPVQGFEDILLGFLKEGEDVREAISVTVYDKGGHEFDMMLKKWVKDSNHYYVLNRGWFSFCDQQCLGENDLVALRTFRHAKSDMLSFVVTFKRMSITVNT

SEQ ID NO: 192778 - protein, 208 aa, Glycine max
  Coding DNA Sequence Number=SeqID_76000
  Gene Ontology: Mol. function=serine-type endopeptidase activity
  Homolog annotation: Hit_ID=Q1RW49; Match level="QueryCoverage=82%, HitCoverage=39%, E-value=1e-17, Identity=29%"; Hit description=IMP dehydrogenase/GMP reductase
MQSVAYTAVPLFSIAAVWFSWICITNCTFLCVNRIGCAVLYIGQGSFHHSMTNTLQYVVHQADSTVDKLRNTKTNINNFANTLADKTKENSDNIHDLLDSARLALIIIDVVTLVLTFLGLLFSIFGIQLLVYLMVIAGWVLVIGTLILCGLFLVIHNVTVDSCVAVNEWIQYPTTHTTTWEQWDTLCATYNLEGKVVFPTEGVDSNSA

SEQ ID NO: 192779 - protein, 41 aa, Glycine max
  Coding DNA Sequence Number=SeqID_76001
MYQVETTLARSISDDDRSYAKLIGPESYTKGHESSSAHTKM

SEQ ID NO: 192780 - protein, 606 aa, Glycine max
  Coding DNA Sequence Number=SeqID_76002
  Gene Ontology: Mol. function=transition metal ion binding
  Pfam annotation: Domain name=Transposase_23; Domain location=373-443; Score=-3.3; E_value=0.0026; Accession=PF03017.5; Description =TNP1ENSPM transposase
  Subcellular localization annotation: CTP_CleavageSite=30; ConfidenceScore=5.77e-01
MPSRLLARIMASSPSSPPPPPPSDASTSPSAVKRTRKATRLRSLSTRPPGAERPVIHIDPAIGKANGSHQKKLRTYLGIVARDKVDVTYENWKEVLTAQKDLIWEDIHAGFEILEASNSRTKKKLLQTVGERWRQFKSDLTRKWDLAVDQDGGDDTVCEKYGISKEKWVQFCQTRRDPSWEAQAIQKQNTVPHVLSHGGYEYLEQKLLAEKTKKKLEEAAQSGSVDGVIDPPSPNSFKEQASQGSFIPHGRQDILTATIGRPEHPGHVRAARADATIKQYFGSTPRTSCSSSSLPPEELQQLTQQIRDQLEESITEKLTRQLMASFSQIQSQFQFQMQSQGLTLPPEPLVGPSGPRVSTKESCVDPSGNDPRTSDSDRCSLYIEANPVCLVALGRVYEGSTVVHNTPLLPGQVKVGVEEVKDPDAPIPVPTDEVSLVGLAIHIFLAWPTHLVKPLSHQVTWDATMFGVFNPDFLLCIKHEDLSEIAHGGQCLSISMLQLWILMRAGNSDLYGFLEPQSIQRYEQSQFEAESYIKSWIQSSKHDVYLGVYLNGALKGLVDAPQLKSKAATRWIVVKYFNDPRPLEPERLNALQIQWAQYYLRVRAQS

SEQ ID NO: 192781 - protein, 116 aa, Glycine max
  Coding DNA Sequence Number=SeqID_76003
  Gene Ontology: Mol. function=hydrolase activity
  Homolog annotation: Hit_ID=Q1SK24; Match level="QueryCoverage=98%, HitCoverage=59%, E-value=3e-29, Identity=91%"; Hit description=Beta -lactamase-like
IRTIDAVIITHSHADAIGGLDDLRDWTNNVQPHIPIYVAKRDFEDALRPDRSTSTHFGLQRALEEVRKIQPKRTLFTGMMHLMDHEEVNDSLAKLLESEGLDAQLSYDGLRIPIRL

SEQ ID NO: 192782 - protein, 69 aa, Glycine max
  Coding DNA Sequence Number=SeqID_76004
MTNTVVPKFAGGKYHVERGSKGGEVTRRRKEGKGFWMEREGRRVLFREKRGGGTARGGKEEGRGRGEKF

SEQ ID NO: 192783 - protein, 88 aa, Glycine max
  Coding DNA Sequence Number=SeqID_76005
MMNKTRPCNAYFYLEAKSINIFVPLEIEESTPVKNLDGCIGCGTLKITFQRPTHFDIASNNFKVQTFNMYKLSELKGRIWTGRISQDH

SEQ ID NO: 192784 - protein, 420 aa, Glycine max
  Coding DNA Sequence Number=SeqID_76006
  Gene Ontology: Mol. function=aminopeptidase I activity; Cellular component=vacuole; Biological process=proteolysis
  Homolog annotation: Hit_ID=Q1SM19; Match level="QueryCoverage=44%, HitCoverage=43%, E-value=5e-64, Identity=62%"; Hit description =Peptidase M18, aminopeptidase I
  Pfam annotation: Domain name=Peptidase_M18; Domain location=1-321; Score=-138.8; E_value=2.4e-09; Accession=PF02127.6; Description =Aminopeptidase I zinc metalloprotease (M18)
MVQHLFDGWVTGACQLFDDTGWVADATFVRSFDKRLCSCAIRSKNLAHAQPNPHEMLQHHPAFHDSAFPKKKLGKRDLSVAGRVILRIGHNSYVLKLLKVDRPMLRIPTLTIHLDRTGNQDDFKPNLETHLLHLLSMEPEGTSLEFNSKEKNSALPSKAHHHRVLICLGGGNNEFIFSGRLDNQASSYCALRALVDSRESPGDLAKVGSGFVQGAGAPTMFQAMRRILANNYVGEGSFVRTICQSFIVSVDKAHGVHPNFMDKHVGDIPSVYRWEMTNRVVHAATRGGNLKILEELLPIALMFWLLEMLMDLLFYMQLLAEGKLRGQLPIAEALVLAFPLVLTFPSLISIRNISGETFLHKAVSGFNSYAFRRLNKHFELLRNMLRGKNFHVADNINVKNNDGRTALHMAIISNIQLPHQ

SEQ ID NO: 192785 - protein, 193 aa, Glycine max
  Coding DNA Sequence Number=SeqID_76007
MASRKRKVPASASQACYDRSRFTSQEAWDRYSDIVIGRKILPERNVMIYHTEFDEFKAELERRNWHKELTNFVDESIDVAIVKEFYTNLYDPEDKSPKQMRVRSHLIKFDEDALNTFLKTHVIIEEGGNLPAYSRFSRLRPDPQELAARLCIPGRGFELNVDGLPLKILRKNLTTLAQTWSVLSFSNLTPTSH

SEQ ID NO: 192786 - protein, 54 aa, Glycine max
  Coding DNA Sequence Number=SeqID_76008
MKVECKKGASNRVGNKKKKVYLWMSALLESKLLHPRKTMNCLQLSLNTSLRKSF

SEQ ID NO: 192787 - protein, 67 aa, Glycine max
  Coding DNA Sequence Number=SeqID_76009
LFNLIILESKLVAYYSFLAQQIGVMSVDLELWVRPCIRVEKFTSQNDFGLWRLKMSPSGIAGFGGGS

SEQ ID NO: 192788 - protein, 101 aa, Glycine max
  Coding DNA Sequence Number=SeqID_76010
  Gene Ontology: Mol. function=protein-tyrosine kinase activity; Cellular component=integral to membrane; Biological process=protein amino acid phosphorylation
  Homolog annotation: Hit_ID=Q9M1L7; Match level="QueryCoverage=65%, HitCoverage=12%, E-value=5e-09, Identity=45%"; Hit description =Receptor protein kinase-like protein
MTTTAMTTSVTLASEYAATSTKLKPDDIILAKVNATIENELANKYDVQGGGVAVNDEKGMFGLSDLMRAAMEVLGNGSFGFSYKVVMANGVEVVVKRTRER

SEQ ID NO: 192789 - protein, 143 aa, Glycine max
  Coding DNA Sequence Number=SeqID_76011
MDKGRDGDNGQAKMVSSIRDTQTYDADFVLSTSLGFLLRLLCAKLEFSRLARWFFFSARRAKVVLLLLREQDSNLRVEDESRRRRKKWEKGLTAEAFGRPVRGSSGSFGRSYSGNFPEEVFFRKLPNFFRKSPGTPLLDTFRK

SEQ ID NO: 192790 - protein, 1077 aa, Glycine max
  Coding DNA Sequence Number=SeqID_76012
  Gene Ontology: Mol. function=cAMP-dependent protein kinase regulator activity; Cellular component=protein serine/threonine phosphatase complex; Biological process=protein amino acid dephosphorylation
  Homolog annotation: Hit_ID=Q6K3D4; Match level="QueryCoverage=96%, HitCoverage=95%, E-value=0.0, Identity=60%"; Hit description =Putative PKG-Ib
  Pfam annotation: Domain name=PP2C; Domain location=100-376; Score =110.0; E_value=6.9e-30; Accession=PF00481.12; Description=Protein phosphatase 2C
  Pfam annotation: Domain name=Pkinase; Domain location=773-1019; Score= 66.0; E_value=1.2e-16; Accession=PF00069.15; Description=Protein kinase domain
  Pfam annotation: Domain name=Pkinase_Tyr; Domain location=765-1005; Score=-170.4; E_value=0.051; Accession=PF07714.7; Description =Protein tyrosine kinase
  Pfam annotation: Domain name=cNMP_binding; Domain location=517-593; Score=10.0; E_value=0.036; Accession=PF00027.19; Description=Cyclic nucleotide-binding domain
  Pfam annotation: Domain name=cNMP_binding; Domain location=624-733; Score=42.6; E_value=1.3e-09; Accession=PF00027.19; Description =Cyclic nucleotide-binding domain
  Pfam module annotation: Pfam domain module=PP2C::Pkinase::Pkinase _Tyr::cNMP_binding::cNMP_binding; Domain location=100-376::773 -1019::765-1005::517-593::624-733
MGCIYSRVCIGDNCRGSSINGDPIARNDVAEVVNFSPSSSDVEEGEIRDQLNQLSITRDSEAGIRRLARVSAQFLPPDGSRIVNVPSGNFELRYSFLSQRGYYPDALDKANQDSFCIHTPFGTSPNDHFFGVFDGHGEFGAQCSQFVKRKLCENLLRNSKFRADPVEACHAAFLATNSQLHNDVLDDSMSGTTAITVLVRGRTIYVANSGDSRAVIAERRGKEVVAVDLSIDQTPFRSDELERVKMCGARVLTMDQIEGLKNPDVQCWGTEEGDDGDPPRLWVPNGMYPGTAFTRSIGDSIAETIGVVANPEIVVFELTQDHPFFVLASDGVFEFLSSQTVVEMVVKFKDPRDACAAIVAESYRLWLQYETRTDDITVIIVHSAVGQSASYGDVLRNPVPQVVEVTGSESPSTFGWSARNHRVRHDLSRARLRALENSLENGQSWVPPSSAHRKTWEEEYKVLNLVSPIGKFNNCEPLMALHLHMPQAHIEQALHDHFLFRKLTDSQCHVLLDCMQRVEVQPGDIIVKQNCDNSYTLQGGEGDCFYVVGSGEFEVLATQEEKDGEASVRAVTKGTLWALKREDFRGILMSEFSNLSSLKLLRSVDLLSRLSILQLSQISDSLSEVSFSNGQTIIDKNEVLALYIIQKGRVKITFDSDLLTGPNAYSLKPEIQNEDDAQSGKELSIEKPEGSYFGEWALLGENIGSLSAVAVGDVVCALLTKDKFESVIGSLQKISQEDHKSRDYSKELTTNYDFSSLDKVQLSDLEWRKTLYSTDCSEIGLANLRDSESLLTLKRFSKPKVKGLGKESQVLKEKILIKGMGSSACIPQVLCTCADRMYAGILLNTRLACPLSSILSSPFSESAAQFCAASVVIALEDLHKNGVLYRGVSPDVLMLEQTGHIQLVDFRFGKQLSGERTFTICGMADSLAPEIVLGKGHGFPADWWALGVLIYYMLRGEMPFGSWRENELDTVAKIAKRKLHLPETFSPEAVDLISKLLEVEESTRLGSQGPDSVKSHPWFNCIEWEGIRHHTFPVPQEIISRITQYLEVHSEDCSTGYLGSPLQEVKELNVPEWLEDW

SEQ ID NO: 192791 - protein, 426 aa, Glycine max
  Coding DNA Sequence Number=SeqID_76013
  Gene Ontology: Mol. function=metal ion binding; Cellular component =integral to membrane; Biological process=ubiquitin cycle
  Homolog annotation: Hit_ID=Q5XF85; Match level="QueryCoverage=96%, HitCoverage=96%, E-value=2e-91, Identity=48%"; Hit description=RING -H2 finger protein ATL4J precursor
  Pfam annotation: Domain name=C1_4; Domain location=113-157; Score= -12.9; E_value=0.098; Accession=PF07975.2; Description=TFIIH C1-like domain
  Pfam annotation: Domain name=zf-C3HC4; Domain location=114-155; Score= 37.3; E_value=5.3e-08; Accession=PF00097.15; Description=Zinc finger, C3HC4 type (RING finger)
  Pfam module annotation: Pfam domain module=C1_4::zf-C3HC4; Domain location=113-157::114-155
  Subcellular localization annotation: CTP_CleavageSite=81; ConfidenceScore=5.08e-01
MNQLCGVILLVHSVLCFHARAQTAAPSGDAVSNFQPSLAVVIGILGVMFLLTFFLLMYAKFCQRCASSPVGDTENQLPFVRSRSRFSGIDKNVIESLPFFRFSSLKGSKEGLECAVCLSKFEDVEILRLLPKCKHAFHIDCIDHWLEKHSSCPICRHRVNPEDHTTFTYSNSLRRLANQSEVGEESNIEIFVQREEEHHGSSRFSFGSSFRKTGKYVKEEEFLIEKGAEDSDGNQKGYHKHNHRITISDVVFKHRWSNVSSSDLMFLNSEMLNDASSNRFSNLESNADMMSSTRGVVENEQIMNIKEEMERKISFESKVGVLNNIKSVSDKHLLFTSDSAGKSTHAPKYANPGEKRSMSEITAVSRFGDLGMKMRVFKDSSSLQNNLKEERMRQIWFPIARRTAQWFVNRERRSQQSQNKQQPLDV

SEQ ID NO: 192792 - protein, 491 aa, Glycine max
  Coding DNA Sequence Number=SeqID_76014
  Homolog annotation: Hit_ID=Q9SFV5; Match level="QueryCoverage=10%, HitCoverage=5%, E-value=4e-08, Identity=41%"; Hit description =Putative RNA-binding protein
  Pfam annotation: Domain name=DUF1675; Domain location=321-465; Score=- 52.1; E_value=0.00055; Accession=PF07897.2; Description=Protein of unknown function (DUF1675)
MEDESGLELSLGLSFGGSSAKPKGKNGSSSDTRAEEVGRGGKMVDDFKSMFDNVPQKPESITGTRRTDSPKPEENFFSDLSKAKEDNASLNLNGRGFLVANSNKPVEIEEDKRSEAANKRKMPFDEIRDQKKHDSDVHADLHDRARASHISITEEGSTAENEDVADSETENSTSRPISHHSDGSKGFIRVSASSDAAKEIRGSADSNATDFSGQKRFTGSSEKDFKHANMTYGASFSVQPVNTMNVPYPSVKESSSVGAPSPQIPGVMHVMPTATGEHLGAQSVSNGNLPVMFGYSPVQLPMLEKDNSWGLVSRPQQLHPSFVGRGPINSVISNNISEAMPYEGRPLERTKGDGKQRVNEEGSSSQPEDVKARSTNLRAKDVSGQSTGEGAIIDFSNIKPGLAADVKFGGCGSYPNLPWVSTSGSGPNGRTISGVTYKYSTNQVRIVCACHGSHMTPEEFVRHANEDQAAAEGNAVLGTVANGNPAASSHS

SEQ ID NO: 192793 - protein, 148 aa, Glycine max
  Coding DNA Sequence Number=SeqID_76015
  Subcellular localization annotation: CTP_CleavageSite=63; ConfidenceScore=5.03e-01
MDHGRENSKVPFVEQEQYTLPYFPYPFFSLFTPNNHTLFTTFSSMFSTMEFNDLNNSNCFTPSVDSSGYCDVLGEHSCAKSDTYSSNEEGDDASDDEVMSLDELQFDGKTKEKIELLAAMVGVDTTDPAIVLNEVVRVLKVLKSINPY

SEQ ID NO: 192794 - protein, 187 aa, Glycine max
  Coding DNA Sequence Number=SeqID_76016
MEILLESLESSIIEVQMVINSELHKRIQIGLTVFDPEEAEATCIVLSLIFGCPELFLTEGTTSKNEKDKSNPKYPNNKYAFIPLPTHLLEDTMLSHGFALFLRTTHFTIPIIPRPLEIHIALKVICLTMTTKVILGFQGLWRQNSLSSALAHSAKTAGLHLRETMIDPKSPGPSPNNAMARCSSCLA

SEQ ID NO: 192795 - protein, 160 aa, Glycine max
  Coding DNA Sequence Number=SeqID_76017
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=72%, HitCoverage=7%, E-value=4e-13, Identity=36%"; Hit description=Chromo
  Pfam annotation: Domain name=Chromo; Domain location=49-103; Score =47.3; E_value=5.2e-11; Accession=PF00385.14; Description='chromo' (CHRromatin Organisation MOdifier
GAVSYKLKLREGSRIHAVFHISQLKKAIGNYSAEPQLPEGLEVEPEDLEEPEEVLASRSVTEGGQRVRQWLVRWKGRTIEDTTWEDESVLKSQFPSFSLEDKTVASGGGNDRTTAGPSINERPNPAERPNPAVWRVYVRRSKKVGNHSVSDVAMGIREYP

SEQ ID NO: 192796 - protein, 195 aa, Glycine max
  Coding DNA Sequence Number=SeqID_76018
  Homolog annotation: Hit_ID=Q1SK18; Match level="QueryCoverage=48%, HitCoverage=48%, E-value=2e-42, Identity=91%"; Hit description =Spectrin repeat
  Subcellular localization annotation: CTP_CleavageSite=22; ConfidenceScore=5.25e-01
MDHYGSSGGSWTMIPTHNSSIQSQSQSNQDPNLFLQQQQQQFLQSQPFQQALPPQSPFQQHHHLYQQQQQQQQQQRLLPQPQQQQQQQQQQQQPQNLHQSLASHYHLLHLVENLAEVIEHGTPDQQSDALINELSNHFEKCQQLLNSISDSISTKAMTVEGQKKKLEESEQLLNQRRDLIANYRKSVEDLVRSEP

SEQ ID NO: 192797 - protein, 966 aa, Glycine max
  Coding DNA Sequence Number=SeqID_76019
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=95%, HitCoverage=60%, E-value=0.0, Identity=47%"; Hit description=Chromo
  Pfam annotation: Domain name=RVP_2; Domain location=51-143; Score= -58.4; E_value=0.035; Accession=PF08284.2; Description=Retroviral aspartyl protease
  Pfam annotation: Domain name=RnaseH; Domain location=525-644; Score= -12.1; E_value=0.00077; Accession=PF00075.14; Description=RNase H
  Pfam annotation: Domain name=rve; Domain location=761-917; Score =107.5; E_value=3.8e-29; Accession=PF00665.16; Description=Integrase core domain
  Pfam module annotation: Pfam domain module=RVP_2::RVT_1::RnaseH::rve; Domain location=51-143::265-434::525-644::761-917
MINEEGEVIAIEVKEDEEEVLDCNSMGLCGITESKTTLSNNPPTTLRLKGSLNGISIVVLIDSGASHNFVSPHVATALGLNVEHGRSMGVKLGDGHRVTTKGRCRNMEVHLDMILGVAWLQRFGKVTFDWEKMTISFVWEGERVELQGQFFTTQDVSTNNTVHTSMDSLHSLLEAEMVPAVNKDTPELIGAQKQELDELLSKFKGVFEEHKGLPPEREINHTIELQKEAGPVSVRPYRYPHHHKGEIERQVRDMLSQGIIRNSSSAFSSPVILVKKKDDSWRMCIDYRELNKVTVPDRYPIPVVDELLDELHGTKYFSKLDLKSGYHQIRVKEEDVQKTAFRTHEGHYEFLVMPFGLTNASATFQSIMNQIFKPHLRKFVLVFFDDILVYSKSWQEHLAHLSQVLEVLQHHCFVVNQKKCSFASRKVEYLGHVISEQGVAVDPAKINSILEWPIPHNVKGVRGFLGLTGYYRKFIVGYGKIAKPLTELTKKDGFHWGPEEQKAFENLKSVMIQAPVLTLPDFTQPFEIECDASGRGIGAVLMQKKKPIAYFSKALSKNNLSKSAYEKELMALVLAVQHWRPYLLGRRFVVYSDQKSLRHLLQQRITTADQQNWIAKLLGYHFEVVYKPGPENKAADALSRIHEEVELKGITSFPICLQEQQIQHEVRNDPYLQKVVTDLQQNPTSQPGFQLIKGRLFYHNRLVLSSSSDCIPLMLKEFHSSATGGHSGFLRTYRRIAGNLYWVGMRKSVQKFVQSCDPLPIPERIWDDISMDFITGLPKSKGYEAIFVVVDRLSKYGHFIPLKHPYTARKVAEIFTKEVVRLHGMPQSIVSDRDPLFVSLFWKELFRLQGTVLSMSSSYHPETDGQTEVVNRCLEAYLRCFASEQPKEWSRWISWAELWYNTTFHVSTGTTPFETMYGRKPPTVVRFLQGETKVEAVATDLIDRDEALRQLKYQLIRAQEQMKRYA

SEQ ID NO: 192798 - protein, 265 aa, Glycine max
  Coding DNA Sequence Number=SeqID_76020
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=2e-38, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
HVLAIRGLHALNFGGLHVLAIKGLHALSFRGLHVLAIGRLHALTFRGLHVLVIRGLHVLAYSGLHVLAIRELYALTFRGQHVLAIRGLHDLTFRGLHILAIRGLHALTFRGLHVLAIRGLHALIFKGLHVLAIEGLHALTFRGLHVLAIRGLHVLAFRGLHVLAIRGLHTLTFRGLHVLTIRGLHALNFGGLLVLTIGGLQALSFRGLHVLACRGLHVLTIRGLHLLVFRGLHVLAYRVLHVLAFRGLHVLAIRGLHALTFRGLH

SEQ ID NO: 192799 - protein, 92 aa, Glycine max
  Coding DNA Sequence Number=SeqID_76021
  Homolog annotation: Hit_ID=Q1S5Y9; Match level="QueryCoverage=40%, HitCoverage=6%, E-value=2e-09, Identity=78%"; Hit description =Tetratricopeptide-like helical
MFNTHTSSAYCSHRPPFPIAGYANCEDMKAAKELYDVMNDKNEVTWVAMIAGYAMLVCHAQSRYANDVNLSRSGSFDTGYGGLDDATSGEGR

SEQ ID NO: 192800 - protein, 55 aa, Glycine max
  Coding DNA Sequence Number=SeqID_76022
MDTSEPYTGAMKGIMHKPQITIGTSKPYTGATRGTVHEPQANLGADQKFSPIDVF

SEQ ID NO: 192801 - protein, 501 aa, Glycine max
  Coding DNA Sequence Number=SeqID_76023
  Gene Ontology: Mol. function=protein serine/threonine kinase activity; Cellular component=integral to membrane; Biological process=protein amino acid phosphorylation
  Homolog annotation: Hit_ID=Q8LPB4; Match level="QueryCoverage=98%, HitCoverage=63%, E-value=2e-65, Identity=30%"; Hit description =Phytosulfokine receptor precursor
  Pfam annotation: Domain name=LRRNT_2; Domain location=122-160; Score =35.1; E_value=2.4e-07; Accession=PF08263.3; Description=Leucine rich repeat N-terminal domain
  Pfam annotation: Domain name=LRR_1; Domain location=163-185; Score =7.1; E_value=13; Accession=PF00560.23; Description=Leucine Rich Repeat
  Pfam annotation: Domain name=LRR_1; Domain location=187-209; Score =15.7; E_value=0.17; Accession=PF00560.23; Description=Leucine Rich Repeat
  Pfam annotation: Domain name=LRR_1; Domain location=211-234; Score =10.2; E_value=3.5; Accession=PF00560.23; Description=Leucine Rich Repeat
  Pfam annotation: Domain name=LRR_1; Domain location=256-278; Score =13.4; E_value=0.8; Accession=PF00560.23; Description=Leucine Rich Repeat
  Pfam annotation: Domain name=LRR_1; Domain location=280-302; Score =13.4; E_value=0.8; Accession=PF00560.23; Description=Leucine Rich Repeat
  Pfam annotation: Domain name=LRR_1; Domain location=30-54; Score=2.0; E_value=1.2e+02; Accession=PF00560.23; Description=Leucine Rich Repeat
  Pfam annotation: Domain name=LRR_1; Domain location=304-326; Score =8.0; E_value=9; Accession=PF00560.23; Description=Leucine Rich Repeat
  Pfam annotation: Domain name=LRR_1; Domain location=328-349; Score =4.6; E_value=39; Accession=PF00560.23; Description=Leucine Rich Repeat
  Pfam annotation: Domain name=LRR_1; Domain location=378-400; Score =9.9; E_value=4; Accession=PF00560.23; Description=Leucine Rich Repeat
  Pfam annotation: Domain name=LRR_1; Domain location=402-424; Score =15.8; E_value=0.15; Accession=PF00560.23; Description=Leucine Rich Repeat
  Pfam annotation: Domain name=LRR_1; Domain location=426-448; Score =18.2; E_value=0.03; Accession=PF00560.23; Description=Leucine Rich Repeat
  Pfam annotation: Domain name=LRR_1; Domain location=6-28; Score=12.8; E_value=1.2; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1; Domain location=122-160::163-185::187-209::211-234::256-278::280 -302::30-54::...
  Pfam module annotation: Domain location=304-326::328-349::378 -400::402-424::426-448::6-28
LSGMAMMEILDLSHNKLFGEIPQSLTELSFLSSFDVSYNELHREIPEKGQFDTFPLTSFEGNRGLYRCSASGFMPSPPDETPAQPHHQKLQIIDFPFWFGSLAGILITIGMYFASGWNFTSSPNDLKALIGFSRCLESAIPDWNSSTSSDYCTWSGVTCVGTRVVRLELGSTQLTGKICESLACLDQLRVLKLSKNLFTGSLPHSLFHLPNLEIMDFSNNQFEGSIDTTMCSSFTQLRVFKLSSNYFSESIFLLQNLNELYLQDNKLSRPLSEGVGKLSNLLEFDISNNEFSGILPNIFGGLTRLKVFYAGSNRFTGPLPASLVNSVSLQMLNLKINSLAATLEVLSHCKNLSTLVLTNNFHNEEMPQAQGQNLEFSNLKVFVLANSQIKGSIPKWLSGCKMLQMLDLSWNHLSGGIPPWIGKLNNLYYLDLSNNSFTGRIPQSFTMFLSLQPNNSSLEGTLFAFPFDTVETGTLKRMKYEKLSNLRPSLLLSYKGFILNE

SEQ ID NO: 192802 - protein, 325 aa, Glycine max
  Coding DNA Sequence Number=SeqID_76024
  Homolog annotation: Hit_ID=Q9LRW1; Match level="QueryCoverage=34%, HitCoverage=41%, E-value=2e-44, Identity=77%"; Hit description =Putative LOB domain-containing protein 22
  Pfam annotation: Domain name=DUF260; Domain location=43-143; Score =170.8; E_value=3.5e-48; Accession=PF03195.5; Description=Protein of unknown function DUF260
  Subcellular localization annotation: CTP_CleavageSite=44; ConfidenceScore=5.51e-01
MQPKSHTPFFVPPQKAMNNNDPNNNYTNNRISTPRNGNSATQACAACKYQRRKCAPDCILAPYFPHDRQRQFLNAHKLFGVSNITKIIKLLSPQDKDQAMRTIIYQSDMRATDPVGGCYRYILELQAQIEYYRAELELVLQQLAIFRAQAQHQHQQQHGIFAANNVNVAVNGDGEVLNGDPMGLYNQQQHYQCLQAQQEEEQYVMMHENGNGSQNIDGIALQEQIKTWAVQNTAVSLSSLSLHGQNSNVSDEYDHKPVVGIDMDSDERSELGFESEELVHRSDEAVLFKIDDAVIKAEANPCMQQAQDHDLKGAATSFTLTNCSC

SEQ ID NO: 192803 - protein, 412 aa, Glycine max
  Coding DNA Sequence Number=SeqID_76025
  Gene Ontology: Mol. function=DNA binding; Cellular component=nuclear pore; Biological process=DNA integration
  Homolog annotation: Hit_ID=Q1RSG2; Match level="QueryCoverage=90%, HitCoverage=39%, E-value=2e-65, Identity=42%"; Hit description =Integrase, catalytic region; Zinc finger, CCHC-type
MSNYKVTGIDQTEDPTIHFALFSDCDPTTLDSAVKEEKWRKAMDDEIDAIKRNDTWELNDLLKGHKTIGVKWVFKTKLKENGEVDKYKARLGPRDTSKNMGSIIQKNSAVAPRCQICILAWILGGTEFKKSMMDEFEMFDLDVMHYFLGIEVVKARDGIFISQKKYIGEILDKFQMKDYNPANTPTEFGLKLNKDHEGKKVDNTFYKQIVGKRIICYLQGTRNFGIFYRKGGKSILFGFSDSDYAGDQGDSTSVFMFGTSAISWSSKKQSIVTLSSTEAEFVVATTCTCQAIWQRRILEELKFKQPETTTVFCDNSSTIKLSKNPVPHGRNKHIGVRFYFLRDLTNERVIDLKFCRSDEQLADMFTKSLKISFFQNLRRLIKDVMEAYISIMAHGCHTSIYPSIKPKRDVIP

SEQ ID NO: 192804 - protein, 789 aa, Glycine max
  Coding DNA Sequence Number=SeqID_76026
  Gene Ontology: Mol. function=hydrolase activity, acting on glycosyl bonds; Cellular component=lysosome; Biological process=carbohydrate metabolic process
  Homolog annotation: Hit_ID=Q9FFX7; Match level="QueryCoverage=98%, HitCoverage=96%, E-value=1e-173, Identity=60%"; Hit description =Alpha-mannosidase
  Pfam annotation: Domain name=Alpha-mann_mid; Domain location=246-302; Score=29.8; E_value=6.6e-08; Accession=PF09261.1; Description=Alpha mannosidase, middle domain
  Pfam annotation: Domain name=Glyco_hydro_38; Domain location=15-314; Score=352.3; E_value=8.2e-103; Accession=PF01074.12; Description =Glycosyl hydrolases family 38
  Pfam annotation: Domain name=Glyco_hydro_38C; Domain location=324 -775; Score=294.1; E_value=2.6e-85; Accession=PF07748.3; Description =Glycosyl hydrolases family 38 C-termi
  Pfam module annotation: Pfam domain module=Alpha-mann_mid::Glyco _hydro_38::Glyco_hydro_38C; Domain location=246-302::15-314::324-775
MVYNTSQGIVPGKLNVHLVAHTHDDVGWLKTVDQYYVGSNNSIQGACVQNVLDSMVHALLADKNRKFIYVEMAFFKRWWRDQSEAVQDVVKKLVSSGQLEFINGAMAMHDEAVTHYIDMIDQTALGHQFLKEEFGVTPRIGWQIDPFGHSAVQAYLLGAEVGFDSFFFGRIDYQDRAKRKKEKSLEVIWQGSKSLGPSAQIFAGAFPENYEPPSGFYFEVNDASPIVQDNMQLFDYNVQDRVNDFVAAALLQAARQLEFFRGRVNSGPNTDSLADALAIAQHHDAVTGTEKQHVANDYSKRLSIGYKEAEELVSSSLACLVESPLLTRCQNPVTKFQQVIEANVRVHDSNGIEIESQLLPQAEKYVDLRNYYVKAYLGQTPPKAPKYWLAFTVSVPPLGFSTYTVSTAKRTGSTRSSVDIYKSSEKSKFDVGQGNLKLTFSMDQEKCTNYVNIRNLVEEQVELSYLYYSGYNGTNQKDPQVGPIPIEDGIGKEVATRISTTMETNNMFYTDSNGRDFIKRIRDYRTDWDLEVNQPAAGNYYPINLGIYTEDNKTEFSVLVDRAIGGSSLQDGQIELMVHRRLLLDDSRGVDEALNETDCVGDDCRGLTVQGKFYYRIDPLGEGAKWRRTFGQEIYSPLLLAFAEKDDKDDWMNSRVLTFSGIDSSYALPDNIAIITLQELDDGTVLLRLAHLYEIEEDKDLSVIATVELKKLLPGRKEVKEMSLSANQERTEMEKKRLAWKVEGSSGSKQVSRGGPVDPKELNVELAPMEIRTFILDFDDVSNQLFDAL

SEQ ID NO: 192805 - protein, 139 aa, Glycine max
  Coding DNA Sequence Number=SeqID_76027
  Subcellular localization annotation: CTP_CleavageSite=23; ConfidenceScore=5.43e-01
MENSLSVLVWINSKVLTLMRSLSAYTFSRTTPLLKKWSTQRYPPPLSTLSTSSSRNSITVNGIHRFMACSHRTKSTTSSNNGNHCCSSTSPRSMTTSLFDAATFMVMVTTVTLRSLIAAVKEPVPPPTSRPSTHGRERQ

SEQ ID NO: 192806 - protein, 148 aa, Glycine max
  Coding DNA Sequence Number=SeqID_76028
MPLRGRIASSGQVFITVAVSLAKPPPKPDPEVDDPLYLMTLTIPGLFLRPYQVRWDATVFGVFNPDFRLYIKHEDLSEIAHGGQCLSISVLQLWILHLTETCMRAGNSDIYGFLEPQSIQRSGQSQFESESSTAADTGRWWSSCPRNT

SEQ ID NO: 192807 - protein, 297 aa, Glycine max
  Coding DNA Sequence Number=SeqID_76029
  Homolog annotation: Hit_ID=Q1SX88; Match level="QueryCoverage=71%, HitCoverage=91%, E-value=7e-18, Identity=24%"; Hit description=Heavy metal transport/detoxification protein; Harpin-induced 1
  Subcellular localization annotation: CTP_CleavageSite=24; ConfidenceScore=5.36e-01
MASTCSAIVACASSSLSVAKKRILAATSQAIFMLLSVETTWKPLTSSWLCSQRTTHLLVDLKPHIHLARRILSRRRRRFLIVGERYGDAVAQNLDPDSRRLEHAHLGLHLGLQLHLQRHQLTLPLHAPLQLHRGVTIHHFLSASNISLEHGGVPLAVEEGGDGGAGDGGVAVEKGYGGRVVGEDDFVVRGGDGECGSLGTVEKVEDGAGGTDEEEEEEEDQEEPAAEGGGTSATTAAAVVLRLGAVGGAVGAGKLGFRSGECRLGAGVGGGFGRRLKDGVIDTQVLVMGERRLHGVG

SEQ ID NO: 192808 - protein, 230 aa, Glycine max
  Coding DNA Sequence Number=SeqID_76030
  Gene Ontology: Mol. function=unfolded protein binding; Cellular component=mitochondrion; Biological process=cellular protein metabolic process
  Homolog annotation: Hit_ID=Q1SK06; Match level="QueryCoverage=92%, HitCoverage=40%, E-value=1e-89, Identity=73%"; Hit description=GroEL- like chaperone, ATPase
MYRLARRVGSSIASPSAKNLVYGGVLSSRNFVSKDINFGVGARAAILHGVTEVADAVKVTMGPKGRNVIIERSRGNPRITKDGVTVAKSTTCATVLTQAILTEGCKSIAAGVNVMDLRHGINKAVDAVITELKRRALMISTSEEITQVGTISANGERDIGELIARAMEKVGKEGVITVVDGNTLDNKLEVVEGMKLTRGYISPYFITDQKTQKCVSADYSFVSNMYSIRS

SEQ ID NO: 192809 - protein, 564 aa, Glycine max
  Coding DNA Sequence Number=SeqID_76031
  Gene Ontology: Mol. function=oxidoreductase activity, acting on CH-OH group of donors; Cellular component=membrane; Biological process =alcohol metabolic process
  Homolog annotation: Hit_ID=Q9S746; Match level="QueryCoverage=95%, HitCoverage=90%, E-value=0.0, Identity=67%"; Hit description=Protein HOTHEAD precursor
  Pfam annotation: Domain name=GMC_oxred_C; Domain location=394-549; Score=93.1; E_value=8.2e-25; Accession=PF05199.4; Description=GMC oxidoreductase
  Pfam annotation: Domain name=GMC_oxred_N; Domain location=30-322; Score=65.2; E_value=2.1e-16; Accession=PF00732.10; Description=GMC oxidoreductase
  Pfam module annotation: Pfam domain module=GMC_oxred_C::GMC_oxred_N; Domain location=394-549::30-322
HWHENRYPGIRNASSFSSPSISTTTGNNAYDYIIVGGGTAGCPLAATLSQNFSVLVLERGGVPFTNPNVSFLENFHITLADISPTSASQYFISTDGVYNSRARVLGGGSSINAGFYTRANPRFIKKVGWDAKLVNQSYPWVEKQIVHRPKFSPYQRAFRDSLLDSGVSPFNGFTYDHLYGTKVGGTIFDRFGRRHTAAELLASGNQDKLTVLVYATVQKIVFDTRGNAIVTGKKPKAVGVIFQDEHGKQHEAILSNDRHSEVIMSSGAIGTPQLLMLSGIGPKAELQKLNIPVVLDNPFVGKGMVDNPMNTMFIPSNRPVHQSLIETVGITKMGVYIEASSGFSQSNDSIHCHHGIMSAELSTIPPKKRSPEAVQEFIKNKKDLPVELFKGGFILSKVANPWSVGELRLNNTNVNDNPVVTFNYFSHPYDLHRCVKGIRLAIKVAQSKHFTNYTLCDKKTSEELLNLTVKANVNFITKHPNDTASIAQFCKDTVITIWHYHGGCHLGKVVSPDYKVLGVDRLRVVDGSTFDESPGTNPQATVMMMGRYMGLKILRDRLGKLAGI

SEQ ID NO: 192810 - protein, 240 aa, Glycine max
  Coding DNA Sequence Number=SeqID_76032
MEDSFRVRAERAFGSLPIPSSSLNTLWSLTEDEINNSPSNRTPKPKPKPYPSSSSRVQLQKGLHDLDDDDDDDDEEEEEPRGVSKPPDYDDEQWQIRAGIGRDCTLDYEEEEDQYDKQAIGKENSGDQILSETRVQIIWRPRIRLKQDDEAAAKKIDALHVSEKSAPDIGGGSGSDVINPKSILKSKDNLSEARDVRKRVRFDSECDDSGNDDDGLEGRTRDVRMKTSSMEEATASDQLS

SEQ ID NO: 192811 - protein, 316 aa, Glycine max
  Coding DNA Sequence Number=SeqID_76033
  Gene Ontology: Mol. function=nucleic acid binding; Biological process= DNA integration
  Homolog annotation: Hit_ID=Q1S4N1; Match level="QueryCoverage=52%, HitCoverage=17%, E-value=6e-32, Identity=40%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MDSKNGVLSRGTGFMESCGRLYPLPKNPTIAQIKNHKERKTKAKARSFSSQAAKCDKYKNFDGSGSSSKSTNAKGNWKKCYPPCQYYSKKGHPSFRCCRRPDAKYNECNQMGHEAVICRNKNKLHGEVARDIDQEEEYLFAATCFSSLESSQNQLIDSGGNNHMTNNKDPFKELSISCTLKNKSCLIDVGDKDILKVKMKGKSIALNSLEEEQIAFSVKENLTSWNVVAKARLAAAKGQEKSTLEKVAIVQKHTNKKTQLREKAAKIEHNEKCLKFLTKNLKAENVKAQSHEKEAIVFQHQQVKVLRKKIGVRSLQ

SEQ ID NO: 192812 - protein, 75 aa, Glycine max
  Coding DNA Sequence Number=SeqID_76034
MGVRIGKAERNRESGEQSFHHHHKKCRNQIDDEENGKSVPISVGLETIVEKCGKGRSKERKAISDSHETQGHYYC

SEQ ID NO: 192813 - protein, 653 aa, Glycine max
  Coding DNA Sequence Number=SeqID_76035
  Gene Ontology: Mol. function=transmembrane receptor activity; Cellular component=integral to membrane; Biological process=defense response to bacterium
  Homolog annotation: Hit_ID=Q9LIC2; Match level="QueryCoverage=99%, HitCoverage=100%, E-value=0.0, Identity=80%"; Hit description =Multispanning membrane protein-like
  Pfam annotation: Domain name=Cytochrom_B_C; Domain location=488-569; Score=-14.2; E_value=0.028; Accession=PF00032.8; Description =Cytochrome b(C-terminal)b6petD
  Pfam annotation: Domain name=EMP70; Domain location=70-611; Score =1105.0; E_value=0; Accession=PF02990.7; Description=Endomembrane protein 70
  Pfam annotation: Domain name=MFS_1; Domain location=298-636; Score= -54.1; E_value=0.094; Accession=PF07690.6; Description=Major Facilitator Superfamily
  Pfam module annotation: Pfam domain module=Cytochrom_B_C::EMP70::MFS _1; Domain location=488-569::70-611::298-636
MKKKMMASTAISVVFAALFLFSSVHSFYLPGVAPRDFQINEDIELLFHVWHQGDPLSVKVNKLSSTKTQLPYDYYFLKYCKPKKILNNAENLGEVLRGDRIENSVYTFHMRKEQSCTVVCHEILDAESAKSFKEKIDDEYRVNMILDNLPVAVHRQRRDGSQSTTYEHGFRVGFKGNYQGSKEEKYFINNHLSFRVMYHKDPETGSARIVGFEVTPNSINHEYKEWNDKNPQVTTCNKDTKNLMQGSTVPQEVDTNKDIVFTYDVSFKESDIKWASRWDTYLLMNDDQIHWFSIINSLMIVLFLSGMVAMIMMRTLYRDIANYNQLETQDEAQEETGWKLVHGDIFRPPVNSNLLCVYVGTGVQIFAMTLVTMIFALLGFLSPSNRGGLMTAMVLLWVFMGLFAGYSSARLYKMFKGTEWKRNTLKTAFMFPGILFAVFFVLNALIWGEQSSGAVPFGTMFALVCLWFGISVPLVFVGSYLGFKKPAIEDPVKTNKIPRQVPEQAWYMKPVFSILIGGILPFGAVFIELFFILTSIWLNQFYYIFGFLFIVFVILLITCAEITIVLCYFQLCSEDYNWWWRSYLTAGSSALYLFLYSIFYFFTKLEISKLVSGILYFGYMIIVSYAFFVLTGTIGFYACFWFVRKIYSSVKID

SEQ ID NO: 192814 - protein, 77 aa, Glycine max
  Coding DNA Sequence Number=SeqID_76036
  Homolog annotation: Hit_ID=Q0KIN0; Match level="QueryCoverage=62%, HitCoverage=2%, E-value=1e-11, Identity=67%"; Hit description =Integrase core domain containing protein
MAAMRRWPLYQLDIKKAFLHGDLAKEVYMGQHPELVAQRESSGFVCNIQDDIVVTIDDHRGIQDLKIICLGTFRLRI

SEQ ID NO: 192815 - protein, 79 aa, Glycine max
  Coding DNA Sequence Number=SeqID_76037
MRNGVEEAGHTHHANTFTSAAHGGRLHFGFNDNNDCRDNIHSHMELLRLSRGRGSQSHEREREQRGSEVEGTIQKGDTQ

SEQ ID NO: 192816 - protein, 154 aa, Glycine max
  Coding DNA Sequence Number=SeqID_76038
  Homolog annotation: Hit_ID=Q9SLW7; Match level="QueryCoverage=30%, HitCoverage=21%, E-value=5e-13, Identity=72%"; Hit description=TMV response-related gene product
  Pfam annotation: Domain name=DUF716; Domain location=74-154; Score= -27.7; E_value=0.018; Accession=PF04819.3; Description=Family of unknown function (DUF716)
  Subcellular localization annotation: CTP_CleavageSite=52; ConfidenceScore=5.43e-01
MVHSDQCSRNPSSSQTKKTKTLFLISLLLFSSFFIINSALSLFDAHNSNDAVGAALQLQVLPIAFVFLFYSLLPLLSLSFTLPSPLLTLIGAFAFAKEFLLFYLQRKDPSGVENHYYNLLLVSIAVCVFGTVLELGSPRSDGIARLGLKVTSFI

SEQ ID NO: 192817 - protein, 139 aa, Glycine max
  Coding DNA Sequence Number=SeqID_76039
MIHFNIQDNEEPFIELNKVDRRHGKRPLPSDHASRERREGFNFSVNQSPPKSQGGEASQFSFMHPINTGDDSTLSSPIPQYGQISNSCLIETQDPSLQPLNQGKIARAFDRRLQEDWARDARKGARVLMSLRVDFRLMG

SEQ ID NO: 192818 - protein, 53 aa, Glycine max
  Coding DNA Sequence Number=SeqID_76040
MTHSHSESVIIARVQRNTRAEILALGGYSRESERAERPRAKIERFSKRVWDRD

SEQ ID NO: 192819 - protein, 417 aa, Glycine max
  Coding DNA Sequence Number=SeqID_76041
  Gene Ontology: Mol. function=hydrolase activity, acting on glycosyl bonds; Cellular component=beta-galactosidase complex; Biological process=carbohydrate metabolic process
  Homolog annotation: Hit_ID=Q93X58; Match level="QueryCoverage=99%, HitCoverage=49%, E-value=0.0, Identity=85%"; Hit description=Beta -galactosidase
  Pfam annotation: Domain name=Glyco_hydro_35; Domain location=31-337; Score=649.3; E_value=3.1e-192; Accession=PF01301.10; Description =Glycosyl hydrolases family 35
  Pfam annotation: Domain name=Glyco_hydro_42; Domain location=53-394; Score=-236.8; E_value=0.0079; Accession=PF02449.6; Description=Beta -galactosidase
  Pfam module annotation: Pfam domain module=Glyco_hydro_35::Glyco _hydro_42; Domain location=31-337::53-394
MWNVPLLLVVVVFACSLIGHASASVSYDHKAITINGQRRILLSGSIHYPRSTPEMWPDLIQKAKEGGLDVIQTYVFWNGHEPSPGKYYFGGNYDLVRFIKLVQQAGLYVNLRIGPYVCAEWNFGGFPVWLKYIPGISFRTDNGPFKFQMEKFTKKIVDMMKAERLFESQGGPIILSQIENEYGPMEYEIGAPGRAYTQWAAHMAVGLGTGVPWIMCKQEDAPDPIINTCNGFYCDYFSPNKAYKPKMWTEAWTGWFTEFGGAVPHRPAEDLAFSIARFIQKGGSFVNYYMYHGGTNFGRTAGGPFIATSYDYDAPLDEYGLPRQPKWGHLKDLHRAIKLCEPALVSGDPTVQQLGNYEEAHVFRSKSGACAAFLANYNPQSYATVAFGNQRYNLPPWSISILPNCKHTVYNTARVRQ

SEQ ID NO: 192820 - protein, 110 aa, Glycine max
  Coding DNA Sequence Number=SeqID_76042
MGKAEEVPEKMKADMEAMKEQMALIMEAMMSMRKIMEANAVTIAATSTVAKVNPMPPSSLNQINHPTLAMVGKDLGSTNGPMMCKFKTSTPSCHMAYLPTYTSQCGVHSQ

SEQ ID NO: 192821 - protein, 139 aa, Glycine max
  Coding DNA Sequence Number=SeqID_76043
  Homolog annotation: Hit_ID=Q1SKD7; Match level="QueryCoverage=97%, HitCoverage=36%, E-value=9e-14, Identity=32%"; Hit description =Ankyrin
MAPKKLSAKRSRKDATAEGTSAAPEFDSHRFRSAEHQQRFEAIKGWSFHRERRVQLRDDEYTDFQEEIARRCWTSLVTPMAKFDPDVVLEFYVNAWPTEEGVRNMRSWVRSQWIPFDVDALSQFLGDPLVLEEGQECEY

SEQ ID NO: 192822 - protein, 53 aa, Glycine max
  Coding DNA Sequence Number=SeqID_76044
MENNQRTAIMRFNCGSGSKSTTFSTQTICFKCDRKAIFREIAYIPRRSRMVGV

SEQ ID NO: 192823 - protein, 48 aa, Glycine max
  Coding DNA Sequence Number=SeqID_76045
MTIRSVNMHSSSSFQILPHAQPRSVALSGCLPKPEDWLSERFCLSSSK

SEQ ID NO: 192824 - protein, 160 aa, Glycine max
  Coding DNA Sequence Number=SeqID_76046
MWAFLIDRQFDWAHLVKYHRHKALRTKAPLPYPQLVTLFLRHFQIPLDDEPFVQVKRSLAIGAGVVTSFGYRKYIDGQWIRKQDLPPSIPDERTPSPPPQRDASSTLMNEVLSELRGLRAFVGDRLDAMDAHFEGMGTRITQLEDDMGFIRRCFDPPAAP

SEQ ID NO: 192825 - protein, 73 aa, Glycine max
  Coding DNA Sequence Number=SeqID_76047
MEDALVTHPRVLFAPPAGEQVVTVGNFTGDLRNIFFYAHMTPTARTHIEILGPIPSSMRAIRSGGQSMVMLGL

SEQ ID NO: 192826 - protein, 212 aa, Glycine max
  Coding DNA Sequence Number=SeqID_76048
MTSIAQSRTSRLEFPALITTLCRARGVVSNSLTFECLSPVINLAYIRKNCWNPEDLTVSIRGTRRARARPTELPSTSTTPTPASTSAAPSVPAQTDSQRFKAMLQRIHQGQIILLQSLLVVVPPGSIPSDESSKATIPEPIVIGEEVGETQVRQVAAATPERSLEATSEPLAPVEDLPSPQHATDPSTPILEITEDPTTPVLTLDTFPPATP

SEQ ID NO: 192827 - protein, 48 aa, Glycine max
  Coding DNA Sequence Number=SeqID_76049
MADFSSLKRKQTPVANHYSQHNTKLKQSLKAVAKQGTRLECITECYTK

SEQ ID NO: 192828 - protein, 183 aa, Glycine max
  Coding DNA Sequence Number=SeqID_76050
  Gene Ontology: Mol. function=helicase activity; Biological process =protein amino acid phosphorylation
  Homolog annotation: Hit_ID=Q1SN45; Match level="QueryCoverage=100%, HitCoverage=10%, E-value=4e-34, Identity=42%"; Hit description=AAA ATPase
MADDIIFNHRKQGIRLTEKETIHLCLTEIENMLQANRRSLRDFLSIPYPIGYARNQHHNNLIHNEMAYDKEMLAKQYNTAYQLLTDEQKTIVDTIMSVVNTQSAAIYFLYGYGGTGKTFVWTTLSSGIRSNGGIVCTISSSGIASLLLPVGQTAHSKFAIPVPATKNSTCNIHQARELAELLK

SEQ ID NO: 192829 - protein, 244 aa, Glycine max
  Coding DNA Sequence Number=SeqID_76051
  Gene Ontology: Mol. function=transferase activity, transferring glycosyl groups; Biological process=nucleoside metabolic process
  Homolog annotation: Hit_ID=Q7W6Q8; Match level="QueryCoverage=49%, HitCoverage=57%, E-value=7e-57, Identity=88%"; Hit description =Putative transferase
  Pfam annotation: Domain name=Pribosyltran; Domain location=131-244; Score=21.3; E_value=8.6e-05; Accession=PF00156.17; Description =Phosphoribosyl transferase domain
DGLETIQLGVGYRVNGEFPRRAAVRRACRGASPAGAGRTAGLERIHRRHHRVRQAARGRPSLPGARGRSLRRADRPSVDRSRPQRNHCAASSPEGLTSGYHSQGRRRSPTGGGLFVFSRRRSLPMSAPTSDDSHLWVTWDDYNRLIERLALQVHQSGWEFDKILCLARGGMRVGDVMSRIFDVPLGILATSSYREAAGTKQGDMDIAQFITITRGTLSGRVLLVDDMVDTGKTFMKVYDHLKSQ

SEQ ID NO: 192830 - protein, 106 aa, Glycine max
  Coding DNA Sequence Number=SeqID_76052
MGGSEPVDAQRLTSSSTPLAEIPYGHPHLSSIEANKFDGIRMMLSSGDIQAQQRTRFFSAGRGRSCSIARGNVVGANSNHAHLGIPGGSNRRRCLLVEATQLAWAS

SEQ ID NO: 192831 - protein, 141 aa, Glycine max
  Coding DNA Sequence Number=SeqID_76053
MAKFDPDIVLEFYANAWPTEEDMRSWVRGQWIPFDADTLSLFLGDPLVLEEGQECEFRFCPDRCRETGADLVAWSGIYNTWFTSRRPTIGGRCRYMSVSTSSASVSRTRVSLLLRALLQISSGLRLHGPEIGLRPRQGRRP

SEQ ID NO: 192832 - protein, 278 aa, Glycine max
  Coding DNA Sequence Number=SeqID_76054
  Gene Ontology: Mol. function=glutamate N-acetyltransferase activity; Biological process=arginine biosynthetic process
  Homolog annotation: Hit_ID=Q7WP92; Match level="QueryCoverage=99%, HitCoverage=35%, E-value=1e-79, Identity=50%"; Hit description =Hypothetical protein vrgS
  Pfam annotation: Domain name=DUF586; Domain location=173-251; Score =180.0; E_value=5.9e-51; Accession=PF04524.3; Description=Protein of unknown function, DUF586
IPYHQTASGGITTEERIGQWALEDSVTPGIYSLDDYDFRKPNAWLFQARQNPASPSPGSIDVYDWPGRFVDHGHGEFYARIRQERWQVEHQQIQASATAVGIAPGATFTLTNAPFFSDNGEYLTTAADYLFEENSYASGGNSDISHQIHFRVIPSSVVYRPAQVTDWPRTYGPQTAKVVGPEGESIWTDRYGRIKVKFHWDRHAKGDDTSSCWVRVSSAWAGQGFGGVQIPRVGDEVVIDFINGDPDRPIVTGRVYNEASMPPWDLPGDATRMGFMTR

SEQ ID NO: 192833 - protein, 79 aa, Glycine max
  Coding DNA Sequence Number=SeqID_76055
MKLPKFLLADNSEFPEDLFVVHTEYPRFILNVEEEEVEWLDDLEGDDEETMADEATKVVEAAFKWCDEELAKYDEEEEE

SEQ ID NO: 192834 - protein, 95 aa, Glycine max
  Coding DNA Sequence Number=SeqID_76056
MESNAATAAAVILATEADPTLLTAVHPPFPNMVEREKSTHGHVSNPHSGYNRGTYPYGLPPNYTPPVMHDDVGHVPPLILEGEPPRHPDEVHNDI

SEQ ID NO: 192835 - protein, 323 aa, Glycine max
  Coding DNA Sequence Number=SeqID_76057
MASKKRKAPATPSQAWERYTDIVVPRKILIERNVVIYHTKFDDFKEELETRNWHEELTSFAEGNIDVAIVKVRGHLVKFDQDTLNTFLKTPMIIGEGETLSAYSRFTLLRPDPRELAAKLCIPGRGFELNADGLTLKILRKNLTTIAQTWSMLSFSNLVPTSHTSDITLDRAKLIYGIIQRMDMNVGYLISHQICMIAQHDSSRLGFPALITALCKVRGVTSNSKTLESLSPAINLAYVKKNCWNLDDLTVTFRGPRKAKGKKSETLSSFEVPPTTSTPSTSAPTFSTLATSASSPAQLPVLAPSSSEPSDFSFTPEMLHVMI

SEQ ID NO: 192836 - protein, 99 aa, Glycine max
  Coding DNA Sequence Number=SeqID_76058
MENWRTALRNNFAGLQSRRWRMHEQRQAMTFMGLRKKVENGELWRMEDWRTALRNNFAGLQTRWWRMHEQRQAMTFMGLRKKWRMENWRTALRNNFAGL

SEQ ID NO: 192837 - protein, 131 aa, Glycine max
  Coding DNA Sequence Number=SeqID_76059
MMAHQNPPYLAFCTPGQNETKNKIQGYQRETNKNIHIFLNEHPGMKGMAFEKQHFIQHACSELQNKERETRLKRAIKGINSRTHQQESSQGYCASNQWGKTHQMIIMMDGSNSNKGKIITFKLSFQNYHDM

SEQ ID NO: 192838 - protein, 119 aa, Glycine max
  Coding DNA Sequence Number=SeqID_76060
  Pfam annotation: Domain name=Transposase_23; Domain location=5-70; Score=-17.3; E_value=0.089; Accession=PF03017.5; Description =TNP1ENSPM transposase
TDPDTGDSDKCKLYIEENPPCLVALGRVYEGSTVVHNIPLLHDQVKVGVEEVKDADAPISIPTDKGIVGPAKPADRLDPKVMWDVSLFGLFNLDFPLYIKHEDLSEITHDGQCLNISVI

SEQ ID NO: 192839 - protein, 57 aa, Glycine max
  Coding DNA Sequence Number=SeqID_76061
MATKKLPAKRSRKDATEEGSSAAPQEDMDFDRHRFRSVEHQHWFEAIKGWSFLRERR

SEQ ID NO: 192840 - protein, 106 aa, Glycine max
  Coding DNA Sequence Number=SeqID_76062
SILSVEQFIEKVSWPGTLLSTVGEGVEMRPEGATFSEPIVPAIHETIEADPPTPVHERPIDLPTPIMEMPEDPTTPVLRQSSTPPATPVLHLTDKEDMQDQDTQGT

SEQ ID NO: 192841 - protein, 263 aa, Glycine max
  Coding DNA Sequence Number=SeqID_76063
  Gene Ontology: Mol. function=hydrolase activity
  Homolog annotation: Hit_ID=Q7X477; Match level="QueryCoverage=99%, HitCoverage=99%, E-value=1e-133, Identity=82%"; Hit description=AhlK
  Pfam annotation: Domain name=Lactamase_B; Domain location=34-247; Score=64.0; E_value=4.8e-16; Accession=PF00753.17; Description =Metallo-beta-lactamase superfamily
MSDIKLFMFQSGTQQCKYQHIRMNQGAGERYEIPVPWFLLTHPEGFTLIDGGLAVAGLKNPAAYWGKGIEQFKPVMSEEQGCLEQLKRLGIAPEKIRYVVLSHLHADHTGAIGHFPHATHVVQKREFEYALDPDWFTSDAYCRHDYDRPELNWLFLNGLPEDNYDLYGDGTIKCVFTPGHSPGHQSFLISLPSGKHFMLAIDAAYTLDHYHERALPGLMTSATDVAQSVRKLRQLTERYNATFIPGHDPEEWGKIRLAPAWYS

SEQ ID NO: 192842 - protein, 54 aa, Glycine max
  Coding DNA Sequence Number=SeqID_76064
MGGVVTLLDIPGGGNRVEYLYLGACHLVWNSLETQADNWGGGVACARQGDLDTY

SEQ ID NO: 192843 - protein, 127 aa, Glycine max
  Coding DNA Sequence Number=SeqID_76065
MLLPSAVHVSSIIKHEASGDWETRYSVVFLIGSFAKYVRKKEGVETRVVITERAGRTKSVSYLCFPLISDERRGWAFSPWVKVYGELGFWLKACRTAGHDICQSVGLASGLGIKGMSHIISMTHMQQ

SEQ ID NO: 192844 - protein, 59 aa, Glycine max
  Coding DNA Sequence Number=SeqID_76066
NHLGTSTCHLTSWVWMTKTVCTDNRLGISVCHRTRRLGMTKVADNHTAPPHVIELVVSR

SEQ ID NO: 192845 - protein, 207 aa, Glycine max
  Coding DNA Sequence Number=SeqID_76067
  Homolog annotation: Hit_ID=Q7W0T9; Match level="QueryCoverage=98%, HitCoverage=31%, E-value=7e-15, Identity=31%"; Hit description =Putative exported protein
MVDEVLAVGQAGDGVPMDFALQRFDSCVLFLHRRGDLPLRVDQGLVRQFAGAAGRTAVRRLHACPVVDLPGGARFDPAQQVGGEQHPEDGRGQRQADDPHAALPQRVARQPGVGLDRDRAEPAAVGRLIGPGGRWRFHRQPAVAPVARQVQPVGRGLAPLDLGVPVFSRDPHHGVCASREEVIGQPGLVLVVGRVVRQGPGQGARTG

SEQ ID NO: 192846 - protein, 67 aa, Glycine max
  Coding DNA Sequence Number=SeqID_76068
MGNPVLKSSRPAPSPRSICFNKNHTGELATYPFNDFGTGRSQTGMCIIDIGDLSIEKIHRPETKRKK

SEQ ID NO: 192847 - protein, 87 aa, Glycine max
  Coding DNA Sequence Number=SeqID_76069
MQVKHVGPRTHELRSQCILRLNWEARAVWSVKDRSNDHNLLMSESFFWFTQKNRTEVTSGERKKKHITETTPQQEFAWSPFRASPKP

SEQ ID NO: 192848 - protein, 273 aa, Glycine max
  Coding DNA Sequence Number=SeqID_76070
  Homolog annotation: Hit_ID=Q1SKD7; Match level="QueryCoverage=81%, HitCoverage=57%, E-value=4e-09, Identity=24%"; Hit description =Ankyrin
MASQKRESIASSSSQLKYDRYKFSSPKAWDRYTNNMFGRKIIPERKVQLSFNDFEEFQGELNRRNWHKKIANLEEGSIDVALVKKFYTNVYDHEDKSPKQVKVRGQWIPFDSAAVNSFLETPVVIEEGESLPTYARFVLLRPNQQELAACLCIPGKGFELNSDGLPLKILRKNLTTFAQTWSVFSFSNLAPTSHTSDINLDRAKLVYALIQKMDMNLGSFISSQITLRAQHDSSRLGFPTLITALCKARGVRSDFLTLESLSPAINLAYIKKN

SEQ ID NO: 192849 - protein, 151 aa, Glycine max
  Coding DNA Sequence Number=SeqID_76071
MAPGSFLEKLSREASLRSFLVRLLREASLRGLFGKLEWCEEWSLKSRFPQLYQMPENKLSRVRDMGRWAQMIDGSRLLIVLISSQLYLEDSGHEIQQLYIKIGRCFVGKKGTQMKYLVWYATCWCIWITGNSVIFRNKCFLAMEMLTHIKI

SEQ ID NO: 192850 - protein, 83 aa, Glycine max
  Coding DNA Sequence Number=SeqID_76072
MVALKYAQDEEAADDQEETGWKYIHGDVFRFPKYKFFFSAALGSVQSLCLCNVIFTRNNIIYSDISNSVSFHIVLGLKDMVNG

SEQ ID NO: 192851 - protein, 438 aa, Glycine max
  Coding DNA Sequence Number=SeqID_76073
  Gene Ontology: Mol. function=nucleic acid binding; Cellular component= intracellular; Biological process=DNA integration
  Homolog annotation: Hit_ID=Q1RSG2; Match level="QueryCoverage=99%, HitCoverage=64%, E-value=1e-85, Identity=45%"; Hit description =Integrase, catalytic region; Zinc finger, CCHC-type
  Pfam annotation: Domain name=rve; Domain location=155-310; Score =37.7; E_value=3.9e-08; Accession=PF00665.16; Description=Integrase core domain
  Pfam module annotation: Pfam domain module=RVT_2::rve; Domain location=382-438::155-310
MGLTEGVDDIARRRDQLALLQIQQGGVEKAQKSKLQYLRIEYERGCPDNKVVDKILRTMPMKYDNVKIGKVSEEALKIQMNVVESTQGAEAKSRGNFDNGERGYLRRRDRGNYRSRGCKNFNQGRDNNFGAFNEGRGAGNFGAANQGRGQGNNYQGQTSHNLLSMEQLSEKGFNMKIHQGYCTLIDKNGRFIIKQKSEACDAFNVLVEKQNGCRIKVLRTDKGQEYLTCITFLDQHGIQHQLATRYMLQQNGVAERKNRTIMDMVRCMSKAMEMPKELWAEAKLDDKGEKCIFIGYNTESKVYKLYNLETKKVIISRDVAFNEKGMKDWSSKNPQLSARLQDYVMFNDKDTSNEEIINFTLFADCDPVIFEEASSDENWRKAMDDEIRAIEKNDTLKWVYKTKYNPKGEIDRFKARMVMKGYKQKPGIGYFKVFALVP

SEQ ID NO: 192852 - protein, 140 aa, Glycine max
  Coding DNA Sequence Number=SeqID_76074
MVACHDFLQLTHAREIKPLTQHSPLNKGTVVKENNLNEVPISKPSSEKKEDSIVTPKNGVASFGNSGAAYTNAFRPTTPGNSPGVGHRKFALEDKDMKATTKVVVESSDVKVYVTEGTTTNGFKPTNPGHSPGVGHDHQN

SEQ ID NO: 192853 - protein, 155 aa, Glycine max
  Coding DNA Sequence Number=SeqID_76075
  Gene Ontology: Mol. function=RNA-directed DNA polymerase activity; Biological process=RNA-dependent DNA replication
MEKPDYGFKGIAFKHLCLEDSLSLISPFTEVEVKDAFWSCDGDKGPGPYGFNFNFFNVLASRLKKVLPQVISMSQTAFLLGRNILDGVVMLNELVNFASSLTKEFEAQRGLKQGDPLAPFLFIIVVEALIGLMNKAMELGRFRGFQVTKGLIFPY

SEQ ID NO: 192854 - protein, 150 aa, Glycine max
  Coding DNA Sequence Number=SeqID_76076
MGCTHGPEIYPKAHKNPRAFSCISGPIYLEFSIQCPCGVGLHQSVSKGENERSRHQRLFEENVRKTKKKSLNLEKMDSGVVYGRQGCCPCSYESSGAMKNSNLPSSLCLKQKMAFGTKEACPGELMLHPEVTGSPRRAGSFSPKQFGGPG

SEQ ID NO: 192855 - protein, 85 aa, Glycine max
  Coding DNA Sequence Number=SeqID_76077
AKHASTVKRNFNATEESGRASISRSCAKREISALSAAVVFCRAQRTTDTKLKSTYSAQNSTAHHNAYFGKRALEAARGTTFAKIP

SEQ ID NO: 192856 - protein, 162 aa, Glycine max
  Coding DNA Sequence Number=SeqID_76078
  Gene Ontology: Mol. function=nucleic acid binding; Biological process= DNA integration
MVSIMEDTVKVDNIPIHLLSSLKGVVLVLNTQCQGSYTRIVETGNARFIENGETSESEASQNVEIKEVRVQVPLTSASTSRIFVPYTVEPHNNQEEQQINDHEVNNEPIVEQSQEMVLRRSQRERRYAISNDYVIYLQESENELSIGNDPISFSKAINGDDS

SEQ ID NO: 192857 - protein, 162 aa, Glycine max
  Coding DNA Sequence Number=SeqID_76079
METFRVSQVIQNYVGGGPDDKQRPSLVILHPRYAEIPYGYLHPFARQTQLCPMASRDQVWSFCTQDTRRYLTRPSLVILHPRYAEIPYGYLHPFARQTQLCPMASRDQVWSFCTQDTRRYLTVICTPLLGRHSCVRWQAETKFGHSAPKIRGDTLRLSAPLC

SEQ ID NO: 192858 - protein, 345 aa, Glycine max
  Coding DNA Sequence Number=SeqID_76080
  Gene Ontology: Mol. function=siderophore-iron transporter activity; Cellular component=outer membrane; Biological process=siderophore transport
  Homolog annotation: Hit_ID=O52981; Match level="QueryCoverage=97%, HitCoverage=49%, E-value=1e-140, Identity=70%"; Hit description =Ferrioxamine receptor
  Pfam annotation: Domain name=TonB_dep_Rec; Domain location=148-339; Score=31.8; E_value=2.3e-06; Accession=PF00593.14; Description=TonB dependent receptor
TGSYSHSNVALDQVYQIGWNSNNPDLLNRYYSGERSSLSAWATDNQLQAEFASGALQHRVTLGAEYHRYKNDLSDASGAASPLNAWNGEAIGSQPDYLWTAQTRRYYQSGLYLQDEMAWQRWHLDLSGRYDRIVSENGNSRRQDDHVSGRAALLYAFDNGVSPYVSWSQAITPASLTDPDGNQLKPTTSEQYEAGVKYQPNGTRDLYSVALYDLTQNDVANRNVQDGTYTPSGKVHAQSIELEARSQLTERFSTIAGYTLNHLRFKDSVDGNDGHTPYVTPNSMASLWGHYQFDYGLSAGAGVRYIGRQWADNENTTRLPSVTLFTLAARRSGRVAVEPERSCCS

SEQ ID NO: 192859 - protein, 113 aa, Glycine max
  Coding DNA Sequence Number=SeqID_76081
  Gene Ontology: Mol. function=acyl-CoA dehydrogenase activity; Cellular component=integral to membrane; Biological process=electron transport
  Homolog annotation: Hit_ID=Q2T8H5; Match level="QueryCoverage=99%, HitCoverage=28%, E-value=2e-25, Identity=49%"; Hit description =Phenol hydroxylase, putative
  Pfam annotation: Domain name=Acyl-CoA_dh_2; Domain location=1-93; Score=-13.2; E_value=0.0031; Accession=PF08028.2; Description=Acyl -CoA dehydrogenase, C-terminal doma
MEIAHCEADLRSARCWFYDAIDDVWQAILRGDEPGEERINAMRLSSTHITRVSASVTTRALKLAGMPGISMLSPLQRYARDSMVITQHAFMGELTYINAGNMFFGHSPQPGYL

SEQ ID NO: 192860 - protein, 116 aa, Glycine max
  Coding DNA Sequence Number=SeqID_76082
  Subcellular localization annotation: CTP_CleavageSite=63; ConfidenceScore=5.36e-01
MDRVTSQSSLFPLLPNTFRTVDVHVTSSFTLTKMSWTIKEQVLRCPYRTCARARVMGEVEEVQEQMKADMEAMKEQMATMMEAMMRMKKIMEANVVAVAATSAVAKVCWIEWPQNN

SEQ ID NO: 192861 - protein, 62 aa, Glycine max
  Coding DNA Sequence Number=SeqID_76083
MLTTSLFAPSGLVAKDHSCVALRVHFWVDGDTAATAEGEGEGEEGGGGGKAVIEAVPESNKH

SEQ ID NO: 192862 - protein, 208 aa, Glycine max
  Coding DNA Sequence Number=SeqID_76084
  Homolog annotation: Hit_ID=Q2L096; Match level="QueryCoverage=22%, HitCoverage=9%, E-value=5e-07, Identity=55%"; Hit description =Nucleosidase
MEPGRGDEGGAAWHRRGRRDARRAAGECGKGSRQRGVQQIPDMTEVAMAQLVGRVRVVLAGSGTPRQAHSQPSTAHRAGRAAGWRREAGGMGGAERRKIGMIYCFFDCGDARPRIRPRNAAEYDTSCSPRLGHNRWHRPSRLDRRERPLKEDHKKAEPSSMMNAVHPLSSMNRPEAIPFEPYHDAVAAVDRLAEIYARNTAFLRAAFR

SEQ ID NO: 192863 - protein, 89 aa, Glycine max
  Coding DNA Sequence Number=SeqID_76085
  Homolog annotation: Hit_ID=Q1SCD0; Match level="QueryCoverage=36%, HitCoverage=16%, E-value=8e-10, Identity=81%"; Hit description =Homeodomain-related
MLSLVVHHGACTLHRGFRVFPYLFCSKRRWADMLGPQWNKDELEHFYEAYRKYGKDWKKQQQHDKLERGRSASGLEELIMGCSSSEIKK

SEQ ID NO: 192864 - protein, 383 aa, Glycine max
  Coding DNA Sequence Number=SeqID_76086
  Homolog annotation: Hit_ID=Q136J2; Match level="QueryCoverage=38%, HitCoverage=83%, E-value=4e-40, Identity=58%"; Hit description =Regulatory protein, MarR
  Subcellular localization annotation: CTP_CleavageSite=70; ConfidenceScore=5.52e-01
PACWNPSTCLARRGRPSRAAFVRRYPAVLPGAGPGRRHRPRLRRAPGATAVVRRQVRAVVPAAWPGRRPVAARAGGARGRDPRHRHGPARRLGTRWLRVAPAGPGRPAPRHRDADAQGQGGGGAPVQGARAMDRLALRRPVASRAAPAWRPVGQGAGARGRRRRHRAHAGRGGAGNFPAHGAGGADPGGKPGRTRHGAHGGAGVGYRARLGLLHGGRRAGPVAGAAPGADPAAGRRRAFRCARMGLAGGAAGAGGGPGRGHRATAGVDGIAVRAPAPLCQRSVAAARRLVRAHRRAQGGSGAGAAAAGAAARRSGGLCAGFGGELAERCQQGPAGLGPAGVRALADAQPGRGDATHLPAGAAHHRGVARRRPRRPRGYRSPLR

SEQ ID NO: 192865 - protein, 167 aa, Glycine max
  Coding DNA Sequence Number=SeqID_76087
MGAKHLTRTKEWTHVIEQRAIRPLFQWAPHPYLKRIQGPLPANCVSTTRGGGYCAATMHTGARFHSSRYKETRIVPPTRSPLDPEKSNRALEFLALIIRPPLTELSSRSTATLGRHRARHHNSLGTANNGQLTHRHHLQNPPQLIYKAWSVAYDPWPTSRRPSPKPK

SEQ ID NO: 192866 - protein, 126 aa, Glycine max
  Coding DNA Sequence Number=SeqID_76088
  Homolog annotation: Hit_ID=Q09JM0; Match level="QueryCoverage=45%, HitCoverage=98%, E-value=1e-10, Identity=63%"; Hit description=10 kDa putative secreted protein
IAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGSSKYSNENFEGRRGERFHVNGTCTW

SEQ ID NO: 192867 - protein, 222 aa, Glycine max
  Coding DNA Sequence Number=SeqID_76089
  Gene Ontology: Mol. function=sulfuric ester hydrolase activity; Cellular component=periplasmic space; Biological process=metabolic process
  Homolog annotation: Hit_ID=Q9X759; Match level="QueryCoverage=99%, HitCoverage=38%, E-value=5e-97, Identity=72%"; Hit description =Arylsulfatase precursor
MGGGTSHFDDAKPLGTVEAFHTFYTLNGKRVSLPKDFYSSKAYADQLEQWIRDTPQNKPVFAYLAFTAPHDPLQAPDDWIAKFDGKYDAGYQQAYQQRIQRLKALGLISERTPMPTLALDKAWNALTPEQQKYEAKTMQVYAAMIAYMDDQVGAVLNTLKQTGRDQNTVIVFATDNGANPASGFYYGSKPEYWRQFDNSYANLGRKGSFISYGPHWANVSNA

SEQ ID NO: 192868 - protein, 87 aa, Glycine max
  Coding DNA Sequence Number=SeqID_76090
MNEERRRTVETFAKFLTKKVTETFRKRLGLDFLHGNNFSKQIRKRENKIGEMVAAQLAQASQVASSRSNSLLEGPSGPGCYLHPHFY

SEQ ID NO: 192869 - protein, 154 aa, Glycine max
  Coding DNA Sequence Number=SeqID_76091
MESVSVLVYCDLDIIPSDEGIVFESPNDPKFITISEDMSLVALRKTIFYANRGLSVPLSVILTISFPTMLTLCLRNRTTLYDSHNNSSSMMPMKGLLDLSSIEIRSLKSTRIVEAMPSKIILMMPKNQELSKFQRFKNQVSRIKIQDSRIKIQE

SEQ ID NO: 192870 - protein, 86 aa, Glycine max
  Coding DNA Sequence Number=SeqID_76092
  Gene Ontology: Mol. function=DNA binding; Biological process=DNA integration
  Homolog annotation: Hit_ID=Q1SKC8; Match level="QueryCoverage=73%, HitCoverage=15%, E-value=3e-19, Identity=64%"; Hit description =Integrase, catalytic region
MEAHTSAIINHRSCTKRGLKGIMIKSYSSRIFNQVNKCCFSIQGLSCFLGSSNLNGPDHLPSRKFDHLERWSFITLKLKILTEHGW

SEQ ID NO: 192871 - protein, 521 aa, Glycine max
  Coding DNA Sequence Number=SeqID_76093
  Gene Ontology: Mol. function=RNA-directed DNA polymerase activity; Cellular component=intracellular; Biological process=RNA-dependent DNA replication
  Pfam annotation: Domain name=RnaseH; Domain location=114-234; Score =35.7; E_value=2.8e-08; Accession=PF00075.14; Description=RNase H
  Pfam annotation: Domain name=rve; Domain location=365-521; Score =128.1; E_value=2.4e-35; Accession=PF00665.16; Description=Integrase core domain
  Pfam module annotation: Pfam domain module=RnaseH::rve; Domain location=114-234::365-521
WAAKRLRHYMINHTTWLISKMDPIKYIFEKPALTGRIARWQMLLSEYDIEYRTRKAIKGSVLADHLAHQPIEDYQPIKFDFPDEEIMHLKMKDCDEPLLGEGPDPESRWGLIFDGAVNVFGNGIGAVIITPEGNHLPFAARLQFDCTNNVAEYEACILGIEKAIDLKIKNLDIYGDSALVINQIKGEWETRHPGLIPYKDYAKHLLTFFNKVELHHIPRDENQMADALATLSSMYEVSHRNNLPTIRIQRLERPAHVFAVEEVVDDKPWFHDIKCFLQSQDIHPKYPTKTGDFEKMSAEFLMHEIHEGSFGTHSNGHAMARKLLRAGYYWMSMETDCCKHARKCHKCQIYADRIHVPPTTLNVLSSPWPFSMWGIDMIGRIEPKASNGHRFILVAIDYFTKWVEAASYANVTKQVVVRFIKNQIICRYGVPNRIITDNGTNLNNKMMKDLCEEFKIEHHNSSPYRPQMNGAVEAANKNIKKIVHKMVVTYKDWHEMLPYALHGYRTSVRTSPGATPFSLVY

SEQ ID NO: 192872 - protein, 95 aa, Glycine max
  Coding DNA Sequence Number=SeqID_76094
  Subcellular localization annotation: CTP_CleavageSite=26; ConfidenceScore=5.09e-01
TYQGNPCGDYPDISSFTGSGVYPDLSSFTGSGVYPDLSSFTGSGVYPDLSSFTGSGVIQNLRSLYQTIPSYSGSHHMRHRPRKNTSRGMPKGITG

SEQ ID NO: 192873 - protein, 186 aa, Glycine max
  Coding DNA Sequence Number=SeqID_76095
MDMNLGYLISHQISLIAQHDTSRLGFPALITALCKARGVQSDSRSLENFSPTINLAYIKKNRWNLDDPTVTFRGPRKARGKRSEVPTTSTAPETPTPSSSTAPVPSSAPVIPPTSTQIPLPAPIAAGPSDFIFTPQMLHSMLQSIHREQFIIMQSLQGLGLPSIMSMHESDAQVAWPGAQPSPSGG

SEQ ID NO: 192874 - protein, 136 aa, Glycine max
  Coding DNA Sequence Number=SeqID_76096
  Gene Ontology: Mol. function=DNA binding; Biological process=DNA integration
MMLFWHIGLLQSTHRNVSLSGCLWKGMSSSTGEERKLQLSELDEIRLEAYENGKFYKEKTKKFHDSMIIKKDFMVGKKVLLYNSKLGLMSVEIKSDSTNKSFKVNGHRLKPFLTNPSLVDVVVEETSLLHPTLPPP

SEQ ID NO: 192875 - protein, 177 aa, Glycine max
  Coding DNA Sequence Number=SeqID_76097
  Gene Ontology: Mol. function=nucleic acid binding; Cellular component= endoplasmic reticulum membrane; Biological process=DNA integration
  Homolog annotation: Hit_ID=Q1S1X7; Match level="QueryCoverage=78%, HitCoverage=13%, E-value=5e-32, Identity=43%"; Hit description =Integrase, catalytic region; Zinc finger, CCHC-type; Peptidase aspartic, catalytic
MKVMRADEKILGMEIKKDRDQKKLFLCQKEYIQKDTTNIGLVYHRDMFHALAGYSNSDYVADLDARRFVTGYAFMIDNSLVSWKETLQPAVDLSTTEAEYMALTKAIKEGIWLKGLISNLGFPQQKTIIFCDNLSAICLAKDHKVDTRENPTDMFTKPIPRSKFMHCLDLLNVDCWR

SEQ ID NO: 192876 - protein, 66 aa, Glycine max
  Coding DNA Sequence Number=SeqID_76098
  Subcellular localization annotation: CTP_CleavageSite=60; ConfidenceScore=5.07e-01
MTVVEWGASSGSGNSSFGMVVVMATIVVGWNSGGSKMHVGEATMMMCGGGGGENGGRVVVVVERWK

SEQ ID NO: 192877 - protein, 100 aa, Glycine max
  Coding DNA Sequence Number=SeqID_76099
MGIGLGLEFESSIIRNISDQKQFEAPDEVDQDLQMNPHHHNTTPLAWAKEKTSALSKPLAWASSNLPGGRGKKIQQPETREKNAEEEGEEGKWSRGTAEL

SEQ ID NO: 192878 - protein, 68 aa, Glycine max
  Coding DNA Sequence Number=SeqID_76100
MACDDERVVVGQRLHAKEGIVGTMINGGFGVVQRCIRATGGVRASLVISISKKGKVVVDAILPRKGIG

SEQ ID NO: 192879 - protein, 84 aa, Glycine max
  Coding DNA Sequence Number=SeqID_76101
  Gene Ontology: Mol. function=nucleic acid binding
MESMITIASSRFLDIILCNLIKIMVWAPPQQSFESFPCFTERFIKTLGKSSNGGFCTNESRRRKEPCNELFLHLSPSVKAFVWM

SEQ ID NO: 192880 - protein, 73 aa, Glycine max
  Coding DNA Sequence Number=SeqID_76102
MEDWENFLHQILEEDSEDSAPIKMFLLLWGFGGKQRRLVAATGGRGWWKRRCSGLGGIWRGGKSENLVYHAEE

SEQ ID NO: 192881 - protein, 183 aa, Glycine max
  Coding DNA Sequence Number=SeqID_76103
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=9e-21, Identity=35%"; Hit description= UPI00006A17C9 related cluster
MPSPSEDYTSWLSEDCTSSPSEDYMSSPSEDYMPPLQRATHPHLRGLRALTFRGLHVLAFIGQHVLTFRGLHVLALRGLHVLAFRGLHVLAFRGLHVLIFRWLHALTFRGLQRTARPLLQRATRPPLQRTARPHLQRAARPHLQRVTRSHLLRTRRPRLQRATRPRLQRTRRPFLQRTTRPRL

SEQ ID NO: 192882 - protein, 120 aa, Glycine max
  Coding DNA Sequence Number=SeqID_76104
MANKSDDIRMMLVAGTIEFDSMWKRHGFQKKAVPSGGSNPTCLGKLGGNHLPFFSYKLGKEGRTNGFSPSGIEKSLKISEKNCFREKNPSRGASVMLLRRFHKRFRGDSSLFFTVLRSST

SEQ ID NO: 192883 - protein, 156 aa, Glycine max
  Coding DNA Sequence Number=SeqID_76105
MKFQKKKGEACPLGRVQIIVSLLWAVYKFVGHVRHRVHAVSMLETPLTGGRGSSVLPSHDHVGEGRSHELVNDNKHQQHKFKIKHVQVVSAKEDGGFICVMGITKIGFLWYVGVESRDHFEGLWDMAHEPVLENVMMMVPSGVMGPNHFPIMEISR

SEQ ID NO: 192884 - protein, 88 aa, Glycine max
  Coding DNA Sequence Number=SeqID_76106
MDWSNSLTKSPVESPTVVTYLSAGGRREAHGCVFQERKMRGVTTNVYSRKMSEKPEKTWSRNFKCERFGSCIYARGRVFPLLLRIPQL

SEQ ID NO: 192885 - protein, 94 aa, Glycine max
  Coding DNA Sequence Number=SeqID_76107
  Gene Ontology: Mol. function=intramolecular transferase activity, phosphotransferases
  Homolog annotation: Hit_ID=Q1AN53; Match level="QueryCoverage=94%, HitCoverage=27%, E-value=1e-24, Identity=66%"; Hit description =Putative phosphopyruvate decarboxylase
MEAFRYAAEDRCGVVVKGANRSGNIAGTCPLKDNDILLTARALDDSNEVRNTIAVVNELSKEMRQILLSHPANPKCAPGGKNIASVVLLGDSGI

SEQ ID NO: 192886 - protein, 164 aa, Glycine max
  Coding DNA Sequence Number=SeqID_76108
MTTFGQGQLSRSFTVMYLIIDVDTFYFALIGNKTLNKLEAIVSTPHLKMKFPTLMGEIMTVKVDQKQARQCYVESLKVEPYPPSSSQVISLDKGSPIRTLIVYKASLGDQDGVFDVDPCDDTIGKCPKPIEELVKLQLRPKSRQCMQLSRDLTSHEYKCIVEAQ

SEQ ID NO: 192887 - protein, 80 aa, Glycine max
  Coding DNA Sequence Number=SeqID_76109
MDADLPLGWKSLNPEHYDGTTNSDEHLNVFLTQANLYTNNDIILYRIFPTPVKRATLTWYEGLPLRSIDSFNTLVEHFNS

SEQ ID NO: 192888 - protein, 80 aa, Glycine max
  Coding DNA Sequence Number=SeqID_76110
METTMRSSWLIRLMPLKSLSVNLMGEKLHGGEVGVHVFGGDASVYLYLLLCPIFYWHRDFCASPHGVLWVLLLELMKHWA

SEQ ID NO: 192889 - protein, 1331 aa, Glycine max
  Coding DNA Sequence Number=SeqID_76111
  Homolog annotation: Hit_ID=Q9LUW1; Match level="QueryCoverage=96%, HitCoverage=80%, E-value=1e-88, Identity=35%"; Hit description =Arabidopsis thaliana genomic DNA, chromosome 3, P1 clone: MCB17
QDEIEIEIAEVLYGMMRQPQGPSKQDIVANDSNKFDSRESNKSSTDAKSPISNPQNSSSSATPMSAVAPKRKRPRPVKHEDENPASLSVRSSPISSTTKAESDQPSKMETCSSNLDKNNVGSVTENLVNSQTVQVMPESNEPKPATEVAERQKDVVGLLSEVVVSPQSPKKESPVRQVADDDREDVKATKANHSISESENQREEKFQIDLMAPPPPLRSSPERDAENNNMVVDAEKEVKPMTKEDEKVLRMNKEVAMAIEMEKVKAKAEENDSQKPGLLQKERGIDLQLDLEKADRVDTSGNVGGMVNKKQQQHQNAQRQPQPQLQQTNSEKNVQSNSLPLPLSVPSWPGGLPPMGYMTPLQGVVSMDGTPVTSAAIPPPHLLFNQPRPKRCATHCYIARNILYHQQIARMNPFWPAAAGSASLYGAKPSNLNVAPSTELHGNVPCRSANSSQDKGHGIAMFPGHIGKDKASQPANVDNSSRKQILLQQALPPGAAPSNILHGPAFIFPLNQQQAAAAASVRPGSVKSLPVSSNGAPSSVSNSAPPNACGTGAAAGAAAPTMSFSYPNMPGNEAPYLAILQNNAYSFPIPAHVGGPPGYRGTPHAQAFPFFNGSFYSSQMLHPSQIQQQQLPAQSQQQSQQGHQNASMSSGSSTSQKQHAQNQQQKPNNNATGSNGGGSLQGFPVTKNPPSLPLQLQQQQPQQRQNHHPSHPARQVESEMGGEDSPSTADSRLARATMNIYGQNFAMPMQSPNFALMTPASISAAGSNGGHGEKKQPQQHPGPKAGGETAPAFAMSFASMNGAPGLDLSSIAQNPSIMPSNHNYHIMAAAQAASAQLKKSYHAAEEGKNVVNSSNLDEDRKAISAGKIPATMGQSIAFGRPEVSDPSLASLSGGNNVIDTSGRNLNLGSASSRASTSVMPAVISTNPASSQQQMQRNQQQQQILQHQKQNQFAAAAAAAARNKTPSTSNGSVYSDNLPSTSSMANKFPSAVSAFPQSLVQSSNTVAQSPQWKNSVRATTTSQSPPSMASTTPPSSVKNLPQQQARSQQPHTQISFATNPKSSAAQVQPSSSTQSPSPPVMVGSPTTSSMSKNTGSPRTTSASTTNNKISQSSSLSSQQAKNSSAVPARKSSPVGSRNVPSILNVPQLTPSSSTGSKSQLPQKQQPQQQIPKQALQQAQLLFSSPYVHPQSNSTTSTTTVPSGYYLQHQQRRGPEQMQRPGSSPAVNNVKGSSALPTQGLLHPAQVAAMQPSGSHPQFVPTGFSYASYHVHSVPSVQVKPAEQKQPAVKHVNWHGILKCKMGSLSNGGGKMSCCYVDDGMPYVEKASKLDGV

SEQ ID NO: 192890 - protein, 194 aa, Glycine max
  Coding DNA Sequence Number=SeqID_76112
  Gene Ontology: Mol. function=sugar porter activity; Cellular component=integral to membrane; Biological process=carbohydrate transport
  Homolog annotation: Hit_ID=Q94AZ2; Match level="QueryCoverage=99%, HitCoverage=37%, E-value=6e-65, Identity=66%"; Hit description=Sugar transport protein 13
MAGGGFVSASGESHFEAKITFAVIISCIMAATGGLMFGYDIGISGGVTSMPSFLEKFFPEVYRKIQDHGVDSNYCKYDNQTLQLFTSSLYLAALVATMFASSVTRTLGRKQTMLIAGIFFIVGTVLNAVANSLLLLIVGRILLGCGVGFANQAVPVFISEIAPTRIRGALNIMFQLNITIGILIANIVNYFTAK

SEQ ID NO: 192891 - protein, 113 aa, Glycine max
  Coding DNA Sequence Number=SeqID_76113
MEIRRGTGHSWKKQADSKEGASPTWHLNQELSNYTAEMSAEARVTQSHGHGTSKPWILVLVTLRFAFDEGAFILSRSLAHSLTRCREIPQLCHVCTGTATSGSLRGFVYDRRH

SEQ ID NO: 192892 - protein, 232 aa, Glycine max
  Coding DNA Sequence Number=SeqID_76114
  Homolog annotation: Hit_ID=Q9LUW1; Match level="QueryCoverage=70%, HitCoverage=13%, E-value=1e-29, Identity=43%"; Hit description =Arabidopsis thaliana genomic DNA, chromosome 3, P1 clone: MCB17
MVEFHVCFAFTKVPATGYIRVRIARGDAVENRDRPGVFGQREEEKNKGKKDKLSKAKQSKAAPLRSLWIREARRSTMAANGLTRRRHRTNSLRDSPEEDGGMELQEPSRLRDRGGSGKKDRDRERERERERDRLGRSKKRRGDRLMHSSREDGGEDTSEESINDEDDDDDEDGGGGGGSASVRMLPLNPSSLSKHHHRKSFPPAKVLRPTPPTTWKAADEMIGVSVPRKARS

SEQ ID NO: 192893 - protein, 306 aa, Glycine max
  Coding DNA Sequence Number=SeqID_76115
  Gene Ontology: Mol. function=sugar porter activity; Cellular component=integral to membrane; Biological process=carbohydrate transport
  Homolog annotation: Hit_ID=Q1SDF6; Match level="QueryCoverage=99%, HitCoverage=58%, E-value=1e-136, Identity=74%"; Hit description =Sugar transporter superfamily; Major facilitator superfamily MFS_1
  Pfam annotation: Domain name=Sugar_tr; Domain location=3-293; Score =120.5; E_value=4.7e-33; Accession=PF00083.14; Description=Sugar (and other) transporter
IEGGYGWRISVALAGIPAIMLTFGSLLVHDTPNSLIERGLEDEGKAVLKKIRGVENVEPEFQEILKASKVAKAVKNPFQNLLKRHNRPPLIIAVMMQVFQQFTGINAIMFYAPVLFSTLGFKSDASLYSAVITGAVNVLSTLVSVYFVDKAGRRMLLLEACVQMFVSQMVIGTVLGLKVQDHSDSLNKGLGVLVVVMVCTFVASFAWSWGPLGWLIPSETFPLEARSAGQSVTVFTNMLFTFIIAQGFLSMMCHLKFGIFFFFSAWVLAMAIFTVLLIPETKNIPIEEMTDKVWRNHWFWKSYMED

SEQ ID NO: 192894 - protein, 114 aa, Glycine max
  Coding DNA Sequence Number=SeqID_76116
  Subcellular localization annotation: CTP_CleavageSite=41; ConfidenceScore=5.09e-01
MPLHTTPQPPSIVVPATSLFYCNYIPTTSRRVDGFQNQGFRGNEGGNDGAAVPVTGQQPHGGGIMGNEGLYVNSGGVGGASVDVIVPGDTILFVGDLYWWTIDAEPKAGLSMRL

SEQ ID NO: 192895 - protein, 152 aa, Glycine max
  Coding DNA Sequence Number=SeqID_76117
  Gene Ontology: Mol. function=electron carrier activity; Cellular component=anchored to membrane; Biological process=electron transport
  Homolog annotation: Hit_ID=Q1SDF8; Match level="QueryCoverage=99%, HitCoverage=84%, E-value=4e-59, Identity=71%"; Hit description=Blue (Type 1) copper domain
  Pfam annotation: Domain name=Cu_bind_like; Domain location=33-116; Score=149.4; E_value=9.4e-42; Accession=PF02298.8; Description =Plastocyanin-like domain
MALVERVVVLFIVMAFVQVSFAAVYKVGDSAGWTTLGTIDYRKWAATKNFQIGDTIIFEYNAKFHNVMRVTHAIYKTCNASSPIATFTTGKDSINITNHGHHFFFCGVPGHCQAGQKVDINVLSISAEAPTPSGSALASPTVQTSTVPAPSP

SEQ ID NO: 192896 - protein, 438 aa, Glycine max
  Coding DNA Sequence Number=SeqID_76118
  Gene Ontology: Mol. function=sugar porter activity; Cellular component=integral to membrane; Biological process=carbohydrate transport
  Homolog annotation: Hit_ID=Q1SDF6; Match level="QueryCoverage=97%, HitCoverage=89%, E-value=1e-166, Identity=67%"; Hit description =Sugar transporter superfamily; Major facilitator superfamily MFS_1
  Pfam annotation: Domain name=DUF81; Domain location=92-356; Score= -61.7; E_value=0.021; Accession=PF01925.9; Description=Domain of unknown function DUF81
  Pfam annotation: Domain name=MFS_1; Domain location=7-399; Score =46.2; E_value=1.1e-10; Accession=PF07690.6; Description=Major Facilitator Superfamily
  Pfam annotation: Domain name=Sugar_tr; Domain location=1-413; Score =297.5; E_value=2.5e-86; Accession=PF00083.14; Description=Sugar (and other) transporter
  Pfam module annotation: Pfam domain module=DUF81::MFS_1::Sugar_tr; Domain location=92-356::7-399::1-413
MGRFESGGVTSMPAFLKEFFPEVYRKTVEEEELDSNYCKYDNEKLQLFTSCLYLAGLIATFFASHITRRQGRRATMLISGFIFIAGVAFNAAAQNLAMLIIGRVLLGSGVGFANQAVPVFLSEIAPSQIRGALNILFQLNITLGILFSNLVNYATNKLSLGLGGLPALLLTLGAFMVVDTPNSLIERGHLEEGKVVLRKIRGIDNIEPEFLELLHASRVAKEVKHPFRNILKRKNRPQLVICIALQIFQQFTGINAIMFYAPVLFNTLGFKNDASLYSAVIIGAVNVVSTVVSIYSVDRLGRRILLLEAGVQMFLSQLVIAVIIGMKVKDHSEDLSKGYAVLVVVLVCIFVSAFAWSWGPLSWLIPSLSLNAVFLQVWHLLVLLWMCLAHVHLCAFPSPRDKECPIEEMTQSVWKQHWLWKRFIEDDCVKEEKVDTGN

SEQ ID NO: 192897 - protein, 221 aa, Glycine max
  Coding DNA Sequence Number=SeqID_76119
  Gene Ontology: Mol. function=sugar porter activity; Cellular component=integral to membrane; Biological process=carbohydrate transport
  Homolog annotation: Hit_ID=Q1SDF6; Match level="QueryCoverage=99%, HitCoverage=43%, E-value=4e-77, Identity=78%"; Hit description=Sugar transporter superfamily; Major facilitator superfamily MFS_1
MAGSSRFSFRDRTFKNSWSIEYTVPAEYHPWHSLCQPGQLCHQSGWGWRLSLGLGGLPALLLTLGAFLLVDTPNSLIERGHLEEGKAVLRKIRGIDNIEPEFLELLEASHVAKGVKHPFRNILKGRNRPQLVISIALQVFQQFTGSNAIMFYAPVLFNTLGFKNDASVYSAVITGAINMLSTVVSIYSSRTPNALIGSRHSDVLVTCCDCSCNGNEGEGPF

SEQ ID NO: 192898 - protein, 197 aa, Glycine max
  Coding DNA Sequence Number=SeqID_76120
  Gene Ontology: Mol. function=sequence-specific DNA binding; Cellular component=intracellular; Biological process=regulation of transcription, DNA-dependent
  Homolog annotation: Hit_ID=UPI00005F8D65; Match level="QueryCoverage =80%, HitCoverage=53%, E-value=2e-39, Identity=58%"; Hit description =COG4977: Transcriptional regulator containing an amidase domain and an AraC-type DNA-binding HTH domain
RQRQIEAGADAARGPDWAVLDIQRAAFNLHARIAGLQRVQQTPVAGGAPAIQQSRLRQQHRRPANRHHAARLRGSQLNPVHHHIAFFGVITAAGNHDGVPAFARIEFSQFEIGEQIEAGLAVDHLVRLRGRNADAIAMSAIPAASNSMPPSGTIIRKGFALFNPFARAIQRDAARHRIITGGFNNRADERDLTVRGK

SEQ ID NO: 192899 - protein, 45 aa, Glycine max
  Coding DNA Sequence Number=SeqID_76121
MLASTMVDNRLCQWQQLQNYTMEVTKILDGWLEALIFQRTMTSQQ

SEQ ID NO: 192900 - protein, 141 aa, Glycine max
  Coding DNA Sequence Number=SeqID_76122
  Gene Ontology: Biological process=regulation of progression through cell cycle
  Homolog annotation: Hit_ID=Q6EEW1; Match level="QueryCoverage=52%, HitCoverage=22%, E-value=3e-14, Identity=54%"; Hit description =Cyclin T1
MVGTYAKLMPRMVSLTIYEPLFVLNNAGCSDGCLVRLRSSLWLQFKPHHIAAGAAYLAAKFLNMDLAAYQNIWQEFQTTPSILQVNEEPICESTQRFVTLYVRNNYWVRRFKFIFGCPPDSGLWYERKIKLTSVVMVNLGA

SEQ ID NO: 192901 - protein, 106 aa, Glycine max
  Coding DNA Sequence Number=SeqID_76123
MSHCSSTSICFNNWEVLIVTLGCKGKQLQGDHFPKKEKETSKQTLTSLALFFKKPNLHMITLQVECCQLMTRLSTQNPVHYNFHTSCAELPEEMKVLAVNHIGEEG

SEQ ID NO: 192902 - protein, 65 aa, Glycine max
  Coding DNA Sequence Number=SeqID_76124
MDHTPAAQRRLKAIHAHLTATADESPSHLRSNPTAGEFFSDWRKTNSQYGLEEKIRFVSLFARDT

SEQ ID NO: 192903 - protein, 61 aa, Glycine max
  Coding DNA Sequence Number=SeqID_76125
  Gene Ontology: Mol. function=nucleic acid binding; Cellular component= ribonucleoprotein complex; Biological process=nuclear mRNA splicing, via spliceosome
  Homolog annotation: Hit_ID=Q42404; Match level="QueryCoverage=75%, HitCoverage=11%, E-value=1e-16, Identity=80%"; Hit description=U1 small nuclear ribonucleoprotein 70 kDa
MVCLTKNGIIRTRGYAFIEYLHTTDMKVAYKQADGRKIDGRRVLMDVKRGRTVPNWRHILQ

SEQ ID NO: 192904 - protein, 210 aa, Glycine max
  Coding DNA Sequence Number=SeqID_76126
  Homolog annotation: Hit_ID=Q41112; Match level="QueryCoverage=42%, HitCoverage=59%, E-value=8e-24, Identity=67%"; Hit description =Stress-related protein
MDSPPRVLTPPASPKGSDVLCHPLLIHQGARGLSEAQRRHRGGGHEDLRGFGLRQVPPCPRRGPQIHESEGCRVRQPCSLQREKGRDVISTYAMNIYSKYEPTTTAKQCADVVLQPEWRRPRPSAPLLEPSNRVTKEELLFQPEWRRLKPSATAIANANASVWEPEWRRSRPMATTFPWNQNYNVRKGTASSSDDGDGGVERREDPNDLW

SEQ ID NO: 192905 - protein, 52 aa, Glycine max
  Coding DNA Sequence Number=SeqID_76127
  Gene Ontology: Mol. function=methyltransferase activity; Biological process=metabolic process
  Homolog annotation: Hit_ID=Q8L9U0; Match level="QueryCoverage=95%, HitCoverage=14%, E-value=3e-13, Identity=75%"; Hit description =Coclaurine N-methyltransferase
MEASYDRIFSIEMFEHMKNYKDPLKKISKWMKKDGLYLFITFATKHLPTSLR

SEQ ID NO: 192906 - protein, 114 aa, Glycine max
  Coding DNA Sequence Number=SeqID_76128
MELLTPIGVQFLQERQKTSMLASTWAMIPKTNKQTNKLAKTEYDTKAYKEDKQFIFKIPDRIKRFEPVRNRGWAGIQPKKPISPSSSVYNRNNEEKGWEWPRCMCIDKGFRTLE

SEQ ID NO: 192907 - protein, 80 aa, Glycine max
  Coding DNA Sequence Number=SeqID_76129
MKDPFMNTFPPPSKELKPKDKSKHKRKHYDHKHVAAEPSSHAGFGEVASLANSSARSLMSRLMCPTWTSSNSSLNCWKAW

SEQ ID NO: 192908 - protein, 183 aa, Glycine max
  Coding DNA Sequence Number=SeqID_76130
LRNVALSGWLAKPADWLSERGHFMPQTTLLNMCQDHLILGRILFNVSGPPYVEEDLEHTMIATTIGRGYPEEELGGSLKKLVRRILRKISMRICGMLPHESPVVRDLLNYRPFVTPFLHAVSSLGLGCLKEFMESGSKVKGPTDEVFKVFPKQVAYNITHYIDKVVDNTTVVVDVAMRIAQEK

SEQ ID NO: 192909 - protein, 86 aa, Glycine max
  Coding DNA Sequence Number=SeqID_76131
MGNEQKTQNRGEKINLRGVLQPWAHLGPLGSFNMKQLARLGEHVASELSHQLAWASWVASSSLILAMKGRGRLRGRGQHPWYSDFT

SEQ ID NO: 192910 - protein, 63 aa, Glycine max
  Coding DNA Sequence Number=SeqID_76132
MASLSYFHEESGALVGGEQASKIVMGAQGLFEGTFDGGGDKDKPSEVGKDEISITSIGVATRP

SEQ ID NO: 192911 - protein, 83 aa, Glycine max
  Coding DNA Sequence Number=SeqID_76133
MEPPVRGKYGKEEEKTGVTHFKSFWVGTIGQLPYPNFVRGPLFDGMQPLLNHFEKSKENIVARSVKFRNMPETKRKHCYAIRK

SEQ ID NO: 192912 - protein, 302 aa, Glycine max
  Coding DNA Sequence Number=SeqID_76134
  Gene Ontology: Mol. function=RNA-directed DNA polymerase activity; Cellular component=membrane; Biological process=RNA-dependent DNA replication
  Homolog annotation: Hit_ID=Q1SYP9; Match level="QueryCoverage=74%, HitCoverage=25%, E-value=4e-16, Identity=24%"; Hit description=Myb, DNA-binding
MQCRPQLNGISFSNIGQQQNQMLVCNFYEQEIRAFNKALLGKWRWDMLQQSNKLWSKILHSKYGGWRSLVEGGRRNNESGWWKDLMEVTHDQQMNSILQDGTTWRVGCGDKIKFWEDSWAGHGKAQKMKYPRLYRISLQQHKLIQQVGSFNDSSWEWNLSWRRSLFDNEIASAAGFLEQICQITIQPHIADCCKWEAEPNGCYSTRSAYNIIQQEDAAHLFFNCTKSLALWWESLAWTGIVGAFPIIPRYHFLQHQNEMNGGKRNNRWKDVDEEKDKEEQNKKKIKEVSHGEQAQGHLDDKA

SEQ ID NO: 192913 - protein, 195 aa, Glycine max
  Coding DNA Sequence Number=SeqID_76135
  Gene Ontology: Mol. function=protein phosphatase type 2A regulator activity; Cellular component=protein phosphatase type 2A complex; Biological process=signal transduction
  Homolog annotation: Hit_ID=Q1SHY8; Match level="QueryCoverage=99%, HitCoverage=30%, E-value=6e-78, Identity=73%"; Hit description=WD40 -like
  Pfam annotation: Domain name=WD40; Domain location=114-152; Score =38.6; E_value=2.1e-08; Accession=PF00400.22; Description=WD domain, G-beta repeat
  Pfam annotation: Domain name=WD40; Domain location=155-193; Score =0.3; E_value=34; Accession=PF00400.22; Description=WD domain, G-beta repeat
  Pfam annotation: Domain name=WD40; Domain location=73-110; Score =40.0; E_value=8.2e-09; Accession=PF00400.22; Description=WD domain, G-beta repeat
  Pfam module annotation: Pfam domain module=WD40::WD40::WD40; Domain location=114-152::155-193::73-110
MKFSPCGQYLASGGEDGVVCIWRVTSLDKSSICSTTEDSTSNSKVECDNSSPRNKHSSQPFIFLPNSIFQIEESPLQEFFGHSSDVLDLAWSNSDILLSSSMDKTVRLWQIGCNQCLNVFHHNDYVTCIQFNPVDENYFISGSIDGKVRIWGIREERVIDWADIRDVISAISYQQDGKGFVVGSVTGTCCFYVAS

SEQ ID NO: 192914 - protein, 129 aa, Glycine max
  Coding DNA Sequence Number=SeqID_76136
KNPEEDELYRFAKRPASVHPLSEKGALRQKSLTWAKRPELEARAGLRASDESVSDCEILEASWYGKLNPLLDLPFRYLICMLSQPTIRREGDARLAGCVFHERNTRGVATNVYSRKTSEKTRSTNFLVK

SEQ ID NO: 192915 - protein, 199 aa, Glycine max
  Coding DNA Sequence Number=SeqID_76137
MARVLVIRTLLSRILDELSSLKLWKEKLERKVKGKERVKINQDEREQIREEERRKIPKELRKEKHASYSSHNSCKSLSEEIRDYYEGRHRSHLRPHSHRRENERKPQKANINLPYFHGKDNVEAYLDWEIRVKQKRKRKSTLKSYGSHSYPKNDQGLGILGAAPSKPKDDKGKTIEKQPPEASMQGKTSSIKCFKCLGR

SEQ ID NO: 192916 - protein, 156 aa, Glycine max
  Coding DNA Sequence Number=SeqID_76138
  Gene Ontology: Mol. function=microtubule motor activity; Cellular component=microtubule associated complex; Biological process =microtubule-based movement
  Homolog annotation: Hit_ID=Q2HT07; Match level="QueryCoverage=82%, HitCoverage=9%, E-value=3e-48, Identity=76%"; Hit description =Kinesin, motor region; Prefoldin
MVQGLNQGLHHPYVEVVEKEVSRLRGLVGGGEIQDNDISVVSFPGSPGSFKWEGVQGSFSPLTSVKRISQKKDYDIALVGAFRREKDKEMELQALRDEIQASMKLVRQREDEIQSLKMRLRFREAGIKRLETVASEKISAETHLLKEKEEHLKEIE

SEQ ID NO: 192917 - protein, 198 aa, Glycine max
  Coding DNA Sequence Number=SeqID_76139
  Homolog annotation: Hit_ID=Q84N00; Match level="QueryCoverage=41%, HitCoverage=21%, E-value=5e-15, Identity=53%"; Hit description =Putative class 5 chitinase
  Subcellular localization annotation: CTP_CleavageSite=63; ConfidenceScore=5.43e-01
MEKYIATMRRSDSRPVTATSVAIAACYSLNCMLRFFISFTVRGNSQSRSMSWNPKVHARVMVELMKVARAVDFALMREKRVALELVPPMEMRVVMVEPRVVVNFVRFVAVEFETCARVTVEQVRREKLLLQEREWELEAELFLMRTLLPNCPLNWLWAPIKCLDSSSPRAYPALVRVELRELSETTPHFAVASSFKSN

SEQ ID NO: 192918 - protein, 370 aa, Glycine max
  Coding DNA Sequence Number=SeqID_76140
  Homolog annotation: Hit_ID=Q2QMH3; Match level="QueryCoverage=82%, HitCoverage=68%, E-value=7e-19, Identity=29%"; Hit description=IQ calmodulin-binding motif family protein, expressed
  Pfam annotation: Domain name=IQ; Domain location=117-137; Score=18.0; E_value=0.034; Accession=PF00612.17; Description=IQ calmodulin -binding motif
  Pfam annotation: Domain name=IQ; Domain location=95-115; Score=30.1; E_value=7.7e-06; Accession=PF00612.17; Description=IQ calmodulin -binding motif
  Pfam module annotation: Pfam domain module=IQ::IQ; Domain location =117-137::95-115
MGKARKWIRNFLLGKKEDKIKKIEDKSLIVSPKVKCRWSFGKLTGGRITSKVVGHKFSRSFDSGDSAKLQIQPLLETKTPRHLPKPLAKASKDKNKAATKIQASFRSYLARRALHALRGLVKLQALVRGHLVRKQTTATLRGMHALMAIQVRARIHRIQMAEEANLLGQQPLQHRQLPYFTDLITEENKDSNDMSVEEIVEVLKSRSGPLDGSYVKGRERDSMTYYSKHVPVVSKRQNQYKKTLMVEPNSLGNYRAMSEFNPATIALSTSQRHYVPHRQSLSPNYMNKTESSRAKARSQSEPKQRPRRGTRHKGKSVESPLNGPRQNLFSNSLRFDHRSLDHWVINPHGSKNDSRRNSFGSSSVTTESYY

SEQ ID NO: 192919 - protein, 555 aa, Glycine max
  Coding DNA Sequence Number=SeqID_76141
  Gene Ontology: Mol. function=protein serine/threonine kinase activity; Biological process=protein amino acid phosphorylation
  Homolog annotation: Hit_ID=Q8SA64; Match level="QueryCoverage=98%, HitCoverage=99%, E-value=1e-165, Identity=52%"; Hit description=NIMA- related protein kinase
  Pfam annotation: Domain name=Pkinase; Domain location=4-274; Score =70.6; E_value=5.1e-18; Accession=PF00069.15; Description=Protein kinase domain
  Pfam annotation: Domain name=Pkinase_Tyr; Domain location=4-222; Score=-89.8; E_value=5.9e-07; Accession=PF07714.7; Description =Protein tyrosine kinase
  Pfam module annotation: Pfam domain module=Pkinase::Pkinase_Tyr; Domain location=4-274::4-222
MEQYEILEQIGKGAFGSALLVKHKHEKKKYVLKKIRLARQTERSRRSAHLEMELLSKLRNPFLVEYKDSWVEKGCYVFIIIGYCEGGDMAEAIKKASGVMFPEEKLCKWLVQLLMALDYLHVNHILHRDVKVVGTPSYMCPELLADIPYGSKSDIWSLGVFCNHAFLLIYFMYFWIQAAELLGHQHLQPYVLKVHLKINSPRRSTLPGHWPESNYMEKTRFLKSEDDPVSFSGNKRHSFSYDRTLNPSISGAEQDSLCSTLEIDCTPDNLNQRFAELSVGDNHDVKSLHKPVASRTSSKARTPRLTASKASAAPKKSMVSSKNHKTLPVSHNMKEPVHTTRRASLPFPRSCTIQQPPRRASIGLLDHVNSLNISVNSPRIDRIAEFPLASYEDQLFPINSSSPNSAQGSSGFPPCGNDSTLIDKCTIKVCDTSYVRPGCTDAWQGITNSMFKKNDEDKSGSSDQNATAGASSHNSSDLRHRQFDTSSFRQRAEALEGLLEFSARLLQQERYGELGVLLKPFGPGKASPRETAIWLSKSLKENTFSREQSTPPKLL

SEQ ID NO: 192920 - protein, 924 aa, Glycine max
  Coding DNA Sequence Number=SeqID_76142
  Gene Ontology: Mol. function=DNA binding; Cellular component=beta -galactosidase complex; Biological process=DNA integration
  Homolog annotation: Hit_ID=Q1S3I6; Match level="QueryCoverage=99%, HitCoverage=94%, E-value=0.0, Identity=56%"; Hit description =Integrase, catalytic region
GDIFRVADIQEEVARLQQGTLDISSYFTKLTTLWEEIENFRPIRDCTCAIPCSCGAATDLRKFKEQDKVIKFLKGLGDQYSHVRSQIMLMSPLPTLDNAFNLILQQERQFNLPSTTDSSIENQSSVNHFSQTPSRPSNNSGRGRGRGYSFGGRGNRLCTHCNHTNHTVETCFIKHGYPPGFQHRKSNSSGNASVVNSVQDAGSAHISSSSSASTSTNESSASLSTIQEQYTHILQLLQQSKLQSTSPSSVNSVFATNFVSHTSPSPSSSKNLSNNTSHWWIVDTGAIDHITHIFDSFSSTYHIAPKTMTMPNGDTVTTTIAGLVLLYDSLVLHNVYYFPSFHLLHPKMTGFTARRIGKLYVLDTTSPLVFSPTPDTSDILLDLPLSLPPPNEPTSPPAPTRKSHRLTKLPAYLSEYHCNLLSSMLPASNPEPKTYKLACKFDCWNLAMKSELDALASTNTWSVVDLPEGKQPIGCKWVYKIKHHADGSIERYKARLVAKGYTQLEGVDYFDTFSPVAKLTTIRTLLSVAAIKDWHLEQLDINNAFLHGDLHEEVYMDLPPGFLPPGSSSNKVCKLHKSLYGLKQASRQWFSKLSTALISLGYSPSSADHSLFTKLHNSHFTARLVYVDDIVLTGDDLQEIQSVKQFLDSTFKIKDLGKLKYFLGLEIARSTQGIFLNQRKYALELLEDNGLLATKPSTTPFDCSLKLHDSDSPPYEDETVYRRLVGRLLYLTTTRPDIAFIVQQLSQFISQPLQVHHSAAIRVLKYLKSAPAKGLFYSSSSTLKLWFCRLRLGKLPCYSQISDWLLCLSWHIYAVLEIQKAVHSIQDLHISLDQPISVYCDNKSAIYLAHNPIFHERTKHIEIDCHVIREKIQTGLIHLLPVSSAAQLADVLTKPLPAPSFNSLISKLGLLDIHSPACGGLLHD

SEQ ID NO: 192921 - protein, 65 aa, Glycine max
  Coding DNA Sequence Number=SeqID_76143
MCGWHGVADGDDGAINGIGMAGHVKRSRENTVLSYRNSSQHVQALTVTEQEPRAHGMGEAYYYCA

SEQ ID NO: 192922 - protein, 139 aa, Glycine max
  Coding DNA Sequence Number=SeqID_76144
  Pfam annotation: Domain name=AT_hook; Domain location=102-114; Score =12.0; E_value=0.19; Accession=PF02178.9; Description=AT hook motif
  Pfam annotation: Domain name=AT_hook; Domain location=71-83; Score =12.6; E_value=0.15; Accession=PF02178.9; Description=AT hook motif
  Pfam module annotation: Pfam domain module=AT_hook::AT_hook; Domain location=102-114::71-83
MEQQNHTTDTDQFLILGPTPNEPHTPMAHVNVADTNNNVVGGAVNVGIGSGSAHVVAVAKSETVGSGQAVKRGRGRPRKNDIVENAVSPATGPPGFSDQAAKRGRGRPRGSRKLQILASIGNNLNQLEQGRILLHIAII

SEQ ID NO: 192923 - protein, 161 aa, Glycine max
  Coding DNA Sequence Number=SeqID_76145
  Gene Ontology: Mol. function=pseudouridylate synthase activity; Biological process=tRNA processing
  Homolog annotation: Hit_ID=Q5ZBZ5; Match level="QueryCoverage=68%, HitCoverage=16%, E-value=3e-14, Identity=45%"; Hit description =Potential U2 snRNA pseudouridine synthase-like
MTGEIEKLFLRLTFQASYALKAIGSDSDILRNKPEDLLELLSYSDSSEQLVDTDLDKINKSKPMNTVKQMGAANGKNEEAFDCIRELESSDDIAKVENYSEILGEEVKLPHDESLIGSSSQDSQIALKLSFTLPASCYATMAIRELLKTSTSVAYHKTLNQ

SEQ ID NO: 192924 - protein, 129 aa, Glycine max
  Coding DNA Sequence Number=SeqID_76146
  Homolog annotation: Hit_ID=Q1RTU9; Match level="QueryCoverage=60%, HitCoverage=7%, E-value=6e-24, Identity=70%"; Hit description =DEAD/DEAH box helicase, N-terminal
  Pfam annotation: Domain name=DUF699; Domain location=45-128; Score= -34.0; E_value=3.1e-06; Accession=PF05127.4; Description=Putative ATPase (DUF699)
MTKSSWSKVGSTLDQLTKLVFLSDECHVIVTFLDAILSKTLCGTLALLAGRGCGKSATLGLSIAGAIVVGYSNVFLTAPSPDNLKTLFEFILKGFEALHYKLLLVYAVRDNIIDPVKDEILDSLNFSKK

SEQ ID NO: 192925 - protein, 55 aa, Glycine max
  Coding DNA Sequence Number=SeqID_76147
MATCGMVGQGVKVVLTKALPDWTRRWCYGSRSACRRVDPRSCPRRLGSHRGPRRV

SEQ ID NO: 192926 - protein, 249 aa, Glycine max
  Coding DNA Sequence Number=SeqID_76148
  Gene Ontology: Mol. function=DNA binding; Cellular component =mitochondrion; Biological process=chromosome organization and biogenesis (sensu Eukaryota)
  Homolog annotation: Hit_ID=Q53PX7; Match level="QueryCoverage=56%, HitCoverage=38%, E-value=6e-27, Identity=47%"; Hit description =Expressed protein
  Pfam annotation: Domain name=DUF296; Domain location=6-127; Score =141.3; E_value=2.6e-39; Accession=PF03479.5; Description=Domain of unknown function (DUF296)
TAGGSIIPHVLTVKIGEDLVSTIMSFFDKDPQAICILSATGAVSDVAIRQNGASHVITRLEGTFEILSLSGAFTYANSPTGPVSKTGSLSISLARTDGRVFGGILESALVAACPIQLVMASFKQNISSQQIKRKQLSESSNAPLMLCNSDSERDQLKLLKLTEGGDKSCPSPPPTTTLEPTTATTNGVADNVFTATSNGVVDNVFLQNQSVHSASVNGVADLDSQAPQPASDYSDQMTHADVNASVIVL

SEQ ID NO: 192927 - protein, 338 aa, Glycine max
  Coding DNA Sequence Number=SeqID_76149
  Gene Ontology: Mol. function=pseudouridylate synthase activity; Cellular component=nucleus; Biological process=tRNA processing
  Homolog annotation: Hit_ID=Q5ZBZ5; Match level="QueryCoverage=82%, HitCoverage=37%, E-value=3e-76, Identity=54%"; Hit description =Potential U2 snRNA pseudouridine synthase-like
  Pfam annotation: Domain name=TruD; Domain location=35-331; Score =43.1; E_value=3.5e-12; Accession=PF01142.9; Description=tRNA pseudouridine synthase D (TruD)
MHNFFKENFKFLVTDVVNGPDASSKCIRVRLNSAEPNNKGKNSKKRKERDDKPFDSRGSENWPENVGKFLRFHLYKENKDTHEALGVIGNMLSIQPKSFGFAGTKDKRAVTTQRVTVYKQQASRLASLNKRLFGIKLGDFCFIFVSIALTYFLRGIVADSEDIIKASADALGRHGFINYFGLQKSAIAKARKYYKESSDVVGTLKQLPRYLVAERAVLQTLKTSPGNYLQALKSIPRTLRMLYVHSYQSYLWNHAASKRVQKYGTENVVLGDLVYCKENSTGKVTEFVGSEYAEDCRGRYDSNNEDEVSGEIHEEINSVKVSLLILAHCRGLLYSTDM

SEQ ID NO: 192928 - protein, 111 aa, Glycine max
  Coding DNA Sequence Number=SeqID_76150
  Gene Ontology: Mol. function=binding
MVTKTEETQLNRLENQVDNGGGGAWEYLCLVRKLKVRRSEKVLKHGLSILNDLKQRSSLGSDEWTLYEQVAVAAMDCQCLDVAKLCCGDADDAPEMVAHEFLPGIINLLEP

SEQ ID NO: 192929 - protein, 65 aa, Glycine max
  Coding DNA Sequence Number=SeqID_76151
MATQRSKITEVKRMEKRGHYYGRKRKLGIIGDRRTKVTHSTLMTKCETKKSETKLLPDTKRRGFC

SEQ ID NO: 192930 - protein, 339 aa, Glycine max
  Coding DNA Sequence Number=SeqID_76152
  Homolog annotation: Hit_ID=Q9LUA7; Match level="QueryCoverage=72%, HitCoverage=76%, E-value=5e-19, Identity=27%"; Hit description =Arabidopsis thaliana genomic DNA, chromosome 5, P1 clone:MIF21
  Pfam annotation: Domain name=DUF868; Domain location=48-338; Score =101.8; E_value=2e-27; Accession=PF05910.3; Description=Plant protein of unknown function (DUF868)
MQENHQLVPCPTDCDEDLKELKNKLNRMISGCFSQPNTPSSSNISYSSQVPQNVVTCTYLTQLCNSPTYLTLSWSRTLFSHSLTISATDIFSITISLNSSTFFFRTRHGSKSINNRKIKLHWNFTRAEFIQNSAEPESRFYLAISHNGKLQFFLGDLVRDLTRRHKKLDVKANNVVDPVLVSRREHVFGRRCYVSRAVFMGSKHVIEIECGGGVLGVKVDGETRLVVKRLAWKFRGYEKIFIDGVEVEFYWDVLSWVVNRDSNNGHGVFVFQVGDGTVWPEMVGAEKKLMNKSVSSASSVLQWAEETSECGRTSSSSSTKFSGTNATGFSLLLYAWTFN

SEQ ID NO: 192931 - protein, 330 aa, Glycine max
  Coding DNA Sequence Number=SeqID_76153
  Gene Ontology: Mol. function=protein serine/threonine kinase activity; Cellular component=cytoplasm; Biological process=protein amino acid phosphorylation
  Homolog annotation: Hit_ID=O81637; Match level="QueryCoverage=96%, HitCoverage=50%, E-value=1e-117, Identity=61%"; Hit description =Mitogen activated protein kinase kinase
  Pfam annotation: Domain name=Pkinase; Domain location=9-251; Score =126.2; E_value=9e-35; Accession=PF00069.15; Description=Protein kinase domain
  Pfam annotation: Domain name=Pkinase_Tyr; Domain location=10-251; Score=-36.4; E_value=3.1e-10; Accession=PF07714.7; Description =Protein tyrosine kinase
  Pfam module annotation: Pfam domain module=Pkinase::Pkinase_Tyr; Domain location=9-251::10-251
MNQLQASEFVELDPTARYGRSPEDLERLYCEVHLLKTLKHRSIMKFYTSWVDTANRNINFVTEMFTSGTLRQYRQKHKRVNIRAVKHWCRQILRGLLYLHSRDPPVIHRDLKCDNIFVNGNQGEVKIGDLGLAAIVRKSHAAHCVGTPEFMAPEVYEESYNELVDIYSFGMCVLEMVTFEYPYSECSHPAQIYKKVISEWQDINRILHFQGKKPDALYKVKDPEVRKFVEKCLATVSLRLSARELLDDPFLQIDDYEYDLGPVDSGSFDDLGPLTHQPFFDLHRTYSNMSTEYSNGFEYEGDWYSHPAEIEPSGIDFSSAMTMKPLKMLT

SEQ ID NO: 192932 - protein, 281 aa, Glycine max
  Coding DNA Sequence Number=SeqID_76154
  Gene Ontology: Mol. function=protein serine/threonine kinase activity; Biological process=protein amino acid phosphorylation
  Homolog annotation: Hit_ID=O81637; Match level="QueryCoverage=29%, HitCoverage=12%, E-value=4e-17, Identity=53%"; Hit description =Mitogen activated protein kinase kinase
MVAELDITDQDVTSISDMIDGEIASLVPEWKPGPGIEETNHYLNKIVCHNCVSNQGRKNLQLPQCCRHGCASMHGRFEEITFPSECDNHVRGDAPIKSSQSDCLQYQESWNHHESCELSPVESDQSHSGEQYEQFDKPVLAEDKEGKGIWENKFAHDPGNPPRSLSGNYFSAIRFLCCGPENEYEKEVQQEMRWIKAKHERESRKLRDKLFGIAAKSSHTSNREHKTQQGIMPPLPQTVNGVDHGIHLKPLGNFWNYDSVAVLKSKRTTPIWAPKGPKIVR

SEQ ID NO: 192933 - protein, 59 aa, Glycine max
  Coding DNA Sequence Number=SeqID_76155
AVEVLWTPQNENDTLSERELLEDYPLLRPLIISSSTEIISLKLMRLSCYSICKAIFSCG

SEQ ID NO: 192934 - protein, 89 aa, Glycine max
  Coding DNA Sequence Number=SeqID_76156
MTTGDSTQQKTSQGNEKKKEDENITHVKNKIKGFLSLDLVRGVPPQQERSLRIEIEEELKNITKGEKKKFKNIAQVFVLPIHLKSVKTQ

SEQ ID NO: 192935 - protein, 85 aa, Glycine max
  Coding DNA Sequence Number=SeqID_76157
  Gene Ontology: Mol. function=DNA binding; Cellular component=nucleus; Biological process=regulation of transcription, DNA-dependent
  Homolog annotation: Hit_ID=Q8GZA8; Match level="QueryCoverage=96%, HitCoverage=34%, E-value=7e-12, Identity=42%"; Hit description =Protein ULTRAPETALA1
MLKGKGEEGGRETSGFIAKTKTKFHSGRHLIQNITHTRQMWLTGKTLQCGNKTFTGMSSYVARDVGRSAGSISRAHQTLRTTMML

SEQ ID NO: 192936 - protein, 208 aa, Glycine max
  Coding DNA Sequence Number=SeqID_76158
MAEMGKLDHLEERLRAIEGGEDYAFANLEELFLVPNIITPPKFKVLDFDKYKGDYLPQEPIFKMYCRKMGAYAKDEELLIHPSKKVLLGVDIIASDRMQLQNMCKKKGHGSFKEYAQRWRTWQLKWHLNDEKTMTMIVDTLPVFYYGKWWATHLQSFADLVFASERIDVGLERGKFSHPAWKNEKTGAKEEGEDEGEARAVTAIPIQP

SEQ ID NO: 192937 - protein, 92 aa, Glycine max
  Coding DNA Sequence Number=SeqID_76159
MIPTQAGDQPRHAPAADPEEYMQPPIPQVPMAFDAPPHAVAITDRLERVLNLRMVTADTKLHDIMQDCLTVARGGASADGSVRARQRRRTEH

SEQ ID NO: 192938 - protein, 151 aa, Glycine max
  Coding DNA Sequence Number=SeqID_76160
MGHPTNNEWAKLSFCDSLFRKNLLSDKIPEEVFPENSRKNLLPEEEGGLPEELPEYVMEGRVSEFFPEVGFSGRPPSSSRKRFLEKMNSKMVKTFSGRTLNYRRKLFRKNSCEISDQLIPEVDVATSGRSDSGRDFRNNFFRNFSVVLPKC

SEQ ID NO: 192939 - protein, 50 aa, Glycine max
  Coding DNA Sequence Number=SeqID_76161
MDVIGTRDDVLQWARTVAHENGFVVVIMKSDTDTGSRGRSSFVLIGCERS

SEQ ID NO: 192940 - protein, 415 aa, Glycine max
  Coding DNA Sequence Number=SeqID_76162
  Gene Ontology: Mol. function=galactosyltransferase activity; Cellular component=Golgi stack; Biological process=lipid biosynthetic process
  Homolog annotation: Hit_ID=Q2HUE1; Match level="QueryCoverage=65%, HitCoverage=98%, E-value=3e-89, Identity=53%"; Hit description =Glycosyltransferase sugar-binding region containing DXD motif; Alpha 1,4-glycosyltransferase conserved region
  Pfam annotation: Domain name=Gb3_synth; Domain location=281-412; Score=209.8; E_value=6.2e-60; Accession=PF04572.3; Description=Alpha 1,4-glycosyltransferase conserved region
  Pfam annotation: Domain name=Gly_transf_sug; Domain location=186-278; Score=122.9; E_value=9.2e-34; Accession=PF04488.5; Description =Glycosyltransferase sugar-binding region containing DXD motif
  Pfam module annotation: Pfam domain module=Gb3_synth::Gly_transf_sug; Domain location=281-412::186-278
MLDHKHTKISIFSFITFSAIFYLMLCDYLIYHDSLHPGTLVEVLQHRNGEGIRSTLTLSHTPLRSMQEENEGVGDRNHGVLVAPLNANEEERIAWFRGKLHEFKILNSDKLSRRFHARVLRFFSHECESRFFMIWESPAGSFGARELMSIDSVFKVHPKACLVILSRTLDTIRSYRVLKPILDEGFKVQPVTPDLQFLFKGTPAEAWLNELKKGKKDPGQISLFQNLSNLIRLAVLYKYGGVYLDIDFVVLKPISLLRNSIGAQSMDAGNKHWTRLNNAVLIFDMNHPLLLRFIDEFVLTFDGNRWGHNGPYLVSRVVKRLGEKPGFNFTILPPIAFYPADWKKIGGLFRKPKTRSESKLVDAKLLQLSGESYGVHLWNKESRRLKIEEGSVMERLISNHCVTCKNLGFISPTKL

SEQ ID NO: 192941 - protein, 439 aa, Glycine max
  Coding DNA Sequence Number=SeqID_76163
  Homolog annotation: Hit_ID=Q75HX5; Match level="QueryCoverage=38%, HitCoverage=36%, E-value=5e-63, Identity=72%"; Hit description =Putative tubby protein
  Pfam annotation: Domain name=F-box; Domain location=41-96; Score =19.3; E_value=0.014; Accession=PF00646.23; Description=F-box domain
  Pfam annotation: Domain name=Tub; Domain location=107-354; Score= -24.2; E_value=5.4e-08; Accession=PF01167.8; Description=Tub family
  Pfam module annotation: Pfam domain module=F-box::Tub; Domain location=41-96::107-354
MSLKLSVVPCFFSISFRSSLKEKGGSSVHELQDQPPVIQNSRWASLLLELLRDVINRLEASESTWPGCKHVVACAAMCKSWREMCKEIVSSPEFCGKITFPVSLKQPGHRDGPIQCFIKRDKSKLTYHLFLCLSPVSSTPAVLLVENGKFLLSAKRTRRTTCTKYIISMNADNISRSSSTYIGKLRERMMIKVYGGKKDKWLPLHTLAACGEFYLLDSLLKHNVDINVLKNEDSGPLKESTSLIEHRKWDGLYCLPSEKSEIVSDEYLPTNDPKSNNNINDEAAELVKLTEQSLFLKKRTNQTKPRPIVVRLDDGDVAPISVKRPEPMDDIVLNYKQVGMRTLLKVFSLVGSCWSILPSSSVSSNGYVVLSLLKGKKIKAKSKKDNEFDFFYFVQQWPGAYCDTKQSCCYPKTGKPAIYHILVLEVNCLASTLKVLNLT

SEQ ID NO: 192942 - protein, 121 aa, Glycine max
  Coding DNA Sequence Number=SeqID_76164
MEHTSLATHFDSYSGSPIIKSISLWESDSEHEFQDPWAMIKQIGSIPFAGTERESELASKGSYVEGDFGSHYRNDKSGKRKLTRKESFRRLPGFGLWRCGRFRFPLKFRRLKLRIRGRIFG

SEQ ID NO: 192943 - protein, 124 aa, Glycine max
  Coding DNA Sequence Number=SeqID_76165
MAGFFSAFSVFDTVLARTSHGDCKLNVLSGFRDEEIHLTLETRRFESGIGVKRSGLVRRGREGDGQKKLKISHIIMKSPITTCVIITVTRSRCITSNNNTTIMCSLTANTVMHNTPTTTLDSHS

SEQ ID NO: 192944 - protein, 323 aa, Glycine max
  Coding DNA Sequence Number=SeqID_76166
  Pfam annotation: Domain name=DUF1517; Domain location=88-279; Score= -53.3; E_value=1.4e-08; Accession=PF07466.2; Description=Protein of unknown function (DUF1517)
  Subcellular localization annotation: CTP_CleavageSite=66; ConfidenceScore=5.57e-01
MSITLLLQANPSHLKWNQLPSLPRRTRPDRFTPIPDSKRRVSSVKCISSSRKPDNTFSLQSPWEVLASTVSNTLKALKKPAIAAVLVGLLLMYDPTCAFAASGGRMGGRSFSSSSSSSRSYSVPRTSSSGFSFSAPYYGPSPFGGVYVGPAVGVGVGAGSSFFLILVGFLAFVLVSGFLSDRSEGSVLTAADKTTVLKLQLHGCACVSEPKVTGPCIECSEGLAKTSHSCNDAGRLTSSNPGPTQGTSFSAPYYVPSMLVFGSGCSVIYIGPAIGLRVVCLLPLIKTPFSSFKGGQVGLLGMGRTLQRDLNRIAEVADTSTSE

SEQ ID NO: 192945 - protein, 117 aa, Glycine max
  Coding DNA Sequence Number=SeqID_76167
TLHPGDATEINEEMKARARGDMPGEPRASVLDKSCMFLSLREARLNPSSEHNMASLLSVFSLLREACRVCGWDLEKIQSSSISESLLSGVVWVLQTLAAIVLLKALLQPCVIGHVLG

SEQ ID NO: 192946 - protein, 140 aa, Glycine max
  Coding DNA Sequence Number=SeqID_76168
  Gene Ontology: Mol. function=exonuclease activity; Cellular component= intracellular; Biological process=regulation of transcription, DNA -dependent
  Homolog annotation: Hit_ID=Q9FQ04; Match level="QueryCoverage=64%, HitCoverage=10%, E-value=2e-40, Identity=76%"; Hit description=XRN4
  Pfam annotation: Domain name=XRN_N; Domain location=1-135; Score =44.3; E_value=3.5e-12; Accession=PF03159.8; Description=XRN 5'-3' exonuclease N-terminus
MGVPAFYRWLADRYPLSITDVVEEDPSAGAVDVSKPNPSGMEFDNLYLDMNGIIHPCFHPDGKPAPATYEDVFKSIFDYIDHIFSLVRPRKLLYLAIGMLLLLVIVSLVYGAPSISQYFIVLADDTHGGNKIDTIPLCKQ

SEQ ID NO: 192947 - protein, 278 aa, Glycine max
  Coding DNA Sequence Number=SeqID_76169
  Gene Ontology: Mol. function=exonuclease activity; Cellular component= intracellular; Biological process=regulation of transcription, DNA -dependent
  Homolog annotation: Hit_ID=Q9FQ04; Match level="QueryCoverage=87%, HitCoverage=25%, E-value=1e-116, Identity=82%"; Hit description=XRN4
  Pfam annotation: Domain name=XRN_N; Domain location=1-150; Score =172.8; E_value=8.5e-49; Accession=PF03159.8; Description=XRN 5'-3' exonuclease N-terminus
  Pfam annotation: Domain name=zf-CCHC; Domain location=157-174; Score =28.1; E_value=2.3e-05; Accession=PF00098.13; Description=Zinc knuckle
  Pfam module annotation: Pfam domain module=XRN_N::zf-CCHC; Domain location=1-150::157-174
MNQQRSRRFRAAKDAAEKDAAEAEAEIERLREEFEGEMKLLSSKDKPETYDSNVITPGTPFMGVLSVALQYYIQTRLNYNPGWWNTKVILSDSNVPGEGEHKIMDYIRLQRNLPGFNPNTRHCLYGLDADLIMLSLATHEVHFSILREVITFPGQQEKCFQCGQLGHFAAECRGKPGEKAEDWNPVDDTPIHKKKYQFLNIWVLREYLQYEMEIPNPPFEIDFERIVDDFVFLCFFVGNDFLPHMPTLEIREGALNLLMHIYRKEFTAMGGYLTEAGE

SEQ ID NO: 192948 - protein, 55 aa, Glycine max
  Coding DNA Sequence Number=SeqID_76170
MGDQKGPWPRLVASIALRRDCISSASSLTTYVSVLENFVPIVEDSTMTKGLSPIE

SEQ ID NO: 192949 - protein, 179 aa, Glycine max
  Coding DNA Sequence Number=SeqID_76171
  Gene Ontology: Mol. function=pyridoxal phosphate binding; Cellular component=chloroplast; Biological process=cysteine biosynthetic process from serine
  Homolog annotation: Hit_ID=Q6V3A7; Match level="QueryCoverage=76%, HitCoverage=46%, E-value=4e-41, Identity=64%"; Hit description=O -acetylserine (Thiol)lyase
  Pfam annotation: Domain name=PALP; Domain location=1-143; Score= -50.4; E_value=1.5e-05; Accession=PF00291.15; Description=Pyridoxal -phosphate dependent enzyme
VHYETTGPEIWKGSSGKVDALVSGIGTGGTVTGAGKYLKEQNPDIKLYGIEPVESPILSGGKPGPHKIQGIGAGFIPGVLDVDLLDEVVQISSEEAIETAKLLALKEGLLVGISSGAAAAAAVKIAKRPENAGKLIVGAARTQAPTSTNYDVGSPTWGDLRWAPLLSAMEVTNLGHGPS

SEQ ID NO: 192950 - protein, 256 aa, Glycine max
  Coding DNA Sequence Number=SeqID_76172
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=Q7DLR9; Match level="QueryCoverage=97%, HitCoverage=92%, E-value=1e-110, Identity=76%"; Hit description =Proteasome subunit beta type 4 precursor
  Pfam annotation: Domain name=Proteasome; Domain location=14-200; Score=127.3; E_value=4.3e-35; Accession=PF00227.16; Description =Proteasome A-type and B-type
MERVAESERTLYPYVTGSSVVAIKYKDGILMAADMGGSYGSTLRYKSVERIKPIGKHSLLGASGEISDFQEILRYLDELILYDNMWDDGNSLGPKEVHNYLTRVMYNRRNKFNPLWNALVLGGVKNGQKYLGMVNMIGINFEDNHVATGLGNHLARPILRDEWHENLTFEEGVKLLEKCMRVLLYRDRSAVNKIQNIVIIQTSEISDSSKSQCLTLFQEISKITDEGATVFPPFSLKTYWEFSAFKNPTVGAEGSW

SEQ ID NO: 192951 - protein, 464 aa, Glycine max
  Coding DNA Sequence Number=SeqID_76173
  Gene Ontology: Mol. function=transferase activity; Cellular component= nucleus; Biological process=paclitaxel biosynthetic process
  Homolog annotation: Hit_ID=Q5I2Q5; Match level="QueryCoverage=94%, HitCoverage=94%, E-value=1e-165, Identity=62%"; Hit description =Putative alcohol acyl-transferases
  Pfam annotation: Domain name=Transferase; Domain location=10-445; Score=494.0; E_value=1.7e-145; Accession=PF02458.6; Description =Transferase family
MASSSPSLMFTVRRCQPELVAPATPTPHQLKPLSDIDDQDGFRFQVPIIQIYHNQPSMAGKDPVEVIRQALAKTLVFYYPFAGRLREGPDRKLMVDCTGEGVMFIEADADVTLYQFGGEALQPPFPCFQELLYNVPETEEITNTPLLLIQVTRLRCGGFILATRMNHTMSDGAGLSQFMNTWAEMARGVKSPSIVPVWRRELLMARDPPRITCNHREYEHVPDTKEGTITSSYDNDNNMVHRSFFLGPVEIAALRRLIPHNLKYCTTFDIITACLWRCRTKALQIEADEDVRMMCIVNARARFNPPLPVGYYGNVFAYPAAITTAGKLCGNPFGYAVELINKVKREVTEEYMHSVADLLVIKGRCLFNTVRSYIVSDLSRAKFRNVDFGWGDAVFGGPAKCGAGAFPGVSYFTPGKNAKGEEGIIFAIGLPDEAMERFAKELNDMLRNQNQPQTSGANFIMSSL

SEQ ID NO: 192952 - protein, 851 aa, Glycine max
  Coding DNA Sequence Number=SeqID_76174
  Gene Ontology: Mol. function=protein serine/threonine kinase activity; Cellular component=lysosome; Biological process=protein amino acid phosphorylation
  Homolog annotation: Hit_ID=Q2QX93; Match level="QueryCoverage=91%, HitCoverage=100%, E-value=0.0, Identity=67%"; Hit description=WD repeat domain 48, putative, expressed
  Pfam annotation: Domain name=WD40; Domain location=106-143; Score =27.8; E_value=3.7e-05; Accession=PF00400.22; Description=WD domain, G-beta repeat
  Pfam annotation: Domain name=WD40; Domain location=148-187; Score =33.2; E_value=9.1e-07; Accession=PF00400.22; Description=WD domain, G-beta repeat
  Pfam annotation: Domain name=WD40; Domain location=239-277; Score =25.9; E_value=0.00014; Accession=PF00400.22; Description=WD domain, G-beta repeat
  Pfam annotation: Domain name=WD40; Domain location=281-319; Score =39.5; E_value=1.2e-08; Accession=PF00400.22; Description=WD domain, G-beta repeat
  Pfam annotation: Domain name=WD40; Domain location=323-361; Score =21.9; E_value=0.0023; Accession=PF00400.22; Description=WD domain, G- beta repeat
  Pfam annotation: Domain name=WD40; Domain location=364-400; Score =3.4; E_value=15; Accession=PF00400.22; Description=WD domain, G-beta repeat
  Pfam annotation: Domain name=WD40; Domain location=57-100; Score =14.9; E_value=0.29; Accession=PF00400.22; Description=WD domain, G -beta repeat
  Pfam module annotation: Pfam domain module=WD40::WD40::WD40::WD40::WD4 0::WD40::WD40; Domain location=106-143::148-187::239-277::281 -319::323-361::364-400::57-100
MVKLHLGDWLVGHGFESENFFFAHARVRLFSAMHRVGSASNGNNSTRPRKEKRLTYVLNDSDDSKHCAGINCLALLMSAASDGSDYLFTGSRDGRLKRWALGVDRATCLATFESHVDWVNDAVLVGDSTLVSCSSDTTLKTWNALSFGTCTRTLRQHSDYVTCLAAAEKNNNTVASGGLGGEVFIWDIEAALAPSKCNDAMVDESSNGINGSGNLLPLTSLRTINSSDNMSMHTTQTQGYVPISAKGHKDSVYALTMNESGTILVSGGTEKVVRVWDARSGSKTLKLRGHTDNIRALLLDSSGRYCLSGSSDSMIRLWDIGQQRCVHSYAVHTDSVWALASTPTFSHVYSGGRDFSLYLTDLQTRESSLLCTGEHPILQLALHDDSIWVASTDSSVHRWPAEGCDPQKIFQRGNSFLAGNLSFSRARVSPEGSTPVPVYKEPTLTILGTPAIVQHEVLSNKRHVLTKDASGSVKLWEITKGIVVEDYGKVSFEEKKEELFEMVSIPAWFTVDTRLGSLSVHLDTPQCFSAEMYSADLNIVGKPEDDKVNLARETLKGLLAHWLRKRKQRMGSPAPANGELLSGKETASRSSTHSRIEVDGSSENDAMVYPPFEFSVTSPPSIITEGTHGGPWRKKITDLDGTKDEKDFPWWCLDCVLNNRLPPRENTKCSFYLQPCEGSSVQILTQGKLSAPRILRIHKVVNYVIEKMVLDKPLDSLSAEGSIAPGLTGSQSQHQAVGDGSFRSGFQPWQKLRPSIEILCYNQASNMLSCMQSYDSVYCMVLSPEMSLATVRAYVWKKSDDLVLNYRLVQGRFSCDYVKILLNNNSSWVACIDRCWRAYFCWTWWNRLHLA

SEQ ID NO: 192953 - protein, 134 aa, Glycine max
  Coding DNA Sequence Number=SeqID_76175
  Gene Ontology: Mol. function=transferase activity
  Homolog annotation: Hit_ID=Q5I2Q5; Match level="QueryCoverage=96%, HitCoverage=35%, E-value=9e-39, Identity=49%"; Hit description =Putative alcohol acyl-transferases
MMSDGAGLSQFMNTWAEMARGVKSPSIAPVWRRELLMARDPPRITCNHREFEHVPDTKERIIIPENVLRSFFFGPADIEPEEDVRLMCIVNARARFYPPLPVGYYGNAFPYPAAVTAAGKLCGNPFGYAVESTK

SEQ ID NO: 192954 - protein, 439 aa, Glycine max
  Coding DNA Sequence Number=SeqID_76176
  Gene Ontology: Mol. function=transferase activity; Cellular component= nucleus; Biological process=paclitaxel biosynthetic process
  Homolog annotation: Hit_ID=Q5I2Q5; Match level="QueryCoverage=92%, HitCoverage=92%, E-value=1e-142, Identity=58%"; Hit description =Putative alcohol acyl-transferases
  Pfam annotation: Domain name=Transferase; Domain location=6-414; Score=406.2; E_value=4.9e-119; Accession=PF02458.6; Description =Transferase family
CEGANLSWWLLLAATPTPHQLKPLSDIDDQDGFRFQVPIIQIYHNQPSMAGKDPVEVIRQALAKTLVFYYPFAGRLREGPDRKLMVDCTGEGVMFIEADADVTLYQFGGEALQPPFPCFQELLYNVPETEEITNTPLLLIQVTRLKCDGFILAFRFNHTIGDAGGISQFMNAWSEMARSHATKPSIAPVWRRELLRARDPPRITCSHREYDQLEDTIITPSNDNMVQRSFFFGPTEIAAIRRLVPHHLRQCSTFDLITACFWRCRTKALQMKPDEEVRMMCIINARARFNPPLPVGYYGNAVALPAAVTTAGKLCGNPFGYAVELINKLKREVTEEYMHSVAYLMDLTRARFREVDFGWGDAVYGGVAQAGAGTFPAATYHVSYKNAKGEEGIVLPILLPTESMNRFAKELDHMLGNRNQNQNQNQPTTSSPNFIMSTL

SEQ ID NO: 192955 - protein, 175 aa, Glycine max
  Coding DNA Sequence Number=SeqID_76177
  Gene Ontology: Mol. function=transferase activity; Biological process= paclitaxel biosynthetic process
  Homolog annotation: Hit_ID=Q5I2Q5; Match level="QueryCoverage=79%, HitCoverage=30%, E-value=1e-31, Identity=49%"; Hit description =Putative alcohol acyl-transferases
MESSLLFIFCTVHLPPEKCRELLKATTSNFTHPSRIRSGKQSQRHNDPIKRLQRCFFFGPSEVASLRSLVPKHLGRCTTFEVIIACTWRCRIRALQLDPDDGVRFIYTVNFTTKVNPPLPKGYYGNEFVLSAAVKTSRRLRENPLGYALELAKNVKSNVDEEYVLLDCVANCIRF

SEQ ID NO: 192956 - protein, 229 aa, Glycine max
  Coding DNA Sequence Number=SeqID_76178
MPSLRILNKICYSINQNCKCQYRTISSTAQLQGSWMEKVKNVITGQNSTPQSQGDASESFSLLRFADEMKNAKRIGAFKEFMVGRSSEATFSSAFDKYEAIIRFLGALDPTGENLQTTQKQEAAKHCNCTIADVENALAKFTWAKEAQKKLEKLKEEGKPMPKSFAEVQKLVGSTPLDLARSNLAQAGQISRNALCPCGAAERIEGIQRLNVKLPGSLICYGGFIPTHG

SEQ ID NO: 192957 - protein, 93 aa, Glycine max
  Coding DNA Sequence Number=SeqID_76179
MRCKEVKRLRKGAKSRMAEGTLVQKSNFVKSKQPIPFNKPQNERHLRGDCWVPYNRTPTNSRLDTSNVFIDFVNKQLFIGALRLNPLFGLFRT

SEQ ID NO: 192958 - protein, 66 aa, Glycine max
  Coding DNA Sequence Number=SeqID_76180
  Gene Ontology: Mol. function=magnesium ion binding; Cellular component=membrane; Biological process=photosynthesis, light harvesting
  Homolog annotation: Hit_ID=Q53N81; Match level="QueryCoverage=71%, HitCoverage=20%, E-value=2e-11, Identity=72%"; Hit description =Chlorophyll a/b-binding protein CP26-maize
MESMQTEALLLDGGTLNYFGKPIPINLLVVEIVLVGGDEYYRIINGLVSNIFVTKGRVNVHFGHPK

SEQ ID NO: 192959 - protein, 185 aa, Glycine max
  Coding DNA Sequence Number=SeqID_76181
  Gene Ontology: Mol. function=N-acetyltransferase activity; Biological process=metabolic process
  Homolog annotation: Hit_ID=Q9LJ90; Match level="QueryCoverage=87%, HitCoverage=93%, E-value=2e-47, Identity=57%"; Hit description =Alanine acetyl transferase-like protein
  Pfam annotation: Domain name=Acetyltransf_1; Domain location=61-144; Score=35.3; E_value=2.1e-07; Accession=PF00583.14; Description =Acetyltransferase (GNAT) family
MARVDLSRISLRPFKMSDVDDFLIWAGDDQVTRNLRWKTCGSREEALAFIRDVCIPHPWRRSICLDDRSIGFVSVYPWSGDERCKADIGYAIGTNYWGQGIATKALMTAVPQVFKDFNELLRLQAFVDVENKASQRVLEKAGFLREGVLRKYTYLKGVVKDLTNYTRLRQIPPSDGVVMFNFNPL

SEQ ID NO: 192960 - protein, 66 aa, Glycine max
  Coding DNA Sequence Number=SeqID_76182
MRLLLAFLLEVSRPFGVPSPFCGEVSPMRLLLAFLLEVSLPFANQVSLCYCTVSGREQQKITNGSF

SEQ ID NO: 192961 - protein, 552 aa, Glycine max
  Coding DNA Sequence Number=SeqID_76183
  Gene Ontology: Mol. function=galactose oxidase activity; Biological process=cell wall catabolic process
  Homolog annotation: Hit_ID=Q10NU0; Match level="QueryCoverage=93%, HitCoverage=94%, E-value=1e-162, Identity=55%"; Hit description =Glyoxal oxidase, putative, expressed
  Pfam annotation: Domain name=DUF1929; Domain location=446-551; Score =126.8; E_value=5.9e-35; Accession=PF09118.1; Description=Domain of unknown function (DUF1929)
  Pfam annotation: Domain name=Glyoxal_oxid_N; Domain location=48-292; Score=563.8; E_value=1.7e-166; Accession=PF07250.2; Description =Glyoxal oxidase N-terminus
  Pfam module annotation: Pfam domain module=DUF1929::Glyoxal_oxid_N; Domain location=446-551::48-292
MSTITIMILIPFILASLFPYFEAQTLSSTFANQGQWNLVQPSVGISAMHMQLLHNDKIIMFDRTDFGHSYLPLSNGRCRMDPNDIALKVDCSAHSVLYDVPTNTLRPLMIQTDTWCSSGSVLPNGTLIQTGGYNDGERSIRMFTPCFDETCDWVEFPGLLSQRRWYATNQILPDARVIVVGGRRQFNYEFLPKTPSPNSSPSSIPLNFLQQTSDRSENNLYPFVHLLPDGNLFIFANTKSVLFDYKQNSVIKEFPPIPGGDPRNYPSSGSSVLLPLDENLASLEAEVVVCGGAPRGSFESAARGNFVQALGTCGRIKVTDPNPNWVMENMPMPRAMGDMLLLPNGDVVITNGVGAGTAGWEHGHDPVLTPVLFRPSETVNRFSVMAPASRPRLYHSSAVLLRDGRVLVGGSNPHVFYNFTGVEYPTDLSLEAFSPPYLALDFDPVRPTIRYITNNNVLGYRVFCYVTFTVPNFASASEVSVKIVAPSFTTHSFGQNQRMVVLKLSGVTYLAGEAYYATVVGPSTAEIAPPGYYLLFVVHKGVPSSGSWVQVM

SEQ ID NO: 192962 - protein, 204 aa, Glycine max
  Coding DNA Sequence Number=SeqID_76184
  Gene Ontology: Mol. function=N-acetyltransferase activity; Biological process=metabolic process
  Homolog annotation: Hit_ID=Q9LJ90; Match level="QueryCoverage=67%, HitCoverage=81%, E-value=2e-33, Identity=54%"; Hit description =Alanine acetyl transferase-like protein
  Pfam annotation: Domain name=Acetyltransf_1; Domain location=56-139; Score=47.1; E_value=6e-11; Accession=PF00583.14; Description =Acetyltransferase (GNAT) family
MNLSRITLRPLKLSDVDDFMVVAGDDRVTRYTRWNTFVSREQALTFIRDHQHPWTRAICVDDVTIGYVSVSPGSGDDRCRAEIGCYIATDYWGQGIATEATKIAASQVFKDLPGLVRLQAFVAVENKASQRVLEKAGFLREAILKSSLILIAIIKELVSNLLKYGVGFNWVERKRHEACVDRQHYSLAQKMREQAKEFEASSFL

SEQ ID NO: 192963 - protein, 214 aa, Glycine max
  Coding DNA Sequence Number=SeqID_76185
  Gene Ontology: Mol. function=calcium ion binding; Cellular component =mitochondrion; Biological process=embryonic development ending in seed dormancy
  Homolog annotation: Hit_ID=Q1SMD1; Match level="QueryCoverage=88%, HitCoverage=86%, E-value=1e-18, Identity=28%"; Hit description =Tetratricopeptide-like helical
  Pfam annotation: Domain name=PPR; Domain location=113-147; Score =22.1; E_value=0.0019; Accession=PF01535.11; Description=PPR repeat
  Pfam annotation: Domain name=PPR; Domain location=150-184; Score =35.6; E_value=1.7e-07; Accession=PF01535.11; Description=PPR repeat
  Pfam annotation: Domain name=PPR; Domain location=43-77; Score=11.3; E_value=0.35; Accession=PF01535.11; Description=PPR repeat
  Pfam annotation: Domain name=PPR; Domain location=78-112; Score=7.0; E_value=1.1; Accession=PF01535.11; Description=PPR repeat
  Pfam module annotation: Pfam domain module=PPR::PPR::PPR::PPR; Domain location=113-147::150-184::43-77::78-112
MIPKRLLNNSSSIAHTQPHSLSDAVSLFHRTIDNDPTSPPSEPACSTLIDNLRKARQYDAVVSVYHKMVSALVLPRFTSLSALTESFVNTHHPSFAFSVLSLMTKRGFGVNVYNLNLVLKGFCRSGQCDKAMSLFSQMKRNYDCVVPDCVTYNTLVNGFCKAKRLAEARVLFEAMKKGGDCRPNLVTYSVLIDCYCKSGEVGEGLGLLEEMERE

SEQ ID NO: 192964 - protein, 136 aa, Glycine max
  Coding DNA Sequence Number=SeqID_76186
  Gene Ontology: Mol. function=transferase activity, transferring pentosyl groups; Cellular component=imidazoleglycerol-phosphate synthase complex; Biological process=amino acid biosynthetic process
  Homolog annotation: Hit_ID=Q9SZ30; Match level="QueryCoverage=81%, HitCoverage=18%, E-value=2e-48, Identity=85%"; Hit description =Imidazole glycerol phosphate synthase hisHF, chloroplast precursor (IGP synthase) (ImGP ...
  Homolog annotation: Hit description=synthase) (IGPS) [Includes: Glutamine amidotransferase (EC 2.4.2.-); Cyclase (EC 4.1.3.-)]
  Pfam annotation: Domain name=His_biosynth; Domain location=2-119; Score=-53.8; E_value=3.4e-07; Accession=PF00977.11; Description =Histidine biosynthesis protein
MKIVSHLTSYFLQYFFSYLITYVYCKVNGGREGRPIGAYELAKAVEELGAGEILLNCIDCDGQGKGFDEDLIKLISDAVSIPVIASSGAGAPQHFSEVFYKTNASAALAAGIFHKEEVPIQSVKEHLLKEGIEVGI

SEQ ID NO: 192965 - protein, 66 aa, Glycine max
  Coding DNA Sequence Number=SeqID_76187
MALGMEFKQRDGVKRQRERDGAGHSPTDLLGVGEVGRLRSLSIRCRSVKKAKVRMNSCGSAIKRKM

SEQ ID NO: 192966 - protein, 251 aa, Glycine max
  Coding DNA Sequence Number=SeqID_76188
MEFGGHFNQLPFYGKEMQNHVRLANLKAFFLILRQGILYPDWGEINCQSSTGVNFGLIIVDITLLEFIIVVVTSVVGKIILHLNPDSFYGSHFASLSLNDLTSTLVGRLMSVIGGGSGCVRSRRGNVRLVIKACVKVQNDVASGVEDRVITEKREPTVQQHQGEEDKVVAAEGAYTSIMTRSSQKLEKASNAICLGTGIEVATFVVDVRSVEELSRASAADIGRPSTVNLADLEGEKREKKVWEKERRETS

SEQ ID NO: 192967 - protein, 456 aa, Glycine max
  Coding DNA Sequence Number=SeqID_76189
  Homolog annotation: Hit_ID=Q1ZY19; Match level="QueryCoverage=97%, HitCoverage=85%, E-value=2e-23, Identity=25%"; Hit description =Fgenesh protein 60
  Pfam annotation: Domain name=DUF247; Domain location=26-447; Score =191.6; E_value=1.8e-54; Accession=PF03140.6; Description=Plant protein of unknown function
MDQTQNESGWMHSIKVTLGSLDHREVKSFISSIPCVSSKLRKSNEEAYSPKFVSIGPLYRGTSSHLLAMEEHKWRYMLALLHRTQNPVSTLDECGTVILGLDDAVRASYGGNIKYETHELAKIMLLDGSFLLELLLRCAPPNMVPQIPKEDNHNNGSSSDPILGHKEVFLSILTDFTLLENQMPFFVLKTLARMLFPNVFTSEADHLVADLTLSLFSYPLIRCPSVAHFLHLMHLSSIVDEGQKVKQAQQELKRCATRLRAAGVTIRKVERHSKLVNWFGFDIRFSKGVLEIPPLHVVDTTEVYLRNFIAWEQSRIGINRQFTSYALFLRGLMCSVQDIELLVENGVLVKGTKISNRDLLTLFGTITKGVDQMDNSYSKLCEDLNAYSAVNPLRKFPILMLHCCNLCVECIRYSCKHSYKILIRDHIPNVWKLIGIVVAAALLALTIMQTYYSARG

SEQ ID NO: 192968 - protein, 100 aa, Glycine max
  Coding DNA Sequence Number=SeqID_76190
MEDHGQNQRKRHNVFGAFVDKSLGYPSSGADDHDPKKLKPNSEAPLSTIDQQVPALPLPNILVSAFKENTTDGVKFQLFVSKSYTQSTSTSPPPGQYASL

SEQ ID NO: 192969 - protein, 274 aa, Glycine max
  Coding DNA Sequence Number=SeqID_76191
  Gene Ontology: Mol. function=nucleic acid binding; Cellular component= endoplasmic reticulum membrane; Biological process=DNA integration
  Homolog annotation: Hit_ID=Q1S6N9; Match level="QueryCoverage=90%, HitCoverage=22%, E-value=2e-80, Identity=52%"; Hit description =Integrase, catalytic region; Zinc finger, CCHC-type; Peptidase aspartic, catalytic
MVGLYIKWMSRQKEKVYRLNKALYGLKQAPRSWYSEIDAHLVNLGFVKSPTEFTLYVKKVDNDILVVSLYVDDLFVTGSHDEFIDKFKERVKDAFEMTDLGKMTFFLGMQVQQKHNEIFVYQQKYAKEVLRKFNMEECKPTPTPMNQKKFFCKEDEAEKVDERLYKILIGCLMYLIATRPNIMYVVSLLSSYSDNDWAGCVDDMRSTSGYCFTLGFGMFSWCSKKQEVILQSTAEAKYMTVVAAVLPKNRFEFLRKRFGIRASRSRRSVDCNDP

SEQ ID NO: 192970 - protein, 262 aa, Glycine max
  Coding DNA Sequence Number=SeqID_76192
  Gene Ontology: Mol. function=nucleic acid binding; Biological process= DNA integration
  Homolog annotation: Hit_ID=Q1S6N9; Match level="QueryCoverage=99%, HitCoverage=21%, E-value=4e-70, Identity=51%"; Hit description =Integrase, catalytic region; Zinc finger, CCHC-type; Peptidase aspartic, catalytic
  Pfam annotation: Domain name=zf-CCHC; Domain location=146-163; Score =2.4; E_value=0.4; Accession=PF00098.13; Description=Zinc knuckle
  Pfam annotation: Domain name=zf-CCHC; Domain location=167-184; Score =17.5; E_value=0.0013; Accession=PF00098.13; Description=Zinc knuckle
  Pfam module annotation: Pfam domain module=zf-CCHC::zf-CCHC; Domain location=146-163::167-184
MKLKTASAIWNYLKEEYEEDDWIRNMQVLNLIREFKLQRMKESDTIKDFSDRLLDIANKVRLLDTEFEDSRIVQKIHVTVPEKYEASVTTLENTKDQSQITLLEVLHALKTQEQKKAYEVGRICGGNRPEAFANNKNQNSNTQVHPPCPYCKKTNHPQKKCWWRPDVRCHRCGQLGHVERICKFQQQQEEVKVVEDQSQEEQLFVASCLASSSSTKSWLIDSGCTNHMTYDRELFTELDEAIFSKVKIGNATYIEIKGKGIV

SEQ ID NO: 192971 - protein, 250 aa, Glycine max
  Coding DNA Sequence Number=SeqID_76193
MEDSATTGHHNERKRSCDNNAFAKFVPFSPPLEHDTESIEAKFGGHHDHGQKRLKPNSQAPLLETTTNFSPSSHLPNQNIDTKETPDFPSPSTSFKHSDNVGPSPQSIGSKSSHIEYVENDGKISKTVSDSCNWKEDQNQSELESMISMAAEELSRRPKTGGIYKEIANQRECTVKRLKDLSNKEPTIDVGLEMADAAHLLKLMSFSSNEIEMAGQKGHKGAKLLLQAEILRKKGQELIAECQNLLQNAL

SEQ ID NO: 192972 - protein, 108 aa, Glycine max
  Coding DNA Sequence Number=SeqID_76194
MATKELNEEQLEAPVEEVVTDVEGFPDGPHDTSVLRDFENHITLRVCNGEERPELKLSSHGRKMAKFERPTSEIEDLVATSGLNPLIVCSLDTGVSPLGNCEIYQQVY

SEQ ID NO: 192973 - protein, 105 aa, Glycine max
  Coding DNA Sequence Number=SeqID_76195
MSTRDNPGSVGCGEIFRNFTGSAIGCFTASLGIQNSFVEIMGGAIFAIELATSKDFTKSMNSLVGHKQEPRVRAKLNLLRELKLKLHSNEIKILVPLKSEDEDHE

SEQ ID NO: 192974 - protein, 260 aa, Glycine max
  Coding DNA Sequence Number=SeqID_76196
  Gene Ontology: Mol. function=amino acid transporter activity; Cellular component=integral to membrane; Biological process=auxin mediated signaling pathway
  Homolog annotation: Hit_ID=Q9FEL7; Match level="QueryCoverage=98%, HitCoverage=52%, E-value=1e-129, Identity=86%"; Hit description =Auxin transporter-like protein 2
  Pfam annotation: Domain name=Aa_trans; Domain location=51-260; Score=- 63.2; E_value=3.4e-05; Accession=PF01490.8; Description=Transmembrane amino acid transporter protein
METMLPPNQAEEAIVTTSLNETESEVGMREEEKELQQQDHSMFNIKSFLWHGGSVWDAWFSCASNQVAQVLLTLPYSFSQLGMLSGILLQIFYGILGSWTAYLISVLYMEYRTRKEKENVSFKNHVIQWFEVLDGLLGPYWKAVGLAFNCTFLLFGSVIQLIACASNIYYINDHLDKRTWTYIFGACCATSVFIPSFHNYRIWSFLGLGMTTYTAWYLAIAALIHGQAENVTHTGPTKLVLYFTGATNILYTFGGHAVTV

SEQ ID NO: 192975 - protein, 763 aa, Glycine max
  Coding DNA Sequence Number=SeqID_76197
  Gene Ontology: Mol. function=RNA-directed DNA polymerase activity; Cellular component=chromatin; Biological process=chromatin assembly or disassembly
  Pfam annotation: Domain name=rve; Domain location=437-568; Score =53.9; E_value=5.4e-13; Accession=PF00665.16; Description=Integrase core domain
  Pfam annotation: Domain name=zf-H2C2; Domain location=378-419; Score =12.2; E_value=0.0087; Accession=PF09337.1; Description=His(2)-Cys(2) zinc finger
  Pfam module annotation: Pfam domain module=rve::zf-H2C2; Domain location=437-568::378-419
MALEDVNKTAFRTHHDHYKFLVMPFGLCNAPSSFQETMNTIFGPHLWKFVIFFFDDILVYSRTFSDHLEHLRQTFQTLADNSFVLKLSKCSFATQQVEYLDHLVSQGDIEPVLEKVAAVQQWPPPQLVRQLRGYATLAAPFTTLLTKDQFQWTSEAATTFSKLKEALCQAPVLGLPDFSVSFVIKTGASGIGMRAVLSQHHHHHPLAFFSKTFCSKLLRASTYVRELVAIMAAVKKWRQYLLGHHFIILTDHKSLKELMAQAVQTLEQQVYLTRLMGYDYTIHYRAGKHNLAADALSRLPDPPQGQSFMLTIPNCVFLQKLKAELASNKEFLTRKKQIQEKPHNHPECVLRDDLILQHGRIWLPRGLQILQTILAEFHSTPTGGHMGIMKTLVKVHENFTWASMKQDIHHYITNCITCQQIKVDHRRPAGLLCPLPIPARPWEDLSLDFITSLPIYRGNSVILVIVDRFSKGIHLGPLPQHHTASDVAQLFMEISGKFHGMPHSLVSDKDPLFVSRFWQELFKMSGTKLRMSSAYHPQFDEQTEAMNRWSYNTSTHSATGKTPYEITFGKQPPSLPQYLEGSSNVNVVDEWLTQRDEIFASLAKKLAKAQLRMKEFADQWRQDVSYEEGDTVLVKLRPRRQTSATGGTYSKLAKRYYGPFKIVKKISSVGYQLNLPPTSRIHPVFHYSLHKPYHPSDIEVPPNLPASSEGNEPLITPLEILDAKWEETPTSNNSYNLEDKVVLEAYGDVMNAEPTPRIEQHKE

SEQ ID NO: 192976 - protein, 290 aa, Glycine max
  Coding DNA Sequence Number=SeqID_76198
  Gene Ontology: Mol. function=chromatin binding; Cellular component =chromatin; Biological process=chromatin assembly or disassembly
MPMPEAPVLITNDTEKSGKPRTGAWHRASFSLEKVVAASDPESPKKPRSCLTNCGGGHCCTAATFSSTAVVGKGLKGLTQVFQVIGEGPAINQNIIEEEDNEFPQGPVVNAEAPRAIPFLDKKNWGRERACIGTNDAILKHRVDLGFNFLFLEVGIAVGSDINGGGVREKVNGMIGGSGRGKVCWRLKEGGKEVDDGEHSGVGGLGGRGLRAHPDVEKFIGTACLEEMPELGSADGPIGLRRRCRPRTKGGHAKRLDEVFLHKVVCAASVNQNDDTVVRNPASDAECFRC

SEQ ID NO: 192977 - protein, 637 aa, Glycine max
  Coding DNA Sequence Number=SeqID_76199
  Gene Ontology: Mol. function=protein serine/threonine kinase activity; Cellular component=lysosome; Biological process=protein amino acid phosphorylation
  Homolog annotation: Hit_ID=Q2QX93; Match level="QueryCoverage=99%, HitCoverage=83%, E-value=0.0, Identity=70%"; Hit description=WD repeat domain 48, putative, expressed
  Pfam annotation: Domain name=WD40; Domain location=116-155; Score =31.5; E_value=2.9e-06; Accession=PF00400.22; Description=WD domain, G-beta repeat
  Pfam annotation: Domain name=WD40; Domain location=208-246; Score =26.4; E_value=0.0001; Accession=PF00400.22; Description=WD domain, G- beta repeat
  Pfam annotation: Domain name=WD40; Domain location=25-68; Score=15.2; E_value=0.24; Accession=PF00400.22; Description=WD domain, G-beta repeat
  Pfam annotation: Domain name=WD40; Domain location=250-288; Score =39.5; E_value=1.2e-08; Accession=PF00400.22; Description=WD domain, G-beta repeat
  Pfam annotation: Domain name=WD40; Domain location=292-330; Score =21.9; E_value=0.0023; Accession=PF00400.22; Description=WD domain, G- beta repeat
  Pfam annotation: Domain name=WD40; Domain location=333-369; Score =3.4; E_value=15; Accession=PF00400.22; Description=WD domain, G-beta repeat
  Pfam annotation: Domain name=WD40; Domain location=74-111; Score =22.3; E_value=0.0017; Accession=PF00400.22; Description=WD domain, G- beta repeat
  Pfam module annotation: Pfam domain module=WD40::WD40::WD40::WD40::WD4 0::WD40::WD40; Domain location=116-155::208-246::25-68::250-288::292 -330::333-369::74-111
MHRVGSASNGNNSTRPRKEKRITYVLNDSDDTKHCAGINCLALLTSAASDGSDYLFTGSRDGRLKRWALDVNRATSSATFESHVDWVNDAVLVGDSTLVSCSSDTTLKTWNALSFGTCTRTLRQHFDYVTCLAAAGKNSNIVASGGLGGEVFIWDIEAAITPVSKCNDATIDESSNGINGSGNLLPLTSLRPINSSNNMSMHTTQTQGYIPIAAKGHKDSVYALAMNESGTILVSGGTEKVVRVWDARSGSKTLKLRGHTDNIRALLLDSSGRYCLSGSSDSMIRLWDIGQQRCVHSYAVHTDSVWALASTPTFSHVYSGGRDFSLYLTDLQTRESSLLCTGEHPILQLALHDDSIWVASTDSSVHRWPAEGYDPQKIFQRGNSFLAGNLSFSRARVSIEGSTPVPVYKEPTLTILGTPAIVQHEVLNNKRHVLTKDASDSVKLWEITKGVVIEDYGKVSFEEKKEELFEMVSIPAWFTVDTRLGSLSVHLDTPQCFSAEMYSADLNIVGKPEDDKINLARETLKGLLAHWLRKRKQRMESPAPANGELLSGKDISSRSLAHSRIEVDGSSENDAMVYPPFEFSVTSPPSIITEGTHGGPWRKKITDLDGTKDEKDFPWWCLDCVLNNRLPPRENTK

SEQ ID NO: 192978 - protein, 94 aa, Glycine max
  Coding DNA Sequence Number=SeqID_76200
  Gene Ontology: Mol. function=double-stranded RNA binding; Cellular component=intracellular
  Homolog annotation: Hit_ID=Q1SYE6; Match level="QueryCoverage=86%, HitCoverage=16%, E-value=2e-38, Identity=93%"; Hit description =Double-stranded RNA binding
  Pfam annotation: Domain name=dsrm; Domain location=2-68; Score=67.8; E_value=3.5e-17; Accession=PF00035.15; Description=Double-stranded RNA binding motif
MYKNRLQELAQRSCFNLPAYSCIREGPDHAPRFKATVNFNGETFESPTFCSTLRQAEHAAAEVALNTIAKRGPSGALAARVLVSKWEFFIIPLS

SEQ ID NO: 192979 - protein, 153 aa, Glycine max
  Coding DNA Sequence Number=SeqID_76201
  Gene Ontology: Mol. function=acyltransferase activity; Cellular component=plastoglobule; Biological process=metabolic process
  Homolog annotation: Hit_ID=Q1SYE9; Match level="QueryCoverage=85%, HitCoverage=18%, E-value=4e-56, Identity=75%"; Hit description =Esterase/lipase/thioesterase; Phospholipid/glycerol acyltransferase
MKIAGVGERNEKKIAAILGAMVKELVLDYNDLMKIPIVNDQIRNMNRDSVKFRDETSGEVANQNLSFPVLLPKIPGRFYFLFGKPIRTKGMDKMLKDRESANQMYLQIKSEVEHNLNYLIKKREEDPYRNFIDRKMYQIFYPPETDSTPSFNP

SEQ ID NO: 192980 - protein, 45 aa, Glycine max
  Coding DNA Sequence Number=SeqID_76202
MTNKSPRTAAPGLALKRIRKHALCYTNTQCRGLYVTVDIGINYEH

SEQ ID NO: 192981 - protein, 382 aa, Glycine max
  Coding DNA Sequence Number=SeqID_76203
  Gene Ontology: Mol. function=double-stranded RNA binding; Cellular component=intracellular
  Homolog annotation: Hit_ID=Q1SYE6; Match level="QueryCoverage=88%, HitCoverage=63%, E-value=1e-84, Identity=54%"; Hit description =Double-stranded RNA binding
SEHHLSSSTSSSFSRESKANEEQEQVIIAGVLASLHPSGSKNFSTSDSQLGWQKSTTTSLVSTQSTADLYPMQWHCGISSFSPEVALYQTWQQQQIMQQQNRLLELTIQPIIPSTPEIYPLMQSVFQPDHCLYFPARELASVPLGPKLSIATSNPSFYSSNQIVPELNTGRSTLTIREIQEEKTEDPPVCTFSNETRVLTPAPEDEIQKHGGSGGRSRNAELVGEHCEKTECDSHWSTRSVIRPVNTELQNPSSIDSSVLRAHSQASSNRSFRPPAAASSSIVRTMCPTSSVGSRPQHAASRLRTGTPRSPGIPTSERFGMIRAPTPLFMAPAVRIRSVVPVCSAPPRRSMAEVSQSKEKEDLKPEDKEVSRTSSELGHLRI

SEQ ID NO: 192982 - protein, 122 aa, Glycine max
  Coding DNA Sequence Number=SeqID_76204
MKSLFLVTPAVRLCLLMRRNPARQPYRHPSELLRHPQGPLRVMPVSQNWAPNSGCAYCTGRILIVEARGLTPPLAKLIVLAFLQDQWMPQKLVNGILIEGIHWPLTQECLSLTPSFVGHALA

SEQ ID NO: 192983 - protein, 148 aa, Glycine max
  Coding DNA Sequence Number=SeqID_76205
MRHSTGTICTTRVRSPILRHRHDPQRPLGMTEELRRMTIWLTCWISSHKEAKSHSRELAEAHDQSRKSQGLAGLLRVHWVSRRGYIYLGLTENKRGYISCGSVLVEGTSTRLFKENKGGYIPCGSLLLKGFLQGWKRNLKDHRSLGDW

SEQ ID NO: 192984 - protein, 117 aa, Glycine max
  Coding DNA Sequence Number=SeqID_76206
MEGLASHYHERLYTLGVDGNRRRRGMNKGREGKNGSRKRPCFLTLSVLCPLSLCIVLSSWDADISTDIKLRISSRLERSPERLLCERFDVSNRFNSLSMGGIIPLKISPEVKTLEML

SEQ ID NO: 192985 - protein, 47 aa, Glycine max
  Coding DNA Sequence Number=SeqID_76207
METIASLNKCLLDESPRSRPTMEQVSKELAILKLMQSYPLRALDRRL

SEQ ID NO: 192986 - protein, 185 aa, Glycine max
  Coding DNA Sequence Number=SeqID_76208
  Gene Ontology: Mol. function=malate transporter activity; Biological process=response to aluminum ion
  Homolog annotation: Hit_ID=Q14UU8; Match level="QueryCoverage=90%, HitCoverage=33%, E-value=3e-39, Identity=50%"; Hit description =Putative aluminum activated malate transporter
  Pfam annotation: Domain name=UPF0005; Domain location=1-183; Score =81.6; E_value=2.4e-21; Accession=PF01027.11; Description =Uncharacterised protein family UPF0005
ATLGKGLNRTIATLAAGALGVGAHYLASLSGATGEPILIGAFVFVQAAIASFIRFFPKVKARYDYGMLIFILTFSLISVSGFREVEVLEMAHKRLSTIFIGGSACVMISIFVCPVWAGEEFHYSIAHKLEILGDFLEAFVRVYFKISKEGESEDNKGDSKDKSFLEGYKKVLNSKSVDDSLVSVL

SEQ ID NO: 192987 - protein, 86 aa, Glycine max
  Coding DNA Sequence Number=SeqID_76209
MENRVNKVQQAKRSRNKEKKEENQKKPKSSKTLSARYAQRARRQGAKRMIRAERVVALSARLRAQRDYEGPKPNFAPINKRVSLGK

SEQ ID NO: 192988 - protein, 100 aa, Glycine max
  Coding DNA Sequence Number=SeqID_76210
  Gene Ontology: Mol. function=protein dimerization activity
  Homolog annotation: Hit_ID=Q2R1C3; Match level="QueryCoverage=96%, HitCoverage=16%, E-value=8e-21, Identity=40%"; Hit description=HAT family dimerisation domain containing protein
MVKMFFSSRLPFHLARNPCYREAFSYATNTSNISGYKPPGVTIVSDGWSDPQRRPLINFMVITESGPMFLKAIHCSSDVKDKDFIAQHIKDAIMEVGSSW

SEQ ID NO: 192989 - protein, 176 aa, Glycine max
  Coding DNA Sequence Number=SeqID_76211
  Gene Ontology: Mol. function=protein dimerization activity; Biological process=electron transport
  Homolog annotation: Hit_ID=Q2R1C3; Match level="QueryCoverage=92%, HitCoverage=23%, E-value=4e-43, Identity=48%"; Hit description=HAT family dimerisation domain containing protein
  Pfam annotation: Domain name=DUF659; Domain location=67-175; Score= -32.2; E_value=9.3e-05; Accession=PF04937.6; Description=Protein of unknown function (DUF 659)
MQDGAPLKVPRPLEKGFNLQGRDGLDARIARMFFSLGLPFHLARNPYYREAFSYATNTPNLSGYKPPSYNKLRTTLLTTERSHVENLLQPIRNLWNQKGVTIVSDRWSNPQGRPLINFMAITKSGPIFLKAVNCFGDIKDKDFISQQIKDAIMKVGSSNVCKAASMIIENEFHVIY

SEQ ID NO: 192990 - protein, 101 aa, Glycine max
  Coding DNA Sequence Number=SeqID_76212
MRGRCTMYPYVMIALNCHPHDFVRSSRPRRIDGSDWAQCLKFEVLHAASEAFGSLVGNDKEKKKMVGHVQLCVLGWPTVSDNDGCTLHRVTRETIPHPFPV

SEQ ID NO: 192991 - protein, 316 aa, Glycine max
  Coding DNA Sequence Number=SeqID_76213
  Gene Ontology: Mol. function=double-stranded RNA binding; Cellular component=intracellular
  Homolog annotation: Hit_ID=Q5YDB5; Match level="QueryCoverage=80%, HitCoverage=32%, E-value=8e-93, Identity=64%"; Hit description=C -terminal domain phosphatase-like 2
MSRLGFKHEVYDGDKHIGELDVIPPSSLTTTTSFHNNFRFPNNEIRIHHFSAKSERCPPLSILQTVAAFNVRCKLDSSVATEQKELIAIHASCFYEMKTAVVVVNDEEIHLVSMPSKRKKFPCFWCFAVPLGLYDACLGMLNLRCLAIVFDLDETLIVANTMKSFEDRIEALRGWLSRETDPLRVQGMSSELKRYLEDRLLLKQYAESDTVVDNGKVYKVQMEEAPPLSGSHEKLVRPVVRLQERNIVLTRINPELHLASDCGLHWAASEHNATAISNLLKNERGAGESSKSSGIIVRKPLLYSFMGRTITLLCGE

SEQ ID NO: 192992 - protein, 363 aa, Glycine max
  Coding DNA Sequence Number=SeqID_76214
  Gene Ontology: Mol. function=double-stranded RNA binding; Cellular component=intracellular
  Homolog annotation: Hit_ID=Q5YDB5; Match level="QueryCoverage=93%, HitCoverage=43%, E-value=2e-75, Identity=48%"; Hit description=C -terminal domain phosphatase-like 2
MAERDYALEIWRLLDPGAHLIGLKQVLNRVICVKSGSRKSLLNVFQDGVCHPKMAMVIDDRSKVWVDKDQPRVHVVPAFTPYYAPQAEVQTANAVPVLCVARNVACNVRGCFFKEFDESLLQRIAEIFFEDDIGLLPHPPDVSNYLMSEDVPNGNANAPFSEGMNGAEVERRLSQPDDKFSVDLSTRPMTNSVEFRHETSQPTAEPGLLGPPVKHDGNSVDRDYDMRKGLLGMRHGPDIRGQISAEPPLILRPPNQASPSLMQPFGGGLVEDDIASRSQTNSWPSASVKESNVIKSDKHQAQQKPFSNSVIGSSPNVLLPQASQLKAEEATSVSDLQRQIVPSKSQLSSVLMYCLKDQVLNQK

SEQ ID NO: 192993 - protein, 238 aa, Glycine max
  Coding DNA Sequence Number=SeqID_76215
  Gene Ontology: Mol. function=carbohydrate binding; Biological process= carbohydrate metabolic process
  Homolog annotation: Hit_ID=Q1SPM1; Match level="QueryCoverage=81%, HitCoverage=38%, E-value=5e-48, Identity=50%"; Hit description =Glycoside hydrolase, starch-binding
  Pfam annotation: Domain name=CBM_20; Domain location=87-177; Score =18.9; E_value=1.6e-06; Accession=PF00686.10; Description=Starch binding domain
MALNTSCSMAIVDMLGTHVPKCAIHVSNTPKFSLSQLNDKKGCNLGFPKLVQNNKGLFPLHAVPSKTMVDLDNLVLQSQEQPMESKTINVKFQLQRNCNFGEEFLVVGNDPMFGSWNPENAIPMTWSEGHVWTAEMGVPVGKFQFKIILKTREGEIVWQPGPDRNLHTWEAMNRITVCEDWDNAEQQKVTEDDGVPNIKEEDQLANTNKEFQMESEMPNFAENLGNSKEKLKSILIKC

SEQ ID NO: 192994 - protein, 190 aa, Glycine max
  Coding DNA Sequence Number=SeqID_76216
  Gene Ontology: Mol. function=double-stranded RNA binding; Cellular component=intracellular
  Homolog annotation: Hit_ID=Q5YDB5; Match level="QueryCoverage=78%, HitCoverage=18%, E-value=3e-37, Identity=56%"; Hit description=C -terminal domain phosphatase-like 2
  Pfam annotation: Domain name=dsrm; Domain location=29-92; Score=55.4; E_value=1.9e-13; Accession=PF00035.15; Description=Double-stranded RNA binding motif
YGISQNHASSNSKDFQHEAGKMNFLSPLSIQVLQEIGRRCNSKVEFKSILSTSKDLQFSVEVLFTGEKIGVGMGRTRKDAQQQAAENALRSLAEKYVAHVEPQCRAVDKDFDKLSLGCDNGFLWDVINPESSEPQPEDGVSRENASEEIGDAWIRGMWTRNSRWKWLYREITLFMELCSINVKAKSLNGE

SEQ ID NO: 192995 - protein, 1024 aa, Glycine max
  Coding DNA Sequence Number=SeqID_76217
  Gene Ontology: Mol. function=protein serine/threonine kinase activity; Cellular component=integral to membrane; Biological process=protein amino acid phosphorylation
  Homolog annotation: Hit_ID=Q9SD62; Match level="QueryCoverage=95%, HitCoverage=95%, E-value=0.0, Identity=43%"; Hit description =Receptor protein kinase-like protein
  Pfam annotation: Domain name=LRRNT_2; Domain location=39-79; Score =55.3; E_value=2e-13; Accession=PF08263.3; Description=Leucine rich repeat N-terminal domain
  Pfam annotation: Domain name=LRR_1; Domain location=109-131; Score =3.4; E_value=66; Accession=PF00560.23; Description=Leucine Rich Repeat
  Pfam annotation: Domain name=LRR_1; Domain location=133-155; Score =9.2; E_value=5.3; Accession=PF00560.23; Description=Leucine Rich Repeat
  Pfam annotation: Domain name=LRR_1; Domain location=157-179; Score =10.1; E_value=3.7; Accession=PF00560.23; Description=Leucine Rich Repeat
  Pfam annotation: Domain name=LRR_1; Domain location=181-203; Score =3.0; E_value=77; Accession=PF00560.23; Description=Leucine Rich Repeat
  Pfam annotation: Domain name=LRR_1; Domain location=205-227; Score =13.0; E_value=1; Accession=PF00560.23; Description=Leucine Rich Repeat
  Pfam annotation: Domain name=LRR_1; Domain location=229-252; Score =1.1; E_value=1.7e+02; Accession=PF00560.23; Description=Leucine Rich Repeat
  Pfam annotation: Domain name=LRR_1; Domain location=278-300; Score =15.2; E_value=0.24; Accession=PF00560.23; Description=Leucine Rich Repeat
  Pfam annotation: Domain name=LRR_1; Domain location=302-327; Score =7.0; E_value=14; Accession=PF00560.23; Description=Leucine Rich Repeat
  Pfam annotation: Domain name=LRR_1; Domain location=332-354; Score =6.4; E_value=18; Accession=PF00560.23; Description=Leucine Rich Repeat
  Pfam annotation: Domain name=LRR_1; Domain location=357-379; Score =6.8; E_value=15; Accession=PF00560.23; Description=Leucine Rich Repeat
  Pfam annotation: Domain name=LRR_1; Domain location=381-403; Score =7.8; E_value=9.9; Accession=PF00560.23; Description=Leucine Rich Repeat
  Pfam annotation: Domain name=LRR_1; Domain location=405-427; Score =14.4; E_value=0.43; Accession=PF00560.23; Description=Leucine Rich Repeat
  Pfam annotation: Domain name=LRR_1; Domain location=429-451; Score =10.4; E_value=3.2; Accession=PF00560.23; Description=Leucine Rich Repeat
  Pfam annotation: Domain name=LRR_1; Domain location=453-475; Score =10.7; E_value=2.8; Accession=PF00560.23; Description=Leucine Rich Repeat
  Pfam annotation: Domain name=LRR_1; Domain location=478-500; Score =3.3; E_value=69; Accession=PF00560.23; Description=Leucine Rich Repeat
  Pfam annotation: Domain name=LRR_1; Domain location=502-524; Score =14.9; E_value=0.29; Accession=PF00560.23; Description=Leucine Rich Repeat
  Pfam annotation: Domain name=LRR_1; Domain location=526-548; Score =15.0; E_value=0.27; Accession=PF00560.23; Description=Leucine Rich Repeat
  Pfam annotation: Domain name=LRR_1; Domain location=550-572; Score =11.3; E_value=2.2; Accession=PF00560.23; Description=Leucine Rich Repeat
  Pfam annotation: Domain name=LRR_1; Domain location=574-597; Score =16.3; E_value=0.11; Accession=PF00560.23; Description=Leucine Rich Repeat
  Pfam annotation: Domain name=LRR_1; Domain location=85-107; Score =2.2; E_value=1.1e+02; Accession=PF00560.23; Description=Leucine Rich Repeat
  Pfam annotation: Domain name=Pkinase; Domain location=695-1016; Score= 133.3; E_value=6.7e-37; Accession=PF00069.15; Description=Protein kinase domain
  Pfam annotation: Domain name=Pkinase_Tyr; Domain location=695-1009; Score=72.5; E_value=1.3e-18; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::Pkinase::Pkinase _Tyr; ...
  Pfam module annotation: Pfam domain module=Domain location=39-79::109- 131::133-155::157-179::181-203::205-227::229-252::278-300::302 -327::332-354::357-379::381-403::405-427::429-451::453-475::478 -500::502-524::526-548::...
  Pfam module annotation: =550-572::574-597::85-107::695-1016::695-1009
MNHPCANSKSLLLQVLNGCLLLCMILIKDSAIAAIPTGNETDLQALVHFKSKIVEDPFNTMSSWNGSINHCNWIGITCSNISNGRVTHLSLEQLRLGGTLTPFIGNLTFLTTVNLLNNSFHGEFPQEVGRLLYLQYLNFSINNFGGSFPSNLSHCTNLRVLAAGLNNLTGTIPTWIGNLSSLSRVSFGLNNFIGRIPHEVGLLSSLTSLVLYGNYLTGTVPSSIYNISSLYYFTFTQNHLHGTLPADVGFTLPNIQVFAGAVNNLTGSVPASLLNASKLEILDFSLNGLTGTLPKNLGVLYRLTRLSFEHNRLGTGKTDDLSFLDSLVNCTALQVLRLGVNNFGGVLPKSIANFSSQLHTFALNSNRIHGNIPAGIGNLANLALIGLEGNELTSSVPDALGRLQNLQLLYLNVNKFSGRIPSSLGNLSLITKLFLEENNFEGSIPSSLGNCQKLLVLSLYSNKLSGTIPTEVIGLSSLAIYFDVSYNALSGTLPVEVSKLRNLAELVLSENNFSGVIPSSLGSCISLEKLHLQGNSFEGNIPQTIKDLRGLLDIDLSRNNLSGKIPEFLGGFTELKHLNLSYNNFEGEIPKNGIFKNATSISLYGNIKLCGGVSELNFPPCTIRKRKASRLRKLVASKVAIPIAIALILLLLLSCFLTLFPIVKRAKRKTPTSTTGNALDLEISYSEITKCTGGFSQDNLIGSGSFGSVYKGTLSGDGSIVAVKVLNLQQRGASRSFIDECHVLRSIRHRNLLKIITAISGVDHQGNDFKALVFEYMPNGSLEDWLHPVNNVQTQTKKLTFIQRLNIAIDVACALEYLHHFCETPIVHCDIKPSNVLLDNDLVAHVGDFGLATFLFEESSKFSTQSVISASLRGSIGYIPPEYGMGGKPSTLGDVYSYGILLLEIFTGKRPTDEEAFEGGMGIHQFVAMALPNRVTDIVDPSLVSEQDFDEENQEFEDEEKAIRKNYEIEASAKGLMEDCFVSLMEIGASCSANPPSERMPITVVINKLHAIKNSFKKIKHSAI

SEQ ID NO: 192996 - protein, 110 aa, Glycine max
  Coding DNA Sequence Number=SeqID_76218
MAWYNQSLVSTHYPILRVPLHMSPIEALRAQTGFLEEEEDHRHEERVASSRTGFWELSGEREDEDYKGNTKTFWKALDAETRSSTPNAINQQMDKRMSSPRMPNSKRLKE

SEQ ID NO: 192997 - protein, 100 aa, Glycine max
  Coding DNA Sequence Number=SeqID_76219
  Gene Ontology: Mol. function=protein kinase activity; Cellular component=integral to membrane; Biological process=protein amino acid phosphorylation
  Homolog annotation: Hit_ID=Q2QM26; Match level="QueryCoverage=64%, HitCoverage=7%, E-value=4e-13, Identity=54%"; Hit description =Leucine Rich Repeat family protein
MVLLDNNMVAHVGDFGLAIFLFEESNGSPQQSTMSKYGMGGQPLALEDSYSYGILLLEIFTGKRPTDEAFEEFDDRDEEFWAKEKAMLRENEPEVIECCK

SEQ ID NO: 192998 - protein, 138 aa, Glycine max
  Coding DNA Sequence Number=SeqID_76220
MLGVGKITHEIFTLHNGLVGLAFRLNIDRTYRDMLGAPSNLLNGPFCPSFKNLKSCSSFGRTTFVLLCAASFLLPHKPRASSSPRARLLLLVGSDVICLREDAGKNGESSVTVAFSGRTVKASSRTSGTLLPESFRKK

SEQ ID NO: 192999 - protein, 297 aa, Glycine max
  Coding DNA Sequence Number=SeqID_76221
  Homolog annotation: Hit_ID=Q1SVS0; Match level="QueryCoverage=52%, HitCoverage=15%, E-value=5e-45, Identity=62%"; Hit description =Bromodomain
MASGPIVGDDGAKEKQRYTESKVYISKAFKGPKNKGNAFSTVNAVPPPTAAATTNGGDNGSATATAVDYNKDNSTVNNGDVRAKDNSNNASVLPVPVPVPEDGNSARPQVNSRLDVISDDSSSLNRPRDEPLSVPGVRERSPGPENCVRISLASRSKQEKRELRRRLQGELIRVRSLVNGIEEKLGVLGGYGNSDRMVDRGIGNGIGAKRAHSEVASAVVTLREPTRPLHQLSVSVLENSQGVGEIVEKEKRTPKANQFYRNSEFLLAKDKFPPAESNKKSKLNGKKHGTGEMGHGM

SEQ ID NO: 193000 - protein, 45 aa, Glycine max
  Coding DNA Sequence Number=SeqID_76222
MDRSMLISGFWLSACFSHLADGLKCRGVLRSADGSLSQKIGLARG

SEQ ID NO: 193001 - protein, 377 aa, Glycine max
  Coding DNA Sequence Number=SeqID_76223
  Gene Ontology: Mol. function=translation elongation factor activity; Cellular component=intracellular; Biological process=translational elongation
  Homolog annotation: Hit_ID=UPI00005F742B; Match level="QueryCoverage =99%, HitCoverage=53%, E-value=0.0, Identity=84%"; Hit description =COG0480: Translation elongation factors (GTPases)
  Pfam annotation: Domain name=EFG_C; Domain location=284-371; Score =166.8; E_value=5.4e-47; Accession=PF00679.14; Description=Elongation factor G C-terminus
  Pfam annotation: Domain name=EFG_IV; Domain location=162-282; Score =237.1; E_value=3.7e-68; Accession=PF03764.8; Description=Elongation factor G, domain IV
  Pfam annotation: Domain name=GTP_EFTU_D2; Domain location=7-74; Score= 79.5; E_value=1e-20; Accession=PF03144.15; Description=Elongation factor Tu domain 2
  Pfam module annotation: Pfam domain module=EFG_C::EFG_IV::GTP_EFTU _D2; Domain location=284-371::162-282::7-74
MSDPYVGQLTFVRVYSGVLRKGDSVWNAVKGRKERIGRIVQMQANDRIEIDEIRAGDIAACVGLKEVTTGETLCDPNAVITLERMEFPDPVISLSIEPKTKGDQEKMGLALQRLAAEDPSFRLHTDEESGQTIISGMGELHLEIIVDRLKREFGVEANIGRPQVTYRETIRKTVREVEGKFVRQSGGKGQYGHVVLTLEPQAAGSGFAFEDATKGGVVPREFIPSVEKGIREALNSGVLAGYPVVDIKATLTFGSYHDVDSSEMAFRMAAIFGFKAAAKQADPVILEPVMQVEVETPEEYAGGVMGDLSSRRGTLQGMDERFGARIIRAEVPLAEMFGYATTLRSMSQGRATYSMEFAHYAEAPRNVAEAIIAARAQ

SEQ ID NO: 193002 - protein, 163 aa, Glycine max
  Coding DNA Sequence Number=SeqID_76224
MDLASNNFMLPLKASGEGLHRHRKHGAWGSGPHARVEGWWFLLLVCGECVDRHFYFSYCISCRTTNRKGKKGMMVIGMRERKWERGDDGPLGPSRFFLQKAVASGGSNLARLGKLGGKLLPYFAINRGRSEEEKGSAFLALRIHLKLLRKIVSVKKIQAEGLP

SEQ ID NO: 193003 - protein, 326 aa, Glycine max
  Coding DNA Sequence Number=SeqID_76225
  Gene Ontology: Mol. function=transition metal ion binding
  Pfam annotation: Domain name=Transposase_21; Domain location=15-157; Score=-55.2; E_value=6.8e-10; Accession=PF02992.5; Description =Transposase family tnp2
MYKCPRCGVSRYKVKDNDECSSDENTKKDPQQRCYDLKNLWDEEVDVFDENRNKTFKLGAMVFCTINDFLAYGNLSGYCVKGHRAYPIYKEDTSYLQLKHGRKTMCTRHKCFLKPYHPYWQLKKVFNGSQENEIVPIPLIGKTKDGLNTCQNLDEMGVRDQLHPRSDGMYPVKRYMNILKRYAKNLQRPEASIVERNIAEEAIEYCSELKRQNMLGFLSILMTRKWEGYDINKYLFLTKSQDDKNTVKNNGCKWVDSNIDVQTDDFKFTLVDLKKVLHEETIGVNLEDDESTLYTCHTPFSTHMPTINGENEVDDVHANRNDHDEG

SEQ ID NO: 193004 - protein, 49 aa, Glycine max
  Coding DNA Sequence Number=SeqID_76226
MVSIMEDSVKLDNIPIHLLSSLKGVVLVLNTQCQDSLYSSPKYDFQLCT

SEQ ID NO: 193005 - protein, 147 aa, Glycine max
  Coding DNA Sequence Number=SeqID_76227
  Homolog annotation: Hit_ID=Q1RSF8; Match level="QueryCoverage=46%, HitCoverage=28%, E-value=8e-10, Identity=45%"; Hit description=Mis12
  Subcellular localization annotation: CTP_CleavageSite=33; ConfidenceScore=5.14e-01
MVPGSGNGNGKDATKNNHHHPQLENVMLLRRTTASSARGPPFVLSILNPVQYESESKAIFGALNLNPQLFYNEVLNIVNNVLDKAFNIFYQDASTKLNIEGTQSSHDLKMFISVMVQNLELIYKTSKQSYTTTGLCSSSSLNSADKV

SEQ ID NO: 193006 - protein, 116 aa, Glycine max
  Coding DNA Sequence Number=SeqID_76228
  Homolog annotation: Hit_ID=Q42546; Match level="QueryCoverage=27%, HitCoverage=9%, E-value=8e-10, Identity=87%"; Hit description=SAL1 phosphatase (3'(2'),5'-bisphosphate nucleotidase 1) (EC 3.1.3.7) (3'(2'),...
  Homolog annotation: Hit description=5'-bisphosphonucleoside 3'(2') -phosphohydrolase 1)
MELCQEEMGLYIYVSLIKDTVKEYGIILLAALFSKVDVSLSELNALSECHPLSKTSACLVDRRNLEGNLSRRHALSASLARSASRLSPSRLRTSLALSKNSLTRAKHKNGAKCNVE

SEQ ID NO: 193007 - protein, 67 aa, Glycine max
  Coding DNA Sequence Number=SeqID_76229
MVIQMVPSSPPPSWDWGLGFPPCDKEDARVREMMCELESRMGFIFGSSIALGISAKFVPLCKLGKLP

SEQ ID NO: 193008 - protein, 71 aa, Glycine max
  Coding DNA Sequence Number=SeqID_76230
MGNIDVQTDDFKFTLVDLKKVLHEETIGVNLEDDESTLYTCHTPFSTHMPTINGENEVDDVHANRNDHDEG

SEQ ID NO: 193009 - protein, 90 aa, Glycine max
  Coding DNA Sequence Number=SeqID_76231
  Subcellular localization annotation: CTP_CleavageSite=49; ConfidenceScore=5.50e-01
MLYFNMHIDIPPGSPPPESAPSPSMSKRTRKVTQLRSLSARPMGLERPLAHVDPNTRKVPVAQKDLIWKDNQAEFDIPKTSDKRIKKKIL

SEQ ID NO: 193010 - protein, 53 aa, Glycine max
  Coding DNA Sequence Number=SeqID_76232
EGSIDVAMVKEFYANFYSLADQAPKCAKIRGHLIKIDADNLNEFLQTPMLLEE

SEQ ID NO: 193011 - protein, 70 aa, Glycine max
  Coding DNA Sequence Number=SeqID_76233
  Subcellular localization annotation: CTP_CleavageSite=51; ConfidenceScore=5.24e-01
MTMITPSSKLTLTKGNKSWYRAPPRGRRMYLLVTISRNGWGRVRLWLGGVRADGVRRSVNVLPQELDVLD

SEQ ID NO: 193012 - protein, 173 aa, Glycine max
  Coding DNA Sequence Number=SeqID_76234
MFGLYNDNVPLYIKHEDLGKISHSGQFLNIITIQLWIMHMSELSLQSRNDSVYGFLESQSKQRSGQLQFESKDYIKKLMSNSKRCLPRSLLEWGFNDKHRSKSKANAKWISVKSNKQRGSTECNYYVMHWMSTIVLGGFKDNWEMPTFNDWSFNIGSKLMLNVDAILPPKRIG

SEQ ID NO: 193013 - protein, 147 aa, Glycine max
  Coding DNA Sequence Number=SeqID_76235
KFGLFECDVDYERRKTQVKKGSVRHGRGLCEVQGTMRSRDHEDKEWPRVRVDNANRILLRFCHLSLGPCRRSYPLDEQCEEVRLKPKNSEFKIDLAIDLESNNIDKEFANKYNTTKQVGNSSKGDSHNNHYLWQISGYHPVLHGCNK

SEQ ID NO: 193014 - protein, 71 aa, Glycine max
  Coding DNA Sequence Number=SeqID_76236
  Subcellular localization annotation: CTP_CleavageSite=41; ConfidenceScore=5.10e-01
APSCPALAVAPDSWALPKALDPWALPKAPASGALPTVSRVTCTVEAPGWGALCNKKNRPPLPGNNCKKTPF

SEQ ID NO: 193015 - protein, 340 aa, Glycine max
  Coding DNA Sequence Number=SeqID_76237
  Homolog annotation: Hit_ID=Q2SK73; Match level="QueryCoverage=25%, HitCoverage=32%, E-value=5e-27, Identity=65%"; Hit description =Uncharacterized protein conserved in bacteria
MDYGRSAHQRQAALGGRAGTIGITAQGGDAVAALGQVFQPLAEEGVHPHAMADQLRRRRIQAHRVLPAAAHVAVGGLGLAGVTVQPHIGRRVRLSGDRVGQVVGQAQFHRVTVALDHVQTNIQAVADRGNVAARHQSGRFEQAHQVAVVLRVQAHEPAQPAQAGNAFGTGQGSGHGSILHVGASTWGRLKPQPTRRSLSRGSAGRWPAAPQRRSRCHGGSAGRWPAASQCEKGQYSSRCSPNVASTLLEISSIEAVRVDGQPEQLAPVVAQARRQAITFQVLVGQRVVGRAHPVMQGQVDAGGRLASARHRYQDHVGIVVVHRDAVVVGQGEVHRVDAPV

SEQ ID NO: 193016 - protein, 57 aa, Glycine max
  Coding DNA Sequence Number=SeqID_76238
MEKCWWKWQGVSPLKMAASMVPPVLLARQQLKWKVPPVKLARHLHVGSASSAGDTAS

SEQ ID NO: 193017 - protein, 87 aa, Glycine max
  Coding DNA Sequence Number=SeqID_76239
MARNKFISSMIIFLALIIFCRQFHSTKARYLKHNQAKNNSNNNKHLGNDVHGDISATGVAPPPGRGVEDFRPMTPRHSPGVGHSVHN

SEQ ID NO: 193018 - protein, 100 aa, Glycine max
  Coding DNA Sequence Number=SeqID_76240
  Gene Ontology: Mol. function=serine carboxypeptidase activity; Cellular component=cellulose and pectin-containing cell wall; Biological process=proteolysis
  Homolog annotation: Hit_ID=Q1M2Z7; Match level="QueryCoverage=85%, HitCoverage=46%, E-value=7e-12, Identity=38%"; Hit description =Serine carboxypeptidase II
MCSLLWSSIALCVAILLLQLGIVHPSPSHHRITRLPGQPHVQFHQFSGPGCSFEGPGCSSLGVGAFLENEPFRPKGEGLVRNQFSWKKGHYVPQLAELML

SEQ ID NO: 193019 - protein, 86 aa, Glycine max
  Coding DNA Sequence Number=SeqID_76241
MVNTRSGKPMAKPKNKEKATSTPKKEALNEESRDTKKMGEKEVLAPARKLGLHEPQLTNISLQLVDRTLTNPRGVMENYESRLANS

SEQ ID NO: 193020 - protein, 123 aa, Glycine max
  Coding DNA Sequence Number=SeqID_76242
  Subcellular localization annotation: CTP_CleavageSite=28; ConfidenceScore=5.02e-01
MAHSWFHTTQHITTINKPYPFAQNRNFRHSKEEKLELVTTTAWTNRFHGETSFFRCDRKPSSSIETTPLLMPVAVRAQWIASSLSKRHELTLMARDNLHSPTNTASGRQSEVSWRHSASQCRV

SEQ ID NO: 193021 - protein, 298 aa, Glycine max
  Coding DNA Sequence Number=SeqID_76243
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q3XQ56; Match level="QueryCoverage=76%, HitCoverage=33%, E-value=2e-28, Identity=34%"; Hit description=ATP -binding region, ATPase-like:Histidine kinase, HAMP region:Histidine kinase A, N-terminal precursor
  Pfam annotation: Domain name=HAMP; Domain location=20-90; Score=46.5; E_value=9.1e-11; Accession=PF00672.15; Description=HAMP domain
  Pfam annotation: Domain name=HATPase_c; Domain location=180-289; Score=85.8; E_value=1.3e-22; Accession=PF02518.16; Description =Histidine kinase-, DNA gyrase B-, and HSP90-like ATPase
  Pfam annotation: Domain name=HisKA; Domain location=94-152; Score =19.6; E_value=0.0013; Accession=PF00512.15; Description=His Kinase A (phosphoacceptor) domain
  Pfam module annotation: Pfam domain module=HAMP::HATPase_c::HisKA; Domain location=20-90::180-289::94-152
MIELHYGNHRPPAGPPHERNPLAILLALLGLISIIWVVAFVATQPLRKLANAALHLAHNIEHPPLPENEGSTEVRHAAKAFNEMQRSILKHIQERGFILGAIAHDLQTPLTRLRLRLEKVKDLELKQSLIKDLTATQEMVREGLDFARLCGENIHKSKIDLTALATARANCPTQSITTWGSAHLLTRCLTNLLNNTVAYANTPKLSLYTEGKQAICIISDDGPGIPEQELNSVLEPFRRVEDSRSRQTGGTGLGLYIARMIIEKHGAWGLRCRLAPLPMLVVTITSRLGEVAELVECT

SEQ ID NO: 193022 - protein, 148 aa, Glycine max
  Coding DNA Sequence Number=SeqID_76244
MTQELVARGDTLRLSAPRHSVTPSVIHEQRPIWSSAPFSEMSAFSDGDFSSLTSYPELQAAGPMIRGDTLRLSAPFCHPEAAGPMTSRDQVWSFCTLVSSRGGGPDDTRRYLTVIRTLLSSRGGGPDDKQRPSWVILHPCIIQRRRAR

SEQ ID NO: 193023 - protein, 195 aa, Glycine max
  Coding DNA Sequence Number=SeqID_76245
  Gene Ontology: Mol. function=nucleic acid binding; Cellular component= integral to membrane
  Homolog annotation: Hit_ID=Q9FNZ2; Match level="QueryCoverage=69%, HitCoverage=31%, E-value=4e-42, Identity=54%"; Hit description=Zfwd1 protein
  Pfam annotation: Domain name=WD40; Domain location=88-126; Score =30.9; E_value=4.4e-06; Accession=PF00400.22; Description=WD domain, G-beta repeat
TPSPPAACGYGNTAYNYGKKPHSSFENTLKYGSKKALLRDYGDRGDATRVAKAFKKSSPRICKYWINNNCVHGEQFLYLHSWFRGDGFSTVMKLQEHKKVITGIALPVGSDKLYSGSTDGTVRIWDCHTGQCAKVINLGAEVTSLISEGSWIFVGLQNAVKAWNIQTMSEFTLDGPKGRVRAMTVGNNTLFAGAE

SEQ ID NO: 193024 - protein, 177 aa, Glycine max
  Coding DNA Sequence Number=SeqID_76246
  Gene Ontology: Mol. function=chromatin binding; Cellular component =signal recognition particle, endoplasmic reticulum targeting; Biological process=chromatin assembly or disassembly
  Homolog annotation: Hit_ID=O22265; Match level="QueryCoverage=95%, HitCoverage=51%, E-value=1e-47, Identity=52%"; Hit description =Signal recognition particle 43 kDa protein, chloroplast precursor
  Pfam annotation: Domain name=Ank; Domain location=28-69; Score=7.8; E_ value=2.3; Accession=PF00023.20; Description=Ankyrin repeat
  Pfam annotation: Domain name=Ank; Domain location=71-103; Score=13.2; E_value=0.39; Accession=PF00023.20; Description=Ankyrin repeat
  Pfam module annotation: Pfam domain module=Ank::Ank; Domain location =28-69::71-103
MEYLIEWKDGHASSWVPTDFIAKDIIAKYKTPWWTAAKKPDESILKNLIESNDGHNLAEAGANLDHRNQSGGLTKLHLAAGYVRPSVAKVLLDLSIDPKVANNRERMTLDLARDILKVMPKRNLMQFGCRIRLKGVIRVLEEVEFEYAKVQEILEWRGKAENLEYLVGGKTTKQTSG

SEQ ID NO: 193025 - protein, 66 aa, Glycine max
  Coding DNA Sequence Number=SeqID_76247
MRFYVDKIPEYLLKFGEEEGPTEGLNMEKCQRERGQKEWVCYMTNNKPYFLNDGGFAASGSQGFNG

SEQ ID NO: 193026 - protein, 94 aa, Glycine max
  Coding DNA Sequence Number=SeqID_76248
MSMLDQFHLCIHNSIENIVDVKVDGMGEDSWSLVHNHLLKELAKWSDEYINLLGGIVRFDELKRSLLVDGLSMVIMDKWMNIIDMGYVIASRFI

SEQ ID NO: 193027 - protein, 51 aa, Glycine max
  Coding DNA Sequence Number=SeqID_76249
GVVLAEVLLADSRFTRPDMGFHPTKLDFVPRNADEAPLDVSICLHAFGIAR

SEQ ID NO: 193028 - protein, 101 aa, Glycine max
  Coding DNA Sequence Number=SeqID_76250
  Gene Ontology: Mol. function=transition metal ion binding
MEVHHEALAKESNPKMTKNRVLKEQNKTFLNQFKDIIFDDNNASETLRKLADGPKRNVITWHGYDINKFSFYPKSQDNKSTLQNSGVSLSAESQHFATVRG

SEQ ID NO: 193029 - protein, 146 aa, Glycine max
  Coding DNA Sequence Number=SeqID_76251
  Gene Ontology: Mol. function=RNA-directed DNA polymerase activity; Cellular component=intracellular; Biological process=RNA-dependent DNA replication
MAPKDMEKTTFVTLWGTFCYKVMSFGFKNAGATYQRAMVALFHDMMHQEIEVYVDDIIAKSKSEEEHLVNLRKFRKGIEVDPDKEKAILEMPEPRTRSKSEFVQWDDDCQVAFERIKWCLMNPLVLVPPVPGRPLILYMTMLDESM

SEQ ID NO: 193030 - protein, 181 aa, Glycine max
  Coding DNA Sequence Number=SeqID_76252
  Homolog annotation: Hit_ID=Q9FIC3; Match level="QueryCoverage=36%, HitCoverage=70%, E-value=4e-23, Identity=78%"; Hit description =Arabidopsis thaliana genomic DNA, chromosome 5, P1 clone:MYH9
  Pfam annotation: Domain name=BolA; Domain location=104-168; Score =68.5; E_value=2.2e-17; Accession=PF01722.8; Description=BolA-like protein
MTVGGEIDRQGYEDLQFLSSFVYFFFMGVGIYEKETLASQGKYKSIPQTHCILTYPIVLYTWKDGTGHIHICNMYWIVLRILKPPELISLAVWFRLTGLYCFAPLNELEEVVDTSGGCGASFVVEIVSEQFEGKRLLERHRMVNAALEEEMKQIHALSIKKAVTPDQWKQQQESNQSNPAA

SEQ ID NO: 193031 - protein, 545 aa, Glycine max
  Coding DNA Sequence Number=SeqID_76253
  Gene Ontology: Cellular component=membrane; Biological process =protein transport
  Homolog annotation: Hit_ID=Q1SQB8; Match level="QueryCoverage=83%, HitCoverage=74%, E-value=1e-136, Identity=57%"; Hit description=IMP dehydrogenase/GMP reductase
MASSHGNAHSDAAKMEQIITEFFAKSLHIILESRALYVSSRNSYGDQAVSSPCSSSSSSSSVRPRDKWFNLALRECPAALENIDLWRQNNLECIVIDVILVQRPLDWDPVTVSFSPKRVLPRSSSLKERCPFGWNTDQEELGVVGRSEKIVERWLVQYESRKTRDSNSGSRRSSNVSLHNLYKKSTLLLRSLYATVRLLPAYKLFRELNSSGQIRDFTLGHRVSSFVEPFTRKQEAEMMKFGFTPVDTSSGRLCLSVMYCPSASDVSSEPSTPMSPQVITDYVGSPLADPLRRFPSLPVAGLPSSRQRSWSFDHYRASPPSYLPSPTHSESLSSGYNACLRRFPPASLPPHPSEMSLIQKKNTNFDDYYPSASPSTSNSGPLPCKPLLRSESAPVSIPTAEVDNSPGYSNRHNLPPSPPLRISRGIGKIDKNPMQTGATAEKLFSLGKDESRKYSGVKISANSSPQISISRSSSRSYQDDFDDTDFTCPFDVDDDDMTDPGSRNKRQSKSIVGVSRLNRYRNKSTSIPLGFPVSGLGKSSTVFYM

SEQ ID NO: 193032 - protein, 66 aa, Glycine max
  Coding DNA Sequence Number=SeqID_76254
MPPLWHRTKYYKINAFALEKVQRAINRLVCETVSRNSICGAIYVAGIRNLEDGGNHPVRNLRTGQV

SEQ ID NO: 193033 - protein, 49 aa, Glycine max
  Coding DNA Sequence Number=SeqID_76255
MMLGGLQNRTQVNSNPSLTVSVLKLKQIKPLDTPVTSYFIFTGKSSSSL

SEQ ID NO: 193034 - protein, 413 aa, Glycine max
  Coding DNA Sequence Number=SeqID_76256
  Gene Ontology: Mol. function=carbohydrate binding; Cellular component= cell surface; Biological process=D-amino acid catabolic process
  Homolog annotation: Hit_ID=Q63FD2; Match level="QueryCoverage=79%, HitCoverage=37%, E-value=5e-21, Identity=32%"; Hit description =Collagen-binding surface protein
MGGCATKPKVSKDDPDGMPKAPQPEPQPELQPNKDTLKTKAPAAQVEQAAAAHNNNLNVNEIVDDDQANKRRSLSFLFKENEDKKGSTENEKNTVEESVKEEVLEVKKPAEDAKSNEPIVKQESPRPDEKLSEESRNNESSKQENETLKTETSHAEETHVNEPAKETVKLEPEAQKPSEETLAIEPAKETLIIESETKKPSEETLIVEPAKETVIVESEARKPSEETLINEPAKETVIVESEARKPSEETLINEPAKETVIVESEAQKPLEETHINEPAKKTVKPDSEAEKPSEVNNESSKPLNEEFVQAMEILSEETQSNGLIKLKEVPIEPSEEGKPSGESERNASETEKPETSIVTEVVPMPEERVIEEIPTDAKSVEKVTKEAASSTEETSHNGVENAPKVVDAGTEIH

SEQ ID NO: 193035 - protein, 78 aa, Glycine max
  Coding DNA Sequence Number=SeqID_76257
  Gene Ontology: Mol. function=nucleic acid binding
MTNNKDLFKDPNISCTLKVGVGDDKCITNLWSVGQLIKKGYKVLFENKKCLIKDVDDKYILKVKMKEKSFALNPLEEE

SEQ ID NO: 193036 - protein, 161 aa, Glycine max
  Coding DNA Sequence Number=SeqID_76258
MDEIEKVQEQMKADSEALKEKMATMVEAMMSIKEIVEVSAAYQTRARAKIMGEVEKVQEQMKADMEAMKKQMAHEIPHHNLADFEPCLGYATEGQAVGGIHMPNTSEGPQYHPQLHLLHSTTSKNPHAMVEMGKLDHLEERLRAIEGGEDYAFANLGELFL

SEQ ID NO: 193037 - protein, 202 aa, Glycine max
  Coding DNA Sequence Number=SeqID_76259
  Gene Ontology: Mol. function=cytochrome-c oxidase activity; Cellular component=membrane; Biological process=electron transport
  Homolog annotation: Hit_ID=Q9FGG3; Match level="QueryCoverage=92%, HitCoverage=56%, E-value=4e-54, Identity=57%"; Hit description =Nodulin-like protein
  Pfam annotation: Domain name=DUF6; Domain location=66-181; Score=5.7; E_value=0.031; Accession=PF00892.11; Description=Integral membrane protein DUF6
  Pfam annotation: Domain name=TPT; Domain location=57-174; Score= -37.7; E_value=0.089; Accession=PF03151.7; Description=Triose -phosphate Transporter family
  Pfam module annotation: Pfam domain module=DUF6::TPT; Domain location= 66-181::57-174
TSGVAKLVGVVACLTGSAILAFYKGPHLEVLSHYHVLGYHKNQQHLGRVASGTWIKGCFLLLLSNTFWGMWLVLQTYVIKGYPSKLLLTTLQCFLSSIQSLGIALAVERDIEQWKLGWNGIMVTGVTYYLQTWVIEKKGPVFLAMATPLALIMTIFSSAVLLGEIITLGRWHRFGHWTVLRAVGKEQRANAKSLVRLGGGII

SEQ ID NO: 193038 - protein, 62 aa, Glycine max
  Coding DNA Sequence Number=SeqID_76260
MKVVVVTYAVCIKIVVIMNEKYGSAEVALGMSVNLNKNSSSVVHGDKVAFMEQKLFHWRPLR

SEQ ID NO: 193039 - protein, 69 aa, Glycine max
  Coding DNA Sequence Number=SeqID_76261
MSQNFTDCLTMGVKFLEVVKMDPLLEMVPQLMLALADKSAKAGSRAEVEDVGMPTIGAKEEGTSAALSL

SEQ ID NO: 193040 - protein, 158 aa, Glycine max
  Coding DNA Sequence Number=SeqID_76262
  Homolog annotation: Hit_ID=P16181; Match level="QueryCoverage=23%, HitCoverage=23%, E-value=9e-08, Identity=72%"; Hit description=40S ribosomal protein S11-1
MGKHNNSGWEWYFNWRRPLFDSEIGMAITFLSEVEGKPIHNYGSDSWDWAAEPWGIYSTNNAYSMFWEEAAVDSLEECFEELWKIKIPSKIARHTFDGFPGSLKANHNGLPKSIPTLFETLSFPSFLRATKSRKRSPVCDKDELRQKEKEEEHPGNLK

SEQ ID NO: 193041 - protein, 93 aa, Glycine max
  Coding DNA Sequence Number=SeqID_76263
  Subcellular localization annotation: CTP_CleavageSite=68; ConfidenceScore=5.05e-01
MLSKFILMMPKTQVKNQEPSNFQESKSRSIKNQDSAQFVQKNFSKKNLLPIVLLSDNRLPEGSNQLPVANILFKLIYKAVIDHHEHVINYQCF

SEQ ID NO: 193042 - protein, 107 aa, Glycine max
  Coding DNA Sequence Number=SeqID_76264
KHKGYVSGSLSDEGKVELGGDSGKSESSLEKGLVDRSDASDVDAKVDNMARCFRTNQRILVLSAAKVAKKMKLKFTKDWIAYLRLPLPIDVYKELKHYILKHGANVM

SEQ ID NO: 193043 - protein, 81 aa, Glycine max
  Coding DNA Sequence Number=SeqID_76265
  Subcellular localization annotation: CTP_CleavageSite=42; ConfidenceScore=5.07e-01
MLLNNNVIHIHVRVVMLVCMIRTRLFAAARVKSCPSMHTRCVIASLSGCARTVGRPPISGGGPGTDIRKLTGPLTGSASLG

SEQ ID NO: 193044 - protein, 172 aa, Glycine max
  Coding DNA Sequence Number=SeqID_76266
FARNWLVFPWLTKAAGNHNVDPACHMTSRVRTTKGAEDDVSLRTSMGSFSLDDESVNGLVFPLLMKGAGQWARLPLVDESNPACHLTSRVRTTKGAEDDVSLRASMDSFAPGEEDDVGLRASTGSFPLVDDRCGNHKVTQHVTCVHGSGRQKVQKTMLVFVRQWARFPLVDD

SEQ ID NO: 193045 - protein, 204 aa, Glycine max
  Coding DNA Sequence Number=SeqID_76267
  Homolog annotation: Hit_ID=Q6D0Z0; Match level="QueryCoverage=93%, HitCoverage=81%, E-value=9e-52, Identity=52%"; Hit description =Putative membrane protein
MQIIYPDDYSNLGRPDENFAEEFTCVKDRGIRCFLLSSEAAALGKTRFSGRFEPGIPVIWRGWMLNAEEYRQLHRTVAANGGEMLESPDDYLRNHHITGWYEPCKSYTAETVLATADTDFDTLVTQLCWPAYFVKDYVKSLTTSRGSVAHNAAEIREVIKLIAHYRGELEGGVSLRRFENLIDDSERRYFSLNGQVFSARWRNT

SEQ ID NO: 193046 - protein, 85 aa, Glycine max
  Coding DNA Sequence Number=SeqID_76268
  Homolog annotation: Hit_ID=Q5W7C9; Match level="QueryCoverage=66%, HitCoverage=21%, E-value=8e-21, Identity=82%"; Hit description =Unknow protein
MVEVISSSLIIPKPKRTPVEYEAPGYKLCLGMEENSESALSTNKEAISNATRNLMESSIMAQDERWWHALHMQVGREVVFPVADG

SEQ ID NO: 193047 - protein, 102 aa, Glycine max
  Coding DNA Sequence Number=SeqID_76269
MAEKTKKKLEEATQSGTTNGVIDPTSPIRRHVKWKMTRTKKIEQMTSEAAKEIAEKIASQGSFVPHGCQDVLTTIIGRPDHPGYVRAAGSGVTIKQYFRSAP

SEQ ID NO: 193048 - protein, 88 aa, Glycine max
  Coding DNA Sequence Number=SeqID_76270
MVEREKFDHIEERLRAIEGDEDYPFADMEELCLVPDIIIPLKFKVPDFNKYKGTTCPKNHLKMYCRKMGAYAKDEKLLMHFFKRVWLG

SEQ ID NO: 193049 - protein, 136 aa, Glycine max
  Coding DNA Sequence Number=SeqID_76271
MEETHEIPHHDLANFEPCLGYAAEGQAVGGIPMPNTLEGPQFRPQPQPLHFAVGRAPPAMAEKGKLDHIEERLKDIEGVEDCAFANLEELFLVPNIITPPKFKVLDFDKYKGTTCPKNHPKMYYQKIRAYAKMRDC

SEQ ID NO: 193050 - protein, 152 aa, Glycine max
  Coding DNA Sequence Number=SeqID_76272
ANEPVDAKRLTSSSAPFVIQGRRVRWQVEIPYGHPRLSSTEGNEFDGIKMMDGRDESAPFSSGNIQAQRRARFFSTRQGRSSTMASATCRKSKGSIVAQSVKFSNIPEVKKGMGLQIATRPTWTFQGVPTEGGAFWWKQPSSAGQAGRQPPS

SEQ ID NO: 193051 - protein, 407 aa, Glycine max
  Coding DNA Sequence Number=SeqID_76273
  Gene Ontology: Mol. function=transporter activity; Cellular component= outer membrane; Biological process=transport
  Homolog annotation: Hit_ID=Q8YV28; Match level="QueryCoverage=96%, HitCoverage=46%, E-value=2e-13, Identity=22%"; Hit description=Outer membrane heme receptor
  Pfam annotation: Domain name=TonB_dep_Rec; Domain location=249-406; Score=30.6; E_value=5.7e-06; Accession=PF00593.14; Description=TonB dependent receptor
MRWHSDAALINGVIDAGGSGRIIGTLDFYRKSSRESAPMYKKLNSSAPRESIVGSHGQKNSTQRDSISLAHVFTPGNNTLIDTMESKVFYQRTRVGDDTVSAQDIVTSSRWRSTGMETENPLENVSTFSDMNTKTYGLQSEITKDYGAQALNYGVNFSITDFSRPFEQVGADHPTLQPQGNNRTYDTNVWLSDTITIGALSVMPGLKYSWHKINPQGFEAPSDDKALGALTLAEINEIHGKTFTDGKLLPSLTVMYASKQGFNTYLQYKRGVSYPTSSQIAGIWLHPRIGRASPAMVGNSDLKSETSNQFELGVVGKAARGLTVRGNVFYNSYDNVIYNRKYALRDYQTGAPKPGVQSLLARLPASISSLTIAENRDKAYIYGAEVVTRIDYGALFGAAPRLSSTFA

SEQ ID NO: 193052 - protein, 165 aa, Glycine max
  Coding DNA Sequence Number=SeqID_76274
  Gene Ontology: Mol. function=transition metal ion binding; Cellular component=cytoplasm; Biological process=fucose metabolic process
DRLEDMIHDLGQESFQQAHAPMYDTLQIDSKKLLYPSSPLQVVHDMLPEGNTLLKSYYQEKKILCPMGMEYQKIHACPNDCILYRHEFQQMPKCPRCGVSRYKVKYDEECSSDENSKGPPAKVLWYLPIIPRFKCLFANGDDVKDLTWHANGRNCDGMLRHLADS

SEQ ID NO: 193053 - protein, 79 aa, Glycine max
  Coding DNA Sequence Number=SeqID_76275
  Gene Ontology: Mol. function=DNA binding; Cellular component=nucleus; Biological process=regulation of transcription, DNA-dependent
  Homolog annotation: Hit_ID=Q6R074; Match level="QueryCoverage=51%, HitCoverage=15%, E-value=3e-13, Identity=78%"; Hit description=MYB transcription factor
  Pfam annotation: Domain name=Myb_DNA-binding; Domain location=13-54; Score=20.2; E_value=0.0075; Accession=PF00249.21; Description=Myb -like DNA-binding domain
MGRGVIEEQVWRKGPWTAEEDRLLVEYVRLHGEGRWNSVARLATNKNSEYFDILTLTVARSRHHSKEHDFGYGGGGNNR

SEQ ID NO: 193054 - protein, 93 aa, Glycine max
  Coding DNA Sequence Number=SeqID_76276
  Gene Ontology: Mol. function=DNA-directed RNA polymerase activity; Cellular component=DNA-directed RNA polymerase II, core complex; Biological process=transcription
  Homolog annotation: Hit_ID=O48890; Match level="QueryCoverage=93%, HitCoverage=65%, E-value=8e-32, Identity=76%"; Hit description=15.9 kDa subunit of RNA polymerase II
  Pfam annotation: Domain name=RNA_pol_Rpb4; Domain location=2-92; Score=49.0; E_value=1.6e-11; Accession=PF03874.6; Description=RNA polymerase Rpb4
MRWKRSKVVGVFEKSQQYVKRFSRYKNPDAVRDKILARYQLAEFELCVLGNLCLETVEEAIAMVPSIESRGRAQDDEAIEKMLNDLSLIKKFE

SEQ ID NO: 193055 - protein, 168 aa, Glycine max
  Coding DNA Sequence Number=SeqID_76277
  Gene Ontology: Mol. function=DNA binding; Cellular component=nucleus; Biological process=regulation of transcription, DNA-dependent
  Homolog annotation: Hit_ID=Q9FHJ4; Match level="QueryCoverage=97%, HitCoverage=47%, E-value=2e-42, Identity=53%"; Hit description =Arabidopsis thaliana genomic DNA, chromosome 5, P1 clone:MFC19
  Pfam annotation: Domain name=Myb_DNA-binding; Domain location=108 -157; Score=25.5; E_value=0.00018; Accession=PF00249.21; Description =Myb-like DNA-binding domain
MEKTYIARSKQVIHISHTNDDVLSFLAIPFQVFAREWSSVGKPGRWEAIAAAFGGRHRVESVIKKAKELGEKRVDDSESYAQFLKKRKALDKRVVEENEGESEGKAVDNGWSSAEDIALLNALKAFPKEVSMRWEKVAAAFPGRSKPACMKRFAELKKGFLTAKAAAE

SEQ ID NO: 193056 - protein, 1183 aa, Glycine max
  Coding DNA Sequence Number=SeqID_76278
  Gene Ontology: Mol. function=protein binding; Cellular component =thylakoid; Biological process=photosynthesis
  Homolog annotation: Hit_ID=Q4W7J1; Match level="QueryCoverage=99%, HitCoverage=87%, E-value=0.0, Identity=52%"; Hit description=TONSOKU protein
  Pfam annotation: Domain name=LRR_1; Domain location=1021-1043; Score =1.7; E_value=1.4e+02; Accession=PF00560.23; Description=Leucine Rich Repeat
  Pfam annotation: Domain name=LRR_1; Domain location=1077-1093; Score =5.1; E_value=31; Accession=PF00560.23; Description=Leucine Rich Repeat
  Pfam annotation: Domain name=LRR_1; Domain location=1103-1126; Score =2.1; E_value=1.1e+02; Accession=PF00560.23; Description=Leucine Rich Repeat
  Pfam annotation: Domain name=LRR_1; Domain location=1132-1155; Score =0.2; E_value=2.6e+02; Accession=PF00560.23; Description=Leucine Rich Repeat
  Pfam annotation: Domain name=LRR_1; Domain location=1160-1182; Score =2.4; E_value=1e+02; Accession=PF00560.23; Description=Leucine Rich Repeat
  Pfam annotation: Domain name=LRR_1; Domain location=819-840; Score =4.6; E_value=40; Accession=PF00560.23; Description=Leucine Rich Repeat
  Pfam annotation: Domain name=LRR_1; Domain location=877-899; Score =5.9; E_value=22; Accession=PF00560.23; Description=Leucine Rich Repeat
  Pfam annotation: Domain name=LRR_1; Domain location=936-962; Score =12.2; E_value=1.5; Accession=PF00560.23; Description=Leucine Rich Repeat
  Pfam annotation: Domain name=LRR_1; Domain location=964-987; Score =1.4; E_value=1.5e+02; Accession=PF00560.23; Description=Leucine Rich Repeat
  Pfam annotation: Domain name=TPR_1; Domain location=162-195; Score =15.4; E_value=0.078; Accession=PF00515.18; Description =Tetratricopeptide repeat
  Pfam annotation: Domain name=TPR_1; Domain location=205-238; Score =11.1; E_value=0.25; Accession=PF00515.18; Description=Tetratricopepti de repeat
  Pfam annotation: Domain name=TPR_1; Domain location=245-278; Score =28.4; E_value=2.5e-05; Accession=PF00515.18; Description =Tetratricopeptide repeat
  Pfam annotation: Domain name=TPR_1; Domain location=382-415; Score =18.3; E_value=0.028; Accession=PF00515.18; Description =Tetratricopeptide repeat
  Pfam annotation: Domain name=TPR_1; Domain location=422-455; Score =9.3; E_value=0.42; Accession=PF00515.18; Description=Tetratricopeptid e repeat
  Pfam annotation: Domain name=TPR_1; Domain location=65-98; Score=3.6; E_value=2; Accession=PF00515.18; Description=Tetratricopeptide repeat
  Pfam annotation: Domain name=TPR_2; Domain location=162-195; Score =16.7; E_value=0.085; Accession=PF07719.7; Description=Tetratricopepti de repeat
  Pfam annotation: Domain name=TPR_2; Domain location=205-238; Score =20.8; E_value=0.005; Accession=PF07719.7; Description=Tetratricopepti de repeat
  Pfam annotation: Domain name=TPR_2; Domain location=245-278; Score =28.5; E_value=2.4e-05; Accession=PF07719.7; Description =Tetratricopeptide repeat
  Pfam annotation: Domain name=TPR_2; Domain location=25-58; Score=5.5; E_value=7.6; Accession=PF07719.7; Description=Tetratricopeptide repeat
  Pfam annotation: Domain name=TPR_2; Domain location=382-415; Score =16.4; E_value=0.1; Accession=PF07719.7; Description=Tetratricopeptide repeat
  Pfam annotation: Domain name=TPR_2; Domain location=422-455; Score =10.8; E_value=1.9; Accession=PF07719.7; Description=Tetratricopeptide repeat
  Pfam annotation: Domain name=TPR_2; Domain location=65-98; Score=7.4; E_value=4.6; Accession=PF07719.7; Description=Tetratricopeptide repeat
  Pfam module annotation: Pfam domain module=LRR_1::LRR_1::LRR_1::LRR _1::LRR_1::LRR_1::LRR_1::LRR_1::LRR_1::TPR_1::TPR_1::TPR_1::TPR _1::TPR_1::TPR_1::TPR_2::TPR_2::TPR_2::TPR_2::TPR_2::TPR_2::TPR_2; Domain location=...
  Pfam module annotation: Domain location=1021-1043::1077-1093::1103 -1126::1132-1155::1160-1182::819-840::877-899::936-962::964-987::162 -195::205-238::245-278::382-415::422-455::65-98::162-195::205 -238::245-278::25-58::382-415::422-455::65-98
MDADLKSAKAAYRNAKAEGNHREEARWANVIGDILKNRGEYVQALKWLRIDYEISLKHLPEKHLLPTCQSLGEMYLRLEHFSDALIYQKKHLDLARDAGDVVEQQRASTQLGRTYHELFSRSEHDHNSIRNAKKYFKSAMDLAVKLQENPPNSKSSFLKEYIDAHNNIGMLEMDLDNLHEARKILTRGLEICNDEEVAEFDDGRSRLHHNLGNVYMELRDWDKARKHIRTDIVICNRIGHVQGEAKGYINLGEVNYRTQKYEDASAYYEKALGLAKSLEDEDALVRQIEQNIETVREAVKVMADIKKEEQSLKKLKRDIATARGTPNERKFLLQQNAVLERLVEKARMISAWEKRLFQAMHCEFAKEKKKIASELCDRQRLADSYLDVAESYHKLRKFNKAIKWYKKSWEMYKNIGNLEGQAMVKINIGNVYDSTESWRKALDAFQESYSIAVEADLPDVQLAALENMHYSNMIRFDDEDETRRLNLLIDKLKKLEEKEAEAKSMPEDFCSETDTEADECLSNSGSDDFCFPKTISRSKTLTTGEELKEDAPLMSLYQSLKGSSKKKAGHKESLANSTKQDEHSPSSLKNQTSDHQTVVGRKRVRVILSDDDDDEVECSSRKDHNCPVEDLPTYDAIKSKASPCKFQVISENGSKTAINVEESSSSFKCWSPHRATKSGRHSRSFSNDIVAEPDFPGGSKCDTDVSGKQNDITQPMLHHSQNDLQQYVTCRIGNDLIRVEASLCTTGDQLNIDSLKAVVACLYYLQFPTEKRSEGLLPIIEHIKCAGRDLESLETVEHLKEVLGNDMVEASVDGWIHKGLIKMYVDHCKELSEVPNIKVLKKLYNLEVSDDEIVVSDCDLQDLSITPLINALHSQKSFAMLDLSHNLLGNGTIEKLQKVFTASGQSYGGLTLDLHCNRFGPTSLFQICECSLLFDRLEVLNISGNRLTDACGSYLSTILKNCTALCSLNIENCCVTSRTIQKVADALDSTSVLAHLCIGYNSPVSGNAIVNLVSKLSTLKRFSELNMSGLKLGKPVVDTLCKLAGTLNLSGLILGGTGVGTEGAIKLAESLLQGTEELVKLDLSYCGLTFNFVLNTSVNFFCSILELNLEGNPIMPEGSNTLFSLLVNPQCCLKVLVLKKCQLGLAGILHIIEALAENSCLEELNVANNSIPKEVSALQYDLS

SEQ ID NO: 193057 - protein, 234 aa, Glycine max
  Coding DNA Sequence Number=SeqID_76279
  Homolog annotation: Hit_ID=Q1SQB8; Match level="QueryCoverage=50%, HitCoverage=18%, E-value=9e-33, Identity=69%"; Hit description=IMP dehydrogenase/GMP reductase
MFSKTKQAIRNPPRKKKKIHQSEYEKSKSSAVVPNLFAYLKLQIEIPLKQPEGEYQREIQGVNLLQRVSPLHEQLLAGKHKALDGFGHALEVATEKQKPQFALTPNRGHSILQPAESLDHGHIAETLEAGGFFPIRKSQDAAVGALVHMLKKAPPLHQDFSTSQHLSQGAYPETWKNNTQGTNQILEASSRPVSIMSSGIIATRKTTADALEEFHGYKEMKNLLLRRGSSKHQK

SEQ ID NO: 193058 - protein, 484 aa, Glycine max
  Coding DNA Sequence Number=SeqID_76280
  Gene Ontology: Mol. function=transcription factor activity; Cellular component=nucleus; Biological process=regulation of transcription, DNA-dependent
  Homolog annotation: Hit_ID=Q5NE24; Match level="QueryCoverage=74%, HitCoverage=75%, E-value=1e-52, Identity=36%"; Hit description =Nodulation signaling pathway 2 protein
  Pfam annotation: Domain name=GRAS; Domain location=88-386; Score =199.9; E_value=6e-57; Accession=PF03514.5; Description=GRAS family transcription factor
MDFEQFYYSFGPPYMNQLHECISENAFPFQTENLLSPNTFLDEMFDQEYSMEGLLQQHANNQEDFGFLKHDDPLETEFCHGFSPSAEENMHVSMEEGDSCLKGIQAELMEETSLADLLLTGAEAVEAQNWPLASDIIEKLNNASSLENGDGLLNRLALFFTQSLYYKSTNAPELLQCGAVSTHTNAFCVFQVLQELSPYVKFAHFTANQAILEATEGAEDLHIIDFDIMEGIQWPPLMVDLAMKKSVNSLRVTAITVNQRGADSVQQTGRRLKEFAASINFPFMFDQLMMEREEDFQGIELGQTLIVNCMIHQWMPNRSFSLVKTFLDGVTKLSPRLVVLVEEELFNFPRLKSMSFVEFFCEALHHYTALCDSLASNLWGSHKMELSLIEKEVIGLRILDSVRQFPCERKERMVWEEGFYSLKGFKRVPMSTCNISQAKFLVSLFGGGYWVQYEKGRLALCWKSRPLTVASIWEPMAYLDDKVK

SEQ ID NO: 193059 - protein, 108 aa, Glycine max
  Coding DNA Sequence Number=SeqID_76281
  Homolog annotation: Hit_ID=Q3BR08; Match level="QueryCoverage=63%, HitCoverage=38%, E-value=1e-08, Identity=43%"; Hit description =Putative secreted protein precursor
MLNAYVMALLNRDRKAIYAAWTFPPSDARRADDAALRQLTDVLSLRLTSELPVARDGHQPPQLLEVPVQIRAVTPEGTFRFGGWYRVQPSPDGRAWQIQSAQLRPSLD

SEQ ID NO: 193060 - protein, 166 aa, Glycine max
  Coding DNA Sequence Number=SeqID_76282
  Homolog annotation: Hit_ID=Q3RAY5; Match level="QueryCoverage=80%, HitCoverage=58%, E-value=5e-32, Identity=47%"; Hit description =Hypothetical protein precursor
AGHGRVQLVHRFALGVVAQPGIEQAAGARIEATALVGRGEVIHARLLQVEALGLRVVPQAAAELHRSQLGRVATGGGQCEVHAQVQPFAGRKAQLRMAHGQGDQATQGVLGAREAAIEVLLHVAGTDRQFAAGNGRGGLGADRSSDQHGGGREAGHQGTQAHGGDR

SEQ ID NO: 193061 - protein, 112 aa, Glycine max
  Coding DNA Sequence Number=SeqID_76283
MVIYHTEFDDFKEELERRNWHEELTNFAQGSIDVAIVKEFYANLYDLEDKSPKQVRVRGHLVKFDEDALNIFLKTPMITEEGETLSAYSIFALLRPDPQELAANVPSFSYIS

SEQ ID NO: 193062 - protein, 243 aa, Glycine max
  Coding DNA Sequence Number=SeqID_76284
  Homolog annotation: Hit_ID=Q1T493; Match level="QueryCoverage=56%, HitCoverage=25%, E-value=5e-08, Identity=27%"; Hit description =Nucleic acid-binding, OB-fold, subgroup
  Pfam annotation: Domain name=Rep_fac-A_C; Domain location=87-186; Score=-68.8; E_value=0.074; Accession=PF08646.1; Description =Replication factor-A C terminal domain
SYLASVSNSFKASKLMINDLVLEIQEFRESLLDLGIEVRSILVPIGQGSSHVSGSSQLSSKDVFLSKTEVKNISQINASSEEFVCVTVAKITTIVMDNYSWCYPTCGQCYKKANMQTVSFTCLCGKENDQPVLRYRVEVMDGDVDLNVSPQALDRLLGCFLAFKVKVQPRFRNSVVLKYSDESDLINVVLDMIPDSEQSLSIIADHDRSMLGSSEPTEFESQSVSVTGDHDPFLRIPLTPTKR

SEQ ID NO: 193063 - protein, 188 aa, Glycine max
  Coding DNA Sequence Number=SeqID_76285
MGTRGCINYNLVLAIRQLGYPMRGAPSEESIAPFIARGFSDPNAGVLQGVHKAWDVVQRKDKELRGSSNGIISDYLKPKLQKRVRRYLKAELERARAVKKKFKSTAIKVQREYDELRDVNMATIEALEQETKRMSTPRYQRKGKHGKAFTFTLNGSQELSQLLAKAKAMADVYRPLKKFTGSSTIANT

SEQ ID NO: 193064 - protein, 71 aa, Glycine max
  Coding DNA Sequence Number=SeqID_76286
MELMDKLQRLRQGSMSVEEYRQQMELLLEILILGQMSYRIFKQVNNTRELLTQFGATSPTSGGYQAREEIH

SEQ ID NO: 193065 - protein, 74 aa, Glycine max
  Coding DNA Sequence Number=SeqID_76287
LASSSPWSPNYFRVKEPASLGEPVTSGVSISSLGRVAIDPSAHFPINRRAREAEERIQGSEVEGIERTKKEEEE

SEQ ID NO: 193066 - protein, 46 aa, Glycine max
  Coding DNA Sequence Number=SeqID_76288
MSKRQQEDWYQEHLHGEEDPRPISSTWSYDMWYQEHLRLGSIIFQS

SEQ ID NO: 193067 - protein, 112 aa, Glycine max
  Coding DNA Sequence Number=SeqID_76289
MPKRKKNNRLKYAFKYDFVSPNIGKLAFSILVHLSYAHGIKIENKRLKISKISYRNKKKYTRLSGVGVWLSGGGLGERNDLMGISPENGGLQSEKFTADIEVEGGGGGSVIP

SEQ ID NO: 193068 - protein, 191 aa, Glycine max
  Coding DNA Sequence Number=SeqID_76290
MQSFIDKQLNTTFLRNLTIVKQDADVSVIDLFDLHHQWVNIQDMQCTDKHTLISRSRPSLSRWTSLNEKLEQLLANVSKLTIEEHGEWREMANMMQNVVAPPEAFFQTVLAKDQIFGEISKVYAVKWEDVLDGSVTFKIYLTEQKVTCSSLTKARLICTWRTLQNVGLCSIIGGRHLELELDGNIYAKPCP

SEQ ID NO: 193069 - protein, 111 aa, Glycine max
  Coding DNA Sequence Number=SeqID_76291
MGVVRVELGGGGLLGMDPLRKRHEIIESIALCENKMGVLAATGKGPVVLCLKGGPQLGRVKEFRWHCRRPARVATATWELWSKGDQWCSPCVLRKEVTACVVQEEHGHGYA

SEQ ID NO: 193070 - protein, 68 aa, Glycine max
  Coding DNA Sequence Number=SeqID_76292
MVLESILDPSLGHLHLAHFRLKVLGVREKNESHEDSTNGDFNLFSVSLTFGNSIRAVGGKTERILGNR

SEQ ID NO: 193071 - protein, 99 aa, Glycine max
  Coding DNA Sequence Number=SeqID_76293
  Subcellular localization annotation: CTP_CleavageSite=80; ConfidenceScore=5.65e-01
MPPKASGISLRGGRSTGKGARLALPEPTIKKSSTSSGSPTQAGSSTQKTNLEGSSTQIASIKPEPSTQESPKPATAKQTSADYAWPIETLQALQDMDGT

SEQ ID NO: 193072 - protein, 80 aa, Glycine max
  Coding DNA Sequence Number=SeqID_76294
MWVQAIGLFAQATCAPEFGLPRPLNQRLLVLHVGGGAVKQQGQPFPYAQESPTTRDPRSLNPFSEIRRREEEISRKRGRL

SEQ ID NO: 193073 - protein, 48 aa, Glycine max
  Coding DNA Sequence Number=SeqID_76295
ACRLPVEIEHKANWAVKICNFSFDQAGEETKLQLSELDKIDRGRKRIK

SEQ ID NO: 193074 - protein, 74 aa, Glycine max
  Coding DNA Sequence Number=SeqID_76296
MGLQIRFDGGGCMNNARQSIRGAPDSMIRFDGGGCMNNARQSIRGAPDSMVEDARTTLGNQFVGLWTRWGRMHE

SEQ ID NO: 193075 - protein, 110 aa, Glycine max
  Coding DNA Sequence Number=SeqID_76297
  Homolog annotation: Hit_ID=Q1SKD7; Match level="QueryCoverage=88%, HitCoverage=25%, E-value=1e-09, Identity=32%"; Hit description =Ankyrin
MALRKLPAKRSRKDKAAEGTSAAPEYDSHRFRSVEHQQRFEAIKGCSFHRERRVQLRDDEYTDFQEEIARRWWTSLVTPMAKFDPDIVLEFYANAWPTQEGVRDMRSWVR

SEQ ID NO: 193076 - protein, 227 aa, Glycine max
  Coding DNA Sequence Number=SeqID_76298
MADDELSSKCLDRLEATIVDLVITQASMAAKLDLLILKMDTLLISQHPLSASSAKALLAHTLMPTPPPMPTPSPMPIPPPRLALMQQHPAPLSAPLTIVVVHHPDNSKPQMSSPGRREAATHQIGAEFPSRRILPSVLCLSPSVMFIVKVRDKELDHPFLLPFYASIDAAKWLRFRNTNLHLRTSYFPSPFLIWVPVPLLKPWFEAQHLEDKVIKNFYGREIGFSYG

SEQ ID NO: 193077 - protein, 64 aa, Glycine max
  Coding DNA Sequence Number=SeqID_76299
MAHRGGIRQNVNRGKKTGTLVGLDNGNNITWSFTWQQLPVQPLVAEKPSSKKALGWCHPIGGRG

SEQ ID NO: 193078 - protein, 271 aa, Glycine max
  Coding DNA Sequence Number=SeqID_76300
  Homolog annotation: Hit_ID=Q9AV79; Match level="QueryCoverage=24%, HitCoverage=14%, E-value=2e-11, Identity=50%"; Hit description =Putative flowering-time gene protein
  Pfam annotation: Domain name=CCT; Domain location=176-214; Score =75.4; E_value=1.7e-19; Accession=PF06203.4; Description=CCT motif
MASIPQFYPNYTFTTHDLSEYPVPLLNGGGNASVMDSTTMWGGGQDSLSIPVLDMNNGALDHIVSLDCDTMACAANWMPSFSEQLGGLSDLAISDCKIGFYGGGFQSFNNSRSYQPHVGEFGDECCGFVEDLKPPPYPNAARENWGIEGNQMAAVEEPNIKVGRYSEEERKERILRYLKKRNQRNFNKTIKYACRKTLADRRVRVRGRFARNNELCEEDMATKKHENHHHHKEDFYGGDSIQFQLKNDEEDWLQEAMASLVYLSHSSPEDM

SEQ ID NO: 193079 - protein, 158 aa, Glycine max
  Coding DNA Sequence Number=SeqID_76301
MQKLLEWKMFLHHSFQDTVVWNSEISGEFLTKSGYWWLIKCDFPSNMGSGWKSIWQRLSQLFYGKFGKLGMLTFSSRKHVNLHHNVGKILIIHEAIIMAFDAHNDASDANSSSSKWVSCIHPIGNQVSLHGCNGNMDSWVIWRHRADGHHQRGAVSNS

SEQ ID NO: 193080 - protein, 35 aa, Glycine max
  Coding DNA Sequence Number=SeqID_76302
MGLVHDILMRFKCGSNLESMGLSIGGVTMLVCSKV

SEQ ID NO: 193081 - protein, 611 aa, Glycine max
  Coding DNA Sequence Number=SeqID_76303
  Gene Ontology: Mol. function=protein kinase binding; Cellular component=nucleus; Biological process=regulation of cyclin-dependent protein kinase activity
  Homolog annotation: Hit_ID=Q9FKE6; Match level="QueryCoverage=86%, HitCoverage=85%, E-value=1e-109, Identity=46%"; Hit description =Similarity to cyclin
  Pfam annotation: Domain name=Cyclin_N; Domain location=49-173; Score=- 28.8; E_value=0.049; Accession=PF00134.13; Description=Cyclin, N -terminal domain
  Subcellular localization annotation: CTP_CleavageSite=39; ConfidenceScore=5.22e-01
MCLFGGIFWNQYIAPATASIQPSIWSTTLNCFSMAVTLNSSTKVAPEDRGRSALLHHYRPATAAIQPAIWSTMAATLNCSATAAPVADRGHSAPLHLYSGTITIATVCMFLAGKVEETPRPLKDVILISYEIIHKKDPAAIMRIKQKEVYEQHKELILLGERVVLATLGFDLNVHHPYKPLVEAIKKFKVAQNALAQVAWNFVNDGLRTSLCLQFKPHHIAAGAIFLAAKFLKVKLPSDGEKVWWQEFDVTPRQLEEVSNQMLELYEQNRMPPSNDVEGGGTSNRTTAKALATNDENAAAKSNSQAGATRLETSKTASSMAIFDSPVPNHVGRPISNHGRSGDYGSTEMKHRVEGDAKGNQYPERESIPFKENSHEAQDVVKFRFDNGEKEHESNAGGTETKELTELKDRHNSRNPDHREDAFSRPPQEAIKKIDTDKVKAALEKRRKAAGHITKKTDVMDDDDLIERELEDGIELAPQSEKNKDKRQSWSKPSDRSDYDNMRGRHLDHEDEQYHGVKGLASYEPDLSAVEEGEVSALDDIGVGLPSPKSSNRKRKAGSSPERGMEGKQRHNYGLGPNHNNRFDYVEDRNKVSRLGHTERDSKRHVQENHV

SEQ ID NO: 193082 - protein, 768 aa, Glycine max
  Coding DNA Sequence Number=SeqID_76304
  Gene Ontology: Mol. function=protein serine/threonine kinase activity; Cellular component=cell surface; Biological process =protein amino acid phosphorylation
  Homolog annotation: Hit_ID=Q0ZCC5; Match level="QueryCoverage=93%, HitCoverage=35%, E-value=0.0, Identity=52%"; Hit description=CCHC -type integrase
  Pfam annotation: Domain name=B_lectin; Domain location=44-144; Score =63.6; E_value=6.4e-16; Accession=PF01453.15; Description=D-mannose binding lectin
  Pfam annotation: Domain name=PAN_2; Domain location=316-384; Score= -8.7; E_value=0.011; Accession=PF08276.2; Description=PAN-like domain
  Pfam annotation: Domain name=Pkinase; Domain location=480-747; Score =150.1; E_value=5.7e-42; Accession=PF00069.15; Description=Protein kinase domain
  Pfam annotation: Domain name=Pkinase_Tyr; Domain location=481-747; Score=85.9; E_value=1.2e-22; Accession=PF07714.7; Description =Protein tyrosine kinase
  Pfam module annotation: Pfam domain module=B_lectin::PAN _2::Pkinase::Pkinase_Tyr; Domain location=44-144::316-384::480 -747::481-747
VGDSLMAGNGTSRWLSPSGDFAFGFYQLPNEFFLLAVWYDKMPNKTIIWFANGDNPAPIGSRLELNDSGLVLNNPQGLELWRSNFASGTIFNGLMNDDGNFQLLDQNAVSLWETFTHPTDTLVPNQVMELNGKLFSRRGEFNFSHGRFKLHLQEDVNLVLSLINLPSNYSYEPYYDTGTADANNQTNIGMKLIFDKSGFLYILKKSGEKFYITKPNETISTNDFYYKATINYDGVFTVSYYPKDLRKGQGWVTTKTIPENICLSSTFTDGEGVCGFNSICNLKADQRPICNCPERYSLIDSNNMYGGCVPNFQVVCQGGGYMVSQDDYIMKELRNTDWPTSDYETLSPYSLKECTKSCLQDCLCVLVTFSGSSCWKKKLPLTNGRRDKGVNATSVIKLMKNDYLLTSFPNPNGKKDHDVLIVVLSVLLAGSVLIILMLVGALYFGFSCNRKKIESSRTNKSVAKKNLHDFTFKELVEATNNFREELGRGSFSIVYKGTIEMTSVAVKKLDKLFQDNDREFQTEVNVIGQTHHRNLVRLLGYCNEGQHRILVYEFMSNGTLASFLFSSLKSNWGQRFDIALGIARGLVYLHEECCTQIIHCDIKPQNILLDDQYNARISDFGLAKLLLINQSRTETGIRGTKGYVAPDWFRSAPITAKVDTYSFGVLLLEIICCRKNVEKELVNEEKGILTDWAYDCYKTRRLEILLENDDEAINDIKSFEKLVMIAIWCIQEHPSLRPTMKKVLLMLEGNVEVLTPPSPYLHGSISEN

SEQ ID NO: 193083 - protein, 205 aa, Glycine max
  Coding DNA Sequence Number=SeqID_76305
  Gene Ontology: Mol. function=protein serine/threonine kinase activity; Cellular component=anchored to membrane; Biological process=protein amino acid phosphorylation
  Homolog annotation: Hit_ID=Q1S6B1; Match level="QueryCoverage=98%, HitCoverage=68%, E-value=2e-37, Identity=47%"; Hit description =Thaumatin, pathogenesis-related
  Pfam annotation: Domain name=Thaumatin; Domain location=10-198; Score= 67.3; E_value=4.9e-17; Accession=PF00314.8; Description=Thaumatin family
  Subcellular localization annotation: CTP_CleavageSite=86; ConfidenceScore=5.45e-01
VNSTKFTLVNQCNYTVWPALMGNVNLSTLKGNDNLSTTGFVLRSGESSTVTPPAKWNGRIWGRTLCTNSSGNFSCVTGDCGSGKIACDGKAGSMPVTVLEFSLRHTHYADYYDVSLVDGFNVPFDNCSHKQQQQVTPVVGGPKNDIFVVLVVMRDPTANQACTTRKYSRLHARKPTATQKATKPACSAATILSITTLSFVLHLAT

SEQ ID NO: 193084 - protein, 833 aa, Glycine max
  Coding DNA Sequence Number=SeqID_76306
  Gene Ontology: Mol. function=RNA-directed DNA polymerase activity; Cellular component=nucleus; Biological process=RNA-dependent DNA replication
MVRLWNKLKRLQQDMRRFSKPLSNLKQNLIKAREDLQFAQENLRNNNMNGDSIDRVRQLTEEVINLNELEEKDAYAESKSGLDKERNNRRNIYMLQKTDGTLLENQSEIEDEIMDFYKKLMGTEDSQLHHIDIDAMRNGKQVNMDQRRYLVSNITEQDIERALKGIGDDKSPGIDGFGAKFFKASWCIVKEDVIAAILEFFNTERLYRGFNNTVVTLIPKGDNARYVKDYRPIAGCTTVYKIIAKIITERLGKILPSIISHSQAAFVPGQNIHNHILLAYELLNGYGRKGGTPRVMMQLDLHKAYDMVNWRAMECILKEIGLPMQFVSWIMTGVSTFSYRFNVNGIYSDIMQAKRGIRQGDPMSPMLFVIIMEYMHRTLVKMQQNPDFNHHSKCEKIGLTNLTFADDVLLFCRGDSKSVSMMMETIRKNSDSTGLKVNPAKCQMFFGGMDGCSKENLRRITDFAEGKLPVRYLGVPLSCKRLTIQQYMPLIDKIVDRVKHWTSKLLSYAGRIQLVKSITSAIAMYWMQCFPLPQFVLRKINAICRSFVWTGKQEISKKSLVAWDTMCRNKSQGGVGIINLQVWNIVSLMKCLWNICRNSENLWVLWVHTYYLKGNDAITAFVRPNSSWILKNIMNQRDKLGQIQQHWDQALSRQKFPMSAMYHGLTEEHQRVPWRSVMCGNKARPRAVICLWLACHKKLSTKDRLRRFGMIQSSDCSICNCADETINHLFFNCSGTREIWGNILDWLGRRHDPREWDMELAWIIENTKGKGWKSALLKMATAETVYNVWHYRNSMCFGTVVDKQVIERNIIDNIVYRSWQYPTLRSHVAKLMM

SEQ ID NO: 193085 - protein, 62 aa, Glycine max
  Coding DNA Sequence Number=SeqID_76307
MKGRTRVSFSPETRAKLEDSASIEGFLSVWGCNGEQRRNGSFAHTPDIFSTIPTVRSWTIVL

SEQ ID NO: 193086 - protein, 108 aa, Glycine max
  Coding DNA Sequence Number=SeqID_76308
  Gene Ontology: Mol. function=nucleic acid binding
  Homolog annotation: Hit_ID=Q1SKJ3; Match level="QueryCoverage=63%, HitCoverage=7%, E-value=7e-20, Identity=57%"; Hit description=Zinc finger, CCHC-type; Endonuclease/exonuclease/phosphatase
MAQAQKNDPLDDGGGGVSKGKVSFKDMTMANKQDALVASFEILDIGNGYFMVKFDNEDDQNKVIVDGPWMIFDHYLTVRTWFVDFISLQATIVKTMVWIQFPSLNLLY

SEQ ID NO: 193087 - protein, 182 aa, Glycine max
  Coding DNA Sequence Number=SeqID_76309
MQDEDPAAALRLLLNTSQANTSSEKNPGASSSSDADITSTKKRENGARLDAQKQAHILLLEKARAAQREVERLTKEAKEGSSEIKACDDNISSWEATITNLLSQVDDLRQKIVTEQAKRKELQEKAADSIQKLVAEKGREGLKAFSASQAVADEARAMESADQVLSKEMATLKKLYEDLIMT

SEQ ID NO: 193088 - protein, 64 aa, Glycine max
  Coding DNA Sequence Number=SeqID_76310
MVEVSGNRLLGCAIDYTEGWVTDNRLPASGNRLPRLCNRLPEMKSLQILLLIACSGYETHCAAA

SEQ ID NO: 193089 - protein, 145 aa, Glycine max
  Coding DNA Sequence Number=SeqID_76311
  Gene Ontology: Mol. function=nucleic acid binding; Biological process= DNA integration
  Homolog annotation: Hit_ID=Q1RSN0; Match level="QueryCoverage=97%, HitCoverage=22%, E-value=3e-11, Identity=29%"; Hit description=Zinc finger, CCHC-type
  Pfam annotation: Domain name=zf-CCHC; Domain location=73-90; Score =19.7; E_value=0.00056; Accession=PF00098.13; Description=Zinc knuckle
MNRMIKKRKGIALRASSTFIQEESDKEDLNEIEEGDDFIPFVKRFNKFLRNKRNQRKSNINSKKKGEDSSLAPKCYECNQPEHLRFDCLVLKRRMEKFDKRNFIEKKAYVTWEDNDMDPSGDSENKIINLGLMAKDYESEEELTH

SEQ ID NO: 193090 - protein, 305 aa, Glycine max
  Coding DNA Sequence Number=SeqID_76312
  Gene Ontology: Mol. function=RNA-directed DNA polymerase activity; Biological process=RNA-dependent DNA replication
  Homolog annotation: Hit_ID=Q2HRL0; Match level="QueryCoverage=38%, HitCoverage=24%, E-value=3e-27, Identity=41%"; Hit description=RNA -processing protein, HAT helix
MPIWVKLPQLPLCLWGLKSLNKIGSAIGNPLMTDECTTQKLRVSYARILVEVDTTQKLVEEITISDRTGGKIKQIVEYEWKPEFCEKCQKAGHQCGKKKVVKKWIPRNKQADEVKADPLPKTPVQNTETEGEDKPEGWITVGKAARHTGKAIEVIGKLKEISSRLLKLRPTIAILIETRVKNKNAKKIRDKLKLPHNYLDNYKWHDNGRLWIEWDNSKIDVRHVKCSSQYVHVVYALNQLDRRKVLWKDLEAIHKHQQGPWCVIGDFNNVTKAQDRIGGKAVTESEYIDLLNMMETTGLAEMDTT

SEQ ID NO: 193091 - protein, 396 aa, Glycine max
  Coding DNA Sequence Number=SeqID_76313
  Gene Ontology: Mol. function=RNA-directed DNA polymerase activity; Cellular component=intracellular; Biological process=RNA-dependent DNA replication
  Pfam annotation: Domain name=rve; Domain location=255-395; Score= -4.7; E_value=0.015; Accession=PF00665.16; Description=Integrase core domain
MDVPFKFDEECMIDFNTLKEKLIIAPINIAPNWSQGFELMCDASDYVVGAVLGQWRNKVFHSIYYASKVLNDAQMNYATIEKELLAIIVYALEKFRSYLIGSKIIIFIDHSAIKYVLANADSKPRLIWWVLLMQEFDLEIKDKNGCETLLVDHLSRLMNEEVTHKEQEIQDEFLDESLMVSRRNFEEAKGILWNCHNSPYRGNYSDEKISTNVLQSRFYLPSIFKDAYVHAQSCNKCQRTRSVSKRNELPLHTILEVEIFDYWGIDFVGPFPPSFSNEYILVAVDYVSKWVEAVACQKSDAKIVIKFLKKQIFSRLGVPWYTKKTRLKLLELEELRIHAYDSSKNNKERSKWSRLFLVKEGKPYGAVELVNPFATELARSWVVNGQRLKSYLIHLK

SEQ ID NO: 193092 - protein, 130 aa, Glycine max
  Coding DNA Sequence Number=SeqID_76314
  Homolog annotation: Hit_ID=A0A762; Match level="QueryCoverage=42%, HitCoverage=13%, E-value=3e-21, Identity=89%"; Hit description =Calreticulin-1
PFSAEAGFVALERLKDVVVKKKDFESQMEVGNTTRKNIFYDIDVARVLTDGKIVELNQIGKKDENLTGEWNHTSGQWNGDANDKGIQTSEDYRFYVISAEYPELGLFVSPDLNQDYLFDVGVIVWLEVQW

SEQ ID NO: 193093 - protein, 71 aa, Glycine max
  Coding DNA Sequence Number=SeqID_76315
MAKPHSSVGKEDSPRKKVIPKDPRWTKKKGDNITIQDLDYGVDDYIRGSMKKEKSPCSRVVDCLSFLIFQT

SEQ ID NO: 193094 - protein, 291 aa, Glycine max
  Coding DNA Sequence Number=SeqID_76316
  Gene Ontology: Mol. function=binding
  Homolog annotation: Hit_ID=UPI000060EA9A; Match level="QueryCoverage =39%, HitCoverage=13%, E-value=4e-15, Identity=37%"; Hit description =smooth muscle cell associated protein-1 isoform 1
  Pfam annotation: Domain name=TPR_1; Domain location=3-36; Score=7.7; E_value=0.65; Accession=PF00515.18; Description=Tetratricopeptide repeat
  Pfam annotation: Domain name=TPR_1; Domain location=40-73; Score =28.4; E_value=2.6e-05; Accession=PF00515.18; Description =Tetratricopeptide repeat
  Pfam annotation: Domain name=TPR_1; Domain location=74-107; Score =11.3; E_value=0.24; Accession=PF00515.18; Description=Tetratricopepti de repeat
  Pfam annotation: Domain name=TPR_2; Domain location=3-36; Score=18.5; E_value=0.024; Accession=PF07719.7; Description=Tetratricopeptide repeat
  Pfam annotation: Domain name=TPR_2; Domain location=40-73; Score =23.9; E_value=0.00059; Accession=PF07719.7; Description =Tetratricopeptide repeat
  Pfam annotation: Domain name=TPR_2; Domain location=74-107; Score =15.1; E_value=0.25; Accession=PF07719.7; Description=Tetratricopeptid e repeat
  Pfam module annotation: Pfam domain module=TPR_1::TPR_1::TPR_1::TPR _2::TPR_2::TPR_2; Domain location=3-36::40-73::74-107::3-36::40 -73::74-107
MAAPNRIERAHQMYRDGSYEEALGFYTEAIALAKTNPQKIALHSNRAACYLKLHDFKKAAEECTSVLELDHKHSGALMLRAQTLVTLKEYHSALFDVSRLLELNPSSEVYQNLQAPRESGSSRIKRSRERGKALAPIPESEEEFQEQEDEEPEVISQGENENEEMGEKYSSISNIRTDQKVELGKGIIIADCAPHETDLKFSSKQGRNQNHEPKKSIADAIAPKAPNRETTEQHSKGWQTIPKPKGHSALDYARWDSVEDDSSDDDDDDEDEESLPQYRFRVRTVGVRPVK

SEQ ID NO: 193095 - protein, 83 aa, Glycine max
  Coding DNA Sequence Number=SeqID_76317
MEIRSHWEGWRCENNITWPKSSLKLLCHHGPHVSKANTNGNDADVAPEFSPLKTVQFGNPSQDTVEPRDEGFGGRLWRWKWEK

SEQ ID NO: 193096 - protein, 52 aa, Glycine max
  Coding DNA Sequence Number=SeqID_76318
MSTFSLGTPKFLLIVVFFMVVSISWSLRVIPNHASKLASLQKEKPTIRDKKV

SEQ ID NO: 193097 - protein, 98 aa, Glycine max
  Coding DNA Sequence Number=SeqID_76319
MTIMMIICVNVDTNGDDGDDDNLSVGDGVNVNSDGGNNINGNDSDNNNDNSDNNVNGGSSVGINGDGSGGSDKNATNDSGTNIDGMVIMVVVVVEGYC

SEQ ID NO: 193098 - protein, 156 aa, Glycine max
  Coding DNA Sequence Number=SeqID_76320
MIAREWLQEREHEYENEMIVRSRTVWPCCRKECVRVRVRRRAREMSDNENENNFKEKQQPNFDDELQVYSKKDNDFIWRTPKSCIQLSRTFGTRHGKKTRTREYSPESVPTLTGNTQVDRVWVWVRVFPDNQKSGTGTGMGLLDPSRPRNRTRPAT

SEQ ID NO: 193099 - protein, 50 aa, Glycine max
  Coding DNA Sequence Number=SeqID_76321
  Gene Ontology: Mol. function=dihydrodipicolinate reductase activity; Biological process=lysine biosynthetic process via diaminopimelate
  Homolog annotation: Hit_ID=O80574; Match level="QueryCoverage=72%, HitCoverage=10%, E-value=8e-10, Identity=83%"; Hit description =Expressed protein
MEEVLKCLKLEMAVVQVLESHQASKVDASGTAKAVISCFNKLGVSYDMDQ

SEQ ID NO: 193100 - protein, 162 aa, Glycine max
  Coding DNA Sequence Number=SeqID_76322
  Gene Ontology: Mol. function=hydrolase activity, acting on carbon -nitrogen (but not peptide) bonds; Cellular component=cellular _component; Biological process=nitrogen compound metabolic process
  Homolog annotation: Hit_ID=Q45R31; Match level="QueryCoverage=84%, HitCoverage=68%, E-value=1e-45, Identity=71%"; Hit description =Putative carbon-nitrogen hydrolase family protein
  Pfam annotation: Domain name=CN_hydrolase; Domain location=28-157; Score=19.7; E_value=2.7e-06; Accession=PF00795.12; Description =Carbon-nitrogen hydrolase
MSATSVNSERALAPPAIPLPPPPLSNFKIGLYQLSVSPDKDNNIAHARTAIQDDASKGAQLVLLPEIWNSPYSNDSFPVYAEDIDAGASPSTAMLSELSRILKITIVGCFIPESYGGLLYNTCCVFGTDENLLAKDRKRCMVAKGNESYYGCSLVRLDKALK

SEQ ID NO: 193101 - protein, 116 aa, Glycine max
  Coding DNA Sequence Number=SeqID_76323
MTSSSVNVILHYNGAIIKTKHGSTFVSDSPKVIQLDNKMSLHALKQAIGNKICLPNGKVVNDIYFQLPVSFVGNYGQYRAYILHDDADVMTMFSMFKQVSNLTCLKLYITTTNTPT

SEQ ID NO: 193102 - protein, 198 aa, Glycine max
  Coding DNA Sequence Number=SeqID_76324
MLKFTSVQLVDDEDIKEPTSSTQLNELEFTTEPSLSNKELSPFSEDEDEVLRSKPQEDDEEQVVLVSPITIVPPYYIPPHMHNFEESNFVVSEYNHSLDHEEVQHLVETLFEGMHFLTKQGVQHALQQYHFCLEVQGSIHPCKPCIDGFQYCKPIVQVDGTRLYDKYKGTLLVVVAQDDNNKILQIAFTVVEGETTEA

SEQ ID NO: 193103 - protein, 210 aa, Glycine max
  Coding DNA Sequence Number=SeqID_76325
QEKERERARNAAEFEFLSNNTSNNNTVVTADELFFEGKLLPFWQMQHLEKLSKINLKTKEGEEEEEEELEEEVVVVSNNNKEDNNNSNSSSRVNWFVDDDPSPRPPKCTVLWKELLRLKKQRASSLSPSSSSSSSSSSASSLGDVAAKEGSRSSSNKEHQQHVKRVKKGLERTRSATIRIRPMINVPICTQVKSSALPPLFPIKKGKLER

SEQ ID NO: 193104 - protein, 39 aa, Glycine max
  Coding DNA Sequence Number=SeqID_76326
MKSKAIPSRVKVLPPSGSTSKTSPALIEGPKEELAAGVK

SEQ ID NO: 193105 - protein, 695 aa, Glycine max
  Coding DNA Sequence Number=SeqID_76327
  Gene Ontology: Mol. function=protein binding; Cellular component =cytoskeleton; Biological process=vacuole fusion, non-autophagic
  Homolog annotation: Hit_ID=Q00U71; Match level="QueryCoverage=78%, HitCoverage=40%, E-value=4e-95, Identity=39%"; Hit description =Chromosome 16 contig 1, DNA sequence
  Pfam annotation: Domain name=Arm; Domain location=157-205; Score =23.4; E_value=0.0008; Accession=PF00514.13; Description =Armadillobeta-catenin-like repeat
  Pfam annotation: Domain name=Arm; Domain location=207-243; Score =21.0; E_value=0.0043; Accession=PF00514.13; Description =Armadillobeta-catenin-like repeat
  Pfam annotation: Domain name=Arm; Domain location=245-285; Score =43.3; E_value=8.5e-10; Accession=PF00514.13; Description =Armadillobeta-catenin-like repeat
  Pfam annotation: Domain name=Arm; Domain location=287-327; Score =14.4; E_value=0.19; Accession=PF00514.13; Description=Armadillobeta -catenin-like repeat
  Pfam annotation: Domain name=Arm; Domain location=329-369; Score =32.4; E_value=1.6e-06; Accession=PF00514.13; Description =Armadillobeta-catenin-like repeat
  Pfam annotation: Domain name=Arm; Domain location=370-410; Score =19.5; E_value=0.012; Accession=PF00514.13; Description=Armadillobeta- catenin-like repeat
  Pfam annotation: Domain name=Arm; Domain location=485-525; Score =17.4; E_value=0.054; Accession=PF00514.13; Description=Armadillobeta- catenin-like repeat
  Pfam annotation: Domain name=BTB; Domain location=546-654; Score =105.5; E_value=1.5e-28; Accession=PF00651.21; Description=BTBPOZ domain
  Pfam annotation: Domain name=HEAT; Domain location=208-245; Score =1.6; E_value=27; Accession=PF02985.12; Description=HEAT repeat
  Pfam annotation: Domain name=HEAT; Domain location=250-287; Score =9.8; E_value=2.7; Accession=PF02985.12; Description=HEAT repeat
  Pfam annotation: Domain name=HEAT; Domain location=293-329; Score =3.4; E_value=16; Accession=PF02985.12; Description=HEAT repeat
  Pfam annotation: Domain name=HEAT; Domain location=335-371; Score =18.8; E_value=0.019; Accession=PF02985.12; Description=HEAT repeat
  Pfam annotation: Domain name=HEAT; Domain location=381-412; Score =4.6; E_value=12; Accession=PF02985.12; Description=HEAT repeat
  Pfam annotation: Domain name=HEAT; Domain location=450-486; Score =2.1; E_value=24; Accession=PF02985.12; Description=HEAT repeat
  Pfam annotation: Domain name=HEAT_PBS; Domain location=192-225; Score= 2.9; E_value=40; Accession=PF03130.6; Description=PBS lyase HEAT-like repeat
  Pfam annotation: Domain name=HEAT_PBS; Domain location=230-267; Score= 1.7; E_value=58; Accession=PF03130.6; Description=PBS lyase HEAT-like repeat
  Pfam annotation: Domain name=HEAT_PBS; Domain location=314-351; Score= 9.7; E_value=4.5; Accession=PF03130.6; Description=PBS lyase HEAT -like repeat
  Pfam annotation: Domain name=HEAT_PBS; Domain location=356-392; Score= 5.5; E_value=17; Accession=PF03130.6; Description=PBS lyase HEAT-like repeat
  Pfam module annotation: Pfam domain module=Arm::Arm::Arm::Arm::Arm::Ar m::Arm::BTB::HEAT::HEAT::HEAT::HEAT::HEAT::HEAT::HEAT_PBS::HEAT _PBS::HEAT_PBS::HEAT_PBS; Domain location=157-205::207-243::245 -285::287-327::329-369::...
  Pfam module annotation: Domain location=370-410::485-525::546 -654::208-245::250-287::293-329::335-371::381-412::450-486::192 -225::230-267::314-351::356-392
MELQRRQDQSLSQRKGQKRKLDEEQHHEDRQISPAPPTADERAALLSDVAEQVSILESTFTWNEADRSAAKRATHALADLAKNGKKSMPPPISPRVAAFVWIAVSDVVNLIVEGGAIPALVKHLQAPPLSDRVQNPLPFEHEVEKGSAFTLGLLAVKPEHQQFIVDSGALTHLVDLLKRHRNGLTSRAINSLIRRAADAITNLAHENSSIKTRGGIPPLVHLLDFADAKVQRAAAGALRTLAFKNDENKNQIVECNALPTLILMLRSEDAGVHYEAVGVIGNLVHSSPNIKKEVLLAGALQPVIGLLSSCCSESQREAALLLGQFAATDSDCKVHIVQRGAVQPLIEMLQSPDVQLREMSAFALGRLAQDPHNQAGIAHNGGLVPLLKLLDSKNGSLQHNAAFALYGLADNEDNASDFIRVGGVQRLQDGEFIVQATKDCVAKTLKRLEEKIHGRVLNHLLYLMRVSEKGCQRRVALALAHLCSSDDQRIIFIDHYGLELLIGLLGSSSSKQQLDGAVALCKLADKASTLSPVDAAPPSPTPQVYLGEQYVNNATLSDVTFLVEGKRFYAHRICLLASSDAFRAMFDGGYREKEARDIEIPNIRWEVFELMMRFVYCGSVDVTLDIAQDLLRAADQYLLEGLKRLCEYTIAQDISLENVSSMYELTEAFNAISLRHACILFILEQFDKLSSRPGY

SEQ ID NO: 193106 - protein, 277 aa, Glycine max
  Coding DNA Sequence Number=SeqID_76328
  Gene Ontology: Mol. function=protein binding; Cellular component =integral to membrane; Biological process=protein amino acid phosphorylation
  Homolog annotation: Hit_ID=Q10QT0; Match level="QueryCoverage=64%, HitCoverage=34%, E-value=1e-43, Identity=50%"; Hit description =Leucine-rich repeat family protein, putative, expressed
MEDNYSVQDFQKDEKGAIVLMTEEKRATVVAVSDGSSVEGSLEIFENKEAQLAKNELEEAIAEEKFKICTTNDWLRPSFRKINLFGPLRLSSKKSRGFLINCGAHSAAQFQNRTWLPDSAFISSGTPLNVTTPVLFPTLHTLRSFPRRVNKHCYNIPVYRGAQYLVRTTYFYGGVNGADHPSPPVFDQILDGTLWSVVNTTRDYADGNSSFYEGVFLAQGKIMSLCIGSNTYTDSDPFISALEFVILEGSLYNSTDFTRYGLALIARHGFGYSGPPI

SEQ ID NO: 193107 - protein, 1088 aa, Glycine max
  Coding DNA Sequence Number=SeqID_76329
  Gene Ontology: Mol. function=nucleic acid binding; Cellular component= SWI/SNF complex; Biological process=negative regulation of transcription from RNA polymerase II promoter
  Homolog annotation: Hit_ID=Q9SFG5; Match level="QueryCoverage=97%, HitCoverage=88%, E-value=0.0, Identity=64%"; Hit description =Putative transcriptional regulator
  Pfam annotation: Domain name=DEAD; Domain location=387-554; Score= -14.8; E_value=0.0001; Accession=PF00270.19; Description=DEADDEAH box helicase
  Pfam annotation: Domain name=Helicase_C; Domain location=731-810; Score=102.4; E_value=1.3e-27; Accession=PF00271.21; Description =Helicase conserved C-terminal domain
  Pfam annotation: Domain name=ResIII; Domain location=383-548; Score =6.3; E_value=1.4e-05; Accession=PF04851.6; Description=Type III restriction enzyme, res subunit
  Pfam annotation: Domain name=SNF2_N; Domain location=389-678; Score =446.1; E_value=4.4e-131; Accession=PF00176.13; Description=SNF2 family N-terminal domain
  Pfam module annotation: Pfam domain module=DEAD::Helicase _C::ResIII::SNF2_N; Domain location=387-554::731-810::383-548::389-678
MSIHITISINREWSLSWSSDNFTEELWYCVDPELPSSRGEDLQTKCLLELYGLKLAELQMKVRSDVSSEYWLNAKCAYPDRQLFDWGMMRLRRPLYGVGDPFAMDADDQLKKKREAERLSRLEEKEKNHIETRTRKFFAEILNTVREFQLQIQASVKRRKQRNDGVQRIVLGVWEVSEKYKLIITPEAPGASTLSVVLQISIGFQPSLKHLSSHDWTLKQYRPMIDTLAIIQSLSVYAFLLAWHGRQRQRATRAEKLRFQALKADDQEAYMRMVKESKNERLTLLLEETNKLLVNLGAAVQRQKDNKYSNGIEALEDSEADLLESDALKNGVSKESPLDEDIDMIDSDHNGDSSDLLEGQRQYNSAIHSIQEKVTEQPSMLQGGELRPYQIEGLQWMLSLFNNNLNGILADEMGLGKTIQTISLIAHLMEHKGVTGPHLIVAPKAVLPNWVNEFTTWAPSITAILYDGRLDERKAMKEELSGEGKFNVLLTHYDLIMRDKAFLKKIQWKYLIVDEGHRLKNHESALARTLDNGYRIQRRLLLTGTPIQNSLQELWSLLNFLLPNIFNSVQNFEDWFNAPFADRVDVSLTDEEQLLIIRRLHQVIRPFILRRKKDEVEKFLPGKSQVILKCDMSAWQKVYYQQVTDVGRVGLDNGSGKSKSLQNLTMQLRKCCNHPYLFVGDYDMYRRKEEIVRASGKFELLDRLLPKLRRAGHRVLLFSQMTRLMDTLEVYLRLHDFKYLRLDGSTKTEERGNLLRKFNAPDSPYFMFLLSTRAGGLGLNLQTADTVIIFDSDWNPQMDQQAEDRAHRIGQKKEVRVFVLVSVGSIEEVILERAKQKMGIDAKVIQAGLFNTTSTAQDRREMLEEIMRRGTSSLGTDVPSEREINRLAARSDEEFWLFEKMDEERRQKENYRSRLMEEHELPDWVYSPMNKDDKAKDFNSGVTGKRKRKEVVYADTLSDLQWMKAVENGEDISKFSGKGKRRDHRSSDSVAQASDNTGAEESLELRTESVPMENERTSEDSFHVTPPAKRFKPEGTNFLKHTYEDVGSGLNRHLLSWNTHKKKRSSFLGQGSLSDTRGHSSNGRANWN

SEQ ID NO: 193108 - protein, 92 aa, Glycine max
  Coding DNA Sequence Number=SeqID_76330
  Homolog annotation: Hit_ID=Q9SFG5; Match level="QueryCoverage=90%, HitCoverage=9%, E-value=1e-16, Identity=48%"; Hit description =Putative transcriptional regulator
MENERHAKTLICALNLLSRDLPLPPHILNSVSSIYRNNHGDGGNSGEDLMTDLEDALSKQRPNCVPGFKLEQSRDNRYRSLIQHRLNELQGQ

SEQ ID NO: 193109 - protein, 158 aa, Glycine max
  Coding DNA Sequence Number=SeqID_76331
  Homolog annotation: Hit_ID=Q9SBU1; Match level="QueryCoverage=31%, HitCoverage=24%, E-value=7e-16, Identity=79%"; Hit description=GTP binding protein
MCLALQPSAVMLALCTTLANLLVVQRDREEGSSIQENPSLPSSVFFSLVFVQRDCEEASNRQVKAVFTAPWFCNVTREEVSSILTLTHISAQQQRFVTFNLHGYLRFNIFTPKALAINDATVKFETWDTTGQERYHSLAPMYYRGVAAAIIVYDITSS

SEQ ID NO: 193110 - protein, 77 aa, Glycine max
  Coding DNA Sequence Number=SeqID_76332
MHKYPKCGISWYKVKDDDECNSDELTMKGPPAKWKMINRLYLDFEKEARNLRLGLATDGINPYGSLSTQCNIPIFRK

SEQ ID NO: 193111 - protein, 235 aa, Glycine max
  Coding DNA Sequence Number=SeqID_76333
  Gene Ontology: Mol. function=deoxyribose-phosphate aldolase activity; Cellular component=cytoplasm; Biological process=deoxyribonucleotide catabolic process
  Homolog annotation: Hit_ID=UPI000051AB2F; Match level="QueryCoverage =51%, HitCoverage=34%, E-value=5e-29, Identity=52%"; Hit description =PREDICTED: similar to CG12128-PA, isoform A, partial
  Pfam annotation: Domain name=DUF171; Domain location=45-231; Score =98.8; E_value=1.6e-26; Accession=PF02598.7; Description =Uncharacterized ACR, COG2106
MAKKNKKQATEGEVEPELNTNNDDSDDSHNKKKLKKKNKKMKIPTVSIAVPGSIIDNVPTLELATRLAGQIARAATIFRINEVVVFDNKSNPDNDSVLDNSNDESGASFLMQILQYLETPQYLRKALFPMHNSLRFVGLLPPLDAPHHLRKHEWGPYREDYILNHESLISKNKCSRDKNAEVLIYCNNFIGVTVKERHLNSGATLVDVGLVKIKSLWPVSVLLIWLLSRLQFICV

SEQ ID NO: 193112 - protein, 125 aa, Glycine max
  Coding DNA Sequence Number=SeqID_76334
  Gene Ontology: Mol. function=binding; Cellular component =mitochondrial inner membrane; Biological process=transport
  Pfam annotation: Domain name=Mito_carr; Domain location=17-108; Score= 11.0; E_value=0.00035; Accession=PF00153.17; Description =Mitochondrial carrier protein
MMSFSKGYSLARWTLYPNGYLLLTFVFSGHITWCKVMIQAAESEDDKSTEAERKAQRTISGALYTIWKREGILGFFKGLQAHILKTVLSSALLLMVKEKIAKSTWILILVIGRYLSVNSPKLKAV

SEQ ID NO: 193113 - protein, 278 aa, Glycine max
  Coding DNA Sequence Number=SeqID_76335
  Gene Ontology: Mol. function=protein serine/threonine kinase activity; Biological process=protein amino acid phosphorylation
  Homolog annotation: Hit_ID=Q40541; Match level="QueryCoverage=96%, HitCoverage=42%, E-value=2e-32, Identity=35%"; Hit description =Protein kinase
MATYGMNSRNFLDSVQGSTCTGLKDVCQIDSIRFSTVYHKADSYQRASNNDDDMCQMDEDDFFIDSSVKSKSLLASDDIKSFNPMCKPLDGRPFNFDETQYLEKRRPNLPFSSEPLGTEDDDEVTESKIRAFLDDKALELKKLQTPLYEEFRNISNAAIAPAPIEVAKIKVMSDVSNVTSSIGRSASQAWRRFSMVGSANVASPGSHTKYRSNLSGAHCRPLQEIQPSELNESEETLHDAELESSNVSSSFSERQRKWKEELVEELDWKRGKFSLPQL

SEQ ID NO: 193114 - protein, 271 aa, Glycine max
  Coding DNA Sequence Number=SeqID_76336
MDFVDRVIAIRKPLDLNIFALVCEVFTDASRFNSWAFIMADILLNLPSSIHFSNLKLLTLQYVVFPGYESTQQLFSGLPVLEELTLDSCCWLNFEIVTIALPMLKKLDIKENLADHDNCQFFIIAENLNSFYYIDTLKNDYWIYNTVSLDWGLMGLCSTDDIGESSRLREVAQRAGRLRGISCAKELLLTPYAFEGICLSGNHEGGSWILDPVPSSCFSRHLKFIRMSILWNRWGTARKGMFLNNCECFLEPPLTAQSIFLELLYGGPSGK

SEQ ID NO: 193115 - protein, 104 aa, Glycine max
  Coding DNA Sequence Number=SeqID_76337
  Gene Ontology: Mol. function=nucleic acid binding; Biological process= DNA integration
MVLEHMKEKIGYRWILGTKFKADGSIDRHKAYLVAKGYTQQAGIGLFGNLLTSGQNAKGENLACKLNQFVYGLQQASKQWFPKLSCAIISSGFIQSSAAQLLVS

SEQ ID NO: 193116 - protein, 118 aa, Glycine max
  Coding DNA Sequence Number=SeqID_76338
MATLHSHPFSEPHERYCLGLFMCPPLSCLELCFTIAEVRTLKAMLHSHPFPEPHECYCLALFMCPPHSSLELCFMIDYVRTLKAILHSHPFSEPHERYCLGLLMCPPPSSLELCFMIA

SEQ ID NO: 193117 - protein, 90 aa, Glycine max
  Coding DNA Sequence Number=SeqID_76339
MSEYAVASWLFERDYPHPAVDLGVAKALGRHVEVSERQRKRKQFPASITHSFINGQQHQSPRALIEAYGSDKSQQTSSSKSLLVEPLDNK

SEQ ID NO: 193118 - protein, 81 aa, Glycine max
  Coding DNA Sequence Number=SeqID_76340
  Pfam annotation: Domain name=zf-CCHC; Domain location=45-62; Score =14.7; E_value=0.0037; Accession=PF00098.13; Description=Zinc knuckle
DSDEDEFAFISRKIRMMWRNKNGSKWRSSSRRMSWGKKDKNKSSIVYYECKKLGHFKLECPDLEKSQDKKKFFKTNEKKGS

SEQ ID NO: 193119 - protein, 525 aa, Glycine max
  Coding DNA Sequence Number=SeqID_76341
  Gene Ontology: Mol. function=DNA binding; Cellular component=nucleus; Biological process=regulation of transcription, DNA-dependent
  Homolog annotation: Hit_ID=Q0PJB9; Match level="QueryCoverage=60%, HitCoverage=86%, E-value=1e-118, Identity=73%"; Hit description=MYB transcription factor MYB131
  Pfam annotation: Domain name=Myb_DNA-binding; Domain location=104 -149; Score=57.7; E_value=3.7e-14; Accession=PF00249.21; Description =Myb-like DNA-binding domain
MYICFGLSVVALDQIESTRSTIFGSASNIHSNGEKQSENVAHIPSVGNNQTPKVALLHKLKYSFPFHGEIWLKNYLYVALLFLIPETSFNSHQVRKPYTITKQREKWTEEEHQKFLEALKLYGRGWRQIEEHIGTKNAVQIRSHAQKFFSKVVRESEGSAESSIQPINIPPPRPKRKPLHPYPRKSVNSFKGHCIPNETEISPSTNLLVAEKDTPSPTSVLSTVGSEAFGSQFSEQTNRCLSPNSCTTDIHSVSLSPAEKENDCMTSKASEEEEKASPASLPLSTVSNPNMCMKPEFSSKDTFIEDAANMPQTTSIKLFGRTVSMVGNQKSLNIDDDDGKPITVKSDEVDDVENEKLGQSGESKQVDTQLSLGVVSGNWIITPDADGANTTSIEPPKENLCFSECAPDASFPQWSLYQGLPPFYLRPCNQVLNPLPLRPSLKVRTREEESCCTGSNTESVCDMENQGKNSDAVDSKCQKYHKEGAAPQKRARGFVPYKRCLSERDGNSLIVDMEEREGQRARVCS

SEQ ID NO: 193120 - protein, 181 aa, Glycine max
  Coding DNA Sequence Number=SeqID_76342
  Homolog annotation: Hit_ID=Q9FX45; Match level="QueryCoverage=36%, HitCoverage=36%, E-value=2e-21, Identity=69%"; Hit description=RNA -binding glycine-rich protein, putative
  Pfam annotation: Domain name=RRM_1; Domain location=90-161; Score =76.2; E_value=1.1e-19; Accession=PF00076.12; Description=RNA recognition motif. (a.k.a. RRM, R
  Subcellular localization annotation: CTP_CleavageSite=6; ConfidenceScore=5.63e-01
MANNVVVVLKVAPVSLPPFPITNNALTFKSQRHTLHLNCFQTKNRTTSFPSSSSILRNKASCSVLACLPPESSTSSSTAKPSFPSPQTKLYVSGLSFRTTEESLRNAFKNFGQLVEVKLVMDRIANRPRGFAFLRYATEEESQKAIEGMHGKMHKWKFILSRRVIWRVRVFCNFLWFANFK

SEQ ID NO: 193121 - protein, 237 aa, Glycine max
  Coding DNA Sequence Number=SeqID_76343
  Gene Ontology: Mol. function=DNA binding; Cellular component=nucleus; Biological process=regulation of transcription
  Homolog annotation: Hit_ID=Q9LSH5; Match level="QueryCoverage=94%, HitCoverage=97%, E-value=1e-105, Identity=75%"; Hit description =Similarity to NAM
  Pfam annotation: Domain name=NAM; Domain location=6-134; Score=308.1; E_value=1.6e-89; Accession=PF02365.6; Description=No apical meristem (NAM) protein
MSPVGLPPGFRFHPTDEELVNYYLKRKINGQEIELDIIPEVDLYKCEPWELAEKSFLPSRDPEWYFFGPRDRKYPNGYRTNRATRAGYWKSTGKDRRVSCQSRPIGMKKTLVYYRGRAPQGIRTDWVMHEYRLDDKECEDTTGLQDTYALCRVFKKNGICSDIEEQGQCSISLIESSQTITNECETMSPDIPGASSSCLEEEDKDDSWMQFITEDAWYSSNAAMVGGEEVSHVTFTN

SEQ ID NO: 193122 - protein, 44 aa, Glycine max
  Coding DNA Sequence Number=SeqID_76344
MAVNQDGTHTRTLCVGTIYLFIKMAPNGANSTSKRWTGDKTHLL

SEQ ID NO: 193123 - protein, 96 aa, Glycine max
  Coding DNA Sequence Number=SeqID_76345
VLAKLLCTRLDSDELSACCKGLLEEEKDLVGKVECITVERDELAKVVTHLKARLKESEYRLEESELRVAKERPWIFFINGVFCFLKINDSGIEKKE

SEQ ID NO: 193124 - protein, 647 aa, Glycine max
  Coding DNA Sequence Number=SeqID_76346
  Gene Ontology: Mol. function=sequence-specific DNA binding; Cellular component=nucleus; Biological process=regulation of transcription, DNA-dependent
  Homolog annotation: Hit_ID=Q38887; Match level="QueryCoverage=99%, HitCoverage=89%, E-value=0.0, Identity=57%"; Hit description =Meristem L1 layer homeobox protein
  Pfam annotation: Domain name=START; Domain location=166-385; Score =194.0; E_value=3.6e-55; Accession=PF01852.10; Description=START domain
SQQERYENNLLRVENDKLRAENSRYRNALSNTSCPNCGAPTTLGEMSFDEQQLRMENARQKEEIDSMSGLAAKYAAGKSASNSYYNMPSNQNQMPSRSLDLGVVNNNSSINNNNSSINNSNNKNNNNNNYIVQAQPVAMVGEMYGGNDPLRELPLLSSFDKDLISEIGLVAVEEINQLTLSADPLWVPGNYGSEVINEDEYLRHFPRGIGPTLLGARTESSRQTAIVMMHHMKLVEMLMDVNQWSNMFCGIVSRAVTHEVLSIGDHARYDGAYQVMSAEFQVPSPLVPTRDNYFIRFSKKHAGQSWAVVDISMDHLRPGAVTRTRRRPSGCIIQELPNGYSKVIWVEHVEVDDIEVHNLYKNLVNSTLAFGAKRWIAAIERTCEHLARAMATNIPQGALCVITSHEGRKSMMKLAERMVLSFSTGVGASTANAWTPLPLDLENVRVMTRKSVDDPGRPSGIVLSAATSLWLPVPARRVFDFLRSENTRNQWDILSSGAQVNELAHIAKGRDHGNSVSLLRVNTQNVAQNNMLILQESCIDATGSFVVYAPIDLASMNLVLGGGNPDYVALLPSGFAVLPDGPALNVVPGPVCEVVGSGRGCLLTVAFQILVDSTPTAKLSVGSVTTVNNLIKRTVERIKDSVTLDGA

SEQ ID NO: 193125 - protein, 130 aa, Glycine max
  Coding DNA Sequence Number=SeqID_76347
  Gene Ontology: Mol. function=sequence-specific DNA binding; Cellular component=nucleus; Biological process=regulation of transcription, DNA-dependent
  Homolog annotation: Hit_ID=Q93V99; Match level="QueryCoverage=79%, HitCoverage=14%, E-value=5e-25, Identity=54%"; Hit description =Protodermal factor2
  Pfam annotation: Domain name=Homeobox; Domain location=75-130; Score =59.0; E_value=1.6e-14; Accession=PF00046.19; Description=Homeobox domain
  Subcellular localization annotation: CTP_CleavageSite=50; ConfidenceScore=5.26e-01
MYNKSQNTKFDSQQQQQQQQPQQQQPQNLMEMSTQRTSSEGRNRDDQEPAAGNEVTMEAPPSGDEDQDPDEGFKRRRHTRHTLHQISEMEAFFKECPHPDEKQRKALGRELGLVPLQIKFWFQNKRTQVK

SEQ ID NO: 193126 - protein, 130 aa, Glycine max
  Coding DNA Sequence Number=SeqID_76348
MYEQETYNIGPKNQNLKLHFDSMFNPFQYGGLATSTIYEHNFFLNDCIAPTPSITHLPNKSKSPTVVYLVELGETSLYFGMKAMEKAVMLNRRKVKKRLSHEVPKVTIEFSLAVGLSAQPPLSAASTRLA

SEQ ID NO: 193127 - protein, 134 aa, Glycine max
  Coding DNA Sequence Number=SeqID_76349
  Subcellular localization annotation: CTP_CleavageSite=52; ConfidenceScore=5.24e-01
MSCLAIITPISLWLSASWCMPPSRHPLDPNKSNRALGFSALIMGLCQSFRVPVTHSKVIRPPITRAFIEKYLTPRQAQGYAHQAADAPPPPWQADPTGSLGIERYLQHLVRQQVANHRGQVQIHECLYRFSLSQ

SEQ ID NO: 193128 - protein, 352 aa, Glycine max
  Coding DNA Sequence Number=SeqID_76350
  Gene Ontology: Mol. function=chitin binding; Cellular component =extracellular region; Biological process=chitin metabolic process
  Homolog annotation: Hit_ID=UPI00006A17C9; Match level="QueryCoverage =88%, HitCoverage=100%, E-value=2e-19, Identity=26%"; Hit description= UPI00006A17C9 related cluster
  Subcellular localization annotation: CTP_CleavageSite=55; ConfidenceScore=5.18e-01
STLEDPTTLRRLHALTFRGLHALTLRNTRPHLQRAARSHLQRASRPRLQRTTCPRLQRTAHHPLQRTTRPRHQRTTGLHTLTIRGLHALAIRRLHVLAFMGLHVLAFIELHVLPFRAIHAPAFRGLHVLTFKGLHALALKGLQVLAFRGLHVLAIRGLHVLAIKGLHALTFRGLLFLALRTTRPHLERATRPHHQRTTRPRLQRATRSRLQRTTHPHFQTTTRPLLQMITRRRLQRATRPYLQRTTRPRLQRTSRPRLLRTTRPRLQCTMRPHLQRTTRPRLQRATRSRLQRTTHPRLQTTTRLHVLTFTGLHTLTIRGLHVLAFRELHVLAFRGLHRGLDILAFRGLDVLA

SEQ ID NO: 193129 - protein, 159 aa, Glycine max
  Coding DNA Sequence Number=SeqID_76351
MWLPPKRWNEKPRGLVGKNTAGTNSEGLCGVATASLNSEERKGTNHKLARGPNEVSLSGLCETETNMLAIITKYQEELNLAVAHEHRVADEYAQVYAEKEARGRVTDSLHQEATIWMDRFALNLNGSQELPRLLAKAKAMADTYSAPEESIDFSAIVSI

SEQ ID NO: 193130 - protein, 428 aa, Glycine max
  Coding DNA Sequence Number=SeqID_76352
  Gene Ontology: Mol. function=hydrolase activity, acting on carbon -nitrogen (but not peptide) bonds; Biological process=carbohydrate metabolic process
  Homolog annotation: Hit_ID=Q81YQ8; Match level="QueryCoverage=96%, HitCoverage=43%, E-value=2e-75, Identity=38%"; Hit description =Glycosyl transferase, group 2 family protein/polysaccharide deacetylase family protein
  Pfam annotation: Domain name=Polysacc_deac_1; Domain location=111 -241; Score=128.7; E_value=1.6e-35; Accession=PF01522.11; Description= Polysaccharide deacetylase
MRHRVFNTMRFSSEYPLAGTALWRLGSEDSRIWNFYDKDLTFAGLPKLDLKKLENVKGQTMVDYIGDGEVLDVLNTPHDGKIALETDPKEKIITDENYITYPSSYEVKKYGWAPQKELVLTFDDGPDETYTPQVLDILSKYHVPAAFFLIGLNAEKNLPLVKRIYREGHEIGNHTFTHENVAKVSPERALLEMKLTRLLFECITGHSTILFRAPYNADSEPTTSEEIIPVALARQQNYLDIGESIDPEDWQPGIKADEIVKRVMQGIKQERGNIILLHDAGGDTREETIKALKILIPTLQKQGYHFTNLASILHKSKNELMPAVPKTKSYYIMQLNLVLATVIYGISHFLVALFTIFIILGIIRLLFMVYWAVKEKSKEKKLSNFPVLDSYPKMTEVKISLIQRPGKNLLNILNSRFSRKLTEEKQPL

SEQ ID NO: 193131 - protein, 99 aa, Glycine max
  Coding DNA Sequence Number=SeqID_76353
MVMMVVAVVTMVTTMAMVVTATIMTVSDDNKAGGGCYDDNGDDDDSGCYGSDGCYGDNGRVVVVIVMTRAKVTVVAAAVMAVSGGNNNDGGGGCDSYME

SEQ ID NO: 193132 - protein, 115 aa, Glycine max
  Coding DNA Sequence Number=SeqID_76354
  Homolog annotation: Hit_ID=Q1SP03; Match level="QueryCoverage=87%, HitCoverage=18%, E-value=7e-12, Identity=36%"; Hit description=IMP dehydrogenase/GMP reductase
MGTNQNGKRFYQVKVKSLDVTSLKELGRLMGPLQRQAFRKVYGKILDLAAAEVFTEVVVSLAQYYDQPLRCFTFGDFQMVPTIEEFEEILGCPLGGRKPYLFSGFLPSLSKIAAV

SEQ ID NO: 193133 - protein, 93 aa, Glycine max
  Coding DNA Sequence Number=SeqID_76355
  Subcellular localization annotation: CTP_CleavageSite=68; ConfidenceScore=5.22e-01
MDHAIIPFLGFWDVMELYGLRTNTSFRLPACHGTSRVVQKCFLLTSGMSRNFTNCLTMGAKYLKVVKRGSHPNNGWSPDEFRVTHVNRCDFSF

SEQ ID NO: 193134 - protein, 74 aa, Glycine max
  Coding DNA Sequence Number=SeqID_76356
MEVTNRSVFPIWDPTNIWNPESVQALPVRRCTHAVNPRRSPDQYWTLRLRESAHISSTTEQCDVTVKLSAAGIL

SEQ ID NO: 193135 - protein, 187 aa, Glycine max
  Coding DNA Sequence Number=SeqID_76357
  Homolog annotation: Hit_ID=Q1RWU1; Match level="QueryCoverage=59%, HitCoverage=28%, E-value=9e-07, Identity=38%"; Hit description =Resistance-like protein HAAS-2-related
MISCYSGLQRSGPFAVYYRPERVMRQFGYTQTIPAPPVDSWVSYDDIHDRWMHYSDHMFPAGAVCAVTGQCASDYIDWFFRISHPFMKPCQASVPLPDGHAPQPRVVPQAPETDIPHVSELGALLTSARPAVEEPRHAEVCYGIAERLELHLSLGVVTPSSSIHEVIEECLKMARSVTQDQLVYVRS

SEQ ID NO: 193136 - protein, 100 aa, Glycine max
  Coding DNA Sequence Number=SeqID_76358
LFKVALERSPPICASSSSISVVYKSKGETKDIELVEEEQTWIGVDPSSETSNKSENYKEEALKKTQKHKPKRVESVNADAEAFADDWKILIALCIVKLKQ

SEQ ID NO: 193137 - protein, 121 aa, Glycine max
  Coding DNA Sequence Number=SeqID_76359
  Gene Ontology: Mol. function=oxidoreductase activity, acting on the aldehyde or oxo group of donors, NAD or NADP as acceptor; Cellular component=cytoplasm; Biological process=amino acid metabolic process
  Homolog annotation: Hit_ID=Q12Q59; Match level="QueryCoverage=95%, HitCoverage=53%, E-value=3e-24, Identity=50%"; Hit description =Putative NADH dehydrogenase with NAD(P)-binding domain
  Pfam annotation: Domain name=Semialdhyde_dh; Domain location=2-120; Score=-13.5; E_value=0.0082; Accession=PF01118.15; Description =Semialdehyde dehydrogenase, NAD binding domain
MKALVIGATGATGKDLVNQLLNDKEFDEVDVFVRKPLDIRSDKLNVHIVNFDAPEEWKEAVKGDVAFSCLGTTLKTAGSKEAQRKVDFDYQYEFAKAAKENNVDDYILVSAYGANPKSKIF

SEQ ID NO: 193138 - protein, 151 aa, Glycine max
  Coding DNA Sequence Number=SeqID_76360
MVFGKHQLKVELAVNCFHCHTSDSNNAGSIVECAFGIRRQLDQSSLSVVPKVRPPSAIAFWNVRTPLAIARTRSGTNELDAQPLLLLMPDHFLSTHELKAIGTLSTPSYYCIYSAYLLLPCPPSMAIMMPLLLYYNKVRTSSLYYIDNTLR

SEQ ID NO: 193139 - protein, 194 aa, Glycine max
  Coding DNA Sequence Number=SeqID_76361
  Subcellular localization annotation: CTP_CleavageSite=25; ConfidenceScore=5.20e-01
PSYEVPTSGSAPTNGSKTYLFQPVQAVHSVVNPHVLVTVVEGRSWGQVIVVVTLPTAGSVPHHDPTQQQLGWMQLAVMDSSIKASSARIQVVQVVHQHAGIMMAMDGGQGRRSVPIAFSSWVDRKWSGIRSSSGWASSSLVPDRVRAIARGVRTFQNAMADGGLTLGTTDRLDCGSSLQLAPPSTTGMSDNHDC

SEQ ID NO: 193140 - protein, 404 aa, Glycine max
  Coding DNA Sequence Number=SeqID_76362
  Homolog annotation: Hit_ID=Q6D293; Match level="QueryCoverage=40%, HitCoverage=63%, E-value=3e-68, Identity=74%"; Hit description =Putative exported protein
  Pfam annotation: Domain name=Serglycin; Domain location=107-236; Score=-59.1; E_value=0.075; Accession=PF04360.3; Description =Serglycin
MAGAFFHHRDATRSGEFTTERGGWATARRDSAGLAPDPQRFASEAIVQVYAAPTYGWKGAVAVHPWIIFKRAGETRYNRYEVISWGSGDKVRRNSNLPDGYWYGARPRLLVSHRGAAAQAMIPQIEAAIQSYPWPNTYHAWPGPNSNTFLAHIGREVPALKLDLPANAIGKDFPVAARRAGRHAGSGRGRGGESAGTESGAGFHPVASAAAVYRRNAEIPVFMIEIDAVGLHLDLFFDRIVNAGAPQRIARNAQHLHFWTTVAVQQKQRGQTEEDKEAAGIGDGGDQYAGADRRVAFEFGHNQRNQHAHQRRQQQIQHHRQHHHAAQLQIVVHQPGYAAHDAAPEQAVKQRHAEFTRNQKRKVAGFNLMQRQRAHDHGDGLIAGITANAGDNRHQRGQRHQLRN

SEQ ID NO: 193141 - protein, 630 aa, Glycine max
  Coding DNA Sequence Number=SeqID_76363
  Gene Ontology: Mol. function=transmembrane receptor activity; Cellular component=exocyst; Biological process=exocytosis
  Homolog annotation: Hit_ID=Q9FNR3; Match level="QueryCoverage=99%, HitCoverage=100%, E-value=1e-128, Identity=40%"; Hit description =Leucine zipper protein-like
  Pfam annotation: Domain name=Exo70; Domain location=48-617; Score =291.9; E_value=1.2e-84; Accession=PF03081.6; Description=Exo70 exocyst complex subunit
MEEHKSVISTCEQDQHVVAAAQHILKALAASKNVSDDLRKTLLDIETQLSSISIVNERKGREIKHLERQLKCVEDKVMRWEANPSNESSEYLKVVGEIQVLIQNLESFSVNEKWKQKELVRRANEILQVAMSRLEKELVHILLQHKQHLEPEYLYFHFNRVDMVFDESFRSVEDEQIDEASRSSGASQSEASTVDLVNPAVLERLKSIASVMFASKYHQEFCQVFVTSRRDALAEYFVILEMEKLRIEDVLKLEWHCLNHEIRKWVRAMKIIVRVYLVSEKRLCKQVLGDFGSFYQCCFSEISQSFMLHLLNFGEAVAMGMHTPEKMFRLLDMYEVLEKLDVDVDVLFFEEVGSFVRGEFHKLLRSFGDTIKSTLLAFRNAIASNHSKTPFPQGGVHHVTKYVMNYIMALVEYGDTLNLLLVDDTSIDPAGNKDDTPCLSLCPVACQFRSITATLESNLSNKSKLYKDEALQHIFMMNNIHYMVQKVKCSDLSHFFGDCWLRQHIAMYQRDARCYERISWGSVLSMLKEGSVSNCVSQRTLEKRCKEFSTAFGEVYRIQTGWFILDPRLREDLQISVSQKLVLAYRTYIGRNSSSIAEKYVKYTEDDLQSYILDLFQGSPKSLHYPQHRK

SEQ ID NO: 193142 - protein, 98 aa, Glycine max
  Coding DNA Sequence Number=SeqID_76364
MAVIASFGYQKEHDGSWVKKGARPVDEEGHGGEDSSLLQKILDRFDGLQTFVGERFDTLELQLDMRFNEMESRITKVEEDVSYIRTSFDLPPPPSPSS

SEQ ID NO: 193143 - protein, 120 aa, Glycine max
  Coding DNA Sequence Number=SeqID_76365
SLFKELSKMEENMWAIIDQYKEKLSLAATHEQRLEDEYAKVSVLQTEREARERVIDSLHREAMMWMDRFTFTLNGSQELPRLLAKAKAMADVYSAPEEVHGLLDYCQHMIDLMDHIIRNR

SEQ ID NO: 193144 - protein, 162 aa, Glycine max
  Coding DNA Sequence Number=SeqID_76366
MEQGESLPSYSKFARLRPDPQELVARLCIPGRGFALNAKEPAPGPAPDYAEFADYAEFAGCGPATAIYEPGGVCSEGGGEASAAQEPQPGQEDDILEASEPILSEPVIVETSLAIPQKDVAVVTPQLEPFAPVPDLPLSQDSPSGTTTLDLNEHATDSAQDH

SEQ ID NO: 193145 - protein, 51 aa, Glycine max
  Coding DNA Sequence Number=SeqID_76367
LSLAHHWAKRASTAKRSFNALNTIEESGRASVSRSDAKREISALSTAVVCS

SEQ ID NO: 193146 - protein, 181 aa, Glycine max
  Coding DNA Sequence Number=SeqID_76368
MTNANCPQESLHSVSNGNLRVCVYHEDVCSCDANYGNLSTIALSVKDPVSVKERREHFLQGLGLVNSSSKVCSQQKMSLDDSSISLGLERIRECSGAISNACILHTDEVVSEKLILSGGKAGSKEKISLDEFTGCPQDEAEANIQGKEHELSYTAHEHRPKEGVSQEEFQDFHISKRKRIN

SEQ ID NO: 193147 - protein, 147 aa, Glycine max
  Coding DNA Sequence Number=SeqID_76369
MGEYLDEVAKKTRLHVIDKLTPDMVYEMGFDNPAELNKSLSLGMKRQGALIVAVTKRWGISGEEVIPVLFAKRAAGIVEQKTHELLQLRNEISLPQGSYTSLEKEIRALDARHEERVQSRFSTFKSYLTEHRSNLLALQNPYAPDSA

SEQ ID NO: 193148 - protein, 148 aa, Glycine max
  Coding DNA Sequence Number=SeqID_76370
  Gene Ontology: Mol. function=structural constituent of ribosome; Cellular component=ribonucleoprotein complex; Biological process =translation
  Homolog annotation: Hit_ID=Q0BYA9; Match level="QueryCoverage=63%, HitCoverage=74%, E-value=5e-33, Identity=75%"; Hit description =Ribosomal protein S12
  Pfam annotation: Domain name=Ribosomal_S12; Domain location=2-118; Score=151.4; E_value=2.4e-42; Accession=PF00164.15; Description =Ribosomal protein S12
  Subcellular localization annotation: CTP_CleavageSite=58; ConfidenceScore=5.25e-01
MPTIHQIIKTKNERPPKRVRRKTPALKQSPQKQGVCLRVFTRTPKKPNSALRKVAKVRLTNYAEVSAYIPGEGHNLQEHSVVLIRGGRVKDLPGEKVIEGCNQRIATESGGIDANIGKGNLSCRHLLDPTRFCQRFTSVAWQEAALLG

SEQ ID NO: 193149 - protein, 78 aa, Glycine max
  Coding DNA Sequence Number=SeqID_76371
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56308; Match level="QueryCoverage=98%, HitCoverage=16%, E-value=3e-33, Identity=85%"; Hit description =Photosystem II 44 kDa reaction center protein
  Subcellular localization annotation: CTP_CleavageSite=20; ConfidenceScore=5.05e-01
MTHAPLGSLNSVGGVATEINAVNFVSPRSWLATSHFCLGFFFFVGHLWHAGRARAAAAGFEKGIDRDNEPVLSMRPLD

SEQ ID NO: 193150 - protein, 144 aa, Glycine max
  Coding DNA Sequence Number=SeqID_76372
MEKPSKGAGKDAAENIDKVEAFDMEIGDNPMVENRLMPADPEFGEGSRYCWPLDRNDAESMLLHGQYYDDIEGFLEEHPFYCTDGADNKEWIKDSCQRVANTDQGARQAQEGDSLGYLASPLHLLDPSGHRASASCPIRAKQFG

SEQ ID NO: 193151 - protein, 202 aa, Glycine max
  Coding DNA Sequence Number=SeqID_76373
MSLIIARIPCYKCGSDKEKLHPNCASSERLTRCVGCDYIIRFYSEGLTKDEYGHDAVADWVFKQEARVPLQRCNAVDSGVRYFHQSCLGRDEPSALSRANGYYSIRGKIESEKYPELRNITHKCCEDCVIAAQTRGKDLNEDKLNFIMHQGVIEAETGDLERKRADRRSSKIRGIIGGQQARLEDNGTTSTAIFATRHLNQK

SEQ ID NO: 193152 - protein, 141 aa, Glycine max
  Coding DNA Sequence Number=SeqID_76374
PTAVLHGVLLGLLEPRPLDKEEEGSLGPVNGDSCPVVSPRSVYSMAGNCLHTVLDRSNHLAGNGFQEEGGPCNARWPHLVAPAVQRNCPQLDVEGVRWRPLCPQGVAIEHNDPGGPPPANCYLSRSQKTMFCVSNNGDNIG

SEQ ID NO: 193153 - protein, 188 aa, Glycine max
  Coding DNA Sequence Number=SeqID_76375
  Subcellular localization annotation: CTP_CleavageSite=64; ConfidenceScore=5.05e-01
MGLRVTCFHWSRDLSSSAQHGPGGASFTPGALASPPSAGASLGHARMKDCITSISHDFSTDTPASSMVAKQGSGAGGKCHKGGRVRGGNRGRGKGAATALEQGPKTSSADGGRPKELISRSNQHRGAQGSREEHSSSSSSCPATWVPHLASLISTMQTVKSWQLEPQRALDAHALSTPRPRLLRPRPD

SEQ ID NO: 193154 - protein, 268 aa, Glycine max
  Coding DNA Sequence Number=SeqID_76376
MAIISFTRGFLSESCKDVPDGEGETSGASLQSGRGLLDNGPIFVKLTRRLDEARPRIFKALLAMQLPPCTDVGATPGAVLYAAHWVPRRVDDDELLEPSIVLDVPKPCAIEPALHCRRKGLAAIGGGSVVVPSLISGDPIGLSRLNNQIVGLSNLETLNALRHSARDKPSRVRANNPYVVASAVVGFEMGGFRMGPFIKPCEEWALRRINTRIVECTRNLPPPDLILSPEGARQFAVTYPLFSTCSPGVAKEDVSVQMPGRNMLDQFI

SEQ ID NO: 193155 - protein, 156 aa, Glycine max
  Coding DNA Sequence Number=SeqID_76377
MICGFLSNEQISNHAVLPLPLLSLLLACPVSFPDNLLPLRWGSVLLHVSCLSPSLLPLCYNVYTFSSPTDQYEAALSQAEGTLAEDGLAFDLFLKESDEKVQQAMRKADAEMRLKQEKRDDSVLEVMKSCDKVWILRVCLGALDSVPTASLSLERR

SEQ ID NO: 193156 - protein, 187 aa, Glycine max
  Coding DNA Sequence Number=SeqID_76378
  Gene Ontology: Mol. function=structural constituent of ribosome; Cellular component=ribonucleoprotein complex; Biological process =translation
  Homolog annotation: Hit_ID=Q20F07; Match level="QueryCoverage=95%, HitCoverage=99%, E-value=6e-72, Identity=77%"; Hit description =Chloroplast 50S ribosomal protein L5
  Pfam annotation: Domain name=Ribosomal_L5; Domain location=31-87; Score=85.7; E_value=1.5e-22; Accession=PF00281.9; Description =Ribosomal protein L5
  Pfam annotation: Domain name=Ribosomal_L5_C; Domain location=91-185; Score=182.4; E_value=1.1e-51; Accession=PF00673.11; Description =ribosomal L5P family C-terminus
  Pfam module annotation: Pfam domain module=Ribosomal_L5::Ribosomal_L5_ C; Domain location=31-87::91-185
MEAVICMTQRLRNFYNTSIVPKLMGEFKYKNRLQVTRIEKIVINRGLGDASQNAKVLESSLRELSLIAGQKGVVTRSKKAIAGFKLRQKNPVGVSVTLRGERMYSFLDRLINLALPRIRDFQGVSPRSVDGHGNFSLGLEEQLMFPEIDYDKIDQIRGMDISIVTTSPSDAECLALLKEFGMPFQTV

SEQ ID NO: 193157 - protein, 254 aa, Glycine max
  Coding DNA Sequence Number=SeqID_76379
  Gene Ontology: Mol. function=sequence-specific DNA binding; Cellular component=intracellular; Biological process=regulation of transcription, DNA-dependent
  Homolog annotation: Hit_ID=Q83Q58; Match level="QueryCoverage=94%, HitCoverage=64%, E-value=8e-81, Identity=62%"; Hit description =Putative ARAC-type regulatory protein
  Pfam annotation: Domain name=AraC_N; Domain location=39-193; Score =226.1; E_value=7.9e-65; Accession=PF06719.3; Description=AraC-type transcriptional regulator N
  Pfam annotation: Domain name=HTH_AraC; Domain location=208-254; Score= 44.7; E_value=3.1e-10; Accession=PF00165.13; Description=Bacterial regulatory helix-turn-helix proteins, araC family
  Pfam module annotation: Pfam domain module=AraC_N::HTH_AraC; Domain location=39-193::208-254
MRHTAFFAARESAMPNDALCRQLAQRVITLMREPQKPLCAVENVRLIYAEEPLPRTPMLYPAGIVILFQGHKTGYLGSTVFRYDATKYLMLTVTLPVECETDATPQQPLAGMSLTVDPASLQDLLLSIGDDEQFQPQPQTSGIHSAFLSEEMLCAAERLLDVMDKPRDARVLGPQLVREIIYYVLTGPIGGALLSLVNRQTQFSQVARALRRIENHFAESLSVEMLAAEVNMSVSAFHHNFKAVTQTSPLQYLK

SEQ ID NO: 193158 - protein, 126 aa, Glycine max
  Coding DNA Sequence Number=SeqID_76380
MVHARDVYQSNVPQATELGCQFAAQRGCPSLMGTSLYIEQPSEIARVEDVLKPSNLQPLNFLEGGSHACTHRPHSLGTGHVQVRSQESKSATHAMPVASGHVHMCINVSGNCKLPQWLPNTGVGSK

SEQ ID NO: 193159 - protein, 163 aa, Glycine max
  Coding DNA Sequence Number=SeqID_76381
MHACFPVPQINAVGLLLHLGYANVLMHGLEPELSNDLRSRSLIRALCSMQPDPYLSFEHEVAFLEAHLGHLGGGGNAYVLGDALHGLRWHVYVASDCGWPAAARRDSSADHSIEVCMTDLCPVKVGTVIMLIYCSGHQRFICSTVACSLSVHCGCMHALLPLA

SEQ ID NO: 193160 - protein, 132 aa, Glycine max
  Coding DNA Sequence Number=SeqID_76382
MEAAMGVIAGLACQLNPSPQARGHSSAHSDVQILPDDTVYVLTDDRRIVGTAEVVHIGPGTRFHGAELEGFGVICGLTITDATGAGHQKAWLSDTDEVRAGRTPLEAIGGNQMVAVPERCLRFLRRPPAAGE

SEQ ID NO: 193161 - protein, 70 aa, Glycine max
  Coding DNA Sequence Number=SeqID_76383
MQRLTSSYAPFVNRGQRARSHAEIYVVLRAVDLCQYLPMKLGGRQKYPSGYPYKQSFAIRKTQRMIACKD

SEQ ID NO: 193162 - protein, 172 aa, Glycine max
  Coding DNA Sequence Number=SeqID_76384
MKFGGRRKYPSGYPYTHSFAIRKTQCTVAWANEPVDAKRLTLSPAPSVILTRANEPVHAKRPTSSSAPFAIQGQRVGWQAEIPYGHQRLSSTEGTEFNNIRMMGVKIVTSLLGPSRVFQQKAVPSGGSNPARLGELGGGKEGRANSFNPPDVSVSDFVRILHRSSLFFGIQP

SEQ ID NO: 193163 - protein, 272 aa, Glycine max
  Coding DNA Sequence Number=SeqID_76385
  Subcellular localization annotation: CTP_CleavageSite=53; ConfidenceScore=5.08e-01
IPFLMEVLVPVDVLGQSDILPPRIASLVKSATTSPTSSVSDPPESELEAGGVQASGRMSPGSSAAAQDSQKASNFVETLHFFGVFDGHGGAEGALHCAQTLHQRFVEAILEHTSPGGLPPPAAEQMETSIASTAATSVEAAAEAAACGVARGNVAESAPRNVPKPAAADADTDSNSRSMQQLGRTEKFAASCTRLCPAWRIFCPEHLICISVRSDSDAFMVAAIEEENAAAAAEGAESQNENTIACSAQHFETALTDAFNRTDEEFGKADNA

SEQ ID NO: 193164 - protein, 70 aa, Glycine max
  Coding DNA Sequence Number=SeqID_76386
MDICEDTDIPVILGRPFMLTASCIVEMGKRKLELGFEDQKIDFDLFVEDKPTPEQNVCLQVMEGGQEVLT

SEQ ID NO: 193165 - protein, 331 aa, Glycine max
  Coding DNA Sequence Number=SeqID_76387
  Gene Ontology: Mol. function=urea carboxylase activity; Cellular component=cytoplasm; Biological process=metabolic process
  Homolog annotation: Hit_ID=Q6D598; Match level="QueryCoverage=100%, HitCoverage=27%, E-value=1e-153, Identity=78%"; Hit description=Urea amidolyase
  Pfam annotation: Domain name=AHS2; Domain location=240-331; Score= -121.3; E_value=0.0022; Accession=PF02626.6; Description=Allophanate hydrolase subunit 2
  Pfam annotation: Domain name=Biotin_carb_C; Domain location=105-209; Score=199.6; E_value=7.2e-57; Accession=PF02785.9; Description =Biotin carboxylase C-terminal domain
  Pfam annotation: Domain name=CPSase_L_D2; Domain location=1-100; Score=-39.2; E_value=2.5e-08; Accession=PF02786.7; Description =Carbamoyl-phosphate synthase L chain, ATP binding domain
  Pfam module annotation: Pfam domain module=AHS2::Biotin_carb _C::CPSase_L_D2; Domain location=240-331::105-209::1-100
RRNQKVVEETPAPNLPQATREALLASAVRLGELVNYRSAGTVEYIYDAAQDAFYFLEVNTRLQVEHPVTECVTGLDLVECMLQVAADDAIDWDRLQQAPHGASIEVRLYAEDPLKNFQPSPGVLTHVSFPPGVRVDGWIETGSEVTAFYDPMVAKLIVHGETRDAALAKLQQALDATQLHGIATNLDYLRQIVATDAFRSGNVWTRFLDGFTPAASVIEVLQPGTFSSIQDFPGRLGYWDIGVPPSGPMDDFAFRLANRIVGNHASAAGLEFTLQGPTLRFHSDALIALTGADCPADLDGSAVDYWQPVAVKAGQTLTLGRAQSGCRTYLA

SEQ ID NO: 193166 - protein, 217 aa, Glycine max
  Coding DNA Sequence Number=SeqID_76388
SGEGFCLANLPGDAFSLWGNFFEAKKQMMADAKVCGAAWFSHCLSFSMCPVVGFGPWLGLGKPLVEILPPGQLRGFCPLLAWLGSAVLGYGPVLSFGLVGPLLPPVISFVARILPTLACAPLAKSVPRWWIIMQNEREPTNGSLFWPNIVEEERDTGLIGEGRIKATRAESQWIVAARPLCHLQYPVAYLSRLQRILPAARWELRFKASRRANPPHE

SEQ ID NO: 193167 - protein, 179 aa, Glycine max
  Coding DNA Sequence Number=SeqID_76389
  Homolog annotation: Hit_ID=O82290; Match level="QueryCoverage=35%, HitCoverage=16%, E-value=2e-17, Identity=70%"; Hit description =Expressed protein
MAIAHTILTRDLTDELGSHGGVAALRGAENERGSAVGGAWGAGVHGGGGGRSCAKRTWMRVLIFKASASGNLEAKRLHKQMCCHCVDSLFLLILLFLKNTIFVSVLAIDLFDADKYIDDDQLVVNFKKQDPDLRWLDIMESWESLTARSPQLLQGTSIYIVGDSTEINQKGAQKLATDL

SEQ ID NO: 193168 - protein, 65 aa, Glycine max
  Coding DNA Sequence Number=SeqID_76390
MLWLCYIWLVGLLLLLVSLVSAILMKKLSHLRNMLESSADSVNNNPVFGGSQMSLGPSSPFSKVP

SEQ ID NO: 193169 - protein, 136 aa, Glycine max
  Coding DNA Sequence Number=SeqID_76391
MASNAAIKLQEAKDSIDQHKNMFPKFPTSSIWSYIMWYQEHLHLGDVLLLPLSFGSVNSLYFLAIHLILHMITKDDDKGDDKKLKGHSKNEFKMFKIESRTLQDSRGKLNSRIKIQEIKVQDSRIKKRLFKNQEKA

SEQ ID NO: 193170 - protein, 65 aa, Glycine max
  Coding DNA Sequence Number=SeqID_76392
  Pfam annotation: Domain name=DUF1723; Domain location=13-60; Score =30.0; E_value=8.3e-06; Accession=PF08330.1; Description=Protein of unknown function (DUF1723)
MAFIVAPLLWKQHLHRSREVFERWRPKSHMFHLPVGECIITLEDVALQLSLRVDEKPVIDPTYYD

SEQ ID NO: 193171 - protein, 50 aa, Glycine max
  Coding DNA Sequence Number=SeqID_76393
MSGQRRSSRTSKFTEIEINELVSRLQVLLLQGNQRGNSRLIDSITSSTLA

SEQ ID NO: 193172 - protein, 98 aa, Glycine max
  Coding DNA Sequence Number=SeqID_76394
WVASRSNPARVGELRSPGRAGRQPPPPFSYKKAEGGYSKDPSAPWLCISAVLGEKNCFREENPSRGASVTLPRCFRKQIREGFRPFFIVLHPFFVLQR

SEQ ID NO: 193173 - protein, 87 aa, Glycine max
  Coding DNA Sequence Number=SeqID_76395
MADAREKTKASTKGGDARAHGCVFHGRKMRGVATNVYSRKTSEKPEKGVSLAPTYSSIVIRKSDLRSSLKRGESSDSFYLEGGHLRR

SEQ ID NO: 193174 - protein, 533 aa, Glycine max
  Coding DNA Sequence Number=SeqID_76396
  Gene Ontology: Mol. function=cysteine protease inhibitor activity; Cellular component=intracellular; Biological process=defense response
  Homolog annotation: Hit_ID=Q1S339; Match level="QueryCoverage=96%, HitCoverage=49%, E-value=1e-126, Identity=47%"; Hit description =Proteinase inhibitor I25, cystatin; Disease resistance protein; AAA ATPase
  Pfam annotation: Domain name=NACHT; Domain location=200-347; Score= -28.9; E_value=0.01; Accession=PF05729.3; Description=NACHT domain
  Pfam annotation: Domain name=NB-ARC; Domain location=162-507; Score= -22.7; E_value=7.7e-09; Accession=PF00931.13; Description=NB-ARC domain
  Pfam module annotation: Pfam domain module=NACHT::NB-ARC; Domain location=200-347::162-507
MSDYLKEKGGPRLVIMGETKQLVTLLTRFQAAMKMIKDIVEKSRSSKKSKRLLRKTLKNMTPLLQEINQYNEHLEPPREEINTLMKEKDAVEELVCYSCSRSIWWTKFLSWLPLYGDGLWHNKNNPLAADDNQVKYIKNTLYEVKEVLELLDIENFQQKLKGVGSPIKCPFGVPENPGFTVGLNPLLSKLKMEVLRDGMSTHLLTGLGGSGKTTLATKLCRDEEVKGKFKENILFFTFSQTPKLKNIIERLFEHCGYHVPEFISDEDAIKRLEILLRKIEGSPLLLVLDDVWPGSEALIEKFQFQMSDYKIVVTSRVAFPKYGTPYVLKPLAHEDAMTLFRHHALLEKSSSHIPDKEIVQKVLILLSDIGSNLYQSFVSEAIVDLESTKLCFDSSNQYYGRLLATWAPNVVRYCKGLPLAVKVIGRSLSHRPIEMWQKMVEELSQGHSILDSNIELLTCFQKLLHVLEDNPNNKECFMDLGLFPEDQRIPLPVLIDIWAVLYGFDDDGIEAMDIINKLDSMNLVNVLLARYND

SEQ ID NO: 193175 - protein, 44 aa, Glycine max
  Coding DNA Sequence Number=SeqID_76397
MEGRVNLGLKSENGSDMSGKVTCGKAWAEQMGKMSDQSEGKSHF

SEQ ID NO: 193176 - protein, 99 aa, Glycine max
  Coding DNA Sequence Number=SeqID_76398
  Gene Ontology: Mol. function=DNA binding; Biological process=DNA integration
MDIELEQLDVKIAFPYGRLEEDILMQQPEGFEDKVRNHQGGGIRDSMSSLSSMGISEVHMTRVYLSKLEEGSHIYLLLYMDDMLIDGSFLEKFLWRVDL

SEQ ID NO: 193177 - protein, 116 aa, Glycine max
  Coding DNA Sequence Number=SeqID_76399
  Gene Ontology: Mol. function=nucleic acid binding; Biological process= RNA-dependent DNA replication
MALVMGPFLGRTTSNCEDELVQYHGLSAFKKHNSPKFCGASDPEGAKLQFFEVEKIFKAMGSYEEHKMVCQIVPEEGVISWDAFKAKFLEKYFPKDLRKEKAKEFLELKQGNIIVG

SEQ ID NO: 193178 - protein, 158 aa, Glycine max
  Coding DNA Sequence Number=SeqID_76400
ARIMSEIEEVQEQMKADMEAMKDQMTTMMEVMMSMRKMMEVNMAIVAATSTATEVDSTHPSGINQVQSKHHFLPYGLPPNYAPPNVAYALEDNVDNSTPIPIESQQPRSGHAQVPQPMGETHEVPRDHALVDFEPHLGYATEGQAFGGVPLPNSLGGP

SEQ ID NO: 193179 - protein, 493 aa, Glycine max
  Coding DNA Sequence Number=SeqID_76401
  Gene Ontology: Mol. function=sequence-specific DNA binding; Cellular component=nucleus; Biological process=regulation of transcription, DNA-dependent
  Homolog annotation: Hit_ID=Q9M7S0; Match level="QueryCoverage=94%, HitCoverage=59%, E-value=1e-103, Identity=48%"; Hit description =Homeodomain protein
  Pfam annotation: Domain name=POX; Domain location=353-480; Score =240.7; E_value=3.1e-69; Accession=PF07526.2; Description=Associated with HOX
  Subcellular localization annotation: CTP_CleavageSite=68; ConfidenceScore=5.04e-01
MGIATPSSSLPSILSHSKTQQQIHHSNSSMSQDYHHHHQGIFSFPNGFERSAAATTMTHQDPHQQQIRRDKVRVQGFEPPPSHQTLVPIEEDESGSLPVYETAGMLSEMFNFTPGATELLEQQQQQQQPMATTTARAVGSGGSEWYGNRQGMLSNLGPLGDSKNHHHHGSVNSRDSSSSSIVQNQHHHHHNHHHHQMSSINADSAAAMQLFLMNPQTTRSPSPPPPPPPSSSTLHMLLPNTFPPGSGGSFGQFTWLPDTTQEGGPSTVVEGPGHGHGQGLSLSLSSSIEAAKAEELRMGDSGFLYYNQASGGPSSYKSTLGGHHHQALLGQAHQGNVGFGAASSSTSSLGVVNALRNSKYAKAAQELLEEFCSVGRGQFKKNKFNRQLSNPSSNLGGSGGGGGGASSSSSKDIPPLSAADRIEHQRRKVDRRYSHYCEQMHMVVNSFDMVMGFGAAVPYTALAQKAMSRHFRCLKDAITAQLKHSCEVLGEKD

SEQ ID NO: 193180 - protein, 33 aa, Glycine max
  Coding DNA Sequence Number=SeqID_76402
MKEIGPPFREATPKSIVKKGIPTPEWGMKMTQY

SEQ ID NO: 193181 - protein, 190 aa, Glycine max
  Coding DNA Sequence Number=SeqID_76403
  Homolog annotation: Hit_ID=Q1S563; Match level="QueryCoverage=89%, HitCoverage=94%, E-value=5e-54, Identity=63%"; Hit description =Leucine-rich repeat
  Subcellular localization annotation: CTP_CleavageSite=51; ConfidenceScore=5.10e-01
MAFKKTLAQRLLNITKISNYRISSSVVRSPNPTKPDIAPDPGDSRRFLHKRASVLPPELRPPLPAGSLLQRLREMDIARSRIRLDGLAPPETEQTVAPEHVRKVLRAVQIETVKSKLRKIPQSCISYSEFIRMCSENCSDQEQAMSVAKMLDESASVIIIGDVVFLRPEQENESLLFANVKRIDSLRLRW

SEQ ID NO: 193182 - protein, 65 aa, Glycine max
  Coding DNA Sequence Number=SeqID_76404
MNEDNEDESSVLENIDCSDAFNTYQVFVTHDDVLHWTRSVAYDIGFVIVIMRSDTNIGKRGRTSI

SEQ ID NO: 193183 - protein, 259 aa, Glycine max
  Coding DNA Sequence Number=SeqID_76405
  Gene Ontology: Mol. function=protein binding
  Homolog annotation: Hit_ID=Q75KA7; Match level="QueryCoverage=98%, HitCoverage=49%, E-value=7e-93, Identity=65%"; Hit description =Expressed protein
NPVLKRISSDISNVPKDTLSHIIDLVLKSNEERGRREMKSIVLKLLRENNSLPSYARSTDICNDTIYRSCRSCLDSLLSLFKQAAEPDKPSEDRDPIAKCIALEADNLSWLLEILVDKQAADEFALMWANQQELALLHTKLPTMLRYHVSCLSGRLYVGIGRGELLPSKDTRRLLLQTWLQPLMNDYNWLQHGCRSFDRKLVEEGIGRTILTLPLEYQQSILLSWLGSFLKTGDSCPNLQRAFEVWWRRTFIRPYVENQ

SEQ ID NO: 193184 - protein, 109 aa, Glycine max
  Coding DNA Sequence Number=SeqID_76406
MDTVMISHGIGNMVKLILIQLGQSSHAELVLEVKMAGSAKHHAIEFSFGMKGMHQDLISARNMAKYSLFSWPLISYLFEGALAAALTCDLFSRILSWTICVEAKLGVLH

SEQ ID NO: 193185 - protein, 1398 aa, Glycine max
  Coding DNA Sequence Number=SeqID_76407
  Gene Ontology: Mol. function=histone-lysine N-methyltransferase activity; Cellular component=intracellular; Biological process =chromatin modification
  Homolog annotation: Hit_ID=Q6YV15; Match level="QueryCoverage=77%, HitCoverage=90%, E-value=0.0, Identity=39%"; Hit description =Putative SET domain protein SDG117
  Pfam annotation: Domain name=Pre-SET; Domain location=1181-1314; Score=49.6; E_value=1e-11; Accession=PF05033.6; Description=Pre-SET motif
  Pfam annotation: Domain name=SET; Domain location=1316-1394; Score =4.1; E_value=0.00036; Accession=PF00856.18; Description=SET domain
  Pfam annotation: Domain name=zf-C2H2; Domain location=794-817; Score =7.1; E_value=1.8; Accession=PF00096.16; Description=Zinc finger, C2H2 type
  Pfam annotation: Domain name=zf-C2H2; Domain location=828-851; Score =20.5; E_value=0.006; Accession=PF00096.16; Description=Zinc finger, C2H2 type
  Pfam annotation: Domain name=zf-C2H2; Domain location=862-885; Score =4.1; E_value=3.8; Accession=PF00096.16; Description=Zinc finger, C2H2 type
  Pfam annotation: Domain name=zf-C2H2; Domain location=930-953; Score =15.0; E_value=0.25; Accession=PF00096.16; Description=Zinc finger, C2H2 type
  Pfam module annotation: Pfam domain module=Pre-SET::SET::zf-C2H2::zf -C2H2::zf-C2H2::zf-C2H2; Domain location=1181-1314::1316-1394::794 -817::828-851::862-885::930-953
MEVLPCSGVQYAGGSDCSQPSLGTTFVNQGESGDQAKLEDDQLNDSLRTEGPQLERQGQTQQIVCEPLTNIACQCGGSSCCDCQVEGQKESISFHDVEDDGINKPCLAFENSGSIPDTNESESPNGSREVELSFSEPTWLKGDEPVALWVKWRGNWQAGIKCARADWPLSTLKAKPTHDRKKYFVIFFPHTRNHSWADMLLVRSIYEFPQPIAHKTHQAGLKMVKDLTVARRFIMQKLTIGILSIVDQLHPNALLETARDVMVWKEFAMETSRCNSYSDFGRMLLKLQNSIVKHYTDADWIQHSSYSWAERCQTANSAELVELLKEELSDSILWNDVNALWDALVQSTLGSEWKTWKHDVMKWFSTSPSFSSSKDMNQMTSDGLFPNTHATLVETKGSYQQITLETDPGFYRSQDILNTLAAETSTHKDIKEVPVATSNLTNKWNEIVVEATDSEMLHGNGMESTPMNEMAGKKIVEPGAKNRQCIAYVEAKGRQCVRWANDGEVYCCAHLSSHFLGSLGKAEKPVSVDTPMCGGTTVLGTKCKHHALPGSSFCKKHRPHAETNEISNLTHNTLKRKHEENHIGSGGLISKDMVLINAESSLQVEPVPAIDGDSFLGRSNLDERPALSGNDQIAMEVLHCIGSPPYDDKDPCLEEPKRYFLYCEKHLPSWLKRARNGKSRIISKEVFTEILRDCCSWKQKVHLHKACELFYRLFKSILSQRSPASKEVQFKQALTEASKDTSVGEFLMKLVHSEKERIELIWGFNDDIDVSSLVEGPPLVPSTDNDSFDNENVIKCKICCAKFPDDQTLGNHWMDNHKKEAQWLFRGYACAICLDSFTNKKLLEAHVQERHRVQFVEQCLLLQCIPCGSHFGNMEQLWLHVLSVHPVEFKPLKAPEQQTLPCEDSPENLDQGNSASLENNSENPGGLRRFVCRFCGLKFDLLPDLGRHHQAAHMGRNLGTSRSTKRGVRYYTHRLKSGRLSRPRFKNGLAAASFRIRNRANANLKRHIQATKSLDMVERKIKPHVTETGNIGKLAEYQCSAVAKILFSEIQKTKPRPNNLDILSIGRSVCCKVSLKASLEEKYGILPERLYLKAAKLCSDHNIQVGWHQDGFICPRGCKVLKDQRDLSPLASLPNGFLKPKSVILSDPVCDELEVDEFHYIIDSQHLKVGSLQKVTVLCDDISFGKESIPVICVLDQDILNSLLRHGSVEEDINLSRPWESFTYVTKPMLDQSLSLDTESLQLRCACSFSACCPETCDHVYLFDNDYDDAKDIFGKPMRSRFPYDENGRIILEEGYLVYECNQMCKCNKTCPNRILQNGIRIKLEVFKTEKKGWAVRAGEAILRGTFVCEYIGEVLDKQEAQNRRKRFTFLHNVVSFSSVVKWWHYGRHGSFAANRHC

SEQ ID NO: 193186 - protein, 54 aa, Glycine max
  Coding DNA Sequence Number=SeqID_76408
MKAKRERGFKSRAQIKARNNKGSLGVFFLVKDTGKDLDFHKELKGATAMQGERN

SEQ ID NO: 193187 - protein, 224 aa, Glycine max
  Coding DNA Sequence Number=SeqID_76409
  Gene Ontology: Mol. function=protein binding
  Homolog annotation: Hit_ID=Q75KA7; Match level="QueryCoverage=99%, HitCoverage=40%, E-value=5e-40, Identity=42%"; Hit description =Expressed protein
MAEIRLTRVEQGQTKIKNVPIAVTPEGFWCCPSPVVFQKSLKTQNTLNKHKPSSPPPPKTSVQKKPVPVSVSVPVCERRTTTPAPSGLVLSDEKQCATAPERPPPPTATSVAAAERAPRQKIESLPKKVAIEFGEPGTCDMKVVLLGKQGFCVKLSVHRDVLTQKSGFFSEKLSEQSGLSCLQIGDCEDVEIYVETVGLMYCKEMKQRLMKQSVSRILRILKVL

SEQ ID NO: 193188 - protein, 626 aa, Glycine max
  Coding DNA Sequence Number=SeqID_76410
  Gene Ontology: Mol. function=transcriptional elongation regulator activity; Cellular component=cytoplasm; Biological process =regulation of transcription, DNA-dependent
  Homolog annotation: Hit_ID=Q9FJY0; Match level="QueryCoverage=99%, HitCoverage=95%, E-value=1e-158, Identity=50%"; Hit description =Arabidopsis thaliana genomic DNA, chromosome 5, TAC clone:K1F13
  Pfam annotation: Domain name=DUF547; Domain location=401-547; Score =310.5; E_value=3e-90; Accession=PF04784.5; Description=Protein of unknown function, DUF547
FPDKKRDGNDNPYNHLEASDRTNQDTGYLTECVKPRKKQTPTSDLQHSLKQEILLLEKRLQDQFEVRCTLEKALGYRPTSLVNSNETILPKKIDVDIQFCFMYTTRLMVKMFEAKSCHPTSKLIKEIAVLELEVVYLEQYLLSLYRKAFDQQLPSVAPFTKEEKVKSPPSTPRARLVEVSKPEVLTKRGSSAVQSIDHELDTLQKEYSGYEHETLRKEYNVHQPEGKRLDSSVYRCHSSLSQCTTFTTRVSAPAAEVLTESLRTCHSQPLSMMENNQPGRHLGTRISDHIPDTPNRLSEDMVKCISAIYCKLADPSTTNPGLSSPSSSLSSTSAFSIADQVDMWSPGLRNNSSFDVRLDNPFHVEGLKEFSGPYSTMVEVSWIYRENQKFGDTEQLLKNFRSLICQLEEVDPGKLKNEDKLAFWINIHNALVMHAFLAYGIPQNNVKRVFLLLKAAYNIGGHTISADTIQNTILRCRLPRPGQWFRLFFSPRTKFKAGDGRQAYPIERPEPLLHFALCSGNHSDPAVRIYTPKRVLQELEVAKEEYIRATFGVRKDQKILFPKLVESFVKDSGLCPAGTMEMIQKSLPESLRKSVKKCDLAKSKKSIEWIPHNFTFRYLIPKELVK

SEQ ID NO: 193189 - protein, 66 aa, Glycine max
  Coding DNA Sequence Number=SeqID_76411
MVQLIYSFGLLIGVWFCRSVAIEENEGEKGRNFWSLWLVSSMVERCMVKRKRMASGRDGGGGKGKG

SEQ ID NO: 193190 - protein, 253 aa, Glycine max
  Coding DNA Sequence Number=SeqID_76412
  Homolog annotation: Hit_ID=Q1S569; Match level="QueryCoverage=95%, HitCoverage=69%, E-value=7e-74, Identity=58%"; Hit description =Cystinosin/ERS1p repeat
  Pfam annotation: Domain name=PQ-loop; Domain location=150-216; Score =59.9; E_value=8.4e-15; Accession=PF04193.5; Description=PQ loop repeat
MRWYKHRQKVNLVRDHEEEKKPLKPPKPTNKSGIPIPNGSPKAAPRQEYYYMSARSLAGSGTPPWGIYMRAAKSGPSAIESIDDSSSDDEAPPASSNNSASQAMPIPRSVAGSYGTFLAAAVNLPLKGNALRQGYIGYGGRKLLQEYEKHSTFGQWLGWLMAAIYISGRVPQIWLNIKRSSVEGLNPFMFVFALVANVTYVGSILVRTTEWESIKANMPWLLDAIISQYIYYRYFRRREAKDDYKEAGKVAAS

SEQ ID NO: 193191 - protein, 283 aa, Glycine max
  Coding DNA Sequence Number=SeqID_76413
  Gene Ontology: Mol. function=transferase activity, transferring hexosyl groups; Biological process=carbohydrate biosynthetic process
  Homolog annotation: Hit_ID=Q8LF94; Match level="QueryCoverage=95%, HitCoverage=93%, E-value=2e-91, Identity=56%"; Hit description =Avr9/Cf-9 rapidly elicited protein 231
MLGHSLVFTLEEQRNESRADRREPTMRPKGKACRRQAWPTASLCHSNAAGSRARGEGLGKARGSYLRRARAGSTGGPPPQFSRRTPAGTAALHPLLDLGRVLALAPLPEVDHHYARVEVARWPPAVSEDKRQRGVGPERGREVRREVRGAVLRRGEHRRARERCLRELRDVVDEDQVRVEVDDFRDAGREEADGGGDEARNGVVVEGVDLEIQVGEGGGVLQNGEDCGHGTSEVGNVEGHCHVDSVVGARVVWVRVVAEGGARGGVVEFWSFFETLLLGGGGA

SEQ ID NO: 193192 - protein, 386 aa, Glycine max
  Coding DNA Sequence Number=SeqID_76414
  Gene Ontology: Mol. function=transferase activity, transferring hexosyl groups; Cellular component=integral to membrane; Biological process=carbohydrate biosynthetic process
  Homolog annotation: Hit_ID=Q8LF94; Match level="QueryCoverage=84%, HitCoverage=93%, E-value=1e-125, Identity=65%"; Hit description =Avr9/Cf-9 rapidly elicited protein 231
  Pfam annotation: Domain name=Glyco_transf_8; Domain location=96-360; Score=296.2; E_value=6.1e-86; Accession=PF01501.10; Description =Glycosyl transferase family 8
  Subcellular localization annotation: CTP_CleavageSite=76; ConfidenceScore=5.56e-01
MNEVFQVLASSNVLYLSLSLTVITYSNPTSLNTKGAMAPPSFFFVFFFILIFSCTSATTTQQQRFKEAPKFYNSPTCATLRHHPNPNHTCPDNAVHVAMTLDVSYLRGSMAAILSVLQHTSCPENVIFHFVTAASKSSSAAKLNQTLTTSFPYLNFQIYPFDDDAVSRLISTSIRSALDCPLNYARSYLSTLLPPCVAKIVYLDSDLILVDDISKLAETPLSGTAVLAAPEYCSANFSAYFTPSFWSNPSLSLVLANRRRPPCYFNTGVMVIDLRQWREGEYTTEIEEWMELQKRMRIYELGSLPPFLLVFAGRIAAVDHRWNQHGLGGDNFRGLCRDLHPGPVSLLHWSGKGKPWARLDAGRPCPLDALWAPYDLLETRFAALQA

SEQ ID NO: 193193 - protein, 174 aa, Glycine max
  Coding DNA Sequence Number=SeqID_76415
  Homolog annotation: Hit_ID=Q9MAX0; Match level="QueryCoverage=29%, HitCoverage=14%, E-value=4e-14, Identity=82%"; Hit description =Aspartate kinase
  Subcellular localization annotation: CTP_CleavageSite=35; ConfidenceScore=5.15e-01
MEILTSLVATTLTNTSKSSKIENTLARNPNWPRMRVLTISSMITLRFKTKLVDKQCLAHIPYLRVARCTTKCGTFASSYSTASRSRRRRSSSSTSSRWHHRSSFAARPSALLTLTWPRPKPGTGGTLQLTADTQSLSVEYLASLSSLDMAAEKQIEGLVMKVGEDLFNFMQSFC

SEQ ID NO: 193194 - protein, 72 aa, Glycine max
  Coding DNA Sequence Number=SeqID_76416
LWFNDQAAKIMKGVFVLSSRIDKPFCKYDGFTTRKCVAKVYINIVDLSLVESVRIPYMKNLPPYYILDACGS

SEQ ID NO: 193195 - protein, 112 aa, Glycine max
  Coding DNA Sequence Number=SeqID_76417
MVDYTPSSFDDMVFTDERIKGEDEGEARAVTAIPIQPSFPPTQQCHYSANNQPSPYPPPSYPQRPSLKQPQSLSSALPMTNITFSTNQEHQPRNEFCSEKACRIHPNSSVLC

SEQ ID NO: 193196 - protein, 660 aa, Glycine max
  Coding DNA Sequence Number=SeqID_76418
  Gene Ontology: Mol. function=protein kinase activity; Cellular component=integral to membrane; Biological process=protein amino acid phosphorylation
  Homolog annotation: Hit_ID=Q2R2M3; Match level="QueryCoverage=94%, HitCoverage=94%, E-value=1e-107, Identity=36%"; Hit description =Protein kinase domain containing protein, expressed
  Pfam annotation: Domain name=LysM; Domain location=131-176; Score =30.3; E_value=6.8e-06; Accession=PF01476.10; Description=LysM domain
  Pfam annotation: Domain name=LysM; Domain location=197-241; Score =25.3; E_value=0.00022; Accession=PF01476.10; Description=LysM domain
  Pfam annotation: Domain name=Pkinase; Domain location=359-634; Score =100.5; E_value=4.9e-27; Accession=PF00069.15; Description=Protein kinase domain
  Pfam annotation: Domain name=Pkinase_Tyr; Domain location=375-634; Score=68.7; E_value=1.9e-17; Accession=PF07714.7; Description =Protein tyrosine kinase
  Pfam module annotation: Pfam domain module=LysM::LysM::Pkinase::Pkinas e_Tyr; Domain location=131-176::197-241::359-634::375-634
  Subcellular localization annotation: CTP_CleavageSite=92; ConfidenceScore=5.27e-01
MNLFPMITTTIFTLIMLCSMSVVVHVQGKQPYVGLATTACGQTGNSNSMRGYTCNGVNPSCQAYLTFRAQPLYNTVPSISALLGSDSSQLSVANSVSEDGTFETNKLVIVPINCSCSGNNNNQYYQFNTSYEVERGDSYFVIANNTFEGLSTCQALQDQNNIPEGDLMPGNELIVPLRCACPSKNQTEQGVKYLLSYLVASNHIVWLIGERFGVSSETIVEANTLSSQQPIIHPFTTLLVPLQDEPSSNQTSEPSPPPSTPPPPPLSSSSGRSSKTWVYAVVGVVGAIALISSVLCAIVFRTRYLKGGNKRKDDSLIVSDSFVAVAIEKPQEKKLEEEESENLAEIISGISESFKVYRYEELQSATNGFSPSCCIKGSVYRGFINGDLAAIKKIDGDVSKEIELLSKVNHSNVIRLSGVCFNGGYWYLVYEYAANGYLSDWINIKGKFLSWTQRIQIALDVATGLDYLHSFTSPPHVHKDLKSGNILLDSDFRAKISNFRLARSVEREGSEGDQYVMTRHIVGTRGYMAPEYLENGLVSTKLDVYAFGVLMLEMLTGKDVADVYAEGNIANLFDVLSAVLDEEGEHLRLSEFMDPSLKGNYPMELAVFVARMIETCIKKDPASRPDMHEIVSSLSKALDSSLRWETSMERKFRFYKGFLN

SEQ ID NO: 193197 - protein, 1141 aa, Glycine max
  Coding DNA Sequence Number=SeqID_76419
  Homolog annotation: Hit_ID=Q5SMM0; Match level="QueryCoverage=41%, HitCoverage=90%, E-value=1e-158, Identity=57%"; Hit description=LIM domain containing protein-like
  Pfam annotation: Domain name=Arm; Domain location=1091-1131; Score =10.2; E_value=0.65; Accession=PF00514.13; Description=Armadillobeta -catenin-like repeat
  Pfam annotation: Domain name=Arm; Domain location=934-975; Score =15.8; E_value=0.13; Accession=PF00514.13; Description=Armadillobeta -catenin-like repeat
  Pfam annotation: Domain name=LIM; Domain location=170-249; Score=8.0; E_value=0.00068; Accession=PF00412.12; Description=LIM domain
  Pfam annotation: Domain name=UIM; Domain location=128-145; Score =11.8; E_value=0.73; Accession=PF02809.10; Description=Ubiquitin interaction motif
  Pfam annotation: Domain name=UIM; Domain location=44-61; Score=16.5; E_value=0.099; Accession=PF02809.10; Description=Ubiquitin interaction motif
  Pfam annotation: Domain name=V-ATPase_H; Domain location=747-1096; Score=-34.9; E_value=6.9e-14; Accession=PF03224.5; Description=V -ATPase subunit H
  Pfam module annotation: Pfam domain module=Arm::Arm::LIM::UIM::UIM::V- ATPase_H; Domain location=1091-1131::934-975::170-249::128-145::44 -61::747-1096
VDTSSSVLGSLNQGLGFDSRLGHGVTRGGITLPQKWANPDDLTDIEKEEIGRAIALSLSEADKKGKKVIGLMFLPHKTPEDDSESEDDELCPLSDEEAESVGEVQQDEDDHHAKIQQDEDKHLDEVQLEEDEQLARAIQESLSISSPPRSETDSLFQPFAHLFPPVYRICSGCNAEIGHGRFLSCMGGYWHPECFCCHACKLPITDYEIPPNSAGLIEYRAHPFWLQKYCPSHERDGTPRCCSCQRLESVDTKYLLLDDGRKLCLECLDSAIMDTHECQPLYVEIQEFYEGLHMKIEQQVPMLLVERQALNEAMEGEKNGHHHLPETRGLCLSEEQTVPTILRRPRIGAGYQLIDMITEPFRLVRRCEVTAILVLYGLPRLLTGSILAHEMMHAWLRLKGYGNLRPEVEEGICQVLAHMWLESEIIPGTGDEGASSSSSSSSSSSSSSSPSSSSSSKKGKRSDFEKKLGKYFKHQIESDSSAAYGDGFREGNQAVAKYGLRRTLDHIRLTGSPTVKTVLLEASLPLFPELPLSLFLGGGRGVAVLAGESLPDERELQGRMANNNNLRFHFLNFSSELRPVLGFPTAMYQAELTSEQVLRRDIPWETYMSTKLISGTSLQLLRRYDHRPESHRAQLLDDDGPSYVRVFVRVLRDIFKEDTVEYVLALIDEMLAANPKRARLFHDSALADEDTYEPFLSYYLLPLFVGPSSPPPQSPFSTVRCCRRRFPAVSLPLFTSFSSSSLHFLLLLCPNPSLSKSKPRSDRNQISNDALFSMFCATRNAFSTPWTPQLQPHRVLHDLKRNHCDRKVKRHAQVQLQVVEALVWNPGPSESPTAINPCGINSYGQHFVPRNVHIREASNGKKPFTTIDDVLIGLVKWLCEQLKKPSHPIRGVPTAINCLATLLKEPVVRSSFVQADGVKLLVPLISPASTQQSIQPAIEYLATSRTLPRLIDVVRSSTKEKVVRVVVLTLKNLMSKGTLGAQMVDLQLAQVVLSLKAQAWSDEALNSLEEGLKDNIKRLSSFDMYKQEVLLGHLDWSPMHKDPIFWRENINNFEENDFQILRVLLTILDTSSDPRTLAVACYDLSQFIQHHSAGRIIVSDLKAKERVMKLMNHENVEVTKNALLCIQRLFLGAKYASFLQV

SEQ ID NO: 193198 - protein, 68 aa, Glycine max
  Coding DNA Sequence Number=SeqID_76420
  Subcellular localization annotation: CTP_CleavageSite=11; ConfidenceScore=5.08e-01
MAPPLTSSPLSSAMVQKKDLIEAQRSNLHKSFSSMFPSSDIRVQELQKLDLISYGSNFLFLFLNHELC

SEQ ID NO: 193199 - protein, 314 aa, Glycine max
  Coding DNA Sequence Number=SeqID_76421
  Homolog annotation: Hit_ID=Q47522; Match level="QueryCoverage=20%, HitCoverage=83%, E-value=1e-21, Identity=75%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIEAISDSENQHIQEAAHIWSMAKQLGATGGEKQNIIIKKLQYIEERDKAEAERRRDSRRSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 193200 - protein, 112 aa, Glycine max
  Coding DNA Sequence Number=SeqID_76422
YIHCSFELDNCCTVVVCKEDLLQDLEAVVIPEEEPQPSEASSTFPIAEHYHLDPIEDYIMAEEPRRVTLEDYSSSNNNLFHGLPNEDPYAYLANYIEICNTIRLAGVPEAAI

SEQ ID NO: 193201 - protein, 213 aa, Glycine max
  Coding DNA Sequence Number=SeqID_76423
  Homolog annotation: Hit_ID=Q0KIN0; Match level="QueryCoverage=68%, HitCoverage=8%, E-value=1e-12, Identity=31%"; Hit description =Integrase core domain containing protein
  Pfam annotation: Domain name=zf-CCHC; Domain location=126-143; Score =10.9; E_value=0.016; Accession=PF00098.13; Description=Zinc knuckle
MKVTALKQTSHDMIAHIGKAQAAVEELKRFLVAESLEEVNRKLDKFYMVLILRSLHSDFDHVRDQVLAGDQVPSMDSLITRLLRVPHALKEENPADVVETSAMAAPRGRGGGRNSRGSRGGRGGRPQCTYCKRMGHTQETCYSLHGFPDKVAQLKSEKSSSQTSSSSVPCYSTACISQSIDGLSPWILDSGASDHISGNKSSFTSISFPQGIL

SEQ ID NO: 193202 - protein, 87 aa, Glycine max
  Coding DNA Sequence Number=SeqID_76424
  Gene Ontology: Mol. function=ribonuclease H activity; Biological process=DNA integration
MSHGRLYQKRVKNAFEKNVRTRRFSEGDLVLKKVSQALKDRGKWAPNYEGPFVVKRAFSRGALVLANMDDEELPSPVNSDVVKRYYA

SEQ ID NO: 193203 - protein, 183 aa, Glycine max
  Coding DNA Sequence Number=SeqID_76425
  Subcellular localization annotation: CTP_CleavageSite=60; ConfidenceScore=5.03e-01
MTTFGQGKLSKSFNVKKMLNKLKAIASTPYLKMKFPNLMGDIVIVKPRKTHRTPHECGSQVMSVDEGPLVRTLTVYEASRGDQNDIFNVDLRDDTVGKGSKPIEELAKLQLRCKLGQCTQLSRDLPSHKYKHIAEVLCKNINLFAWKLCDMCRNLPFGGRATRDSRDACSTKGIRAESPPTFI

SEQ ID NO: 193204 - protein, 58 aa, Glycine max
  Coding DNA Sequence Number=SeqID_76426
MDDMGLNQFRFFNMVHDILVKVKLEVTRTSTVLNVFGSRRSSDRKMQGSPMSEHGGIL

SEQ ID NO: 193205 - protein, 58 aa, Glycine max
  Coding DNA Sequence Number=SeqID_76427
MWEQAIGQFAQATCASEFGLPRLFNKRLLLLHVGGERSELSRIGCWTNGLSYLKKKRG

SEQ ID NO: 193206 - protein, 234 aa, Glycine max
  Coding DNA Sequence Number=SeqID_76428
  Subcellular localization annotation: CTP_CleavageSite=33; ConfidenceScore=5.19e-01
MNVGALISGQITSMAQSNSFRLGFPALIIALCRSRGVASHSLVFERLSPVINLAYIRKNCWNPADLIITIRGARRVRAMPAEAPSTSAAPPSTPSSADFQCLEAMLQSIHQGQIVLLQSLQLVAPPNSISSIEQFNEWREDKSSETSTLEPLIRRKRVVETQEAVATFEKSLEAISEPSKLVADTASIQQAADPSTPEDQTTPVLSLNTSPPATPVLHLTNEEDVQTQDTQDIS

SEQ ID NO: 193207 - protein, 214 aa, Glycine max
  Coding DNA Sequence Number=SeqID_76429
  Homolog annotation: Hit_ID=Q9LU33; Match level="QueryCoverage=98%, HitCoverage=99%, E-value=4e-48, Identity=45%"; Hit description =Arabidopsis thaliana genomic DNA, chromosome 3, P1 clone: MXL8
  Pfam annotation: Domain name=GLTP; Domain location=37-210; Score =102.2; E_value=1.5e-27; Accession=PF08718.1; Description=Glycolipid transfer protein (GLTP)
MNMEREGNKMKSTRREMEKKSEIGLVIEELSMIAIVKPGENHDSAHIPTKLFLSICYLVLQVLDKIGPTMAVLRQDVYQNIKTLELMQESNPSLHSNLVEILKSEATEGNSWKGSSCSKALVWLTRTLDFTSLLLQTLANDPEKRMEQIVEEAYDVALKLVPESKTFVNILKTEDENYDTLKEKMQMLVSLFVPFLEDMHCILRLYNLDKLKST

SEQ ID NO: 193208 - protein, 73 aa, Glycine max
  Coding DNA Sequence Number=SeqID_76430
  Gene Ontology: Mol. function=structural constituent of ribosome; Cellular component=ribonucleoprotein complex; Biological process =translation
  Homolog annotation: Hit_ID=P56791; Match level="QueryCoverage=80%, HitCoverage=21%, E-value=3e-12, Identity=70%"; Hit description =Chloroplast 50S ribosomal protein L2
MWMVYKVHNYTPLTIGCLPSQHLDPTMPKFFWFTVIFPTCLIVAEPFLDAKRTSPEDKYRSHNEVPPNGYIGI

SEQ ID NO: 193209 - protein, 46 aa, Glycine max
  Coding DNA Sequence Number=SeqID_76431
MDTSKPYTGAMRGTVHEPQVPCYKVMTKDNDWYLKALHWGNEGHRA

SEQ ID NO: 193210 - protein, 150 aa, Glycine max
  Coding DNA Sequence Number=SeqID_76432
MLVIISKYKEELDLATAHEHKVADEYAQVKDAITKRAPRHPYRTRSKSRMMGDLEEVQEQMKVDMSALKEQMASMMEVMLGMKQLMESNATTAAAASTAAEADPILLIAMHHPVPNIVGRGRNTSGMSTTPIWGTTEVLTPTVYHPTTHH

SEQ ID NO: 193211 - protein, 146 aa, Glycine max
  Coding DNA Sequence Number=SeqID_76433
MSRVSRERKVQVPESFERFCYAKICRDQSLKQEPMHALLGSFNSGNWSDSKVLDSAGLSFRAFTRNRVLYMDRSPTGNLVPLDLEIEATLRRNRAERIRKLLQDRTVASILEEETHFSDLLSPDSPSSRESTTQLPKAITMAKEHD

SEQ ID NO: 193212 - protein, 233 aa, Glycine max
  Coding DNA Sequence Number=SeqID_76434
  Gene Ontology: Mol. function=transporter activity; Cellular component= integral to membrane; Biological process=oligopeptide transport
  Homolog annotation: Hit_ID=Q669J3; Match level="QueryCoverage=57%, HitCoverage=26%, E-value=4e-45, Identity=70%"; Hit description =Putative proton dependent di-tripeptide transporter
GFDGIMIGHPQHAYHLEFTQHRGVRVGQAPTQDHLLVFYLPDENAWRAACERMRAAGFLVVTAYNPYWDRAGQTFEDPDGYRGYPSGAGRRFLRALGLASEQIRQHIQLVGLDVTADQTGRQVAQRAGAEPQPHHLPAHSLRRQQRHGGQADRAQAQLTQRQHQDTAHQPHRRYAGAAVAQHILRGQHHQAETAGGAQDTDHELGNAARAHVIARQCRPGPAEHRRQQDDEQG

SEQ ID NO: 193213 - protein, 124 aa, Glycine max
  Coding DNA Sequence Number=SeqID_76435
MAEEPRRVTLEDYSSSNVPQFFTSIDKLWLHDVPSVGELMNLDVVFLLKNTPLMKSITREISPKTILMQEDFQDSNMASNIINNRDNGGTTLEISSIEIKVDHPQGHNNKGLVSMIAQRSLKIL

SEQ ID NO: 193214 - protein, 77 aa, Glycine max
  Coding DNA Sequence Number=SeqID_76436
  Pfam annotation: Domain name=zf-GRF; Domain location=15-57; Score =19.1; E_value=0.00015; Accession=PF06839.3; Description=GRF zinc finger
MSPNSSTRKNVTSNCLCYYCRRATIRTTRTAKNNGRLIYVCPLRQIEHGYFVLCNKMQIDVISFRGLMKTLMLVQLK

SEQ ID NO: 193215 - protein, 137 aa, Glycine max
  Coding DNA Sequence Number=SeqID_76437
LGGIDGNPVLRGTRIRATWEYVSSVEGGQLGMVDLCVICGCGESTCTIARSPPSTTYDGVVPGDMSRGSGDLGDVRRAPGSQPIKEQRPQSKEACVVVGQLWILSDIWNMASGNRLPREVEMASGNRLPRGVIDYHA

SEQ ID NO: 193216 - protein, 51 aa, Glycine max
  Coding DNA Sequence Number=SeqID_76438
MDWTHELEDDEGHESIIHRRWFKENLSQIWGSYYEGIKAKCLRKRASMGKE

SEQ ID NO: 193217 - protein, 157 aa, Glycine max
  Coding DNA Sequence Number=SeqID_76439
  Gene Ontology: Mol. function=DNA binding; Biological process=DNA integration
  Homolog annotation: Hit_ID=Q1SKC8; Match level="QueryCoverage=95%, HitCoverage=40%, E-value=7e-50, Identity=56%"; Hit description =Integrase, catalytic region
MKLLWAYRTAYKSPTGLTPFQLVYGKSGHLPIELEHKAFWALKFLNFNSNTIGKHRKLQLHELEELRVQAYENSKLYKQKVKIYHDKKLSKRNFQPDQQLKSKWSRPFITKEVMPHGAMISEDPTTKKTWTVNGSRIKHYLGGDFEKIIIVVQLQEA

SEQ ID NO: 193218 - protein, 85 aa, Glycine max
  Coding DNA Sequence Number=SeqID_76440
MFYGVPVTSSKGIRPPTNRAFIKKYCVSRQVQGETPQQPGDGRQRATDAPPSPLEFISAHPQKAQDVKEALLGGNLVPFKSLLVI

SEQ ID NO: 193219 - protein, 72 aa, Glycine max
  Coding DNA Sequence Number=SeqID_76441
  Gene Ontology: Mol. function=protein serine/threonine kinase activity; Biological process=protein amino acid phosphorylation
  Homolog annotation: Hit_ID=Q1T3X6; Match level="QueryCoverage=58%, HitCoverage=15%, E-value=1e-13, Identity=86%"; Hit description =Protein kinase
MVLMYYASHQLTEKSDVYSFGVVLLELISGKKPLSSEDYGNEMNIVHLVVMIELSKTTRNVGGRVACGKYFT

SEQ ID NO: 193220 - protein, 78 aa, Glycine max
  Coding DNA Sequence Number=SeqID_76442
MGRVNLGLNVRMVVMKAWTEQMRKGNDKCERKEPFLGKCLCIASHGKSSTFRVSGISSRSQRSKCRFMYQEPPVKFSR

SEQ ID NO: 193221 - protein, 63 aa, Glycine max
  Coding DNA Sequence Number=SeqID_76443
MLPSSSSLMCNISHGESNECCSYHGSNNNNNYYGDNNNNDNHSGDRNDCSDGHSGEDELIEIF

SEQ ID NO: 193222 - protein, 486 aa, Glycine max
  Coding DNA Sequence Number=SeqID_76444
  Gene Ontology: Mol. function=zinc ion binding; Cellular component =mitochondrion; Biological process=regulation of transcription, DNA -dependent
  Homolog annotation: Hit_ID=Q1SIQ1; Match level="QueryCoverage=99%, HitCoverage=75%, E-value=1e-138, Identity=60%"; Hit description =Transcriptional factor B3
  Pfam annotation: Domain name=B3; Domain location=221-324; Score=93.9; E_value=4.7e-25; Accession=PF02362.12; Description=B3 DNA binding domain
MEVEVCMNVSCKNGYAREWKKGWPLRSGGFARLCHKCGAGKGNLMLLRRDVEASESIRWPRAERDGIDSCIGPNRQEDRRFSNVVKLSGHSLNFTTLDHNRPTWETQTMHKSSSLNMSLGTSSGNSVQPSALDIAERRLEDKASFCPFPQGQRSLSISKSLMDGITMNLEDSKGVISQERVARPPANGKPKNLLHFRYWPRITGQELEKLSGDLKSTIVPLFEKVLSASDAGRIGRLVLPKSCAEAYFPPISQSEGLPLQFKDVKGNDWTFQFRFWPNNNSRMYVLEGVTPCIQAMQLNAGDIVTFSRIDPGGKFVMGYRRASDSMDTQVDASTFAHSNGFATKEATFSGATANLHSGKSYPDLLQTRNGNGEPYLNGCSEHLRFGTGTADCLQTENCEMVNNDLLQQTISVSEKTLNIAPKSKRLLTHNEDAVELRITWEEAQDLLHPPPSTMPSVETIEDKEFEEFEEPPVFGKGTTINDPPSG

SEQ ID NO: 193223 - protein, 57 aa, Glycine max
  Coding DNA Sequence Number=SeqID_76445
MVMTAAIIVAAIMVMLVILVVACVNDQGDDNNNDNHGGGCNGSSDGHSDHDGLIEIF

SEQ ID NO: 193224 - protein, 106 aa, Glycine max
  Coding DNA Sequence Number=SeqID_76446
  Subcellular localization annotation: CTP_CleavageSite=8; ConfidenceScore=5.37e-01
MRLGRSAECRKNKGFFLSFVDGGFHITIWVVPFRSSRSRSNTSLGGSVPSTSCSGPPCRISVVGSSASSAPQTFVVVTLASRHTRTTISLHVSSRGLGFGVHVRLP

SEQ ID NO: 193225 - protein, 156 aa, Glycine max
  Coding DNA Sequence Number=SeqID_76447
  Gene Ontology: Mol. function=zinc ion binding; Cellular component =mitochondrion; Biological process=regulation of transcription, DNA -dependent
  Homolog annotation: Hit_ID=Q1SIQ1; Match level="QueryCoverage=69%, HitCoverage=15%, E-value=7e-26, Identity=51%"; Hit description =Transcriptional factor B3
MAFQVFELCIRENEFNGLRKYSSNQQRFQSCMASTYSKKRRIMEKLDSSAGATTKHPRHCSGCTCILCIQPPSGKGRHKPTCTTVRRQFKTLMKRKKQRESDATQNDQIHHSDEGDTHGASREGAIASNLENEGSLNRMDELGTGQIDLNSHPDHE

SEQ ID NO: 193226 - protein, 105 aa, Glycine max
  Coding DNA Sequence Number=SeqID_76448
  Subcellular localization annotation: CTP_CleavageSite=67; ConfidenceScore=5.74e-01
FLLQRGSFTYHHQKMNSKPPFVPPRSILRRSTSNTNASRWTKYFSLKGRSTLGLCNSEDVILLLTLLLSMDGSKAKMINNQRGRLELFIRQWKFRVSCIHRKRKL

SEQ ID NO: 193227 - protein, 103 aa, Glycine max
  Coding DNA Sequence Number=SeqID_76449
  Homolog annotation: Hit_ID=Q00M75; Match level="QueryCoverage=28%, HitCoverage=4%, E-value=2e-09, Identity=100%"; Hit description=PPR -repeat containing protein
MRASPGAAVKLCLGDLLVMGSNPETASLHMQSYENDVTSMENYAMKLQNQDVTKANLNEFWGEGAKERQIQIHTAIEIPNIVCNYCSILCCNRHQINAKTNTL

SEQ ID NO: 193228 - protein, 84 aa, Glycine max
  Coding DNA Sequence Number=SeqID_76450
MKHDSRKRKGYLDGMRTHLAPLQAIKTLSDPPKMQRGQSKDQGIEVMESVGMLGTYLRKILLKNGIILFAWGQAKFNLGDFDNC

SEQ ID NO: 193229 - protein, 448 aa, Glycine max
  Coding DNA Sequence Number=SeqID_76451
RCFDEFVREIQDSLGLIGELLDLVTDVLGGFSIATDLVDEISEQDVDVTNDILVDGKLSALRIKNNVGGQGGSMARLNEPMLYDKIQGSYILEKDWEIKLHYLGKVWFLLMGLEWEVVEKKVMDGKKEILKIILGTWALSLEALSWWTQRPQTLEDWTVRESSKGLLLEIISERKRISINSNIYDGRVIKEMPYPIVGTQGIIFQSNMGHLLKVMENGGRKTLEDWTMRESSKGLLLEIIPERKRISINSNVYDGLGALSLNSKCSLDAMSFYNGEEEEGGYVPGFKGRGADEMKDKTREVEKGVGVGSKKVVVGNELGPRYGPTCEVQSEAGCLTYNSFGSLMPKKKWDLNQSHSHELPLLVSFVMSDSILRGSNPNIHRRRNCKTPVTPREGSEGIVAESVSERKGEASTNTTGGKDSQRVRATRESSKGKGTKLWSLLGTNRWQD

SEQ ID NO: 193230 - protein, 137 aa, Glycine max
  Coding DNA Sequence Number=SeqID_76452
  Homolog annotation: Hit_ID=Q6UK15; Match level="QueryCoverage=88%, HitCoverage=51%, E-value=1e-59, Identity=91%"; Hit description=Al -induced protein
MSNTVVNIYDVLIARMQSFAVKDEVFCLFEGALDNLGNLRQQYGLAKSTNEVLLVIEAYKALRDRAPYPANHVVGHLSGSFAFIVFDKSTSTLFVASDQYGKVPLYWGITADGYVAFADDAELLKGACGKSLASFPQ

SEQ ID NO: 193231 - protein, 1019 aa, Glycine max
  Coding DNA Sequence Number=SeqID_76453
  Gene Ontology: Mol. function=protein binding; Biological process =lipid metabolic process
  Homolog annotation: Hit_ID=Q1RV98; Match level="QueryCoverage=95%, HitCoverage=74%, E-value=0.0, Identity=78%"; Hit description =Phospholipase, patatin family, putative
  Pfam annotation: Domain name=Arm; Domain location=182-223; Score =34.1; E_value=4.9e-07; Accession=PF00514.13; Description =Armadillobeta-catenin-like repeat
  Pfam annotation: Domain name=Arm; Domain location=224-265; Score =13.8; E_value=0.23; Accession=PF00514.13; Description=Armadillobeta -catenin-like repeat
  Pfam annotation: Domain name=LRR_1; Domain location=24-45; Score =17.6; E_value=0.045; Accession=PF00560.23; Description=Leucine Rich Repeat
  Pfam annotation: Domain name=LRR_1; Domain location=47-68; Score =12.8; E_value=1.1; Accession=PF00560.23; Description=Leucine Rich Repeat
  Pfam annotation: Domain name=LRR_1; Domain location=70-91; Score=9.6; E_value=4.5; Accession=PF00560.23; Description=Leucine Rich Repeat
  Pfam annotation: Domain name=LRR_1; Domain location=93-113; Score =10.3; E_value=3.4; Accession=PF00560.23; Description=Leucine Rich Repeat
  Pfam annotation: Domain name=Patatin; Domain location=328-580; Score =187.2; E_value=4e-53; Accession=PF01734.12; Description=Patatin-like phospholipase
  Pfam module annotation: Pfam domain module=Arm::Arm::LRR_1::LRR _1::LRR_1::LRR_1::Patatin; Domain location=182-223::224-265::24 -45::47-68::70-91::93-113::328-580
SAAYSFDGTLTLVVLPVELTQLPRLEKLYLDNNRLTVLPPELGELRSLKVLRIDNNMLVSVPAELRQCMQLVELSLEHNKLVRPLLDFRAMAELRVLRLFGNPLEFLPEILPLHKLRHLSLANIRIVADENLRSVNVQIEMENSSYFGASRHKLSAVFSLIFRFSSCHHPLLASALGKIMQDQGNRVFVGKDENAVRQLISMISSDNCHVVEQACSALSSLASDDSVALHLMKADIMQPIGTVLKSAGLEEVQRLALLAVGNLAFSLENRRILVSSESLRELLLRLAVATEPRVYKAAARALAILGENENLRRAIKGRQVGKQGLRILSMDGGGMKGLATVQMLKEIEKGTGKRIHELFDLICGTSTGGMLAVALGIKLMTLEECEDIYKNLDKLIKHLESGKLVFADPVPKDNEAATWREKLDQLYKSSSQSFRVVVHGSKHSAEQFERLLKEMCADEDGDLMIDSAVKNVPKVFVVSTLVSMMPAQPFVFRNYQYPAGTPEVALVATSDSSGINVLASPIGEQVGYKRSAFIGSCKHQVWKAIRASSAAPYYLDDFSDDVNRWQDGAIVANNPTIFAIREAQLLWPDTKIDCLVSVGCGSVRTRVRKGGWRYLDTGQVLIESSCSVDRVEEALSTLLPMLPEIQYFRFNPVDERCDMELDETDPTNWLKLESAIEEYIQKNHHAFENVCERLLLPFQHEEKWSENLRSKLPKTEESLKGADGPTLGWRRNVLLVEASHNPDSGRVIHHARELESFCARNGIRLSLMQGLSGIVKTVPSTTFPTPFQSPLFTGSFPSSPCMFSPDLGQRIGRIDLVPPLSLDGQLGKAIASPPMSPRGLRQLSLPVKSLHEKLQNSPQVGVIHLALQNNSDGLIVSYFCPCGWKPDAIVLLFSWHNDVFVVAEPGELAEKFLQNVKFSLLSTMRSHRRKGASLLANISTISDLVAFKPYFQIGGIVHRYLGRQTLVMEDDQEIASYMFRRTVPSMHLSPEDVRWMGFFYLVVYRDDALYRRIMHWGQN

SEQ ID NO: 193232 - protein, 78 aa, Glycine max
  Coding DNA Sequence Number=SeqID_76454
MVVVTMIDVVIVATETMSKGFRESNINAGGGLPWEVKTIAMGTTMATTACVIEAVLESNKHLKTQYLGSDPRSSPNEQ

SEQ ID NO: 193233 - protein, 349 aa, Glycine max
  Coding DNA Sequence Number=SeqID_76455
  Gene Ontology: Mol. function=nucleic acid binding; Cellular component= cytoplasm; Biological process=regulation of mRNA stability
  Homolog annotation: Hit_ID=Q2PEV8; Match level="QueryCoverage=79%, HitCoverage=84%, E-value=1e-122, Identity=67%"; Hit description =Putative DNA binding protein
  Pfam annotation: Domain name=RRM_1; Domain location=160-213; Score =8.3; E_value=0.025; Accession=PF00076.12; Description=RNA recognition motif. (a.k.a. RRM, R
  Pfam annotation: Domain name=RRM_1; Domain location=214-279; Score =84.0; E_value=4.8e-22; Accession=PF00076.12; Description=RNA recognition motif. (a.k.a. RRM, R
  Pfam annotation: Domain name=RRM_1; Domain location=67-140; Score =41.1; E_value=3.8e-09; Accession=PF00076.12; Description=RNA recognition motif. (a.k.a. RRM, R
  Pfam annotation: Domain name=RRM_3; Domain location=215-302; Score= -13.8; E_value=0.094; Accession=PF08777.1; Description=RNA binding motif
  Pfam module annotation: Pfam domain module=RRM_1::RRM_1::RRM_1::RRM _3; Domain location=160-213::214-279::67-140::215-302
  Subcellular localization annotation: CTP_CleavageSite=60; ConfidenceScore=5.14e-01
MMQAGPGGMAQQANQQYAQQQQQQQQQAYMMMPPQPQPPQMWAPSAQPPSQSVAPPQPTSADEVRTLWIGDLQYWMDENYLYTCFAHTGELASVKVIRNKQTSQSEGYGFIEFTSRAGAERVLQTYNGTIMPNGGQNFRLNWATFSAGERRHDDSPDHTIFVGDLAADVTDYLLQETFRARYPSAKGAKVVIDRLTGRTKGYGFVRFGDESEQIFVGNLDPNVTDDHLRQVFGQYGELVHVKIPAGKRCGFVQFADRSCAEEALRVLNGTLLGGQNVRLSWGRSPSNKQAQPDANQWNGSGGGGYYGYAQGGYENYGYAPAGQDPNMYGSYPGYANYQPPQQPQQIGYS

SEQ ID NO: 193234 - protein, 1125 aa, Glycine max
  Coding DNA Sequence Number=SeqID_76456
  Gene Ontology: Mol. function=calmodulin binding; Cellular component =nucleus; Biological process=cell division
  Homolog annotation: Hit_ID=Q84Z28; Match level="QueryCoverage=88%, HitCoverage=82%, E-value=1e-113, Identity=31%"; Hit description =Abnormal spindle-like protein
  Pfam annotation: Domain name=CH; Domain location=371-482; Score=25.3; E_value=0.00022; Accession=PF00307.21; Description=Calponin homology (CH) domain
  Pfam annotation: Domain name=IQ; Domain location=1010-1030; Score =20.1; E_value=0.0077; Accession=PF00612.17; Description=IQ calmodulin-binding motif
  Pfam annotation: Domain name=IQ; Domain location=1036-1056; Score =21.7; E_value=0.0026; Accession=PF00612.17; Description=IQ calmodulin-binding motif
  Pfam annotation: Domain name=IQ; Domain location=729-749; Score=20.7; E_value=0.0052; Accession=PF00612.17; Description=IQ calmodulin -binding motif
  Pfam annotation: Domain name=IQ; Domain location=752-772; Score=8.9; E_value=4.7; Accession=PF00612.17; Description=IQ calmodulin-binding motif
  Pfam annotation: Domain name=IQ; Domain location=813-833; Score=12.1; E_value=2; Accession=PF00612.17; Description=IQ calmodulin-binding motif
  Pfam annotation: Domain name=IQ; Domain location=847-867; Score=26.7; E_value=8.4e-05; Accession=PF00612.17; Description=IQ calmodulin -binding motif
  Pfam annotation: Domain name=IQ; Domain location=890-910; Score=13.6; E_value=0.73; Accession=PF00612.17; Description=IQ calmodulin-binding motif
  Pfam annotation: Domain name=IQ; Domain location=913-933; Score=22.1; E_value=0.002; Accession=PF00612.17; Description=IQ calmodulin -binding motif
  Pfam annotation: Domain name=IQ; Domain location=936-956; Score=21.1; E_value=0.0039; Accession=PF00612.17; Description=IQ calmodulin -binding motif
  Pfam annotation: Domain name=IQ; Domain location=962-982; Score=24.5; E_value=0.00038; Accession=PF00612.17; Description=IQ calmodulin -binding motif
  Pfam annotation: Domain name=IQ; Domain location=987-1007; Score =22.2; E_value=0.0019; Accession=PF00612.17; Description=IQ calmodulin-binding motif
  Pfam module annotation: Pfam domain module=CH::IQ::IQ::IQ::IQ::IQ::IQ: :IQ::IQ::IQ::IQ::IQ; Domain location=371-482::1010-1030::1036 -1056::729-749::752-772::813-833::847-867::890-910::913-933::936 -956::962-982::987-1007
  Subcellular localization annotation: CTP_CleavageSite=84; ConfidenceScore=5.73e-01
MDCNEAPSPSPSLHSSSLLKDISNFTTPRRPPFSLTAAKSPATQFFTASKHGTSSFHRRPNKSSTAASKKLKAFQLEQFQSSRKAQIKKEHSLKSLSKSLSVWLNFLLQNPTSCGCHLSASNAAPAPATNGKRHGAPGTSVVGVDSTWRTPKRQRKTWSTKKSAATAAEVPDSSFSQLSDSLKDVCSFDDLKQRMRVYLSLAACKEIFHQMNRVTKTIDEGRLNMKAHCPIVTDVGLKTKATRILMCYNPIWLRIGLYIIFGGDSLVLNGDVDSDQDVVFLKMVIDKLFFSHEGLAKEYAYNKMVESVYRSGYYENLGNVILKRILLLVLVLDKAKCQSYLPLEYGIDGLDGEFLSSDVMHGEGNLLTHLVILGYKLSHQQEPIVEYDFRVRDLFVDLQDGLKLCRAIQLLQHDSSILMKIVVPSDTPKKKLANCGLVLQYIRHSGGSLLDEDGIMIVAEDIVNGDKELTLSLLWNMFVHLQLPLLVDKTSLVGEISKIRGFDTDLINNANSSSMELLLNWIQAVCDNYDCAIDNFHSLVDGKAIWCLLDYYFQKELHNSCSLKEVNKKSGKASIMSVNEYSDALYNFILSQKLTTLLGNFPEVLQISELLQHNGACSDRSVVILLVFLANQLFVKKNLDHLNFHKLLGYDCQSPNHRHLRLLRCLSNSESIQKPDASDVHGNEDGARKFKAIQAWWQDMAERNCINKPAVSNLQRSSTTECSTNIRRENAARTIQLHFRGLVARRKFLKMINAVTFLQTGFRAWLQVRQGSVCMMLSTVQVCDSSCEILKQSETYKRYAMLFIHRHSFLRLKRSAQLIQQAVRSWLYRRHQQECSTSPDLMISDMVAATITVQKFVRGWLARSRYIHQLDQKEKSLNCSQQKVTFDLQTNAAIIIQLAWKRFICCKSTQKQHLLATKIQRNFRRWLLRKSFSNQIQAVIKIQSYFRRWRCVNAFQHFKIEYKAAVVIQSFLRGWFARKNACAHSNHLFATKIQRNFRMWLLRKSFLNQIQAVIKIQSYFRMWRCAMAFKHFKIEFKATIVIQSFLRGWFARKDTCARRNHIVEIQALSWLASEAGLLVPKRCCSKDPVCYSKLEVSEGSQLPERCCFGDSMLYKGAFNSESAIR

SEQ ID NO: 193235 - protein, 122 aa, Glycine max
  Coding DNA Sequence Number=SeqID_76457
MEWDGEDWSDLTSKKTRSRKVFDEAHGHGHGLRLGKVQKEKLMGSLRASPDANGKVKIKISKKEFEELLLKQEKHVNNKKQLGRASAEQVLLRLINARDNDARHRFWTPVLESIPELDHRVK

SEQ ID NO: 193236 - protein, 437 aa, Glycine max
  Coding DNA Sequence Number=SeqID_76458
  Homolog annotation: Hit_ID=Q9FLX2; Match level="QueryCoverage=79%, HitCoverage=86%, E-value=1e-20, Identity=25%"; Hit description =Arabidopsis thaliana genomic DNA, chromosome 5, P1 clone:MXC20
  Subcellular localization annotation: CTP_CleavageSite=36; ConfidenceScore=5.35e-01
MNQQNQGSGPPLNVPMKRKRGRPRKEESVVQGANVPVMPGSNNVLNSNQTAGTTTVCDDEMVGKVVTGVIDGTFNAGYLLSVKVADTDAFLRGLVFVEDQVSPVNVENDVAPHVKMIERKEIPIPVVNPQAEIHGSVPSSVQCNKQSFEPELQQVPMSEEQVLPTEIHSGISGLLENQSSSTLIPNSISSEGIPQGIQEPGHVNQSTSILSELDHDKTVKQGETLHELDASTQVKESSADGGETKVSEAVSELINLVPPIENTNMELGTGQQTLPYVQQLNEPNISNIEFNLIPVSAEPEALSCEQTTKTVNYFVEKQELPKTDVLEDTKTKLAIETSSNVDTSNSNGKPSTDVVSIPVVGSNHRLDTSQPESMPSEQVGKSVPSESKFSSEGHDLWGKRDPQNCSSFGDINKVDFNQPTESLAKSIESEKQIGSDT

SEQ ID NO: 193237 - protein, 180 aa, Glycine max
  Coding DNA Sequence Number=SeqID_76459
  Gene Ontology: Mol. function=sequence-specific DNA binding; Cellular component=nucleus; Biological process=regulation of transcription, DNA-dependent
  Homolog annotation: Hit_ID=Q1S3Y2; Match level="QueryCoverage=93%, HitCoverage=94%, E-value=4e-36, Identity=48%"; Hit description =Transcription factor, MADS-box
  Pfam annotation: Domain name=SRF-TF; Domain location=21-71; Score =79.5; E_value=1e-20; Accession=PF00319.9; Description=SRF-type transcription factor (DNA-binding and dimerisation domain)
MDMFKQNQKKKNTGRKKIEIKKLEKASNKQVTFSKRRTGLFKKASELCILCNAYVAIIVFSPADKLFCFGHPDIDSIIGRYLKGDNNAEFEPAAKSSKEKSVSYEECNRQYEAATKKLELEKKNLAQTEILAKGWNRRWWNDPIDQMSEQQLEQFMMSIYELRKKLTERTGELMMLGTMT

SEQ ID NO: 193238 - protein, 113 aa, Glycine max
  Coding DNA Sequence Number=SeqID_76460
MAWDGEDWSDLTSSKKTTSSHGHGLSLGKVQKEKLMGALRASPDANGKVKIKISKKELAELLEKQQQKQVNKKQVGRASAEQVLLCLIKARDDDARHRLWRPELESIPELGYS

SEQ ID NO: 193239 - protein, 132 aa, Glycine max
  Coding DNA Sequence Number=SeqID_76461
MGNCCKAASSMEWDGEDWSDLATSKKTSLRKVFDEAHAHVHHGHGLSLGNVQKEKLMRSLRAFPDANGKANIKISKKELVELLEKQQQTNKKQVGRVSAEQVLLRLTRARDHDAARHGLWKPVLESIPELIS

SEQ ID NO: 193240 - protein, 117 aa, Glycine max
  Coding DNA Sequence Number=SeqID_76462
MGNCCKPASSMEWDGEDWSDLTSKKTTSSKVFDEGHTHGHGLSLGKVQKEKLMGALGASPDANGKVKIKISKQQQVNKKQVGRASAEQVLLRLINARDHDTRHRLWRPVLESIPELG

SEQ ID NO: 193241 - protein, 433 aa, Glycine max
  Coding DNA Sequence Number=SeqID_76463
  Gene Ontology: Mol. function=kinase activity; Cellular component =cytosol; Biological process=porphyrin biosynthetic process
  Homolog annotation: Hit_ID=UPI00005BDDE9; Match level="QueryCoverage =73%, HitCoverage=90%, E-value=4e-60, Identity=41%"; Hit description =PREDICTED: similar to CG10424-PA isoform 1
  Pfam annotation: Domain name=Carb_kinase; Domain location=91-367; Score=92.8; E_value=1.1e-24; Accession=PF01256.8; Description =Carbohydrate kinase
MAQWDWCLFLFVLMRDGMNYRILLDSAKSCILASSVPRRQQFLIRCVGGSIDHRHRDMQALRSLEVDSQTVIRAITPALDPTRHKGQAGNIAVIGGCREYTGAPYFAAISALKIGADLSHVFCTKDAAPVIKSYSPELIVHPVLEESYNVGEEHKSSIASKVLAEVDKWLERFDCLVVGPGLGRDPFLLDCVSEIMRHARRSNIPIVIDGDGLFLVTNNLELVSGYALAVLTPNVNEYKRLVQKVLSSEVNDIDAPQQLLSLAKQIGGVTILSKGNSDLISDGDTGSQISECLWFSQTLWWPSVAVFLTWARQHILAADSNSNHSCKNPIVLGCIAGSAILRKAASLAFSNKKRSTVTGDIIECLGRSFLTKSGITFLRTFLQITGSTEGLSKAMPDSNAEKIQHLLRTHQVSLPKEKMGERSVRRLLPGQNR

SEQ ID NO: 193242 - protein, 149 aa, Glycine max
  Coding DNA Sequence Number=SeqID_76464
  Homolog annotation: Hit_ID=Q2QXS1; Match level="QueryCoverage=46%, HitCoverage=16%, E-value=8e-23, Identity=66%"; Hit description =Expressed protein
MSSPKNSSQHEAEAIPVFEAIRRAKRLRLFEPSLGVLGFVVVTVFVICCFFYSDNGYFASRIGFLEQPQRFAWLWIKGSTEPPRVEFLGEKGGGCDFFDGEWVWDESYPLYQSKDCSFLDEGFRCSENGRRDLFYTKWRWQPKGCNLPS

SEQ ID NO: 193243 - protein, 324 aa, Glycine max
  Coding DNA Sequence Number=SeqID_76465
  Gene Ontology: Mol. function=transferase activity; Biological process= aromatic compound catabolic process
  Homolog annotation: Hit_ID=Q03520; Match level="QueryCoverage=80%, HitCoverage=94%, E-value=5e-16, Identity=23%"; Hit description =Tetrachloro-P-hydroquinone reductive dehalogenase
  Pfam annotation: Domain name=GST_C; Domain location=163-257; Score =27.8; E_value=3.8e-05; Accession=PF00043.15; Description=Glutathione S-transferase, C-terminal domain
  Pfam annotation: Domain name=GST_N; Domain location=1-74; Score=33.5; E_value=7.4e-07; Accession=PF02798.10; Description=Glutathione S -transferase, N-terminal domain
  Pfam module annotation: Pfam domain module=GST_C::GST_N; Domain location=163-257::1-74
MQLYHHPLDLDSQRVRFALEEEGVDYTSHHVNPITGKNLDSSFFKMNRHGRVPVFQNGSHIIYNTIDIIQESKNLDIAAEIAVVDPCFENLIIEWYIERIAVVSSGAESISASSREVIEWMQKIQDWDPKIFTLSHIPEKYRLYVSKFIRQVAIARMSESPELASDYHRKLKEAYETEEKLKEADVLRRSKDHLVRLLDEVERQLSETPHLAGQEFTMADVMLVPVLARLELLDLENEYIIGRPNIAEYWILVQQRLSYKKVIGMVVMLGAGKRWVNFFGFYAGEGMLVKVARLQKILWLSIETIHALQSSSIKRIKERIVCSY

SEQ ID NO: 193244 - protein, 159 aa, Glycine max
  Coding DNA Sequence Number=SeqID_76466
MAPKKNKATKIPSINSEDDSKMVFPKNTFIPGRCANFYSLQEEGFHIKYPFKHDVTTISHSLCIYPTPRFFFTHHVQPIIEEEDLGFAIEVFDPHLQELMINVLISQVGWEPSRSPSLSRASDALIDLSLDSESFGDEFLLKVYEHFAGAKQKKEKKFK

SEQ ID NO: 193245 - protein, 72 aa, Glycine max
  Coding DNA Sequence Number=SeqID_76467
MTSRIFNVKNFFDVKVIYLGGLFFFLQSVALLGTFLGMATRDMVGIGRAHGVPPRVAPCTQAPWVAPCWQAR

SEQ ID NO: 193246 - protein, 136 aa, Glycine max
  Coding DNA Sequence Number=SeqID_76468
  Gene Ontology: Mol. function=RNA-directed DNA polymerase activity; Biological process=RNA-dependent DNA replication
MVAFIRQYQSNSDMAPDRMQLQNMCKREHESFKEYAQRWRDLAAQVASPMMEREMIKMIVDTLSVFYYEKMVGYTPSRFANLVFVDERIEVSQKRGKFDYPALMNRKLGANGENKKEGGTHALTVVPTWPNFPPAQ

SEQ ID NO: 193247 - protein, 505 aa, Glycine max
  Coding DNA Sequence Number=SeqID_76469
  Gene Ontology: Mol. function=kinase activity; Cellular component =chromosome; Biological process=chromosome organization and biogenesis
  Homolog annotation: Hit_ID=Q1SIP3; Match level="QueryCoverage=95%, HitCoverage=77%, E-value=1e-169, Identity=65%"; Hit description=TRNA- binding arm
  Pfam annotation: Domain name=Prefoldin_2; Domain location=351-448; Score=-4.9; E_value=0.041; Accession=PF01920.10; Description =Prefoldin subunit
AGSEPSSTWPSPTPKRGRRFKSGTRAAGFEYFLGTSGNGTDVYQKDGDESSTLTDSEEESDDSSVNNYLGFSRNGSDLGINRRIMELETELREVKEKLWMQEEEHVDGSSRGSRSENTEDVYTKINAYEQELMTVNEKLRLSEEEITKLKIELEKYRLFNTENLEAGFESSSMKEHINEGGEALEHKTIELEGSIDGVDKELFDQNGEIETLVRELRITKENLKASEMQITSLKFEANKSSERIQQLHDQLELARKDISTWKTKFNSEKRESTKLHERLARLRTSLSDRDHEIRDLKTAVSDTEQKIFPEKAQLKSEMSKVLDKRTHLEERIREWESRGRCFEDEIRRIQSEKMETEEALKGEIQLLKADIEQRESNIKDLNTILDTLKLEKDNLHVEVYSLKEEVNSRDGRIEHLNTHLNQLHMEHVQLIAGMDEAQKQVEELKSKAKQLEEEVERQKTVILEGEEEKREAIRQLCFSLEHYRDGYNMLRQHVMGHKRVPVLAV

SEQ ID NO: 193248 - protein, 237 aa, Glycine max
  Coding DNA Sequence Number=SeqID_76470
  Gene Ontology: Mol. function=zinc ion binding
  Homolog annotation: Hit_ID=Q1SIQ2; Match level="QueryCoverage=81%, HitCoverage=72%, E-value=4e-47, Identity=48%"; Hit description=Zinc finger, RING-type; Zinc finger, FYVE/PHD-type
  Pfam annotation: Domain name=FYVE; Domain location=143-200; Score= -8.0; E_value=0.0066; Accession=PF01363.12; Description=FYVE zinc finger
MDDHMNKALQEKPILIGLEDLYQGIPDESVNLTFQHLAEVKTSDKRKPTTTTTTPSRSIAKLPSLDFTKGLQASNHQHHEHYLQDFGHGEPSPLGHSGHFISHASGGAQRQSPRLMAGNDHLGHGMSFDGVSVASGRGSRRRRPGIPHSKICTICNTYVYIFRTRCLVCGRVYCRQCVERGMGEMIEGRKCIECLGLRFSQRQKNNILTFVYMGRNNCMLIKRLSSDPGLTYFSDSL

SEQ ID NO: 193249 - protein, 85 aa, Glycine max
  Coding DNA Sequence Number=SeqID_76471
  Gene Ontology: Mol. function=zinc ion binding
  Homolog annotation: Hit_ID=Q1SIQ2; Match level="QueryCoverage=94%, HitCoverage=26%, E-value=6e-16, Identity=55%"; Hit description=Zinc finger, RING-type; Zinc finger, FYVE/PHD-type
  Subcellular localization annotation: CTP_CleavageSite=70; ConfidenceScore=5.05e-01
YIERAGKVGCCSWRYPNTLKQAELKCAEKGPRRSVRHGHSGMANSTRSRSPISPRRTHNAIGSNEHSFVMSSSFSPFSPHYNLPL

SEQ ID NO: 193250 - protein, 90 aa, Glycine max
  Coding DNA Sequence Number=SeqID_76472
MDKVDIFVPHPLTNACLLIQLSPECGCKPLVCLLKQPALLSVDFQDCSIRDYSSCTLVGESSTTRDPRSLNPFSEIRRREEEVSRKRGRL

SEQ ID NO: 193251 - protein, 48 aa, Glycine max
  Coding DNA Sequence Number=SeqID_76473
  Homolog annotation: Hit_ID=Q1SIP3; Match level="QueryCoverage=97%, HitCoverage=7%, E-value=3e-18, Identity=83%"; Hit description=TRNA -binding arm
MAASGVHSCKQMRRLESRKSHSWWWDSHISPKNSKWLFENLEEIEHHL

SEQ ID NO: 193252 - protein, 109 aa, Glycine max
  Coding DNA Sequence Number=SeqID_76474
MGPILSEPQRPLVGGCAEKGTGHPEAKHCPPRVVSRGFVGGAGVTWFLCPPWTSGCPDCCHLGDLNTLVVCVLLESRASAKRNTPGLSARKTLEEDELYRFAKCTTSSL

SEQ ID NO: 193253 - protein, 101 aa, Glycine max
  Coding DNA Sequence Number=SeqID_76475
MPYFLHSVIDIVLVDSETCFQFSYVTSTLSQATIPKYVLNFFLWGPSVFPIAGSTWTTGLSAPTGLVANDLSCVAFLVRFKVDDDYDAISVGGGGGGGELG

SEQ ID NO: 193254 - protein, 156 aa, Glycine max
  Coding DNA Sequence Number=SeqID_76476
  Gene Ontology: Mol. function=oxidoreductase activity; Biological process=metabolic process
  Homolog annotation: Hit_ID=O22985; Match level="QueryCoverage=53%, HitCoverage=25%, E-value=3e-24, Identity=65%"; Hit description =Ribitol dehydrogenase isolog
MGANVTVNCVHPGIVRTRLTREREGLLTDLVFFLASKLLKTIPQAAATTCYVATHPRLFNVSDKYFADCNEISTSKLGSNSTEAASCNSISGDNTKLYQKLSAEVDTYSMGMSFPVLVIAGARGSLVSLESCQAMASKLLNYAGAVQYDQGELHKL

SEQ ID NO: 193255 - protein, 326 aa, Glycine max
  Coding DNA Sequence Number=SeqID_76477
MGKRSVQNIKGSAQFRLSQDHEFLYGSDDNDNNSDVNNDDNRNISGDHDDNGDSEGGDNDDVVMVTVFTVAANGSDVSSGGGDDGRISSGGGGDGDEVDISGGDSGCSNVSGVGGDDDSDGSNGGGVMVIAVLVVATSNGDVVVIVVVAMLVVLVAMTIVMVVTVVGGSDDIGDDYGDDDGGDIVGSGGVGDNDSDSDIDGVVAMSMATMVSVTVVLVVAPSGDTKWWQCDGGVSGCDNIGGCCSSDDGDGNGDNDDGGDGDGGNNGGGSNVGGDGDVGENGGGGSNTCGCGGGTLGSGGDNGNSGGGDSGYDGGSGDKRKMSSSN

SEQ ID NO: 193256 - protein, 186 aa, Glycine max
  Coding DNA Sequence Number=SeqID_76478
  Gene Ontology: Mol. function=sequence-specific DNA binding; Cellular component=nucleus; Biological process=regulation of transcription, DNA-dependent
  Homolog annotation: Hit_ID=Q533S5; Match level="QueryCoverage=87%, HitCoverage=78%, E-value=1e-81, Identity=93%"; Hit description=MADS box protein PIa
  Pfam annotation: Domain name=K-box; Domain location=71-166; Score =106.5; E_value=7.8e-29; Accession=PF01486.8; Description=K-box region
  Pfam annotation: Domain name=SRF-TF; Domain location=9-59; Score =107.1; E_value=5e-29; Accession=PF00319.9; Description=SRF-type transcription factor (DNA-binding and dimerisation domain)
  Pfam module annotation: Pfam domain module=K-box::SRF-TF; Domain location=71-166::9-59
MGRGKIEIKRIENSSNRQVTYSKRKNGILKKAKEITVLCDAQVSLIIFAASGKMHDYISPSTTLIDILERYHKTSGKRLWDAKHENLNGEIERLKKENDSMQIELRHLKGDDINSLNYKELMALEDALETGLVSVREKQMDVYRMLRRNDKILEEENRELNFLWVRNTLYTHCLIHGCFSKTLPTP

SEQ ID NO: 193257 - protein, 128 aa, Glycine max
  Coding DNA Sequence Number=SeqID_76479
MENMHASRKGGWVGTGSRRLDPTHDYATRLENPSCLAQKMTQSMRKPPRRVAPYPWHHWCKIQQREATIGPMAARQRQQWRFHGGANKKERKETMKNESDRAFNAIGEGPTGTKRPWDSGKWWLQHGQ

SEQ ID NO: 193258 - protein, 227 aa, Glycine max
  Coding DNA Sequence Number=SeqID_76480
MDKVRLVYGLVMKMDIDLGSIISGQISQMAQSNSSRLGFLALIATLCVAKGVVSNSLTFESLSPAINLAYISKNCWNPVDPSITFPGSHKAKAWAPIDAPAPIPPPPAPIPGSAGPSVPSNDTIMPMLQSIHHGLCLVMQSMWLGPESSLPFWGEMRLMWPRSHRHRPLKTLQRLEEAKDTPKTEAEAGEATEKTSGAVKADIDDDYVADVTAAQGTWDPWPTPAQD

SEQ ID NO: 193259 - protein, 70 aa, Glycine max
  Coding DNA Sequence Number=SeqID_76481
MVEELEFVIQDEGHFAFLLERGLCDGTLRGGSESENGDLSAVRHQNSKQTRWDSLHALRNSMEAAWFVLH

SEQ ID NO: 193260 - protein, 296 aa, Glycine max
  Coding DNA Sequence Number=SeqID_76482
  Gene Ontology: Mol. function=hydrogen ion transporting ATP synthase activity, rotational mechanism; Cellular component=proton -transporting two-sector ATPase complex; Biological process =intracellular signaling cascade
  Homolog annotation: Hit_ID=Q2RAK5; Match level="QueryCoverage=97%, HitCoverage=61%, E-value=1e-106, Identity=63%"; Hit description =Expressed protein
  Pfam annotation: Domain name=DUF231; Domain location=117-285; Score =167.1; E_value=4.6e-47; Accession=PF03005.6; Description=Arabidopsis proteins of unknown function
MLEKLRNKRIVFAGDSIGRNQWESLLCMLSSGVPNKQSIYEVNGCPITKHKGFLVFKFKDFNCSVEYYRAPFLVLQSRPPTGAPENIRTTLKVDTMDWNSEKWRDADILVLNTGHWWNYEKTIRGGCYFQEGMEVKLEMQVEDAYKQSIQTVLNWIQNTVNPIKTRVFFRTLAPVHFRGGDWKNGGNCHLETLPELGSSLVPNDNWSQFKIANVVLSAAHANISETKKFVVLNVTQMTAHRKDGHSSIYYLGRSAGPVHHRRQDCSHWCLPGVPDTWNELLYALLLKHETAHRGNL

SEQ ID NO: 193261 - protein, 120 aa, Glycine max
  Coding DNA Sequence Number=SeqID_76483
MGGFVHLRKVWCGYADTTLVLLHMLSDTNLTHRDYINFHLFFLALLLFLPGSISDESNGDVAVDQYHRYLYVENKKRSSKSNGAVLLQCICGTSVIIDGSNGDIATDHYIRYLRNRNRRV

SEQ ID NO: 193262 - protein, 415 aa, Glycine max
  Coding DNA Sequence Number=SeqID_76484
  Gene Ontology: Mol. function=transporter activity; Cellular component= integral to membrane; Biological process=transport
  Homolog annotation: Hit_ID=Q1RV90; Match level="QueryCoverage=93%, HitCoverage=99%, E-value=1e-167, Identity=78%"; Hit description=Tpt phosphate/phosphoenolpyruvate translocator, putative
  Pfam annotation: Domain name=DUF6; Domain location=108-233; Score =32.5; E_value=1.5e-06; Accession=PF00892.11; Description=Integral membrane protein DUF6
  Pfam annotation: Domain name=DUF6; Domain location=251-387; Score =15.7; E_value=0.0084; Accession=PF00892.11; Description=Integral membrane protein DUF6
  Pfam annotation: Domain name=TPT; Domain location=242-387; Score =184.0; E_value=3.8e-52; Accession=PF03151.7; Description=Triose -phosphate Transporter family
  Pfam annotation: Domain name=UAA; Domain location=99-390; Score= -138.4; E_value=0.0017; Accession=PF08449.2; Description=UAA transporter family
  Pfam module annotation: Pfam domain module=DUF6::DUF6::TPT::UAA; Domain location=108-233::251-387::242-387::99-390
  Subcellular localization annotation: CTP_CleavageSite=66; ConfidenceScore=5.69e-01
MVSLVKYTALPLTSPDSSSHVPRPQLCALPSVHNVQQSTQPSLSSLKPLYISSTQNFAFRRRRVPECQAYEADRSRPLELNIELPDEEAGIEATQRIKIGLYFATWWALNVVFNIYNKKVLNAFPYPWLTSTLSLAAGSLMMLISWATKVAELPKVDFQFWKALFPVAVLHTIGHVAATVSMSKVAVSFTHIIKSAEPAFSVLVSRFLLGEAFPGQVYLSLVPIIGGCALAAVTELNFNMIGFMGAMISNLAFVLRNIFSKKGMKGMSVSGMNYYACLSILSLLILTPFAIAVEGPKMWAAGWQTALSEIGPNFVWWVAAQSVFYHLYNQVSYMSLDQISPLTFSIGNTMKRISVIVSSILIFHTPIQPVNALGAAIAILGTFLYSQETPFGDYIPLQKFGNIIFVLHPKKTYMF

SEQ ID NO: 193263 - protein, 222 aa, Glycine max
  Coding DNA Sequence Number=SeqID_76485
  Gene Ontology: Mol. function=ATP-dependent helicase activity; Cellular component=chloroplast; Biological process=translation
  Homolog annotation: Hit_ID=Q1RV87; Match level="QueryCoverage=97%, HitCoverage=67%, E-value=1e-90, Identity=69%"; Hit description =DEAD/DEAH box helicase, putative
  Pfam annotation: Domain name=Helicase_C; Domain location=108-184; Score=37.5; E_value=4.7e-08; Accession=PF00271.21; Description =Helicase conserved C-terminal domain
MLERHFFSLETVRVLIVDEILTSYSSCHNRQTVFASASIPQHNRFIHDFVQQKWAKISDTKRKLQTLLSLIQSDAPEFGIIFVAEQSEKSKKAGKAPSTSLLIDFLKTSYQGDLDILLLEDKMNFNSRAASLLEVRKGGGYLLVATDIAAREVDLPEMPHIYNFDLPRTAIDYLHRAGRTCRKPFSDINCTVTSIIVPDERFVLQRYENELCLTVKSLFHKP

SEQ ID NO: 193264 - protein, 452 aa, Glycine max
  Coding DNA Sequence Number=SeqID_76486
  Gene Ontology: Mol. function=glucose-1-phosphate adenylyltransferase activity; Cellular component=chloroplast; Biological process =glycogen biosynthetic process
  Homolog annotation: Hit_ID=Q1RV88; Match level="QueryCoverage=98%, HitCoverage=86%, E-value=0.0, Identity=88%"; Hit description=Glucose- 1-phosphate adenylyltransferase, putative
  Pfam annotation: Domain name=Hexapep; Domain location=347-364; Score =7.9; E_value=16; Accession=PF00132.14; Description=Bacterial transferase hexapeptide (three rep
  Pfam annotation: Domain name=Hexapep; Domain location=400-417; Score =17.9; E_value=0.036; Accession=PF00132.14; Description=Bacterial transferase hexapeptide (three rep
  Pfam annotation: Domain name=NTP_transferase; Domain location=20-299; Score=426.5; E_value=3.6e-125; Accession=PF00483.13; Description =Nucleotidyl transferase
  Pfam module annotation: Pfam domain module=Hexapep::Hexapep::NTP _transferase; Domain location=347-364::400-417::20-299
MGVVQLRDLDMERRNPRTVLAVILGGGAGTRLFPLTKRRAKPAVPIGGAYRLIDVPMSNCINSGINKVYILTQFNSASLNRHIARAYNSGNGVTFGDGYVEVLAATQTPGEAGKKWFQGTADAVRQFHWLFEDPRSKDIEDVLILSGDHLYRMDYMDFVQNHRESGADITLSCLPMDDSRASDFGLMRIDNKGRILSFSEKPKGEELKAMQVDTTVLGLSKDEAQKKPYIASMGVYVFKKEILLNLLRWRFPTANDFGSEVIPASAREFYMKAYLFNDYWEDIGTIRSFFEANLALTEHPPRFSFYDAAKPMYTSRRNLPPSKIDNSKIVDSIISHGSFLNNSFIEHSVVGIRSRINSNVHLKDTVMLGADYYETDAEVVALLAEGRVPIGIGENTKIKDCIIDKNARIGKNVVIANSEGIQEADRSSEGFYIRSGVTIVLKNSVIEDGFII

SEQ ID NO: 193265 - protein, 133 aa, Glycine max
  Coding DNA Sequence Number=SeqID_76487
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RV93; Match level="QueryCoverage=77%, HitCoverage=22%, E-value=6e-43, Identity=72%"; Hit description =Glycoside hydrolase, family 1
MAKCSEGDSEKEPFIAAHNVILSHAAAVDIHRTKCQTEQKGSIADKLATERARAFSFNWFLDPIIFGKYPTEMENVLGSLLPKFSSHEKEKLKKGLDFIGLNYYTAFMSKIACTPRVSYDPGSPEQRVHTRKM

SEQ ID NO: 193266 - protein, 92 aa, Glycine max
  Coding DNA Sequence Number=SeqID_76488
  Gene Ontology: Mol. function=nucleoside-triphosphatase activity; Cellular component=signal recognition particle, endoplasmic reticulum targeting; Biological process=SRP-dependent cotranslational protein targeting to membrane
  Homolog annotation: Hit_ID=Q6UCJ1; Match level="QueryCoverage=94%, HitCoverage=28%, E-value=1e-33, Identity=82%"; Hit description =Signal recognition particle receptor protein
  Pfam annotation: Domain name=SRP54; Domain location=29-92; Score= -107.6; E_value=0.0021; Accession=PF00448.13; Description=SRP54-type protein, GTPase domain
MEEALIRILTPRRSIDILRDVHAAKEQRKPYVVVFVGVNGVGKSTNLAKVAYWLLQHKVSVMMAACDTFRSGAVEQLRTHARRLQVYIDFTA

SEQ ID NO: 193267 - protein, 104 aa, Glycine max
  Coding DNA Sequence Number=SeqID_76489
  Gene Ontology: Mol. function=deaminase activity; Cellular component =cellular_component; Biological process=purine ribonucleoside monophosphate biosynthetic process
  Homolog annotation: Hit_ID=Q1RV97; Match level="QueryCoverage=83%, HitCoverage=23%, E-value=7e-41, Identity=89%"; Hit description =Adenosine/AMP deaminase
MGKKNRANVPTLKLYWKVMLALEMRHFGVVGIDLSGNPAVGEWITYLLALKFAREQGLYVTLHCGEVSNSKEIHDMLDFLLQRIGHACFFKEEHWRRLKSSNIP

SEQ ID NO: 193268 - protein, 48 aa, Glycine max
  Coding DNA Sequence Number=SeqID_76490
MPCLKEVKKGQGRASKTDGIYGVVNRSMEGGMDPTRCAMFKTNGHVFI

SEQ ID NO: 193269 - protein, 142 aa, Glycine max
  Coding DNA Sequence Number=SeqID_76491
  Subcellular localization annotation: CTP_CleavageSite=25; ConfidenceScore=5.21e-01
MRSDCLVQFSILNLFRSPMNCIFVHVSSTFEFGAMRSDCLVQFSILNLFQSPMNCVFIHVSSTFRFGAMRSDCLVQFSILNPFRSPMYYVFVHVSSTFEFGAMHSDFLEQFSILNPFFGAPSIAFSFICPPPSSLELCVVIA

SEQ ID NO: 193270 - protein, 124 aa, Glycine max
  Coding DNA Sequence Number=SeqID_76492
GYIYLGLTENKRGYISCGSVLVEGTSIRFKENKGGYIPCGSLLLTLTQLKVERQTITEKRGIGEEISVGDGGNAGEDNKEVFKPKVWGRYWWHWQQHHRHSNVKIPPTETAATTLKCQDTANGD

SEQ ID NO: 193271 - protein, 292 aa, Glycine max
  Coding DNA Sequence Number=SeqID_76493
  Homolog annotation: Hit_ID=Q1S065; Match level="QueryCoverage=99%, HitCoverage=100%, E-value=4e-23, Identity=29%"; Hit description =Arabidopsis conserved protein
  Pfam annotation: Domain name=DUF241; Domain location=51-289; Score =231.9; E_value=1.4e-66; Accession=PF03087.5; Description=Arabidopsis protein of unknown function
MDAISTLPRTTTHQPVRSISLPTRVQPSSQRVEALLNHKPHTCLEAETIQSDLAALAELYNCMEELFHSPQTQQALLHYQNGKLVEEALCGSVTLLDACGTARDLLLSLKEHVQTLQSAMRRRRGDSSIENSICEYNGFRKKAKKEIATQLGAMKRMENKVNTCSLMGQSQDQHLIFLARVLREASTITISIFRSLLLFLSMPGLRTKGTSLISKLKPMRLFSSEKEQKNTNVVDLSAMCSLLGRDAKVEVQSALKVLETLNVSIDGLDCGLDCIFRRIVQNRVSFLNMLAH

SEQ ID NO: 193272 - protein, 162 aa, Glycine max
  Coding DNA Sequence Number=SeqID_76494
MSHDDRPILPIHLPNVFVKHLIWEDIQEKYDISKKKWNQFCQSRRDPSCEDVLIAVIGQLEHLCRVRVAGVGSQMQSQMQSEGLALPLELKVGPSATRASTKKNCVDPSGQDPGASDSEKYRVYVDENLPRLVALRRVYEGSTIIHNVPLGNDQVKVGVKEA

SEQ ID NO: 193273 - protein, 458 aa, Glycine max
  Coding DNA Sequence Number=SeqID_76495
  Gene Ontology: Mol. function=protein serine/threonine kinase activity; Cellular component=membrane; Biological process=protein amino acid phosphorylation
  Homolog annotation: Hit_ID=Q84QD9; Match level="QueryCoverage=84%, HitCoverage=88%, E-value=1e-175, Identity=78%"; Hit description =Avr9/Cf-9 induced kinase 1
  Pfam annotation: Domain name=Pkinase; Domain location=79-356; Score =136.1; E_value=9.9e-38; Accession=PF00069.15; Description=Protein kinase domain
  Pfam annotation: Domain name=Pkinase_Tyr; Domain location=79-356; Score=118.9; E_value=1.4e-32; Accession=PF07714.7; Description =Protein tyrosine kinase
  Pfam module annotation: Pfam domain module=Pkinase::Pkinase_Tyr; Domain location=79-356::79-356
  Subcellular localization annotation: CTP_CleavageSite=29; ConfidenceScore=5.05e-01
MTLMKTLWKSIFPGCYKGEYPSPKPKKVVATKPNSSHRISVTDLSYPSTTLSEDLSISLAGTNLHVFSLAELKIITQQFSSSNFLGEGGFGPVHKGFIDDKLRHGLKAQPVAVKLLDLDGSQGHKEWLTEVVFLGQLRHPHLVKLIGYCCEEEHRVLVYEYLPRGSLENQLFRRFSASLSWSTRMKIAVGAAKGLAFLHEAEKPVIYRDFKASNILLGSDYNAKLSDFGLAKDGPEGDDTHVSTRVMGTHGYAAPEYIMTGHLTAMSDVYSFGVVLLELLTGRRSVDKNRPPREQNLVEWARPMLNDSRKLSRIMDPRLEGQYSEMGTKKAAALAYQCLSHRPRSRPSMSTVVKTLEPLQDFDDIPIGTFVYTAPPDNNEMHSAKDQCETPKRRENNNNNGHLHRNGHRHHPLKSPKTPRPQSQSQSRSNDHKHRNGRGSGSNSPPSHGKIRQGVLAY

SEQ ID NO: 193274 - protein, 81 aa, Glycine max
  Coding DNA Sequence Number=SeqID_76496
MVYNEHADMTGRLLAGSFTFERHIMHYILCRVLLPRSTNLAQASEEDLIMLWVLQTGRQIDWAHLVSVVASFGYRKDLEGQ

SEQ ID NO: 193275 - protein, 199 aa, Glycine max
  Coding DNA Sequence Number=SeqID_76497
MIFSLCENSSSSCGSNDFQDYFDDAKESRVKKVPKNQELSKFQRIRLQESSLKESRFKNNQDQDSREVDFKIQEKKSRSNSQDFTREVFFKNPNITQFCFTKEFSKNFSKLPEYLLSGNRLPVSGYILCGTSRGYIYLGCCTENKKGYISCGSVQVEDTSTWLFKENKGGYIPCGSLACKGFYKVERNIKNRWFLGDWM

SEQ ID NO: 193276 - protein, 48 aa, Glycine max
  Coding DNA Sequence Number=SeqID_76498
MCDNNDDHDDKSDSSHGDNNNNNNDNHDNPCNGGSDGHSGHDGLIEIF

SEQ ID NO: 193277 - protein, 129 aa, Glycine max
  Coding DNA Sequence Number=SeqID_76499
MRVSFSINVSWPIRDQLSIALGFKCTDDLGKYLRVKLNHDRVFRGLMGKVVENMKHRLNLWKAKIISFAELCTEPSKLWVKVVRQKHNCKMLHDGGNLIEKSLVTLSHQDLDLRVCDIVRVIGPRDMPI

SEQ ID NO: 193278 - protein, 1133 aa, Glycine max
  Coding DNA Sequence Number=SeqID_76500
  Gene Ontology: Mol. function=protein serine/threonine kinase activity; Cellular component=integral to membrane; Biological process=protein amino acid phosphorylation
  Homolog annotation: Hit_ID=Q9ZPS9; Match level="QueryCoverage=97%, HitCoverage=96%, E-value=0.0, Identity=68%"; Hit description =Serine/threonine-protein kinase BRI1-like 2 precursor
  Pfam annotation: Domain name=LRRNT_2; Domain location=35-75; Score =61.1; E_value=3.5e-15; Accession=PF08263.3; Description=Leucine rich repeat N-terminal domain
  Pfam annotation: Domain name=LRR_1; Domain location=104-125; Score =0.6; E_value=2.2e+02; Accession=PF00560.23; Description=Leucine Rich Repeat
  Pfam annotation: Domain name=LRR_1; Domain location=128-151; Score =8.9; E_value=6; Accession=PF00560.23; Description=Leucine Rich Repeat
  Pfam annotation: Domain name=LRR_1; Domain location=153-176; Score =17.6; E_value=0.046; Accession=PF00560.23; Description=Leucine Rich Repeat
  Pfam annotation: Domain name=LRR_1; Domain location=178-201; Score =11.5; E_value=2; Accession=PF00560.23; Description=Leucine Rich Repeat
  Pfam annotation: Domain name=LRR_1; Domain location=202-224; Score =16.9; E_value=0.074; Accession=PF00560.23; Description=Leucine Rich Repeat
  Pfam annotation: Domain name=LRR_1; Domain location=226-248; Score =16.8; E_value=0.081; Accession=PF00560.23; Description=Leucine Rich Repeat
  Pfam annotation: Domain name=LRR_1; Domain location=250-272; Score =15.6; E_value=0.18; Accession=PF00560.23; Description=Leucine Rich Repeat
  Pfam annotation: Domain name=LRR_1; Domain location=275-297; Score =17.2; E_value=0.06; Accession=PF00560.23; Description=Leucine Rich Repeat
  Pfam annotation: Domain name=LRR_1; Domain location=299-322; Score =10.6; E_value=2.9; Accession=PF00560.23; Description=Leucine Rich Repeat
  Pfam annotation: Domain name=LRR_1; Domain location=324-346; Score =15.4; E_value=0.21; Accession=PF00560.23; Description=Leucine Rich Repeat
  Pfam annotation: Domain name=LRR_1; Domain location=348-371; Score =8.4; E_value=7.6; Accession=PF00560.23; Description=Leucine Rich Repeat
  Pfam annotation: Domain name=LRR_1; Domain location=373-395; Score =13.7; E_value=0.67; Accession=PF00560.23; Description=Leucine Rich Repeat
  Pfam annotation: Domain name=LRR_1; Domain location=397-419; Score =13.2; E_value=0.94; Accession=PF00560.23; Description=Leucine Rich Repeat
  Pfam annotation: Domain name=LRR_1; Domain location=421-443; Score =9.8; E_value=4.1; Accession=PF00560.23; Description=Leucine Rich Repeat
  Pfam annotation: Domain name=LRR_1; Domain location=445-467; Score =14.9; E_value=0.29; Accession=PF00560.23; Description=Leucine Rich Repeat
  Pfam annotation: Domain name=LRR_1; Domain location=469-491; Score =5.8; E_value=23; Accession=PF00560.23; Description=Leucine Rich Repeat
  Pfam annotation: Domain name=LRR_1; Domain location=493-515; Score =15.7; E_value=0.17; Accession=PF00560.23; Description=Leucine Rich Repeat
  Pfam annotation: Domain name=LRR_1; Domain location=517-536; Score =14.4; E_value=0.41; Accession=PF00560.23; Description=Leucine Rich Repeat
  Pfam annotation: Domain name=LRR_1; Domain location=609-631; Score =16.7; E_value=0.083; Accession=PF00560.23; Description=Leucine Rich Repeat
  Pfam annotation: Domain name=LRR_1; Domain location=633-655; Score =19.0; E_value=0.017; Accession=PF00560.23; Description=Leucine Rich Repeat
  Pfam annotation: Domain name=LRR_1; Domain location=657-679; Score =13.1; E_value=1; Accession=PF00560.23; Description=Leucine Rich Repeat
  Pfam annotation: Domain name=LRR_1; Domain location=681-703; Score =8.3; E_value=8.1; Accession=PF00560.23; Description=Leucine Rich Repeat
  Pfam annotation: Domain name=LRR_1; Domain location=78-102; Score =7.0; E_value=14; Accession=PF00560.23; Description=Leucine Rich Repeat
  Pfam annotation: Domain name=Pkinase; Domain location=836-1118; Score= 136.6; E_value=7e-38; Accession=PF00069.15; Description=Protein kinase domain
  Pfam annotation: Domain name=Pkinase_Tyr; Domain location=836-1118; Score=128.7; E_value=1.6e-35; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::...
  Pfam module annotation: Pfam domain module=Pkinase::Pkinase_Tyr; Domain location=35-75::104-125::128-151::153-176::178-201::202 -224::226-248::250-272::275-297::299-322::324-346::348-371::373 -395::397-419::421-443::...
  Pfam module annotation: Domain location=445-467::469-491::493 -515::517-536::609-631::633-655::657-679::681-703::78-102::836 -1118::836-1118
MENNHVQFLPLLTVTLLLVITVLFPVTEGAAVSSIKTDAQALLMFKRMIQKDPSGVLSGWKLNRNPCSWYGVSCTLGRVTQLDISGSNDLAGTISLDPLSSLDMLSVLKMSLNSFSVNSTSLLNLPYSLTQLDLSFGGVTGPVPENLFSKCPNLVVVNLSYNNLTGPIPENFFQNSDKLQVLDLSYNNLSGPIFGLKMECISLLQLDLSGNRLSDSIPLSLSNCTSLKILNLANNMVSGDIPKAFGQLNKLQTLDLSHNQLNGWIPSEFGNACASLLELKLSFNNISGSIPPSFSSCSWLQLLDISNNNMSGQLPDAIFQNLGSLQELRLGNNAITGQFPSSLSSCKKLKIVDFSSNKIYGSIPRDLCPGAVSLEELRMPDNLITGEIPAELSKCSKLKTLDFSLNYLNGTIPDELGELENLEQLIAWFNSLEGSIPPKLGQCKNLKDLILNNNHLTGGIPIELFNCSNLEWISLTSNELSWEIPRKFGLLTRLAVLQLGNNSLTGEIPSELANCRSLVWLDLNSNKLTGEIPPRLGRQLGAKSLFGILSGNTLVFVRNVGNSCKGVGGLLEFSGIRPERLLQVPTLRTCDFARLYSGPVLSQFTKYQTLEYLDLSYNELRGKIPDEFGDMVALQVLELSHNQLSGEIPSSLGQLKNLGVFDASHNRLQGHIPDSFSNLSFLVQIDLSNNELTGQIPSRGQLSTLPASQYANNPGLCGVPLPDCKNDNSQTTTNPSDDVSKGDRKSATATWANSIVMGILISVASVCILIVWAIAMRARRKEAEEVKMLNSLQACHAATTWKIDKEKEPLSINVATFQRQLRKLKFSQLIEATNGFSAASLIGCGGFGEVFKATLKDGSSVAIKKLIRLSCQGDREFMAEMETLGKIKHRNLVPLLGYCKVGEERLLVYEYMEYGSLEEMLHGRIKTRDRRILTWEERKKIARGAAKGLCFLHHNCIPHIIHRDMKSSNVLLDNEMESRVSDFGMARLISALDTHLSVSTLAGTPGYVPPEYYQSFRCTVKGDVYSFGVVMLELLSGKRPTDKEDFGDTNLVGWAKIKVREGKQMEVIDNDLLLATQGTDEAEAKEVKEMIRYLEITLQCVDDLPSRRPNMLQVVAMLRELMPGSTDGSSNSA

SEQ ID NO: 193279 - protein, 440 aa, Glycine max
  Coding DNA Sequence Number=SeqID_76501
  Gene Ontology: Mol. function=nucleic acid binding; Cellular component= intracellular; Biological process=regulation of transcription
  Homolog annotation: Hit_ID=Q9C9X7; Match level="QueryCoverage=93%, HitCoverage=90%, E-value=1e-101, Identity=50%"; Hit description =Putative C2H2-type zinc finger protein; 11906-10073
  Pfam annotation: Domain name=zf-C2H2; Domain location=140-162; Score =23.6; E_value=0.00071; Accession=PF00096.16; Description=Zinc finger, C2H2 type
  Pfam annotation: Domain name=zf-C2H2; Domain location=167-188; Score =14.5; E_value=0.28; Accession=PF00096.16; Description=Zinc finger, C2H2 type
  Pfam annotation: Domain name=zf-C2H2; Domain location=61-83; Score =27.3; E_value=5.3e-05; Accession=PF00096.16; Description=Zinc finger, C2H2 type
  Pfam module annotation: Pfam domain module=zf-C2H2::zf-C2H2::zf-C2H2; Domain location=140-162::167-188::61-83
  Subcellular localization annotation: CTP_CleavageSite=28; ConfidenceScore=5.44e-01
MLDNNNSASNSGAPSSSDAAFALSENGVANNKRKRRPAGTPDPDAEVVSLSPTTLLESDRYVCEICNQGFQRDQNLQMHRRRHKVPWKLLKRETAQGQNKKRVFVCPEPSCLHHDPCHALGDLVGIKKHFRRKHSNHKQWVCDKCSKGYAVQSDYKAHIKTCGTRGHSCDCGRVFSRVESFIEHQDACTVRQHRPELQALQAACSSRTASSASPSSEANFSIAPPLQGLPVLPKPAEQPATAVLLMSEIHNNKSTTSHNLELQLLPSSINSQEKHNPKENYGLKLSIGSCRNDTGNNEPAERACSEAHRSPPERNNNNVSDYSTLEVARLKEFAGEELKLAMAEKAYAEEARREAKRQIEIAEHEFENAKRIRKQAQAELAKAEELRKQAIKKISSTVKEITCHTCKQQFQSSIVGVPSSEETSIVMSYMSSATTEGEAE

SEQ ID NO: 193280 - protein, 85 aa, Glycine max
  Coding DNA Sequence Number=SeqID_76502
  Subcellular localization annotation: CTP_CleavageSite=38; ConfidenceScore=5.00e-01
MKKIQGLEAPHGATSEGVAPPIVVRSVVVKMFQRCSIRCSMATHKGGEGPRQGRGGVVNDGANLYSSSTRTRPPRSRPDLAKTRS

SEQ ID NO: 193281 - protein, 37 aa, Glycine max
  Coding DNA Sequence Number=SeqID_76503
MELPASSKGYRRILTKAWKEKDWGVDYANVDQHYIAR

SEQ ID NO: 193282 - protein, 101 aa, Glycine max
  Coding DNA Sequence Number=SeqID_76504
  Homolog annotation: Hit_ID=O82553; Match level="QueryCoverage=66%, HitCoverage=79%, E-value=7e-08, Identity=58%"; Hit description =Plasma membrane proton-ATPase
MIIAVYVNWGFARIEWSQAGCFHLKEGLWKRREREREAQAEAQHSLHGLNPLEIVKILNEENNYRELFEQARKCAEVARLRELHSLHTKGPYQVCCETPGT

SEQ ID NO: 193283 - protein, 99 aa, Glycine max
  Coding DNA Sequence Number=SeqID_76505
  Gene Ontology: Mol. function=DNA binding; Cellular component=nucleus; Biological process=regulation of transcription
  Homolog annotation: Hit_ID=Q84QS1; Match level="QueryCoverage=70%, HitCoverage=24%, E-value=6e-26, Identity=75%"; Hit description =Transcription factor GT-3b
MEGTHHLRHLHQQQQQKQRVLPQSMSSVNVDVTDRFPQWSIQETKEFLVIRAELDQTFMETKRNKQLWEVISNRMKEKGYHRSAEQCKCKWKNLVTRYK

SEQ ID NO: 193284 - protein, 123 aa, Glycine max
  Coding DNA Sequence Number=SeqID_76506
  Gene Ontology: Cellular component=integral to membrane
  Homolog annotation: Hit_ID=Q9FHT4; Match level="QueryCoverage=87%, HitCoverage=22%, E-value=6e-15, Identity=48%"; Hit description =Endosomal protein-like
MNFTNTFNSHLLALDGPVYVTNKEQRGTETYTTKHEEEAIADAGHMNKPVDPPQRKDLRKTQANINVIKLKAKCSEYIKGLSCLYLQKIHDIIVKKIIIVLAKKTHPSRKRKNVIAINGMILH

SEQ ID NO: 193285 - protein, 138 aa, Glycine max
  Coding DNA Sequence Number=SeqID_76507
MVAHSSLRIETSQAIYLLSQRGLLKLEDRDFPSYLSSLSERLSTWIDSFYYGGSLKLEDRDFLSKLSSLSERLSTWIESSYGGSLKLEDRDLSSYLSSLSERLSTWIASFYGGSLKLEDKDFPSYLSSLSERLSTWIY

SEQ ID NO: 193286 - protein, 147 aa, Glycine max
  Coding DNA Sequence Number=SeqID_76508
MFTCKGLVSSFLPHMLLCRFSHVPLVYEGLSVIIKTEWYSLLAHVEGQDILFDICGYMAEECVRFGWARCLLGLTGYFIQYTSPQTPFRPWPKKGALCCVRTIMNYSPDGYVPLLPQSNRYIVEVTVTPHVSSSSYVGYRNITCPPL

SEQ ID NO: 193287 - protein, 248 aa, Glycine max
  Coding DNA Sequence Number=SeqID_76509
MGVLLIFNVAPMQLHPNGWVAMQAFHVLCLYSFVSAMPRLFLHYFYNHPQDKARWISLIWLPKHPLFHLFTSSYKIFKIGYFKATTRPIAGKDYFYDLEGILCFPSIDNNARQNRIVAASGPSSNPTAKRTSGPHEGLADVVPSVDKHPKGKQKHTKQSHREHRSGLREQSRHREGTSREKRLKQPMLKYSTNSSIYMYLAALIRCSSRSDADFLCRLLTKGLGCNIVIKWCIATVGSKFRIFHEGSQ

SEQ ID NO: 193288 - protein, 85 aa, Glycine max
  Coding DNA Sequence Number=SeqID_76510
MGDKCNAYFIQAVMITLAHVGENINLYVDQDSYILCESETKACLQLTSNIIASTGIRLSVKELKRMVKFRIWVLIVRSLDIKESI

SEQ ID NO: 193289 - protein, 494 aa, Glycine max
  Coding DNA Sequence Number=SeqID_76511
  Gene Ontology: Mol. function=phosphopantetheinyltransferase activity; Cellular component=integral to membrane; Biological process =macromolecule biosynthetic process
  Homolog annotation: Hit_ID=Q8H012; Match level="QueryCoverage=95%, HitCoverage=86%, E-value=0.0, Identity=67%"; Hit description =Putative endosomal protein
  Pfam annotation: Domain name=EMP70; Domain location=51-492; Score =760.6; E_value=9.8e-226; Accession=PF02990.7; Description =Endomembrane protein 70
MGRSTLALVLAILISFQGTHVRSDASDHRYKDGDSVPLYANKVGPFHNPSETYRYFDLPFCVTGHEKEKTEALGEVLNGDRLVSAPYELSFKKEKDSKVVCKRKLTKEQVAQFREAVKKDYYFQMYYDDLPIWGFIGTIDKEGKTDPSEYKYFLYKHIQFDILYNKDRVIEISARMDPHSVVDLTEDKDVDVEFMYTAKWKETDTSFEKRMDKYSQSSSLPHHLEIHWFSIINSCVTVLLLTGFLATILMRVLKNDFMKYAQDEEAADDQEETGWKYIHGDVFRFPKHKSFFSAALGSGTQLFTLTIFIFMLALVGVFYPYNRGALFTALVVIYALTSGIAGYTATSFYIQLEGTNWVRNLLLTGCLFCGPLFLMFCFLNTVAIAYSATAALPFGTIVVIVLIWTLVTSPLLVLGGFLPFSAIYIELYYIFASVWGHRIYTIYSILFIVFIILLIVTAFITVALTYFQLAAEDHEWWWRYVTYVIATFYSLFEN

SEQ ID NO: 193290 - protein, 66 aa, Glycine max
  Coding DNA Sequence Number=SeqID_76512
MLLFDTHIYLGGEEQCCGVAKPSVQSDELSKVNIIKNRFRYAKVLETQKKKWFWDDVNCKKKNQHT

SEQ ID NO: 193291 - protein, 72 aa, Glycine max
  Coding DNA Sequence Number=SeqID_76513
MGKPVRVTLFCKNAPTMWDRHKLKGALKLGVFTPKAYTPKSPSGPLPPNSGPTPKTIFYMQTLLMNYTIPMT

SEQ ID NO: 193292 - protein, 395 aa, Glycine max
  Coding DNA Sequence Number=SeqID_76514
MAKPQKPQPKPGCFSFSSFLRVLLCAGNGTSPPVHPYHITESDESKNAHFTKEKMVVNDNGNDDISAPGVVARLMGLDSLPNPKWVVKCGSGSIPDSVPRSRSVNFVDYLLEFDASHVSSHRRVKTSTSFREVPSLVQNQKGNNGNNLFVFCMDGDGNMREEKEGRNEMREVEELRQRKRQGSNKNKESVSVKKEKNQGKKNKKISKLKNEPRRVPSSKNGSKGRTRNHHGEVKDLSSVSSNSSKCSSSCSSSRKNGVSSRSRFNTSLSNAHKKGVVEPKFRKNMRNQNPVLKEESECRLENHSPVSVVESNDYYPFLYGTDFLDGPSSVASKSKKWGSPSLLSLGEEVEDSASTNEGYTFIDVNKEAEYYSELMLKLRTLTEQDIRESDCTSKR

SEQ ID NO: 193293 - protein, 430 aa, Glycine max
  Coding DNA Sequence Number=SeqID_76515
  Gene Ontology: Mol. function=nucleic acid binding; Cellular component= intracellular; Biological process=chromatin modification
  Homolog annotation: Hit_ID=Q5Z8K9; Match level="QueryCoverage=99%, HitCoverage=100%, E-value=1e-128, Identity=55%"; Hit description =Zinc finger protein-like
  Pfam annotation: Domain name=zf-C2H2; Domain location=255-282; Score =10.6; E_value=0.74; Accession=PF00096.16; Description=Zinc finger, C2H2 type
  Pfam annotation: Domain name=zf-C2H2; Domain location=4-28; Score =10.0; E_value=0.85; Accession=PF00096.16; Description=Zinc finger, C2H2 type
  Pfam annotation: Domain name=zf-C2H2; Domain location=91-115; Score =15.1; E_value=0.24; Accession=PF00096.16; Description=Zinc finger, C2H2 type
  Pfam module annotation: Pfam domain module=zf-C2H2::zf-C2H2::zf-C2H2; Domain location=255-282::4-28::91-115
MPGLTCNACNTKFKDDTEQKLHYKSEWHRYNLKRKFIQIASYNIRTWEEDVVTIEAYQVAGVPGVTEALFLARQSVLAQEKNKLGETPMLYTCGLCGKDYKSSKAHAEHLKSRGHMMRASEGTSHADEKAIVKPLPQRVVNRPPPKREVDNSENEESEDEWEEVDPEEDLVDGAAKSLTDLNVNEHGENVDMEVDDDFEELDPSCCFMCDQEHKTIEDCMVHMHKHHGFFIPDVEYLKDPKGLLTYLGLKVKKDYMCLYCNDRCYPFSSLEAVRKHMEAKSHCKVHYGDGDDDEEVELDEFYDYSSSYVDDQGKQLVASCDASNNVELVGGSELIITTKSGERASTKTLGSREFLRYYRQKPRPSLANMAITAALASRYRSMGLTTIQSREKIVRMKVLKEMNRSGVDNMRTKMAMKSNVIRNLPKNVPY

SEQ ID NO: 193294 - protein, 34 aa, Glycine max
  Coding DNA Sequence Number=SeqID_76516
MEYADYRIEEIDDEIVSTSGSSRGSSGYRRQHVN

SEQ ID NO: 193295 - protein, 108 aa, Glycine max
  Coding DNA Sequence Number=SeqID_76517
  Gene Ontology: Mol. function=protein serine/threonine kinase activity; Biological process=protein amino acid phosphorylation
  Homolog annotation: Hit_ID=Q6UY57; Match level="QueryCoverage=85%, HitCoverage=14%, E-value=6e-14, Identity=39%"; Hit description =Lectin-like receptor kinase 1;1
MANTRRKIVITISAVDERNKINYGDGLTLYKTPLAFDYQTPPNFSGFSLGLYGGTLDNIVAVEFDTYINEYDQPMHRVGINNNSVASLEYKKFRIESNIGKMGHALIT

SEQ ID NO: 193296 - protein, 172 aa, Glycine max
  Coding DNA Sequence Number=SeqID_76518
  Gene Ontology: Mol. function=nucleic acid binding; Biological process= DNA integration
  Homolog annotation: Hit_ID=Q1SDG1; Match level="QueryCoverage=45%, HitCoverage=6%, E-value=8e-11, Identity=44%"; Hit description =Integrase, catalytic region; Zinc finger, CCHC-type
MRNYHNSPWMNRNMSKIQWRRHRRMKRDAILAMQQKSGVRPLVFDRITEAISLDNYGGRAAFNILPRSMLQRFGRSIEDLIPHNIVVSDFCGKPSDSERECVLQNNKRELWYMENRCFRNMSRGKSKFLNLEKKEVEGFIAFRENKKALIKRISKIGKPNSAQIDNVYYVQG

SEQ ID NO: 193297 - protein, 408 aa, Glycine max
  Coding DNA Sequence Number=SeqID_76519
  Gene Ontology: Mol. function=RNA-directed DNA polymerase activity; Cellular component=chromatin; Biological process=RNA-dependent DNA replication
MGAVLSQGGHPIAFFSKQFCPKLMCSFTYVRELAAITATVKKPPQSQGTYGTGDSNPEQHLYLVCLLGYDYSIQYRTCKSNMVADALSRSSDTLPGSLFLLSMTNFLFLTELKQKLSSNGDFVKLRYTIQASPVAYPDYFLTQDFIITIREDTRKFIDSCLDCQHTKYETQKLSGLLCPLPIPAQPWEDLSMDIIVGLPTYRGHTNILVVVDKFSKGLHFEWSYNTSSHSATGMSPFEITFGRKPPNFPQYIVGTSKIEVVNEMLGQREVVFALLRSKLLKSQAHMKHIADTHRREHQFNIGDWVMVKLRPHRQVSATGSSYSKLAKRYYRPFQVKDRMGNVAYKLKLPEQSRIHPMFHCSILKPYFQPTPTSSELVELPPLAIDNQPIVTPLTFLATKWIPSPFGPK

SEQ ID NO: 193298 - protein, 164 aa, Glycine max
  Coding DNA Sequence Number=SeqID_76520
MKKNAIKLITSLKQMDAKFGVSTLLDLDHHFAVVIRVLREVILINLSVFQFILSFLTMASSNSKSTKWLLVAKLTQKGGLLFVFHKPFSPECSWPVSLPLTASLALGGHSRKVAVTYETWKEVPVAQKDLIWEDIQAKFEIPEASGSRTKKKVLLTVGEHSRQF

SEQ ID NO: 193299 - protein, 75 aa, Glycine max
  Coding DNA Sequence Number=SeqID_76521
QSLSITADHDRSMLASSEPTEFESQSVSVTGDHDPLLGIPLTPTKRVSSYELDNERKNFEISPAEVSSNKLAKHS

SEQ ID NO: 193300 - protein, 353 aa, Glycine max
  Coding DNA Sequence Number=SeqID_76522
  Gene Ontology: Mol. function=cysteine-type endopeptidase activity; Cellular component=vacuole; Biological process=proteolysis
  Homolog annotation: Hit_ID=Q1KK73; Match level="QueryCoverage=90%, HitCoverage=92%, E-value=1e-123, Identity=63%"; Hit description =Cysteine protease
  Pfam annotation: Domain name=Inhibitor_I29; Domain location=55-128; Score=65.5; E_value=1.7e-16; Accession=PF08246.2; Description =Cathepsin propeptide inhibitor domain (
  Pfam annotation: Domain name=Peptidase_C1; Domain location=154-348; Score=315.5; E_value=9.6e-92; Accession=PF00112.13; Description =Papain family cysteine protease
  Pfam module annotation: Pfam domain module=Inhibitor_I29::Peptidase _C1; Domain location=55-128::154-348
MARLITVVWCAVAVLLCAAAGASWVEEAANPIRMVAGVEAEVVRVIGQCRRALKFARFMSRFGKSYRSEEEMRERYEIFSQNLRFIRSHNKNRLPYTLSVNRKTERGREEGKGFWIETDFADWTWEEFKRHRLGAAQNCSATLNGNHKLTDAVLPPTKDWRKEGIVSDVKDQGSCGSCWTFSTTGALEAAYAQAFGKSISLSEQQLVDCAGRFNNFGCNGGLPSQAFEYIKYNGGLETEEAYPYTGKDGVCKFSAENVAVQVIDSVNITLVVNGFHFYENGVYTSDICGSTSQDVNHAVLAVGYGVENGVPYWLIKNSWGESWGENGYFKMELGKNMCGKYPLTTPPIPEIIK

SEQ ID NO: 193301 - protein, 152 aa, Glycine max
  Coding DNA Sequence Number=SeqID_76523
  Subcellular localization annotation: CTP_CleavageSite=17; ConfidenceScore=5.07e-01
MRSFAKIFRYGSLLYINCMHAPSKPPVELASLLFAKESPVVMAISPCRGNRQSNWRVPTGTCSRLSRARCRFSRRPCRRVQVQRQAMQEGIAIPIGGSASGHAGGNRHPYWQFALGEGIASLAGGLWAEWTRQLHWRVALIQNSGVIKEEAP

SEQ ID NO: 193302 - protein, 92 aa, Glycine max
  Coding DNA Sequence Number=SeqID_76524
MLTRYQKAEIPKHNPEIKRACRMNNANTRRKRMVEANGGNGGNVIGPLECILQDYLTLVVGITTSIVLLYLENQNYELRHGLINITMTKSTI

SEQ ID NO: 193303 - protein, 230 aa, Glycine max
  Coding DNA Sequence Number=SeqID_76525
  Homolog annotation: Hit_ID=Q1T493; Match level="QueryCoverage=92%, HitCoverage=49%, E-value=1e-20, Identity=26%"; Hit description =Nucleic acid-binding, OB-fold, subgroup
MARVADKIKLIDGSREALKLSVRITDLWFIGIPGKTEQAEMVVVDSDKLCFTGVIVVRQCDMEQLPFRKFIFVSFSSVIAGDFKIGLLVDVIGVVDEVLFRYVSSKNTRVVLNLKDLSGQVLSCTLWENYCLQFLSYLNDIEDERPIVILLTHARIKEAQGSYPASVSNSFKASKLMINDLVLEIQEFRESLLDLGIEVRSILAPIGQGSSQFQGHLNYHQKMCFCQRLK

SEQ ID NO: 193304 - protein, 695 aa, Glycine max
  Coding DNA Sequence Number=SeqID_76526
  Gene Ontology: Mol. function=tubulin-tyrosine ligase activity; Cellular component=extracellular space; Biological process=protein modification process
  Homolog annotation: Hit_ID=Q10QY4; Match level="QueryCoverage=99%, HitCoverage=78%, E-value=0.0, Identity=66%"; Hit description=Tubulin- tyrosine ligase family protein, expressed
  Pfam annotation: Domain name=LRR_1; Domain location=101-123; Score =1.1; E_value=1.8e+02; Accession=PF00560.23; Description=Leucine Rich Repeat
  Pfam annotation: Domain name=LRR_1; Domain location=127-149; Score =10.2; E_value=3.5; Accession=PF00560.23; Description=Leucine Rich Repeat
  Pfam annotation: Domain name=LRR_1; Domain location=5-26; Score=2.2; E_value=1.1e+02; Accession=PF00560.23; Description=Leucine Rich Repeat
  Pfam annotation: Domain name=LRR_1; Domain location=57-80; Score=3.4; E_value=66; Accession=PF00560.23; Description=Leucine Rich Repeat
  Pfam annotation: Domain name=TTL; Domain location=402-693; Score =175.8; E_value=1.1e-49; Accession=PF03133.5; Description=Tubulin -tyrosine ligase family
  Pfam module annotation: Pfam domain module=LRR_1::LRR_1::LRR_1::LRR _1::TTL; Domain location=101-123::127-149::5-26::57-80::402-693
MSLSELVALSLLGNKLNSAEVVFQELIKLKHLKGIWLNNNPVLKNCDGELEQVILKELPELEIYNSSLTGNFGEWALGFCAGLYGKDNPGNADQTDTLLHTVSTLDLSNRNIHNLIKKAFSPICLPSLSYLNIRGNPLEQNSVGDLLDLLRRFPCLRSLEVDIPGPLGGSAIEILESLPNISELNGISASKILETGKHIIDSMLLPRLPEWTPDEPLADRIINAMWQYLMTYRLADEEKLDETSVWYVMDELGSALRHSDEPNFRVAPFLFMPEGNLASAVSFSILWPTQNVCKGDECTRDFLLGIGEDKQRSARLTAWFHTPENYFIHAYEKHHQKLLSTSLMLPTFQSSETRSIHQPGGRPLRVYTDIPHVEEYLTHPKFAITKEPKDADIIWTSVQVDEDMKKATGITDQQYINQFPFEACLVMKHHLAETIQKAHGSPQWLQPTYNLETHLSQLIGDYCVRKKEGLDNLWILKPWNMARTIDTTVTDNLPAIIRLMETGPKICQKYIEQPALFQGRKFDLRYILLVRSMHPLEIFLSDCFWVRIANNQYSLDRSSLFEYETHFTVMNYRGAINHKNASDFVREFEEEHQVKWLDIHTRVRKIIRSVFEAAAVTHPEMHSPTSRAMYGVDVMLDSSFQPKLLEVTYCPDCTRACKYDMDIVVGEGGVAKASDFFNNVFRCLFLNEISQVSPL

SEQ ID NO: 193305 - protein, 294 aa, Glycine max
  Coding DNA Sequence Number=SeqID_76527
  Homolog annotation: Hit_ID=Q8S8K9; Match level="QueryCoverage=98%, HitCoverage=99%, E-value=3e-95, Identity=56%"; Hit description =Expressed protein
MATDRYASPPATSPEENALFLDILHEAPLFAHRQAARAGYATLAIGAHWIFRPVRGLISPVLCSCDVLLLLLTGIFQQYLVYQVQKIRLQGYYSFSQKLKFIVRIPFAITAYGTAAMLLVIVWKPYTGFLSISAILRYHDGRLSDQQMALLQYQRENLHFLSEEILRLQECLSKYERTDDRSTPQVDLAHLLAARDQELRTLSAEMNQVQSELRLARSLIAERDSEIQHVRMTNNQYVEENERLRAILGEWSTRAAKLERALEAERMSTLELQRKLSTPRSQPYTSTEANQHGA

SEQ ID NO: 193306 - protein, 44 aa, Glycine max
  Coding DNA Sequence Number=SeqID_76528
MEEKKEFPKGEFSGFSCWSGLEPAYSRLAWVLVFVLSTGACICA

SEQ ID NO: 193307 - protein, 66 aa, Glycine max
  Coding DNA Sequence Number=SeqID_76529
MMKVEKKLIHRTGQQQSPRSKKKEWGQQQSPRSKKSGVYINISMDGFLSIVGVKLSMKHPLQLAWQ

SEQ ID NO: 193308 - protein, 128 aa, Glycine max
  Coding DNA Sequence Number=SeqID_76530
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=P30186; Match level="QueryCoverage=44%, HitCoverage=23%, E-value=4e-19, Identity=82%"; Hit description =Proteasome subunit alpha type 7-A
MSNRRGKGFETEGIELKRVVVPGVLEFGGGFLLDVEDDVVGAADADGGVALADDFEGVLDLEEMAIRGEHSDCSVVPSHSDCDASVTKIVKTKKTSLVLVLVCSLLAVTQGTSRIASWTGLLESCYSP

SEQ ID NO: 193309 - protein, 127 aa, Glycine max
  Coding DNA Sequence Number=SeqID_76531
MLSPSLSHNTSNHSATLLWSKKEHDEEQLAIHVQNGRIKEYLVLALPGQIVKGKEGTVRLYGGWPMTMIVRLWVWQQGYQRELDHEMWRDSNQIRVHNIKRKMRQQVGKRSCVLEKLTIDFLITGVE

SEQ ID NO: 193310 - protein, 305 aa, Glycine max
  Coding DNA Sequence Number=SeqID_76532
  Homolog annotation: Hit_ID=Q1S065; Match level="QueryCoverage=99%, HitCoverage=99%, E-value=8e-36, Identity=34%"; Hit description =Arabidopsis conserved protein
  Pfam annotation: Domain name=DUF241; Domain location=54-302; Score =204.1; E_value=3.3e-58; Accession=PF03087.5; Description=Arabidopsis protein of unknown function
  Subcellular localization annotation: CTP_CleavageSite=29; ConfidenceScore=5.06e-01
MGTFSQKHSSKYGVRSISLPTRSHPSTVRVEEELSKLKSLEASSSTPKVETICCGLSGLAELYKCIEDLLKLPLTQQALGQHQNEKWVNELLDCPVGFLDLLGKTRDSILLMKESVGELQSALRRKRVGDSDRESYLSTYWRLRRNMRKESTKSMLLLKQMENESFVASPNLDLSEHLSAVVRVLREASLITSSIFESLVVFLSSPILKLKPNKWAFVVSRLMQKGLFAYNNHQENINELEKVDFALNSLIVDNLSKDAEAEKIQSAHGRLEALVVAIDEIENGLECLFKRLINTRVSFLNIFSP

SEQ ID NO: 193311 - protein, 247 aa, Glycine max
  Coding DNA Sequence Number=SeqID_76533
MIGGDIQYAVPAMEGSTTPSLSSPQHSDFSTGYLEDALIESCERSKRRRVLPCATDEHSKSFIDDLEQSFWNFNPLWNQPVENFNFYCMNQIERFCGISDEHISTSRSEEANILLADTKTPEETISASESLNSSSSSYKQPATCKTTDPTVAPTENDDMRNKKVVTRVVYPFAMVKPGGREGDVTLNDINERILMPPTRPVRHPVGDFACRPCVSAEGPGLSGKAVVALTRIHTQGRGTITIIRTKG

SEQ ID NO: 193312 - protein, 70 aa, Glycine max
  Coding DNA Sequence Number=SeqID_76534
  Subcellular localization annotation: CTP_CleavageSite=28; ConfidenceScore=5.09e-01
MGKGVITVASSGRPAKASSGNFPEEVVLSESFRKKGSSRCPLNIPEELFGRATFFGKFPEELLLPEVLFS

SEQ ID NO: 193313 - protein, 392 aa, Glycine max
  Coding DNA Sequence Number=SeqID_76535
  Gene Ontology: Mol. function=RNA-directed DNA polymerase activity; Cellular component=chromatin; Biological process=chromatin assembly or disassembly
MNSVLQPFLRKFTAVFFDDILVYSDSLQSHLHHLEQVLDTLLHHQFFLKRSKCFFGERCLEYLGHIISGAGIEPEPSKFATMTQWPPPFSSKDLRAFLGLTGFYRRFIRNYASIASPLTTLLCRDNFAWSPPAQSAFDHLKKAMTSALVLTPPDFSIPFVLKTDASGIAMGAVLMQNNKPIAYFSKQFTPKLQRASTYTRELHAIMAAVDKWRQYLLGHKFVILTDHRSLQDLMTQVIQTPEQHYYLAKLLGYDYQIKFKRGHSNVVADALSRVPQASEGLCLILHIPQFDFMQQLLQSLQTNTEFQEKLRSIQVAPTAFPTFLVHNDLIYYKGSIWIPDDNPFIPALLHEFHSTPLGGHFGVLKTIHRLQANFTWPNIHRDVRNYIRNCQT

SEQ ID NO: 193314 - protein, 565 aa, Glycine max
  Coding DNA Sequence Number=SeqID_76536
  Gene Ontology: Mol. function=transporter activity; Cellular component= integral to membrane; Biological process=oligopeptide transport
  Homolog annotation: Hit_ID=Q7XAC3; Match level="QueryCoverage=97%, HitCoverage=94%, E-value=0.0, Identity=75%"; Hit description=Peptide transporter 1
  Pfam annotation: Domain name=MFS_1; Domain location=32-514; Score= -19.1; E_value=0.0024; Accession=PF07690.6; Description=Major Facilitator Superfamily
  Pfam annotation: Domain name=PTR2; Domain location=94-498; Score =518.1; E_value=9.7e-153; Accession=PF00854.12; Description=POT family
  Pfam module annotation: Pfam domain module=MFS_1::PTR2; Domain location=32-514::94-498
MMKRVNGDGSVDYRGGPALKKDTGNWRACPFILGNESCEHLAFYGIATNLVNHLTTKLHEGNVSAARNVSIWLGTSYLTPIIGAVLADGYWGRYWTIAVFSVIYFIGMCTLTLSASLPALKPAECLGSVCPPATPAQYAVFYFGLYVIALGIGGIKSCVPSFGADQFDDTDPVERIRKWSFFNWYYFSIYLGAIVSSSIVVWIQDNAGWGLGFGIPTLLIVLSMASFFIGTPLYRFQKPGGSPVTRMCQVLCASVRKWNLVVPEDSSLLYETPDKRPAIKGNHKLVHSDDLRCLDRAAIVSDSESKSGDYSNPWKLCTVTQVEELKILICMFPMWATGAVFSAVYTQMSTLFVEQGTVMNTHIGSFEIPPASLATVDAISVVLWAPAYDRVIVPFTRKFTGNERGISVLHRVSIGYFISVLSMLAAAIVEIMRLRLARELDLVDEPVAVPLSILWQIPQYFLLGAAEVFAYVGLLEFFYDQSPDTMKTLGIALSPLYFALGNYLSSFILTMVTYFTTQGGKLGWIPDNLNKGHLDYFFLLLAGLSFLNMLVYFVAAKRYKKRKTT

SEQ ID NO: 193315 - protein, 363 aa, Glycine max
  Coding DNA Sequence Number=SeqID_76537
  Gene Ontology: Mol. function=histone-lysine N-methyltransferase activity; Cellular component=nucleus; Biological process=chromatin modification
  Homolog annotation: Hit_ID=Q9ZUM9; Match level="QueryCoverage=99%, HitCoverage=96%, E-value=1e-76, Identity=44%"; Hit description =Histone-lysine N-methyltransferase ASHR2
MAAPSSLLKVEEIQGRGRGMVASQPLKAGQSVLRDSPILQYSALPLIRQSLSSSSSASASCFCDHCFKTLPPLQGDSSSCTVLCPNCCHHYFCSSKCLSKALNNSHSSWVCQALSHLRANSLLLEQPLERQVQANFLIAAYNLANFSPSDFQIMLSLQGSPEESTIAAAQFLHPLISPRNEFSLELTSALLANDKLNAFGIMQSFSEHDDQRFDYIDANPPDDGHNTDFIIWMINGVPQGREICLSYFPVNENYSSRQKRLIEDYGFTCNCDRCNVESNWSDNGSVEDNAEDEEEEVMDEDQCEPMAASDTDDHPHEDNNDFPHAYFFLKYMCDRTNCWGTLAPLSPQGVLHLMSWNAMSVAN

SEQ ID NO: 193316 - protein, 581 aa, Glycine max
  Coding DNA Sequence Number=SeqID_76538
  Gene Ontology: Mol. function=transporter activity; Cellular component= integral to membrane; Biological process=oligopeptide transport
  Homolog annotation: Hit_ID=Q7XAC3; Match level="QueryCoverage=99%, HitCoverage=99%, E-value=0.0, Identity=75%"; Hit description=Peptide transporter 1
  Pfam annotation: Domain name=MFS_1; Domain location=52-530; Score= -6.9; E_value=0.00065; Accession=PF07690.6; Description=Major Facilitator Superfamily
  Pfam annotation: Domain name=PTR2; Domain location=114-514; Score =501.6; E_value=9.2e-148; Accession=PF00854.12; Description=POT family
  Pfam module annotation: Pfam domain module=MFS_1::PTR2; Domain location=52-530::114-514
MGSIDDDTPLLEEGLLQDDEGSEQFTGDGSVNFRREPALKKGTGNWRACPFILGNECCERLAFFGITTNLVTYLTTKFHEGNVSAARNISIWQGTCYLTPIIGAVLADGYWGRYWTIAVFSAGMCTLTLSASLPALKPAECLGSVCPSATPAQYAVLYFGLYLIALGTGGVKACVPSFGADQFDDTDPNERVKKASFFNWYYFSIYLGAIVSCSLIVWIQDNAGWGLGFGIPALFMGLSTISFFIGTHLYRFQKPGGSSYTRMAQVLFASVRKWNLVVPEDSSLLYEMPDKKSTIKGSCKLVHSDNLRCLDRAAIVSDYESKSGDYSNPWRLCTVTQVEELKSLIHMFPIWATGIIFAAVYAQMSTLFVEQGTMMNTCIGSFKLPPASLSIFDVISVVLWVPLYDRIIVPILRKFTGKERGLSMLQRMGIGLFISVLCMLAAAVVEIMRLQLARELDLVDKPVDVPLSVLWQIPQYFFLGAAEVFTFVGQLEFLYDQSPYGMKTLGTALTLLNFSLGNYLSSFILTMVTYFTTLDGKPGWIPDNLNKGHLDYFFLLLAGLSFLNMSLYIVAAKRYKQKKAC

SEQ ID NO: 193317 - protein, 601 aa, Glycine max
  Coding DNA Sequence Number=SeqID_76539
  Gene Ontology: Mol. function=transporter activity; Cellular component= integral to membrane; Biological process=oligopeptide transport
  Homolog annotation: Hit_ID=Q7XAC3; Match level="QueryCoverage=99%, HitCoverage=100%, E-value=0.0, Identity=83%"; Hit description =Peptide transporter 1
  Pfam annotation: Domain name=MFS_1; Domain location=51-550; Score =7.0; E_value=0.00015; Accession=PF07690.6; Description=Major Facilitator Superfamily
  Pfam annotation: Domain name=PTR2; Domain location=113-534; Score =552.4; E_value=4.6e-163; Accession=PF00854.12; Description=POT family
  Pfam module annotation: Pfam domain module=MFS_1::PTR2; Domain location=51-550::113-534
MGSPENQLSLAEEALLQDDESKQYTGDGSVDFKGRPVLKRNTGNWKACPFILGNECCERLAYYGIATNLVTYLTQKLHEGNVSAARNVTTWQGTCYLAPLIGAVLADAYWGRYWTIAIFSTIYFIGMGTLTLSASVPALKPAECLGPACPPATPAQYAVFFFGLYLIALGTGGIKPCVSSFGADQFDDTDPGERIKKGSFFNWFYFSINIGALVSSTFIVWIQENAGWGLGFGIPALFMALAIGSFFLGTPLYRFQKPGGSPITRMCQVVVASVRKRNLVVPEDSSLLYETPDKSSAIEGSRKLEHSDELNFFIHGSTLHIIVPYSELCLDRAAVASAAESKSGDYSNKWRLCTVTQVEELKILIRMFPVWATVIVFAAVYAQMSTLFVEQGTMMNTNVGSFKIPPASLSSFDVISVIVWVPVYDRIIVPIARKFTGNERGFSELQRMGIGLFISVLCMSAAAIVEIVRLQLAKEHGLVDEPVPVPLNIFWQIPQYFLLGAAEVFTFIGQLEFFYDQSPDAMRSLCSALALLTTSLGNYLSSFILTVMTYFTTQGGNPGWIPDNLNKGHLDYFFWLLAGLSFLNMFVYIVAAKRYKEKKSA

SEQ ID NO: 193318 - protein, 82 aa, Glycine max
  Coding DNA Sequence Number=SeqID_76540
MYFEFIGSSIHIHSYEEISMRKFASNHLDADDTIQSGKNLMPLGACVTRLIDCSSCMEKMGIGAEGEPLPEAVYDLQSHVSG

SEQ ID NO: 193319 - protein, 86 aa, Glycine max
  Coding DNA Sequence Number=SeqID_76541
ISAYHGCRMTKLGLCVPTDTTVSEWQKGVDNRKNDQTWSLLVIGPAASEWQKGADNRKGCRMTKLGLCVPSDTTMSEWQRGADNRK

SEQ ID NO: 193320 - protein, 58 aa, Glycine max
  Coding DNA Sequence Number=SeqID_76542
MAAKLLVNHAVRAWKYKYGFKIWQEYGRIKRKNGMLLEGSPERTLNHRLQSPQYLKEG

SEQ ID NO: 193321 - protein, 32 aa, Glycine max
  Coding DNA Sequence Number=SeqID_76543
MGFQTPMGEEHKCSSQIIAQSANSTWPREVSF

SEQ ID NO: 193322 - protein, 184 aa, Glycine max
  Coding DNA Sequence Number=SeqID_76544
  Gene Ontology: Mol. function=protein phosphatase type 2C activity
  Homolog annotation: Hit_ID=Q2HW33; Match level="QueryCoverage=44%, HitCoverage=23%, E-value=3e-15, Identity=42%"; Hit description =Protein phosphatase 2C-like
MAQSADGKVFKIVPWHHLEHSTSNSLSIRALSHDLTGSDRGGFDQIDKDDSNLPLDTAPIKHVTQDNQNMSFPSWEGTFMRCFTAIDEKLAKNIDTDGFHGGSTSVSVLKQGEQVIIGNVGDSRAVLCRRAPDNHLIPVQLTVDLTPDIPSIVDLTPDIPRRRAYMRKKQEGCTRGRSRGVQLA

SEQ ID NO: 193323 - protein, 105 aa, Glycine max
  Coding DNA Sequence Number=SeqID_76545
MLFVVLPGGVDSVVSLHFVAPSPDSRGRVVMAAIDDSNPFILHSSDNLGIALVSHPFIVFSVDVVLWMNWRGAVVLVYATALWYLFERVDYNFLSFVTKVFAKKL

SEQ ID NO: 193324 - protein, 303 aa, Glycine max
  Coding DNA Sequence Number=SeqID_76546
  Gene Ontology: Mol. function=transcription factor activity; Cellular component=nucleus; Biological process=regulation of transcription
  Homolog annotation: Hit_ID=Q6Z1C4; Match level="QueryCoverage=87%, HitCoverage=75%, E-value=2e-75, Identity=56%"; Hit description =Putative stress responsive gene 6 protein, Srg6
  Pfam annotation: Domain name=YL1; Domain location=10-232; Score =222.4; E_value=9.8e-64; Accession=PF05764.4; Description=YL1 nuclear protein
MEGSGEDVVLLDRASRATRGKRLTKLLDDEIQEDELFWNQDALKEDEEDDNYQEEPEIADEFDSDFDQDEPVPEEEEDPNKNDDDERMHKKKRLIFPGKTLAKKKKKKKTISKLESSPKENEDEEHSGKVVEDEGGERMIRKSTRTSVIVRQAERDAIRAALQATIKPVKRKKEGEEKRMTQEEMLLEAAQTEIMNLRNLERVLAREEEVKRRAIVHKTVFNGPQIRYISKNGTSYLEFIKGSSFHSDIPTAPVQYPEQPVCPITGLPANLDDTQCVCKLEMLDSFFPYYIGGFLVLVSSKNA

SEQ ID NO: 193325 - protein, 78 aa, Glycine max
  Coding DNA Sequence Number=SeqID_76547
MSPYTIAEPCCDMVFFLNESTNSRKDMSMGGLYDSVSGCGFSIKRKRSIMPDKNVNPDGRSLARFRRIPDFEDEDYSD

SEQ ID NO: 193326 - protein, 69 aa, Glycine max
  Coding DNA Sequence Number=SeqID_76548
MDLVTKDEHRKAHIYACKADLPGQKEEEARAQSADGKVFKIVPWHHLEHSTSNSLSIQALSHDLTGLDR

SEQ ID NO: 193327 - protein, 66 aa, Glycine max
  Coding DNA Sequence Number=SeqID_76549
MTASKGKTHFEVVLPLELPFKVAPDWRCPTPHKQRGKDRNTQLPLQKHYPRENPIDPDRACNLLVR

SEQ ID NO: 193328 - protein, 224 aa, Glycine max
  Coding DNA Sequence Number=SeqID_76550
  Homolog annotation: Hit_ID=Q5CEG7; Match level="QueryCoverage=45%, HitCoverage=97%, E-value=8e-42, Identity=82%"; Hit description =Senescence-associated protein
EGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGRADIEGSKSNVAMNAWLSQASYPCGNFSDTSRFEFRRTKGSIGHAFTVRIRTGNQNQTSFYPFVPHEISVLVELILGHLRYLLTDVPPQPNSPPDNVFRPDRPAEADLGSKKRGSAPLPIHGI

SEQ ID NO: 193329 - protein, 117 aa, Glycine max
  Coding DNA Sequence Number=SeqID_76551
  Gene Ontology: Mol. function=chitinase activity; Cellular component =vacuole; Biological process=cell wall catabolic process
  Homolog annotation: Hit_ID=Q8RVN0; Match level="QueryCoverage=99%, HitCoverage=64%, E-value=2e-40, Identity=75%"; Hit description=Class II chitinase
  Subcellular localization annotation: CTP_CleavageSite=18; ConfidenceScore=5.25e-01
MAFDSSNPSCSQGSLPIYGSTLGRTRSDFSTRVSGLYRHSILPLIMLVITPYPGTSPADLSISDGVHFPVITSWHDGLFPCGVIQNHNAVLNDTSTFVATRSGLFSKSTPSAVPACP

SEQ ID NO: 193330 - protein, 335 aa, Glycine max
  Coding DNA Sequence Number=SeqID_76552
MELEARPLAPTSEEDPASWCTKKVKTRDSEAVVIETLKVEEEMYVSPKASYKEKLLSMSGVKGTTPGLETTVPGKIDFQSVKTNSSNKQGLQGPEVSFRFLEAKLQRSWTKNNTIKILDMLDDYYVIHFSNQDDYNHAFFEGPCIRTMLKVDLMTSIHSRETFARLCVELDLSKPFTTHIMIRGYPLYLEYEEKTKGSPDNESADSDDVPKGNRVVNEEKSKETKVEPSVGYEPWMIIKRKPRKKVDRHETQKGITANNKKESDKRKDSPLIQKGNPRMDRVKNALGGKNPQLNGGKSSQEEEKSPSSGRKVNSKVLPNNKGVAPSGAGSPLKAK

SEQ ID NO: 193331 - protein, 148 aa, Glycine max
  Coding DNA Sequence Number=SeqID_76553
  Subcellular localization annotation: CTP_CleavageSite=65; ConfidenceScore=5.05e-01
MGKNKGRQSHSAAKKIMVKGTTSGSGKVLVKKAGTSYAKTDDVTHQVFDNFSECSADFESFPKVSCTLGDNDSTTDDDSSHSYGSKSSPQLDDNKAPTPWVNLFKDNRNPSKGFGMKFSSPPSDDEVLLEETDLQPLGEAWGHSLIGY

SEQ ID NO: 193332 - protein, 97 aa, Glycine max
  Coding DNA Sequence Number=SeqID_76554
MVPCWSAISYHLCSVVIAINTPLWKINLVRKVVSEAEVIPKLLRSVFWGEGVSWSQDADVVDTRLGRHTLLQGKARSTSLRVWSKKAAERSGDKAGV

SEQ ID NO: 193333 - protein, 378 aa, Glycine max
  Coding DNA Sequence Number=SeqID_76555
  Gene Ontology: Mol. function=RNA-directed DNA polymerase activity; Cellular component=chromatin; Biological process=chromatin assembly or disassembly
MVSSQGVAPDPNKIQAMLDWPTPSSPSDLCGFLGLTSFYRKFICHYAAITTPLTVLLWKEQFSWSPSAQTAFDQLKLIMTQALVLATSDFTIPFTIESYASSTAMGTVLLQNSRPIAFFSKPLCPWLQWASIYVRELHAITSSIRKWHHYLLGHSFIILTDHRSLKELMWQTLFQQILSDSASHPGFTINNGLLLFEGKIWLPLGHTFINLVMEEFHKTPLGGHMGVTKTLRRLRYNFFWPHMCQDITRYVAQCSTCQQMKYEAKKPVGLLHPLPIPSAIWEDLSLDFTTGLPISNGYTMIMVVVDRYSKGTHLGHLPSHFTAHKNGPMTHLCILAQDFLPSKSFMHSTLQHRLLKSQNAMKTQADAHHWDVQFDVGD

SEQ ID NO: 193334 - protein, 116 aa, Glycine max
  Coding DNA Sequence Number=SeqID_76556
  Subcellular localization annotation: CTP_CleavageSite=51; ConfidenceScore=5.41e-01
MAENPFLITMIAQALVSSSGQLFRRKVFNRGFRVWREGSGRDRRRRVGPIMATTLRPAEGIGVETPALRGGVRGRSEMKQLSKEGGARLTMRFARHLNSVRYSFTELCCWSLNKVH

SEQ ID NO: 193335 - protein, 115 aa, Glycine max
  Coding DNA Sequence Number=SeqID_76557
  Gene Ontology: Mol. function=transferase activity, transferring acyl groups, acyl groups converted into alkyl on transfer; Biological process=branched chain family amino acid biosynthetic process
  Homolog annotation: Hit_ID=Q39891; Match level="QueryCoverage=78%, HitCoverage=16%, E-value=6e-47, Identity=100%"; Hit description =Probable 2-isopropylmalate synthase
MALASKGDHALNGLYTRINTRHILETSKMVEEYSGMHLQPHKPLVGANAFVHASGIHQDGMLKHKGTYETISPEEIGHKRTTRIGIVLGKLRYANYFFLKYAYVRKSMTINIRGR

SEQ ID NO: 193336 - protein, 56 aa, Glycine max
  Coding DNA Sequence Number=SeqID_76558
MYFKTFSECEVYMVGCVKIRSMRVNDVEPNQNIKEGKGHCSFLRGFSHNYLRMTTF

SEQ ID NO: 193337 - protein, 74 aa, Glycine max
  Coding DNA Sequence Number=SeqID_76559
  Gene Ontology: Mol. function=DNA binding; Cellular component =chromosome; Biological process=chromosome organization and biogenesis (sensu Eukaryota)
  Homolog annotation: Hit_ID=Q9LD28; Match level="QueryCoverage=99%, HitCoverage=57%, E-value=2e-16, Identity=81%"; Hit description =Histone H2A.6
  Subcellular localization annotation: CTP_CleavageSite=55; ConfidenceScore=5.70e-01
MAGCGKTLGSNTAKKATSRSSKAGLQFPVDLSPVSSRPENISSVLASVLPLTSPLSSNISQPSFGVGWKRCKRQ

SEQ ID NO: 193338 - protein, 71 aa, Glycine max
  Coding DNA Sequence Number=SeqID_76560
MDTRCDQRRRSLPWVYCFEYCKRQSPMLLGIALAQVFIYHFVIWTFKVATRRWKSHAHEHELCGFVIVQIH

SEQ ID NO: 193339 - protein, 106 aa, Glycine max
  Coding DNA Sequence Number=SeqID_76561
MGHSKILPPLIMKEIAPRSEIELKNNLKPFHYVYQSTTSYVEGTKAIGSYLHILTEDDLPHAHKIHNVVLDVNDGGVKDRVPEVEELRHHANDLQCQITDILFGLE

SEQ ID NO: 193340 - protein, 176 aa, Glycine max
  Coding DNA Sequence Number=SeqID_76562
MEESTRSKSNLDCLEDAIAKLAVTQASMSTKLNDLHQKLVVMESTHHSSVSSSTHSPGSSVSLSMQPYCMKLEVPCFDGSDPMGWLFKINQFFKYHATPDHKRLTIALFYMDEPALVWYQWMSCNGQITSWPGFLQALESLFAPSHFDDPTGSLFKLIQQDSVSDYSFTSRLWLTK

SEQ ID NO: 193341 - protein, 33 aa, Glycine max
  Coding DNA Sequence Number=SeqID_76563
MKQNLENEVKRQIVRILEELSTSESPTNSSAQD

SEQ ID NO: 193342 - protein, 152 aa, Glycine max
  Coding DNA Sequence Number=SeqID_76564
  Gene Ontology: Mol. function=transferase activity, transferring acyl groups, acyl groups converted into alkyl on transfer; Cellular component=intracellular; Biological process=branched chain family amino acid biosynthetic process
  Homolog annotation: Hit_ID=Q39891; Match level="QueryCoverage=64%, HitCoverage=17%, E-value=7e-49, Identity=100%"; Hit description =Probable 2-isopropylmalate synthase
  Pfam annotation: Domain name=HMGL-like; Domain location=2-146; Score =2.1; E_value=1.2e-07; Accession=PF00682.9; Description=HMGL-like
MKLGETCKRIIELSGSRERREDLHEEAIIYTFIKRSDREFLYEILGVVIEAGATTVNIADTVGIVMPLELGKLIVDIKDNTPGIANVIISTHCHNDLGLATANTIEGARTGARQLEVTINGIGERAGNASLEEFYISFPISLHNKPIPIQTF

SEQ ID NO: 193343 - protein, 189 aa, Glycine max
  Coding DNA Sequence Number=SeqID_76565
  Gene Ontology: Mol. function=RNA-directed DNA polymerase activity; Cellular component=chromatin; Biological process=chromatin assembly or disassembly
MPPTKAFPVAQEPDDPLPTQISFHAISGHMAPETLRVMGSISDQKVLILVDRGSTHNFIQERLVTMLGPYAQSTPPLHIMIGNDLTMKFKHHNKIIELHSERDYTICGINHYQLKGMVQIDGVNAFFHIDRMNPKLPSNQQTQPLTQDPTIISLLHRYHILFQPPTTLPLPRNITHTINLLPNSLPINV

SEQ ID NO: 193344 - protein, 72 aa, Glycine max
  Coding DNA Sequence Number=SeqID_76566
MVQLATILVRGAGINLTRSGSIREVRVESWAILGKSKIVESTTRKKCFMVIRINTSFGSRKRKDFVCATWMP

SEQ ID NO: 193345 - protein, 171 aa, Glycine max
  Coding DNA Sequence Number=SeqID_76567
  Gene Ontology: Mol. function=hydrolase activity, acting on glycosyl bonds; Cellular component=vacuole; Biological process=cell wall catabolic process
  Homolog annotation: Hit_ID=Q9SDY6; Match level="QueryCoverage=99%, HitCoverage=53%, E-value=3e-78, Identity=76%"; Hit description =Chitinase class I
  Pfam annotation: Domain name=Glyco_hydro_19; Domain location=1-165; Score=303.1; E_value=5e-88; Accession=PF00182.9; Description =Chitinase class I
GWASAPDGPYAWGYCFINERNQADYCTSGTRWPCAPGKKYYGRGPIQLTHNYNYGLAGEQLNLNLLNDPDLVSRDPIVAFRTAIWFWMTAQGNKPSSHSVIIGTWNPSSADWQAGRVPGYGVITNIINGGLECGRGPDSRVQSRIGFYERYCQIFGVSPGNNLDCNNQRPF

SEQ ID NO: 193346 - protein, 67 aa, Glycine max
  Coding DNA Sequence Number=SeqID_76568
MGGGLPAMVEREKFDHIEERLRVIEGGENYAFVDMAELCQVPDVVIPLKFKVTDFDKYKGTTCPKIT

SEQ ID NO: 193347 - protein, 242 aa, Glycine max
  Coding DNA Sequence Number=SeqID_76569
  Gene Ontology: Mol. function=protein binding; Cellular component =membrane; Biological process=defense response
  Homolog annotation: Hit_ID=Q2YE87; Match level="QueryCoverage=98%, HitCoverage=18%, E-value=7e-52, Identity=50%"; Hit description=NBS -LRR type disease resistance protein Rps1-k-2
MAEAVGGAFLSAFLDVVFDKLSTDEVVDFIRGKKLDLNLLENLKTTLRVVGAVLDDAEKKQIKLSSVNQWLIEVKDALYEADDLLDEISTKSATQKKVSKVLSRFTDRKMASKLEKIVDKLDKVLGGMKGLPLQVMAGEMNESWNTQPTTSLEDGYGMYGRDTDKEGIMKLLLSDDSSDGVLVSVIAIVGMGGVGKTTLARSVFNNDNLKQMFDLNAWVCVSDQFDIVKVTKTMIEQITQES

SEQ ID NO: 193348 - protein, 52 aa, Glycine max
  Coding DNA Sequence Number=SeqID_76570
MGTARISAQAKKCKMKMETDSLQHPWPQKEVQPTVLSGNSNKCNHRQDFSPE

SEQ ID NO: 193349 - protein, 126 aa, Glycine max
  Coding DNA Sequence Number=SeqID_76571
MPLLELSHQPPHFQKHVPAIPTPPYFHHPSTRCLLTTPRSPPKLQMEGWGSKYKETSALISSYIVIVPGLEKKGNEKGRLKPLAFFSTVEGDCLFQFSTASFVIGLWNGINASGLRIALSLEFCLV

SEQ ID NO: 193350 - protein, 229 aa, Glycine max
  Coding DNA Sequence Number=SeqID_76572
MEIDQKNVALDMHRNVLVDLVTLEFIAIANNDARYPGPLVDQALKREMSLWEVLDGDEGWFARKNKGRVPKGQGISCVYARQQGSRGDEPGKPPELALEVARLVPRGESQRKLGVMRHPLKPSQCRAIHVEGGDGQSFMVRSRVIVKKLGDLKDPTHGVSVVEARGRLIRLQLCHAVEKVVDLCRHVDLGGGESSNVVFDLVHVGLRASSEPEPFLRTRGLRSPPEMGE

SEQ ID NO: 193351 - protein, 254 aa, Glycine max
  Coding DNA Sequence Number=SeqID_76573
  Gene Ontology: Mol. function=RNA-directed DNA polymerase activity; Cellular component=chromatin; Biological process=chromatin assembly or disassembly
MGEMVLELNSGTLGEYESVLAIEVYRLPFQFDLPPEMVYKSVWTVLSEIGLEANTDSRCMSRSSTASKLEVLVMYCGILGGFLPKVTSNDERLVPEWHEAESANEEWVTIRDDATRHAMVLGPEMKSMNKYSQGVDGTGYDVGLDLTVFWRTRNSEFAANSFFNSSRKASMIDEDDEAVAQQILMPLLNPHGDGGEFLNIASVSTTNGMVKLGRVRTSALLMASLRVWKARSASSGHLNFSCVKRFINGTAMAA

SEQ ID NO: 193352 - protein, 268 aa, Glycine max
  Coding DNA Sequence Number=SeqID_76574
  Gene Ontology: Mol. function=chromatin binding; Cellular component =chromatin; Biological process=chromatin assembly or disassembly
  Homolog annotation: Hit_ID=Q1SAV4; Match level="QueryCoverage=82%, HitCoverage=56%, E-value=4e-62, Identity=52%"; Hit description =Integrase, catalytic region
  Pfam annotation: Domain name=Chromo; Domain location=173-221; Score =16.3; E_value=0.012; Accession=PF00385.14; Description='chromo' (CHRromatin Organisation MOdifier
MWAEWSYNTSCHSGTNLSSFEVTFGKKPPNIPQYITSTSNFEAVDDLLIHRESVFASLCKKLLKAQIHMKKVADGHKKDKEFQIGDWVMVKLRPHRQASATSQSHSKLSKRFYRPFQVEDRIGRVAYKLQLLEHSRIHPMFHCSILIPFHPSSSMIPKPVALPTSAMDNQLEICPLAFLETRWDSTPSGPKQQVLVQWVGLALEDTSWEDWSDLRATYHLENKVLPDAHGNVMAKAKEMQVEENGPEEITNDKPKRKHCPPSYLKDYE

SEQ ID NO: 193353 - protein, 709 aa, Glycine max
  Coding DNA Sequence Number=SeqID_76575
  Gene Ontology: Mol. function=nucleic acid binding
  Homolog annotation: Hit_ID=Q9ZUM0; Match level="QueryCoverage=88%, HitCoverage=85%, E-value=3e-84, Identity=37%"; Hit description =Expressed protein
  Pfam annotation: Domain name=zf-CCCH; Domain location=113-138; Score =23.6; E_value=0.00072; Accession=PF00642.15; Description=Zinc finger C-x8-C-x5-C-x3-H type (and similar)
  Pfam annotation: Domain name=zf-CCCH; Domain location=53-77; Score =9.0; E_value=0.085; Accession=PF00642.15; Description=Zinc finger C -x8-C-x5-C-x3-H type (and similar)
  Pfam module annotation: Pfam domain module=zf-CCCH::zf-CCCH; Domain location=113-138::53-77
MAVQIQYFTVMLCFFGAVQIKYFTVVPCFFVAVQIKYFTGNECEYRHSEYARVNPRDCRYWLSGNCLNPKCPFRHPPLDGLLGTQAAVTGGPSVSPSQIPTASATHAPYNSSKQAVPCFFFQKGLCLKGDRCAFLHGPPTPTSSTGNKVAAQVPVTSQGVENPCFKKPFVSNEKYTQERKTSQGNVAKSSGISEAKPASKIETAPQRNMFEWEKKVPPPAVGFDNEVSRFKTTSPPVTNGPTVARPNRLHQARVPDDHNFQSGKDSDEFLRESSPGFDVLVADELRNSDYYHGEDEFSKARGQDERNLDSLNEYDLGHSGDYSLAADIDRERFRVPQGYESYDHLQEPYAWEQHRKPSAHVDRRTRRRSNSPENAEVSDLRHHLSKRRKGNGLKSVVGHDYAHEGHGEEQSRRPFSRKDSLELPLNESFLGNRFRGRIKLPANGGADHLEREDRGRFRNRLSSGRLPATHHLSPGEGRVHDRIRGRLQDDERRNSKDRLMGRELPGDRSDFAGPKSLSELKNGRNTENREQQSLGRRRSLRDDRPQSEDDFLFEGPKPLSEILKEKRGAGADADSGNGKSSDNKNQEVTNGQNPTPAANTQNGVLSETKEDVKNLPPNNEESSKLEVTDAAGGDNDGEYEEGMVYDEAGEDQYYEGDDQRDADYEYEQGEGDEGYYEYEQGEEGENQEEDYMEEEDGDDFAKKIGVVHS

SEQ ID NO: 193354 - protein, 67 aa, Glycine max
  Coding DNA Sequence Number=SeqID_76576
  Homolog annotation: Hit_ID=Q2HVJ8; Match level="QueryCoverage=79%, HitCoverage=11%, E-value=1e-12, Identity=68%"; Hit description =Nuclear protein SET
MKLAGPERERQLSDTDVQSAVWEVCGDSGALQLLVDLLHVNYETKSSLESLDADLSCLNKLDWLWQE

SEQ ID NO: 193355 - protein, 102 aa, Glycine max
  Coding DNA Sequence Number=SeqID_76577
  Gene Ontology: Cellular component=integral to membrane
  Homolog annotation: Hit_ID=Q402F3; Match level="QueryCoverage=99%, HitCoverage=31%, E-value=3e-43, Identity=86%"; Hit description =Tobamovirus multiplication 3
  Pfam annotation: Domain name=DUF1084; Domain location=1-102; Score= -2.6; E_value=1.1e-09; Accession=PF06454.2; Description=Protein of unknown function (DUF1084)
MLQRFPVESKGRRKKLQEVGYVTTICFSCFLIRCVMMCFNAFDKAADLDVLDHPILNFIYYLVYWVYMVNLAFVEILPSTLVLFILRKLPPKRGITQYHPIR

SEQ ID NO: 193356 - protein, 90 aa, Glycine max
  Coding DNA Sequence Number=SeqID_76578
  Pfam annotation: Domain name=GRP; Domain location=1-79; Score=-13.1; E_value=0.0016; Accession=PF07172.2; Description=Glycine rich protein family
MISIMITVVVINMSVDVTVNSNDSDNHVDGDDSGHGSYYHGGGDDGDNHDDSCNRKEGHDSGGGDNDNDNHGGGYNGGHGGDNDSYGDDK

SEQ ID NO: 193357 - protein, 39 aa, Glycine max
  Coding DNA Sequence Number=SeqID_76579
MDTVEIHADLIFQGGPGGGPDFGRGSDGYGTPISPNIPS

SEQ ID NO: 193358 - protein, 261 aa, Glycine max
  Coding DNA Sequence Number=SeqID_76580
  Gene Ontology: Mol. function=nucleic acid binding; Biological process= DNA integration
  Homolog annotation: Hit_ID=Q1T010; Match level="QueryCoverage=65%, HitCoverage=12%, E-value=1e-36, Identity=44%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKLSTNGGNVPAQLLVLDGKNWERWHIQMKALFEFQDVMEVVKNGVAAEPTEPATEAVRNAYKDSKKKDAKEIFFLHQSVDDANFNLISKATLAKQAWDKLEKCYAGGDRIKKVKLQVLQRQFDSMTMEENEKIADFFARVKVVTNQMATQGETLTDGKICEKITRSLLEKYDYIVCAIEESKEVSEMSLEELQSSLEARELRLLERNKKKIAEQALLAQSSNKNSGDSNRGRSGFRGRGRGRNNRGRSGYVSSSGRGQNN

SEQ ID NO: 193359 - protein, 155 aa, Glycine max
  Coding DNA Sequence Number=SeqID_76581
IMVRTRGLGHALGHVTSRVHDESVLPAPDVEADVFSDDPMAPADVKDTGEDIPTDTGAQATNDEHEGFSGGPGDPSVLTQYADHIACSERPELKLSSHGRKVHSLGRPVLAIEGVVAGIGLSPLIACDDHARQRLITSAFARGWQLARLSTLARG

SEQ ID NO: 193360 - protein, 401 aa, Glycine max
  Coding DNA Sequence Number=SeqID_76582
  Homolog annotation: Hit_ID=Q9ZUM1; Match level="QueryCoverage=96%, HitCoverage=86%, E-value=4e-84, Identity=48%"; Hit description =Expressed protein
  Pfam annotation: Domain name=Remorin_C; Domain location=336-395; Score=5.3; E_value=0.00062; Accession=PF03763.4; Description=Remorin, C-terminal region
MDYERIQKPQGVGGFSPGKLRSMLLGVEKKRKEEEELDSTLTTRSQNSDMDESASSIEAVGGDRFVKANAAVNSRNRVLEDPSSDYDSGHDNMSMSSSMFEFQKAERAPQRVPVGPFSKPAPSKWDDAQKWIASPTSNRPKTAQTQGQGGHAGPRKAGSLGYGSRQSSMKVVVEVPDQKEIALDEPDTKKIDTNQTKMDSGGQKFVSWEADPYAIASFCARSVSMRDMGTEMTPIASQEPSRTGTPVRATTPMRSPNSSRPSTPPRASPASTLTDLHSDNLNLNMNELSEKELQMKTRREIMVLGTQLGKMNIAAWASKEEEDKDASTSLKTKAELPKSVVEARAAAWEEAEKAKYMARFRREEMKIQAWENHQKAKTEAKMRKIENLSQPNNGNTMSAWR

SEQ ID NO: 193361 - protein, 94 aa, Glycine max
  Coding DNA Sequence Number=SeqID_76583
MDPEKSNRVLGFPALITGLCQFYGVPVAPIKVIKPPINWAFIKKYYAPWAGAGRDTIAAWGWPAAGNRCIAATSRAPQFIYKGWRVAYNPWPTS

SEQ ID NO: 193362 - protein, 181 aa, Glycine max
  Coding DNA Sequence Number=SeqID_76584
MHIQGIFAYLWLWTWSPASRPRVVGNSPTFVDELRGSGGCGDASIARCRPSPGCYGVSPCACPGGVVLLDESPVNRGLDDLDGGDGHSVELTKARNQSWKPQDPIGLLWVHWMSCRRDPGGDQHYGHLVKSCPDMHSSCTIASLSGCARTVGRPPISGGGPGTGKIKLLAANPGALASIKH

SEQ ID NO: 193363 - protein, 79 aa, Glycine max
  Coding DNA Sequence Number=SeqID_76585
NRTKKELTAGAGMSQEFSSTVLRKGIDSPIPTEENRPFDRETRKLRSLGFNQAADIGTSYSPTPGNYIEPRIVEDHRTF

SEQ ID NO: 193364 - protein, 240 aa, Glycine max
  Coding DNA Sequence Number=SeqID_76586
  Gene Ontology: Mol. function=binding; Cellular component =mitochondrion; Biological process=metabolic process
  Homolog annotation: Hit_ID=Q2QXL4; Match level="QueryCoverage=55%, HitCoverage=72%, E-value=4e-16, Identity=37%"; Hit description=Rf1 protein, mitochondrial, putative, expressed
  Pfam annotation: Domain name=PPR; Domain location=150-184; Score =43.6; E_value=6.9e-10; Accession=PF01535.11; Description=PPR repeat
  Pfam annotation: Domain name=PPR; Domain location=185-219; Score =50.9; E_value=4.3e-12; Accession=PF01535.11; Description=PPR repeat
  Pfam module annotation: Pfam domain module=PPR::PPR; Domain location =150-184::185-219
  Subcellular localization annotation: CTP_CleavageSite=73; ConfidenceScore=5.92e-01
MLLFARNIGSRASLRVSSFHSSPLQNPFPLFFTPSSLSSQNSIFARPMIWFASFLCVMRYPFVSKPSFDDIASESMRSFLQQDRPHLFDSALVPIWVSKDLLNLKGDPKSALKFFKEAGARAGLSKSSKGELALSLFKDMVVAGLSPSVFTYNIVIGCLAREGGIETARSLFEEMKALGLRPDIVTYNPLIYGYGKVGMLTGAVTVFEEMKDAGCEPDVITYNSLINLKEFLKLLSICMR

SEQ ID NO: 193365 - protein, 339 aa, Glycine max
  Coding DNA Sequence Number=SeqID_76587
  Homolog annotation: Hit_ID=Q1SB92; Match level="QueryCoverage=49%, HitCoverage=86%, E-value=2e-39, Identity=58%"; Hit description =Carbamoyl-phosphate synthase L chain, ATP-binding
MGARVPVQHYNLNSPSSFIESPLHVLNAVDARTAASAIDNPNDDSASAVDCMNESHRSCLPLHSVEVDEDRASLDTNESSRTTSYDILTAEDISPIESARARFLQIIVDHFIDDRVIEVPDSEADYTGQDKMSKRRTREIQYEGDPNFTLPLMYVANMYESLVSDVNNRLASLNGIREKTIGVALEAAGGLYRRLAKKFPKKGPCTFKRRELATSMETRTRFPELVIQEEKRVRFVVVNGLRIVEKPNNMPIDDAEWFKRLTGRSEVAISASDYKFYSPRHKYRRGASISLSNIQDIPSYPGAENSTALATPQGFHSKSSIQSQRIGKNSLNTAKILHN

SEQ ID NO: 193366 - protein, 298 aa, Glycine max
  Coding DNA Sequence Number=SeqID_76588
  Gene Ontology: Mol. function=oxidoreductase activity; Cellular component=phragmoplast; Biological process=metabolic process
  Homolog annotation: Hit_ID=Q012U0; Match level="QueryCoverage=68%, HitCoverage=45%, E-value=1e-41, Identity=39%"; Hit description=[J] KOG2335 tRNA-dihydrouridine synthase
  Pfam annotation: Domain name=Dus; Domain location=1-207; Score=-73.7; E_value=5.5e-05; Accession=PF01207.8; Description=Dihydrouridine synthase (Dus)
MSAIAASTNVPVSVKCRIGVDDHDSYNELCKVSSLSPTKHFIIHSRKALLNGISPAENRSIPPLKYEYFYGLLRDFPDLRFTINGGITSVDEVSAAREAGAHGVMVGRAAYNNPWQILGHVDAAIYGTPSCDLTRRQVLERYLVYGDSVLGKYGHRPTLRDIVKPLLHLFHSEPGNGLWKRKADAAFKNCTKSMSFILYNVLDEAINRLQDIKTFCSSSKAYICILFIFTVLFHDFYLINGIGKTMESFFEETLVAIPDSVLDSPVAEPPPGRDLFANMHNLLPAPYRTREATVIICA

SEQ ID NO: 193367 - protein, 47 aa, Glycine max
  Coding DNA Sequence Number=SeqID_76589
MSSRSSLHEAKYMRPYQEHKAPQLPSNWFTIGRNMGGNYLRLTYLLS

SEQ ID NO: 193368 - protein, 79 aa, Glycine max
  Coding DNA Sequence Number=SeqID_76590
  Gene Ontology: Mol. function=DNA binding
  Homolog annotation: Hit_ID=Q1S4R0; Match level="QueryCoverage=96%, HitCoverage=26%, E-value=1e-09, Identity=35%"; Hit description=Myb, DNA-binding; Tetratricopeptide-like helical
  Pfam annotation: Domain name=PPR; Domain location=22-56; Score=31.6; E_value=2.7e-06; Accession=PF01535.11; Description=PPR repeat
DLNEAFKLESEMQQAGVNLNIVTYTALLDGLCEDGRMREAEELFGALLKAEWTLNQQIYTSLFHGYIKAKMMEKAMDIL

SEQ ID NO: 193369 - protein, 547 aa, Glycine max
  Coding DNA Sequence Number=SeqID_76591
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=5e-54, Identity=30%"; Hit description= UPI00006A17C9 related cluster
AARPHLQRTTCPRHQRVARPHLQRTTRPHLQITARLHLQRTERPRHQRNTRPHLQRAARPHLQRTTRPLPAEGCTLSPSEDYTGLHVLTIRGLHALTFRGLHVLAIRGLHALIFRGLHVLTIRGSHALIFRGLHVLTFRELQFFTIRGLHVLAIRGLHVLTIRRLHALTFRGLHALTFRGLHVLTIRGLHALTFRGLHVLDIRGLHALTFRGLHVLAIRGLHALTFRGLHVLAIRGLHALTFRGLHDLTFRGLHVLAIRGLHTLTFRGLHRTTCPRLRGLHAIIFRGLHVLTIKGMQALTSRGLDIHVLRALHVFAIGGLHASTFRGQHVLAIKGLHALTFRGLHVLAIRGLHILTIRGLYSLTFRGLHVLAIRGLHALIFRGLHVLAIRGLHALTFRGLDILAFRGLHVLAIRGLHALTFRGLHVLASRGLHALTFRGLHVFTIKGMHALTLRGCTSLLSEGCTLSPSEDYTSSPLEDYTSSPSEGCTPSPSEDYTSSPSEGLHVFTIRGLHVLPFRGLHVLTIRGQYSLTCRGLHALPIRGLHAL

SEQ ID NO: 193370 - protein, 68 aa, Glycine max
  Coding DNA Sequence Number=SeqID_76592
MVASLMLFRAPPLVALLGFLCVRKEERNRMCFPKSCSSYGGYKRNHYPFIYWLCSSQASNRAFVATNN

SEQ ID NO: 193371 - protein, 574 aa, Glycine max
  Coding DNA Sequence Number=SeqID_76593
  Gene Ontology: Mol. function=binding; Cellular component =intracellular; Biological process=metabolic process
  Homolog annotation: Hit_ID=Q1SQK8; Match level="QueryCoverage=96%, HitCoverage=96%, E-value=2e-88, Identity=28%"; Hit description =Tetratricopeptide-like helical
  Pfam annotation: Domain name=PPR; Domain location=165-199; Score =22.4; E_value=0.0016; Accession=PF01535.11; Description=PPR repeat
  Pfam annotation: Domain name=PPR; Domain location=267-301; Score =39.6; E_value=1.1e-08; Accession=PF01535.11; Description=PPR repeat
  Pfam annotation: Domain name=PPR; Domain location=302-336; Score=7.8; E_value=0.9; Accession=PF01535.11; Description=PPR repeat
  Pfam annotation: Domain name=PPR; Domain location=338-372; Score=3.8; E_value=2.6; Accession=PF01535.11; Description=PPR repeat
  Pfam annotation: Domain name=PPR; Domain location=35-69; Score=5.0; E_ value=1.9; Accession=PF01535.11; Description=PPR repeat
  Pfam annotation: Domain name=PPR; Domain location=404-438; Score =13.3; E_value=0.2; Accession=PF01535.11; Description=PPR repeat
  Pfam module annotation: Pfam domain module=PPR::PPR::PPR::PPR::PPR::PP R; Domain location=165-199::267-301::302-336::338-372::35-69::404-438
MVQCDENDDEATMSMSMDPRVRHARAITSHAKDRAVWNNLITHYSKSNLSSYAVSLFHRLPFPPNVVSWTALISAHSNTLLSLRHFLAMLRHNTLPNHRTLASLFATCAALTAVSFALSLHSLALKLALAHHPFPASSLLSVYAKLRMPHNARKVFDEIPQPDNVCFSALVVALAQNSRSVDALSVFSDMRCRGFASTVHGVSGGLRAAAQLAALEQCRMMHAHAIIAGLDSNVVVGSAVVDGYGKAGVVDDARRVFEDSLDDMNIAGWNAMMAGYAQHGDYQSAFELFESLEGFGLVPDEYTFLAILTALCNAGMFLEIYRWFTRMRVDYGLEPSLEHYTCLVGAMARAGELERAERVVLTMPFEPDAAVWRALLSVCAYRGEADKAWCMAKRVLELEPHDDYAYVSVANVLSSAGRWDDVAELRKMMKDRRVKKKGGRSWIEVQGEVHVFVAGDWKHERSKEIYQKLAELMGDIEKLGYVPVWDEVLHNVGEEKRKESLWYHSEKLAVAFGVLCGSAPPGKPLRIVKNLRICKDCHEAFKYMTRVLEREIIVRDVNRYHRFVNGNCTCRDIW

SEQ ID NO: 193372 - protein, 237 aa, Glycine max
  Coding DNA Sequence Number=SeqID_76594
EIPISHYTSGRGKDEGKAPPDATTLVEVNKEKEYGSNWNPFTWASDEDTFMQQPRATGGPVIKGGLNSGRRKFVKGRKQDGGLQWVASPAEGVWRNNGKEIIIVNSYAPCDRMARRRVWEELKARKDENVGEREELNNFLADMRLEDMSLVGRKFTWYRSNGGAKRRKPFKVFDCGFSDTRFSKFVEDTWRDLKFEVVERFQEELNRVRVVFEEEDTWRWRVKSTYLALHGRDFANE

SEQ ID NO: 193373 - protein, 81 aa, Glycine max
  Coding DNA Sequence Number=SeqID_76595
  Gene Ontology: Mol. function=calcium ion binding; Cellular component =flagellin-based flagellum; Biological process=ciliary or flagellar motility
  Homolog annotation: Hit_ID=P94092; Match level="QueryCoverage=89%, HitCoverage=91%, E-value=6e-19, Identity=63%"; Hit description =Polcalcin Cyn d 7
  Pfam annotation: Domain name=efhand; Domain location=42-70; Score =23.9; E_value=0.00058; Accession=PF00036.22; Description=EF hand
  Pfam annotation: Domain name=efhand; Domain location=7-35; Score =35.7; E_value=1.7e-07; Accession=PF00036.22; Description=EF hand
  Pfam module annotation: Pfam domain module=efhand::efhand; Domain location=42-70::7-35
MGSEREECERVFKRFDVNGDGNISLSEFADALKVLGLTSQEEVERRMAEIDKDGDGHITLNELIEFHTANPSLMKDVLKKL

SEQ ID NO: 193374 - protein, 346 aa, Glycine max
  Coding DNA Sequence Number=SeqID_76596
  Gene Ontology: Mol. function=oxidoreductase activity; Cellular component=proton-transporting two-sector ATPase complex; Biological process=flavonoid biosynthetic process
  Homolog annotation: Hit_ID=Q39224; Match level="QueryCoverage=94%, HitCoverage=97%, E-value=3e-67, Identity=39%"; Hit description=SRG1 protein
  Pfam annotation: Domain name=2OG-FeII_Oxy; Domain location=206-289; Score=85.9; E_value=1.2e-22; Accession=PF03171.10; Description=2OG -Fe(II) oxygenase superfamily
MASSQQVSVFGSSRSVLGVMDMPKKPEMGIPEMYIRPQEPTIRSNETTLPTIPVFDFKASLHENAIDDAELDKLFTACKDWGFFQVVNHGVSSQLLEKLKLEIEKFFKLPIEEKKKYQIRPGDVQGYGTVIRCKDQKLDWGDRFYMVINPLERRKPHLLPELPASLRDTLESYFRELRKLGMELLGLLGRAISMEIKEVMEISDDGMQSVRLTYYPPCPKPELVVNGVEGLEIKKGGVWIPVTFLPDAFVVNVGDIMEILSNGAYTSIEHRAAVNKEKERISIAMFFNPKFEAEIGPVKSFINSENPPLFKSMLMEDYFKDFFSRNLNGKSHLEKMRVTSFDLIKD

SEQ ID NO: 193375 - protein, 125 aa, Glycine max
  Coding DNA Sequence Number=SeqID_76597
  Homolog annotation: Hit_ID=Q1RX12; Match level="QueryCoverage=57%, HitCoverage=8%, E-value=1e-23, Identity=67%"; Hit description=Zinc finger, RING-type; Transcription factor jumonji, jmjC; Cupin region; Zinc finger, FYVE/PHD-type
MCHVWSTIDTCKSKCTRAALKKLNLVEDRSIPRDKLISFLRISVDLQYKDLRQFQWHWEKGEPVIVSNVLECTSGLSWESLVMWRALRHVTNTKHGQHLAEKTIDCLDWTESHQNRMSLKYFVKY

SEQ ID NO: 193376 - protein, 2646 aa, Glycine max
  Coding DNA Sequence Number=SeqID_76598
  Homolog annotation: Hit_ID=Q1T1K8; Match level="QueryCoverage=17%, HitCoverage=24%, E-value=1e-137, Identity=55%"; Hit description =Integrase, catalytic region; Zinc finger, CCHC-type
  Pfam annotation: Domain name=NSF; Domain location=1555-1566; Score =11.0; E_value=4.5; Accession=PF02071.10; Description=Aromatic-di -Alanine (AdAR) repeat
  Pfam annotation: Domain name=NSF; Domain location=1611-1628; Score =1.9; E_value=1.4e+02; Accession=PF02071.10; Description=Aromatic-di -Alanine (AdAR) repeat
  Pfam annotation: Domain name=NSF; Domain location=1647-1657; Score =1.0; E_value=1.9e+02; Accession=PF02071.10; Description=Aromatic-di -Alanine (AdAR) repeat
  Pfam annotation: Domain name=NSF; Domain location=2544-2555; Score =4.6; E_value=55; Accession=PF02071.10; Description=Aromatic-di -Alanine (AdAR) repeat
  Pfam annotation: Domain name=UvrD-helicase; Domain location=929-1576; Score=-214.8; E_value=0.016; Accession=PF00580.11; Description =UvrDREP helicase
  Pfam module annotation: Pfam domain module=NSF::NSF::NSF::NSF::UvrD -helicase; Domain location=1555-1566::1611-1628::1647-1657::2544 -2555::929-1576
MSTFKVAASKNIDVNEEGQKSLFIVFLTNIIPDRRIWSALHMPGNSMLIKKILCAGGVVEESCEYFSLQPDYVKDDRTYQRLSSELNGSQYEAIWACLSSIQCCHKSTVDLIWGPPGTGKTKTLGTLLYALLKMNHRTLVCAPTNVAVKEVASRVLSMVRESFDRNSEALFCALGDMVLFGNHERLKVGADIEDIYLDYRVKHLMMCFAPLTGWRCCFSSMIDLLENCVSHYHIFIENELRKDQEQVSDNNFNKTKDNSTSHCSETEKVHKTFLEFVRERFLSVAVQLRDCISVLCTHVARSYILDHNFEDLVCLIHKVSSFEALLFQSNIVSEVLEKLFSPPEHLHNSCESSVGVEYLLYKSRTDCLSSLRTLKGSLDELSLPNSMNKESIREFCLQTSSLIFSTASSSFKLHSVVMEPLKVLVIDEAAQLKECESIIPLLLPNVEHAVLVGDECQLPAMVASNVSHKVGFGRSLFARLSSLGHPNHFLNIQYRMHPAISSFPNSHFYFNQILDAPNVVRKNYRKQYLPGPMFGPYSFINVVGGIEEFDDAGRSRKNMVEVAIVMKIIKNCFKAWCDSKENLSIGVVSPYAAQVVAIQDLLGQRYDTHDGFDVKVKTIDGFQGGERDIIILSTVRTNHSTSLQFISNHQRTNVALTRARYCLWVLGNERTLTNEENVWKSLVLDAKKRRCFFNADEDKELAKSIWDTKKELDQLDDLLNPDSFLFKKSRWKVLFSDNFLKSFKKLRSKQTKKLVLDLLLKLSTGWRPKRMKVDLLCGNSSQILKQFKVESLFVVCSTDIVKESMYTQVLKIWDIMPLEDVPKLVKRLDNIFGSYTDEFISCCSEKCLEGNMVVPISWERSTEITKFKTLDNNGNEAELSGCDQRIYVENSKVEESLLLMKFYSLSSVVISHLLSDRISDEFDLPFEVSDEEYDIILFPKSTFVLGRSGTGKTTVLTVKLFQKEYKHHMAVEETYGINSAAVPCLNHDKEYKKSSTTNDRPVLHQLFVTVSPKLCQAVKHHVVRLKRFVCGGNIAAESNSIEEDIVDVDTSIQFKNTPDSFMNLPIDSYPLVITFQKFLMMLDGTVGISYFERFSDLSSDGKNLSARSVALETFIRKKEVTYGRFDSLYWPHFNYQYTKKLDSSRVFTEIISHIKGGMQAVESSDGKLSREEYLSLSENRASSLIRQKREIIYDIYQSYEKMKNDKGDFDLADIVIDLHRRLRINKYEGDEMHFVYIDEVQDLTMNQIALFKYVCQNVEEGFVFCGDTAQTIARGIDFRFQDIKSLFYKRFVLESKGNTHNQGKVKGKISETFLLSQNFRTHAGVLKLSQSTIELLFRFFPHSIDVLKPETSLIYGEGPVVLECGSRKNAIVTIFGNSGHVAGKIVGFGAEQVILVRDDSARKEVLDYVEKQALVLTILECKGLEFQDVLLYNFFGSSPLKNRWRVIYEYMKEQEMLEPTELKSYPNFSDSKHNLLCSELKQLYVAITRTRQRLWICENTEVYSRPMFDYWRKKGLVQFKELDDSLAQAMKVASSPEEWRSRGKKLYYQNNYEMATMCFERAGDSYWERKSKASGLRANANRLRDLNPEDSNAMLREAAEIFEGIGMAESAAQCFSDLGDYERAGKLYLEKCEEPDLKRAGDCFYLAGCYETAARVYAGGSFFSDCLNVCAKGGLFDIGLYYIQHWEKNENADHCMVDSHELFTIEQKFLENCARNYLDRKDTRSMMKFVKAFHSMDLKREFLRSLSLLDELLVLEEESGNFMEAANIAKMMGDVLHEVDLLGKASKFMEACELMLLYVLGNSLWSAGSKGWPIKPFAQKVELLNRALSFAKEELSSFYVIASTEAEILSNEHSNTFEILNHLKSSRTYGSIRGEIICLWKLLDAHFQLNSSKFVWLDNLLDDSVEGMLLENQFSVESLFHCWTCWKDNIVCVVESLPSLKSQDIHHHSSYGKFALNYLGVRKQTSNLNDIYILLIPEANWVMKLGDRFLKKNGRLVSVDVQDLVSAAESYWSSQLVSVGMKVLHILDALYKFSASKALSEFCQFRSLFLIYDVFKFLLKSKCFNLNHGNLKTLEKFSRTPIDRSLCYLVPLDWSKSLIKDMVYLRTTETCQDLVKDVIYENINRKDMLTYGQIGNVVVMILGTANLKSELFVKILARFKENPLWQEFIQSLHLNSAQKNSHVDEAVENFYKALQYTYSVNWTREIDYISPSCFMYLLDRLLLLTSHGKWKGFIFATKSSFVEWLIHQDENSFPNLSVMADVQSGGEHIHRFIFSVLRELLNDQNGTISWIRKSNLNVKNYFPLFLLRLIVSLCLLHLSSGKYLELLHNLLKKNHVLSQLPLEFRNVLQKGRNHLVLKVFAEAFKLIGNPLVVARFHNTSSEILCPDAVFVDLTICQRKFILEVLFPNRVDSVDEETAAVLEASDSTSKEFSSTNCSSFPNKSSPIVTAQTSDREIIGMSTNADSFWATMNNLWFAIDHKVLHNSTITKELLNIWIDGLSHGMHGSLSENPVNLDDKNEVEEVVNLLDEMKQLFSALATSGDGAIENHAQIGELCKRILSRRPKVGHVMNKLYLLSMENSNVGNESSQAKTAVANDEHGQNALEESKDNLSKNSEGATNSGHGNIKENTKGKKNKKKKGKGGRRDI

SEQ ID NO: 193377 - protein, 262 aa, Glycine max
  Coding DNA Sequence Number=SeqID_76599
  Gene Ontology: Mol. function=sugar porter activity; Cellular component=integral to membrane; Biological process=carbohydrate transport
  Homolog annotation: Hit_ID=Q1SDF6; Match level="QueryCoverage=84%, HitCoverage=53%, E-value=4e-82, Identity=71%"; Hit description=Sugar transporter superfamily; Major facilitator superfamily MFS_1
  Pfam annotation: Domain name=Sugar_tr; Domain location=1-236; Score= -142.7; E_value=0.021; Accession=PF00083.14; Description=Sugar (and other) transporter
MDRIKGGWGWRLSLGLGGLPALLLTLGAFLVVDTPNSLIERGHLEEGKSVLRKIRGIDNIEPEFLELLDASRVAKEVKHPFRNILKRRNRSQLVISIALQVFQQFTGINVISLIMFYAPILFNTLGFKNDASLYSAVITGAINVLSTVVSIYSVDRVEHCNGNEDEGPSRGALKGLCSAGGCDGLHLHGHGASWLVHPKFGIFFFFYGWILIMSTFVLFLFPETKNVPIEEMAERVWKQHWLWKRFIDEDDCVKEEKVVTGN

SEQ ID NO: 193378 - protein, 102 aa, Glycine max
  Coding DNA Sequence Number=SeqID_76600
  Subcellular localization annotation: CTP_CleavageSite=69; ConfidenceScore=5.14e-01
MQAWSTTVVVIGCATMSWLFEKRGWFAVSKSEKGRVVMAVSPPLAWKGVVVVAISSLSLSSPLVSVDVVAVMIAVVSSALALFAGAGEDGNRGQSWKRRKGR

SEQ ID NO: 193379 - protein, 83 aa, Glycine max
  Coding DNA Sequence Number=SeqID_76601
MKEARSYAKEGREGREREEREVPGSHWCYWRNAQSQSAPISLVLLAIPTQSALVSLLAMAVHMYIADGSGDTCLPPVGMAEST

SEQ ID NO: 193380 - protein, 54 aa, Glycine max
  Coding DNA Sequence Number=SeqID_76602
MPQESSQNSFFTSPSKRGLKGLVSINKEPSCTAATDESFNDNELAQRKAEEAGV

SEQ ID NO: 193381 - protein, 89 aa, Glycine max
  Coding DNA Sequence Number=SeqID_76603
MRETKANPKIGDKEWAVSFTGKKDDQASSSLEDEKKGEKRHHPLENKPWKEKLHHQESALDKKLREEASMEEENEREREEGGGMGIEGD

SEQ ID NO: 193382 - protein, 81 aa, Glycine max
  Coding DNA Sequence Number=SeqID_76604
MEQQKLKFLQNSKEEYTKVHIFRCAKQMFDTLAMTYKGTSQELIGTLKGPKQELQQDEDLRREKSLSLSSQKNKKEPLSRE

SEQ ID NO: 193383 - protein, 123 aa, Glycine max
  Coding DNA Sequence Number=SeqID_76605
  Gene Ontology: Mol. function=chitinase activity; Cellular component =vacuole; Biological process=cell wall catabolic process
  Homolog annotation: Hit_ID=O22318; Match level="QueryCoverage=80%, HitCoverage=81%, E-value=9e-33, Identity=60%"; Hit description =Ripening-associated protein
  Pfam annotation: Domain name=Chitin_bind_1; Domain location=23-62; Score=72.8; E_value=1.1e-18; Accession=PF00187.9; Description=Chitin recognition protein
MGNMKLCPLMLCLLLAFLLGAAAQNCGTQVGGVICPNGLCCSQYGWCGNTEAHCGRGCQSQCTPGSTPTPTTPSGGDISNTISRSQFEEMLKHRNDAACPGRNFYTYDAFIAAARSFNGFGTP

SEQ ID NO: 193384 - protein, 252 aa, Glycine max
  Coding DNA Sequence Number=SeqID_76606
  Homolog annotation: Hit_ID=Q1SDG1; Match level="QueryCoverage=34%, HitCoverage=10%, E-value=2e-12, Identity=34%"; Hit description =Integrase, catalytic region; Zinc finger, CCHC-type
MEDGFSTNKPPLFRGIKYDYWKEHMIAHLESIHTDLWDMVENGDYIQYEEEYTKVHNFKSAKKMWDTLAVTYKGTSWVKRNKLSLLTRPKREKSLALSSQKNKKASSSREQVLRSSSKALKVDDSSEEDSNEDELAFISRKICKMWRNKGGSKWKNSSRRMPKEKKRKRQKLHNLLRVQKAWTFQDLNNTSSNELDEEANICLMENVASQESESNQEAYKSLQKDFKNLSKDHLKLEKTLQDQVDVSLDESM

SEQ ID NO: 193385 - protein, 315 aa, Glycine max
  Coding DNA Sequence Number=SeqID_76607
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=94%, HitCoverage=53%, E-value=1e-101, Identity=66%"; Hit description=NADH- plastoquinone oxidoreductase subunit 2
  Pfam annotation: Domain name=Oxidored_q1; Domain location=1-295; Score=195.9; E_value=9.6e-56; Accession=PF00361.10; Description=NADH- Ubiquinoneplastoquinone (comple
MYGLMRLLRNIYSWVGASSSILVHGFSWLYGSSGGEIELQEIVNGLINTQMYNSPGILIALLFITVGIGFKLSPAPSHQWTPDVYEGVRVRNNESLYDKQIHFASSLLRVVPTKDRTNDKEVRNPLFDSDSPTPVVAFLSVTSKVAASASATRIFDIPFYFSSNEWHLLLEILAILSMILGNLIAITQTSMKRMLAYSSIGQIGYVIIGIIVGDSNGGYASMITYMLFYISMNLGTFACIVSFGLRTGTDNIRDYAGLYTKDPYLALSLALCLLSLGGLPPLSGFFGKLHLFWCGWQAGIYFLVSIGLLTSVVSI

SEQ ID NO: 193386 - protein, 82 aa, Glycine max
  Coding DNA Sequence Number=SeqID_76608
  Homolog annotation: Hit_ID=Q1SQK6; Match level="QueryCoverage=90%, HitCoverage=5%, E-value=2e-15, Identity=50%"; Hit description =Helicase, C-terminal; Argonaute and Dicer protein, PAZ; Type III restriction enzyme, res ...
  Homolog annotation: Hit description=subunit; Ribonuclease III, bacterial
MKKGGTRTTLYEVYLYLNPVRGCKGQNCFVSKTTLCIPNYGNIESKGEARSDKKTSFDSAAVQMLLEVQRLGKVGIDPLPSS

SEQ ID NO: 193387 - protein, 92 aa, Glycine max
  Coding DNA Sequence Number=SeqID_76609
MASRFPPGVSTIGLRILQARRGRKKEKKKERLTEERRRTEERKGKSGKAFKKAIRPGQAFKKAKLRPFKVWSGLAYSHPYLGITDAKLFWGR

SEQ ID NO: 193388 - protein, 1543 aa, Glycine max
  Coding DNA Sequence Number=SeqID_76610
  Gene Ontology: Mol. function=oxidoreductase activity, acting on the CH-NH2 group of donors, NAD or NADP as acceptor; Cellular component =membrane; Biological process=nitrogen compound metabolic process
  Homolog annotation: Hit_ID=Q93WZ7; Match level="QueryCoverage=98%, HitCoverage=69%, E-value=0.0, Identity=93%"; Hit description=NADH glutamate synthase precursor
  Pfam annotation: Domain name=GATase_2; Domain location=2-170; Score =282.2; E_value=1e-81; Accession=PF00310.11; Description=Glutamine amidotransferases class-II
  Pfam annotation: Domain name=GXGXG; Domain location=1074-1270; Score =370.5; E_value=2.7e-108; Accession=PF01493.9; Description=GXGXG motif
  Pfam annotation: Domain name=Glu_syn_central; Domain location=266 -559; Score=629.5; E_value=2.8e-186; Accession=PF04898.4; Description= Glutamate synthase central domain
  Pfam annotation: Domain name=Glu_synthase; Domain location=623-994; Score=844.3; E_value=6.4e-251; Accession=PF01645.7; Description =Conserved region in glutamate synthase
  Pfam module annotation: Pfam domain module=GATase_2::GXGXG::Glu_syn _central::Glu_synthase; Domain location=2-170::1074-1270::266 -559::623-994
MVELIHSRFSTNTFPSWDRAQPMRVLGHNGEINTLRGNVNWMKAREGLLKCKELGLSENELKKLLPIVDANSSDSGAFDGVLEFLLHSGKSLPEAVMMMIPEAWQNDKNMDSQRKAFYEYFSALMEPWDGPALISFTDGHYLGATLDRNGLRPGRFYVTHSGRVIMASEVGVVDIPPEDVCRKGRLNPGMMLLVDFVKHTVVNDDALKEQYSLARPYEDWLKRQKIELKDIVNSVHESERVPPPIAGVAPLSNDDADMENMGIHGLLVPLKAFGYTVESLEMLLLPMAKDGVEALGSMGNDTPLAVMSKREKLTFEYFKQMFAQVTNPPIDPIREKIVTSMQCMVGPEGDLTEITEEQCHRLSLKGPLLSTEEMEAIKKMNYRGWRSKVIDITYSKECGKRGLDEALDRMCAEAHDAINEGYTTLVLSDRAFSKKRISVSSLLAVGAVHQHLVKTLERTRVALIVESAEPRKVHHFCTLVGFGADAICPYLAIDAIWRLQVDGKIPPKASGEFHSKDELVKKYFKASNYGMMKVLAKMGISTLASYKGAQIFEALGLSSEVIEKCFAGTPSRVEGATFEMLACDAFQLHELAFPSWVFSPGSAEALALPNPGDYHWRKGGEVHLNDPLAMAKLQEAARTNSVDAYKQYSKLIHELNKACNLRGLLKFKETAVKIPIDEVEPASEIVKRFCTGAMSYGSISLEAHTALAMAMNKIGGKSNTGEGGEQPSRMEPLPDGSMNPKRSAIKQVASGRFGVSSYYLTNADELQIKMAQGAKPGEGGELPGHKVIGDIAVTRNSTSGVGLISPPPHHDIYSIEDLAQLIHDLKNANPAARISVKLVSEAGVGIIASGVVKGHADHVLISGHDGGTGASRWTGIKNAGLPWELGLAETHQTLVANDLRGRTVLQTDGQLKTGRDVAIATLLGAEEFGFSTAPLITLGCIMMRKCHKNTCPVGIATQDPVLREKFAGEPEHVINFFFMVAEEMREIMSQLGFRRVNEMVGRSDMLEVDKEVVKSNEKLENIDLSLLLRPAAELRPEASQYCVQKQDHGLDMALDNKLISLSSAALEKGLPVYIETPIYNVNRAVGTMLSHEVTKLYHLAGLPNDTIHIRFTGSAGQSFGAFLCPGITLELEGDSNDYVGKGLSGGKIVVYPPKESNFDPKENIVIGNVALYGATRGEAYFNGMAAERFCVRNSGAKAVVEGVGDHGCEYMTGGTVVVLGKTGRNFAAGMSGGIAYVLDVDGKFQSRCNLELVDLDKVEEEEDILTLRMLIQQHQRHTNSRLAKEVLDDFENLLPKFIKVFPREYKRVLASMKSEETSKDAVVHAAKHEQDDEAQAVEKDAFEELKKLATASLNEKPSQAESPKRPSQVTGAIKHRGFVSYEREGVQYRDPNVRMTDWKEVMEETKPGPLLKTQSARCMDCGTPFCHQENSGCPLGNKIPEFNELVYQNRWHEALERLLETNNFPEFTGRVCPAPCEGSCVLGIIENPVSIKSIECAIIDKAFEEGWMVPRPPVQRTGKRVAIVGSGPSGLAAADQLNKMGHT

SEQ ID NO: 193389 - protein, 189 aa, Glycine max
  Coding DNA Sequence Number=SeqID_76611
  Gene Ontology: Mol. function=nucleic acid binding; Biological process= DNA integration
  Homolog annotation: Hit_ID=Q0KIN0; Match level="QueryCoverage=90%, HitCoverage=10%, E-value=7e-26, Identity=42%"; Hit description =Integrase core domain containing protein
MQQGFNLDKYRIGSTRNPERSSHEYTRSRNRMTSLPEMEDKSGVDATRQSRFLAVPLGLHPFPLALGRGLLYEGKGNAKIICFTLMLIRQTHHQPRRNLIPWGSKKQNIVTRSSAEAEYRAMPATTSEITWLRKLLQQFQFGDTQATNLICDNQAVLHIVSNPVFHEWTKHSRRLSFCERESALRKNHH

SEQ ID NO: 193390 - protein, 60 aa, Glycine max
  Coding DNA Sequence Number=SeqID_76612
MSMDSSSHNSYRDLGNSNLNQKVILRTDMYLRTYLSGASEGFNDSLQTKSKVVARWIVVK

SEQ ID NO: 193391 - protein, 217 aa, Glycine max
  Coding DNA Sequence Number=SeqID_76613
  Homolog annotation: Hit_ID=Q93WZ7; Match level="QueryCoverage=53%, HitCoverage=5%, E-value=7e-34, Identity=68%"; Hit description=NADH glutamate synthase precursor
PGRCVVHREEEVSGNPVPTDRVGPNPVTSIVSVAEAEGGGAVGILGRAGEATGAARAAAKRCVAGWVGFGLVFGGCGDGRAGNVGADDAQRCMRMRSQHWRWCRYSCGPASCLLPGGTKTIVGCCWVYTVKVGPDGNIDRFKACRVAKGYTQIFGLDCRDTFSLVAKITSVSLFLAMVVIGHMVAIGHWPLHRSQNRMSPLPEMEDKSGVDATKVQP

SEQ ID NO: 193392 - protein, 50 aa, Glycine max
  Coding DNA Sequence Number=SeqID_76614
MAMSDSFTVGLTIYFCIFSPLGFPKTCLWRENYSLHIDSEIEASISSPSL

SEQ ID NO: 193393 - protein, 189 aa, Glycine max
  Coding DNA Sequence Number=SeqID_76615
MDQSYEVYIKLEDGEIKSSAKSGLESTHCSQKWHKEYLVIIKDLINGTLQVLKENWTSGKLPKELEFLIQLKEDSIQVLHPVKTYHFGDAYMCFTKDDEDDDFIGRLTNLPIIFNVVDDAIINEVPTKNVADEPILEKTNEKPHEVMSKEHVLLDEVVIFLTNFGPTPINYAPSVSLTEDHVQEMIGNG

SEQ ID NO: 193394 - protein, 168 aa, Glycine max
  Coding DNA Sequence Number=SeqID_76616
MSVDRDCCSLPLPTRDKQVHWHVETNYGHPETIKSDGAQRQIWSFAPCGRRLNVFRPRLLQSPLYHPETSKFDDSMSFRPKLLKSPLRHPETIESDDMRRPTWSPAFVILTLFFDSFIIQRRASPMVCGDDDGHLFLIVSETIEVSLAIQRQASPLARENPHGHMFFI

SEQ ID NO: 193395 - protein, 56 aa, Glycine max
  Coding DNA Sequence Number=SeqID_76617
MEIQRTKEWGTYLYGVSKSAKMETKVQKWWLRDAKLVNPMCSPRRANSAFVFFAKI

SEQ ID NO: 193396 - protein, 68 aa, Glycine max
  Coding DNA Sequence Number=SeqID_76618
MNTARERFSSGVELRTAVQAEVANPKSPQRGTANKSTQLDNSATTDHLSKDTSNNKGHGNANHATKST

SEQ ID NO: 193397 - protein, 83 aa, Glycine max
  Coding DNA Sequence Number=SeqID_76619
MVGVEGVTVANANEFQRGHATNECAKTHEEVQYMNKQGKGTTRTTTIKATYLIQVCQEQGSNSIAMPRKKLYEKTSKLEKTLT

SEQ ID NO: 193398 - protein, 440 aa, Glycine max
  Coding DNA Sequence Number=SeqID_76620
  Gene Ontology: Mol. function=RNA-directed DNA polymerase activity; Biological process=RNA-dependent DNA replication
MKANMEAMKEQMTTMMEAMMSMRKMMEVNTAIVVAASTAIEVYPTHPSILNQVNHLVSDMVGKGGEALGSMGDPYFVQVQSKHPFPPFGLPPNYTPPNVVHAPDENVDNSAPIPIENQQAESGYAQVPQPMGETHEVPQDHILADFEPCLGYATEGQAFGGIPLPNTLGGSQYRPQSFHFAVERLPPAMVEREKFDHIEERLRVIEGGRNYAFADMEKLCLVPDMVIPLMFKVSDFDKYKGTNHLKMYCRKMEAYAKDEKLLMYFFHESLTGAAVAWYTNLEHSRVRSWKDLMVAFIRQYLLQNMCKEHESFKGYAQRWRDLAAQVVPPMMEREMITMIVDTLLVFYYEKMVGYTLSSFSDLVFVDERIKVGLRRGKFDYLALINRKPGANGENKEGETHGLTIVPTWSNFPLAQQYQYSANISPSHYPPPYQPRTPNHP

SEQ ID NO: 193399 - protein, 58 aa, Glycine max
  Coding DNA Sequence Number=SeqID_76621
MKGLFVTKLESNEVLLSPIALKVVGPFILDSNSSRDGTNPPSNSLYGNPQPRKQRDKQ

SEQ ID NO: 193400 - protein, 1268 aa, Glycine max
  Coding DNA Sequence Number=SeqID_76622
  Gene Ontology: Mol. function=protein serine/threonine kinase activity; Cellular component=integral to membrane; Biological process=protein amino acid phosphorylation
  Homolog annotation: Hit_ID=Q6L3I5; Match level="QueryCoverage=99%, HitCoverage=99%, E-value=0.0, Identity=60%"; Hit description=Leucine Rich Repeat family protein
  Pfam annotation: Domain name=LRRNT_2; Domain location=29-70; Score =46.0; E_value=1.2e-10; Accession=PF08263.3; Description=Leucine rich repeat N-terminal domain
  Pfam annotation: Domain name=LRR_1; Domain location=109-131; Score =16.7; E_value=0.084; Accession=PF00560.23; Description=Leucine Rich Repeat
  Pfam annotation: Domain name=LRR_1; Domain location=133-155; Score =14.3; E_value=0.43; Accession=PF00560.23; Description=Leucine Rich Repeat
  Pfam annotation: Domain name=LRR_1; Domain location=157-179; Score =15.3; E_value=0.22; Accession=PF00560.23; Description=Leucine Rich Repeat
  Pfam annotation: Domain name=LRR_1; Domain location=181-203; Score =11.7; E_value=1.8; Accession=PF00560.23; Description=Leucine Rich Repeat
  Pfam annotation: Domain name=LRR_1; Domain location=205-227; Score =8.5; E_value=7.2; Accession=PF00560.23; Description=Leucine Rich Repeat
  Pfam annotation: Domain name=LRR_1; Domain location=229-251; Score =8.4; E_value=7.8; Accession=PF00560.23; Description=Leucine Rich Repeat
  Pfam annotation: Domain name=LRR_1; Domain location=253-275; Score =9.8; E_value=4.1; Accession=PF00560.23; Description=Leucine Rich Repeat
  Pfam annotation: Domain name=LRR_1; Domain location=277-299; Score =9.3; E_value=5.3; Accession=PF00560.23; Description=Leucine Rich Repeat
  Pfam annotation: Domain name=LRR_1; Domain location=301-323; Score =14.6; E_value=0.35; Accession=PF00560.23; Description=Leucine Rich Repeat
  Pfam annotation: Domain name=LRR_1; Domain location=325-348; Score =7.3; E_value=12; Accession=PF00560.23; Description=Leucine Rich Repeat
  Pfam annotation: Domain name=LRR_1; Domain location=350-372; Score =9.9; E_value=4.1; Accession=PF00560.23; Description=Leucine Rich Repeat
  Pfam annotation: Domain name=LRR_1; Domain location=374-396; Score =16.3; E_value=0.11; Accession=PF00560.23; Description=Leucine Rich Repeat
  Pfam annotation: Domain name=LRR_1; Domain location=398-420; Score =8.8; E_value=6.4; Accession=PF00560.23; Description=Leucine Rich Repeat
  Pfam annotation: Domain name=LRR_1; Domain location=422-444; Score =10.4; E_value=3.3; Accession=PF00560.23; Description=Leucine Rich Repeat
  Pfam annotation: Domain name=LRR_1; Domain location=446-468; Score =15.5; E_value=0.19; Accession=PF00560.23; Description=Leucine Rich Repeat
  Pfam annotation: Domain name=LRR_1; Domain location=470-492; Score =9.2; E_value=5.4; Accession=PF00560.23; Description=Leucine Rich Repeat
  Pfam annotation: Domain name=LRR_1; Domain location=494-516; Score =10.6; E_value=3; Accession=PF00560.23; Description=Leucine Rich Repeat
  Pfam annotation: Domain name=LRR_1; Domain location=518-540; Score =15.3; E_value=0.23; Accession=PF00560.23; Description=Leucine Rich Repeat
  Pfam annotation: Domain name=LRR_1; Domain location=542-564; Score =9.7; E_value=4.4; Accession=PF00560.23; Description=Leucine Rich Repeat
  Pfam annotation: Domain name=LRR_1; Domain location=566-587; Score =9.8; E_value=4.2; Accession=PF00560.23; Description=Leucine Rich Repeat
  Pfam annotation: Domain name=LRR_1; Domain location=613-635; Score =12.8; E_value=1.1; Accession=PF00560.23; Description=Leucine Rich Repeat
  Pfam annotation: Domain name=LRR_1; Domain location=637-659; Score =16.8; E_value=0.079; Accession=PF00560.23; Description=Leucine Rich Repeat
  Pfam annotation: Domain name=LRR_1; Domain location=661-683; Score =13.3; E_value=0.9; Accession=PF00560.23; Description=Leucine Rich Repeat
  Pfam annotation: Domain name=LRR_1; Domain location=685-708; Score =10.3; E_value=3.4; Accession=PF00560.23; Description=Leucine Rich Repeat
  Pfam annotation: Domain name=LRR_1; Domain location=709-731; Score =12.2; E_value=1.5; Accession=PF00560.23; Description=Leucine Rich Repeat
  Pfam annotation: Domain name=LRR_1; Domain location=733-755; Score =14.3; E_value=0.43; Accession=PF00560.23; Description=Leucine Rich Repeat
  Pfam annotation: Domain name=LRR_1; Domain location=757-779; Score =10.8; E_value=2.7; Accession=PF00560.23; Description=Leucine Rich Repeat
  Pfam annotation: Domain name=LRR_1; Domain location=781-804; Score =2.5; E_value=96; Accession=PF00560.23; Description=Leucine Rich Repeat
  Pfam annotation: Domain name=LRR_1; Domain location=806-828; Score =17.6; E_value=0.045; Accession=PF00560.23; Description=Leucine Rich Repeat
  Pfam annotation: Domain name=LRR_1; Domain location=830-852; Score =10.1; E_value=3.7; Accession=PF00560.23; Description=Leucine Rich Repeat
  Pfam annotation: Domain name=LRR_1; Domain location=85-107; Score =7.8; E_value=9.9; Accession=PF00560.23; Description=Leucine Rich Repeat
  Pfam annotation: Domain name=Pkinase; Domain location=962-1251; Score= 155.2; E_value=1.7e-43; Accession=PF00069.15; Description=Protein kinase domain
  Pfam annotation: Domain name=Pkinase_Tyr; Domain location=962-1248; Score=90.7; E_value=4.5e-24; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::LRR_1::Pkinase::Pkinase_Tyr; Domain location=29 -70::109-131::133-155::157-179::181-203::205-227::229-251::253 -275::277-299::301-323::...
  Pfam module annotation: Domain location=325-348::350-372::374 -396::398-420::422-444::446-468::470-492::494-516::518-540::542 -564::566-587::613-635::637-659::661-683::685-708::709-731::733 -755::757-779::781-804::806-828::...
  Pfam module annotation: Domain location=830-852::85-107::962 -1251::962-1248
MMKFSTFAIVFLLCFSSMLLVLGQVNSDSESTLRVLLEVKKSFVEDPQNVLGDWSEDNTDYCSWRGVSCELNSNSNTLDSDSVQVVVALNLSDSSLTGSISPSLGRLQNLLHLDLSSNSLMGPIPPNLSNLTSLESLLLFSNQLTGHIPTEFGSLTSLRVMRLGDNALTGTIPASLGNLVNLVNLGLASCGITGSIPSQLGQLSLLENLILQYNELMGPIPTELGNCSSLTVFTAASNKLNGSIPSELGRLGNLQILNLANNSLSWKIPSQLSKMSQLVYMNFMGNQLEGAIPPSLAQLGNLQNLDLSMNKLSGGIPEELGNMGDLAYLVLSGNNLNCVIPRTICSNATSLEHLMLSESGLHGEIPAELSQCQQLKQLDLSNNALNGSIPLELYGLLGLTDLLLNNNTLVGSISPFIGNLSGLQTLALFHNNLEGSLPREIGMLGKLEILYLYDNQLSGAIPMEIGNCSSLQMVDFFGNHFSGEIPITIGRLKELNFLHLRQNELVGEIPSTLGHCHKLNILDLADNQLSGAIPETFEFLEALQQLMLYNNSLEGNLPHQLINVANLTRVNLSKNRLNGSIAALCSSQSFLSFDVTDNEFDGEIPSQMGNSPSLQRLRLGNNKFSGKIPRTLGKILELSLLDLSGNSLTGPIPAELSLCNKLAYIDLNSNLLFGQIPSWLENLPQLGELKLSSNNFSGPLPLGLFKCSKLLVLSLNDNSLNGSLPSNIGDLAYLNVLRLDHNKFSGPIPPEIGKLSKLYELRLSRNSFHGEMPAEIGKLQNLQIILDLSYNNLSGQIPPSVGTLSKLEALDLSHNQLTGEVPPHVGEMSSLGKLDLSYNNLQGKLDKQFSRWSDEAFEGNLHLCGSPLERCRRDDASGSAGLNESSVAIISSLSTLAVIALLIVAVRIFSKNKQEFCRKGSEVNYVYSSSSSQAQRRPLFQLNAAGKRDFRWEHIMDATNNLSDDFMIGSGGSGKIYKAELATGETVAVKKISSKDEFLLNKSFLREVKTLGRIRHRHLVKLIGYCTNRNKEAGWNLLIYEYMENGSVWDWLHGKPAKASKVKRRIDWETRFKIAVGLAQGVEYLHHDCVPRIIHRDIKSSNVLLDSKMEAHLGDFGLAKALTENYDSNTESNSWFAGSYGYIAPEYAYSLQATEKSDVYSMGILLMELVSGKMPTSEFFGAEMDMVRWVEMHMDMHGSGREELIDSELKPLLPGEEFAAFQVLEIALQCTKTTPLERPSSRKACDLLLHVFNNRMVKFEKMNLNHYK

SEQ ID NO: 193401 - protein, 196 aa, Glycine max
  Coding DNA Sequence Number=SeqID_76623
MAGDTASSFSTCMALFFSLLLLSHFTMAILEHNIFSPSTSNKEGVKKRNTKVVASVREESEQNSKKDMALGETSKGSIHVPKREHSQHSQSPNRIFNASAHEVPSGPNPISNRRLLIARYSERRNEGKEQKPPSTTIVLREKVYMDLASKVAYKGSISFFLNIPKYPHHFLWNCLAISVHLNHDFKSWDKATKIPK

SEQ ID NO: 193402 - protein, 138 aa, Glycine max
  Coding DNA Sequence Number=SeqID_76624
  Gene Ontology: Mol. function=L-ascorbic acid binding; Biological process=ethylene biosynthetic process
  Homolog annotation: Hit_ID=Q1S835; Match level="QueryCoverage=52%, HitCoverage=19%, E-value=3e-17, Identity=56%"; Hit description=2OG -Fe(II) oxygenase
MEVSITYEIADTVELNPDRLRELKAFDDSKAGVKGLVDEGVTKIPTLFHHPRDEFVKASTLGYTKHISPVIDLSEVGKELSYGNHLRNGVSVSVGLKSSPKLYGPIKDLLSEDNHPKYRETTVAEYARYCQKNKGENT

SEQ ID NO: 193403 - protein, 162 aa, Glycine max
  Coding DNA Sequence Number=SeqID_76625
MADPLEATTVTNTEDMMVTVVAEEFVESSEREQRKRGRKMLSATAIGALLGLGTQMYSNALRKLPYMRHPWEHVVGMGLGAVFVNQLLKWEAQVEQDLDKMLEKAKAANERRYIEKAQRVPLQEWLMWIVRYAGEKKREVLHMITSLDLNKVSLLTMLEFDK

SEQ ID NO: 193404 - protein, 600 aa, Glycine max
  Coding DNA Sequence Number=SeqID_76626
  Homolog annotation: Hit_ID=Q10PC8; Match level="QueryCoverage=96%, HitCoverage=85%, E-value=7e-81, Identity=35%"; Hit description =Hydroxyproline-rich glycoprotein family protein, putative, expressed
MVIGAIQQRRCNWNQVLMMQQYFSVADVAHALQQVAWRRQQRPLDPVKVGAKEFRKSGSGYRHGQRFEPVKEGYNSSVESYNQYDANVTVTGGTEKGTPVVEKSEEHKSGGKVEKVGDKGLASAEDKKDAITKHQTDGSLKSTRSTEGSLSNLESEAVVNDEWDDSHSVQNQHQSQSLSTKAKTFIGNEMFDGKMVNVVDGLKLYEDLFDSTEIANLVSLVNDLRVSGKKGQLQGSQAYIVSRRPMKGHGREMIQLGVPIADAPAEGENMTGASKGKLYYMNVEPIPSLFQDIIERMVSSQVMTVKPDCCIVDFYNEGDHSQPHSWPSWYGRPVYILFLTECEMTFGRVIASEHPGDYRGGIKLSLVPGSLLVMEGKSSDFAKHALPSVRKQRILVTFTKSQPRKSLSSDAQRLASTATSSHWGPLPSRSPNHVRHHVGSKHYATLPTTGVLPSPPIRPQMAAPVGMQPLFVTAPVVPPMPFPAPVAFPPGSTGWTGAPPPRHPPPRVPAPGTGVFLPPPGSGNSSQQLPAGTLAEVNPSTETPTMLEKENGKTNHNSTSASPKGKVQKQECNGHAADGTQVEPALETRQDSNDKAAPCH

SEQ ID NO: 193405 - protein, 130 aa, Glycine max
  Coding DNA Sequence Number=SeqID_76627
  Homolog annotation: Hit_ID=Q9SCY2; Match level="QueryCoverage=23%, HitCoverage=14%, E-value=1e-09, Identity=90%"; Hit description=FKBP -type peptidyl-prolyl cis-trans isomerase 3, chloroplast precursor
MKHNIKSKNVRISGFEYLVWFVEATEQSSNECKLRMRTLLYERGGVLLCSFGRSSHSTYVELGHFCHLLTQYPLWAHYVGRLENGKVFDSSYNRGKPLCFRVGVGEQYTTLATNLIEFNGVNVKVLTLNQ

SEQ ID NO: 193406 - protein, 303 aa, Glycine max
  Coding DNA Sequence Number=SeqID_76628
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=Q45GM3; Match level="QueryCoverage=81%, HitCoverage=69%, E-value=6e-89, Identity=63%"; Hit description =Expressed protein
MSEVEFEPQSPRLFIPNFLSLNECRELEFIHKSSSTVGYRPIVFSTTLSHLIATNSSHFIIPFIPIRERLKDKLEEFFKCEYELFIEFTGLISWSRGASIGWHSDDNRPYLKQRHFSDVLMYTADDHNIHSVDEITEGERLTLALWFSRDGSHDEDMKLISLLSRHLLHDNMADSYLPLPASSNMYWFSKDQASNNQFGFNICWARLHVLGYDIYISQDSSCESDVSESLLKPVRLVRENELLDQEFVNIMHALQGQGKPQGSMITYRSTYKYYKVVYAFVSETSIARVRVHTTATARTLEFL

SEQ ID NO: 193407 - protein, 235 aa, Glycine max
  Coding DNA Sequence Number=SeqID_76629
  Gene Ontology: Mol. function=intramolecular transferase activity, phosphotransferases; Cellular component=membrane; Biological process= carbohydrate metabolic process
  Homolog annotation: Hit_ID=Q5H5L8; Match level="QueryCoverage=98%, HitCoverage=29%, E-value=8e-98, Identity=75%"; Hit description =Phosphomannomutase
MWRTVGHRHLQFRRGHHLRQLCQYLIRGLLALGQDLQQARRRIQAIVETEPALLEEEVAAHLAGQLGVGLAHLRLHQRMPGLPHQRAATIAQHVVGQLAGALHVVDHHRAGVAHQHIGGKQHQQAVGIDDPAFAGDHAQPVAIAIEGDAEVGAEALDRLHQVFQVGRFARVGMMVGEGTVDIAVQRNDFSTDRFQQLRCERTGDAVAGIGHALQRAVQLHVVGDALNVVGTDKRS

SEQ ID NO: 193408 - protein, 62 aa, Glycine max
  Coding DNA Sequence Number=SeqID_76630
MTQREGLEEEDLGLGLMKNVEQRVWLTDHACVVVLNGGSYSQVTTQHTLSLYIFVAVHLRTE

SEQ ID NO: 193409 - protein, 51 aa, Glycine max
  Coding DNA Sequence Number=SeqID_76631
MTYRMEKLGYGIIKVRFFWFWIPQIRYAPQIKEKNERQKRMVEEGNALCLK

SEQ ID NO: 193410 - protein, 62 aa, Glycine max
  Coding DNA Sequence Number=SeqID_76632
VDSYMILKSVQEKWLQLLAENSEAKSNGFKCKAGHIWPSGCWWGKCYQLCFVGQREFLENQV

SEQ ID NO: 193411 - protein, 236 aa, Glycine max
  Coding DNA Sequence Number=SeqID_76633
MAKYDLEIVMEFYANAWPIEEGVRDKRSWVRGQWVPFDEDAINQFLGHLLVMEEGQHCEFSQRRSQASGFDEKSIGQLLCIPGQDFARSVTGRWDLTAQTPSGPRKVQRSTGVFDLDHRPLPASTIARGGPVDAPPPPLQQPPSLESISAHMRRMELQMHAYIQHLNESFYQYTLHQQSQDPSPFPWPTPEQFRATVSWPGDRPNFQVGVGPAGTLEDEDGAQEDDDMANVMDFFL

SEQ ID NO: 193412 - protein, 423 aa, Glycine max
  Coding DNA Sequence Number=SeqID_76634
  Gene Ontology: Mol. function=protein binding; Cellular component =integral to membrane; Biological process=protein amino acid phosphorylation
  Homolog annotation: Hit_ID=Q10QT0; Match level="QueryCoverage=99%, HitCoverage=81%, E-value=1e-124, Identity=50%"; Hit description =Leucine-rich repeat family protein, putative, expressed
  Pfam annotation: Domain name=LRRNT_2; Domain location=280-319; Score =26.3; E_value=0.00011; Accession=PF08263.3; Description=Leucine rich repeat N-terminal domain
  Pfam annotation: Domain name=LRR_1; Domain location=325-346; Score =3.8; E_value=55; Accession=PF00560.23; Description=Leucine Rich Repeat
  Pfam annotation: Domain name=LRR_1; Domain location=349-370; Score =12.1; E_value=1.5; Accession=PF00560.23; Description=Leucine Rich Repeat
  Pfam annotation: Domain name=LRR_1; Domain location=372-394; Score =9.3; E_value=5.1; Accession=PF00560.23; Description=Leucine Rich Repeat
  Pfam annotation: Domain name=LRR_1; Domain location=396-415; Score =13.5; E_value=0.76; Accession=PF00560.23; Description=Leucine Rich Repeat
  Pfam module annotation: Pfam domain module=LRRNT_2::LRR_1::LRR_1::LRR_ 1::LRR_1; Domain location=280-319::325-346::349-370::372-394::396-415
VKKHCYNIPVYRGAKYLVRTTYFYAGVNGADHPSPPVFDQILDGTLWSVVNTTRDYSDGNSSFYEGLFLAQGKIMSLCIGSNTYTDSDPFISALEFLILEGSLYNTSDFTKYGLALVARHSFGYSGPPIRYPDDLFDRVWEPFGQSNSTQASTDNVSVSGFWNLPPAKIFETRIGSDQLETLQLRWPTASLPSSNSKYYYIALYFADDTAGSRIFNISVNGITYYHNLNVIPSGVVVFASQWPLSGPTTITLTPAASSSLGPLINAGEVFDVLPLGGRTLTRDVIALEKVKQSLRNPPLDWNGDPCMPRQYSWTGISCSEGPRIRVVTLNLTSMDLSGSLSPFVANMTALTNIWLGNNSLSGQIPDLSSLKILETLHLEDNQFSGEIPSSLGDISSLQEVFLQNNNLTGQIPANLIGKPGLDI

SEQ ID NO: 193413 - protein, 58 aa, Glycine max
  Coding DNA Sequence Number=SeqID_76635
MMFGVGIARSRGRAFNDVMRRALLAWVSDDVRNEPPAIVVVVENIERNKEKRLPIKGF

SEQ ID NO: 193414 - protein, 150 aa, Glycine max
  Coding DNA Sequence Number=SeqID_76636
  Gene Ontology: Mol. function=protein binding; Cellular component =extrinsic to mitochondrial inner membrane; Biological process =protein import into mitochondrial matrix
  Homolog annotation: Hit_ID=Q2R2S3; Match level="QueryCoverage=77%, HitCoverage=35%, E-value=2e-35, Identity=58%"; Hit description =Expressed protein
  Pfam annotation: Domain name=Mmp37; Domain location=5-149; Score= -20.3; E_value=8.1e-13; Accession=PF09139.1; Description =Mitochondrial matrix Mmp37
MDNATFRSFLQVLPPVEFACVYGSSLHPSNHDKTTMTDYILGVSDPKQWHSENLKLNKHHYASWMVHLGGESLITGVADRIGVGVHFNPFVTWNGKLFKYGVIQMHDLLQDVQYWEKFYLCGRLQKPDRLFNCRHELAVKVDMQRNTSNI

SEQ ID NO: 193415 - protein, 175 aa, Glycine max
  Coding DNA Sequence Number=SeqID_76637
MVEISQDEREQIREEERRRILKELRKEKHDSYSSHNSCKSLSEEFSDYYRGKHRSLLQPTIRKGHEKADTMGQNCLSPRQKMSGVATNVYLRKTTSGPWDLILSLPSRLFIAKQGIWDEGSSPRRANNFILKQPYLPRRAELAQGSKNKDTNSVLGISPSNWPLAEVQAVKPVKT

SEQ ID NO: 193416 - protein, 103 aa, Glycine max
  Coding DNA Sequence Number=SeqID_76638
  Homolog annotation: Hit_ID=Q10NA6; Match level="QueryCoverage=54%, HitCoverage=70%, E-value=2e-13, Identity=59%"; Hit description =Expressed protein
  Pfam annotation: Domain name=CHCH; Domain location=15-56; Score=23.8; E_value=0.00063; Accession=PF06747.3; Description=CHCH domain
MGRKAGTLFINPKRFGNLQKPCMKEMALFLSCMAANHSDTDACARQKELLNVCIDAQPLCICKSKAAYNIPSPYLHIVKSLWAMGYEVEVEVEWWCVGISFRG

SEQ ID NO: 193417 - protein, 470 aa, Glycine max
  Coding DNA Sequence Number=SeqID_76639
  Gene Ontology: Mol. function=protein binding; Cellular component =cytoskeleton; Biological process=vacuole fusion, non-autophagic
  Homolog annotation: Hit_ID=Q00U71; Match level="QueryCoverage=74%, HitCoverage=24%, E-value=4e-79, Identity=48%"; Hit description =Chromosome 16 contig 1, DNA sequence
  Pfam annotation: Domain name=Arm; Domain location=105-145; Score =42.2; E_value=1.7e-09; Accession=PF00514.13; Description =Armadillobeta-catenin-like repeat
  Pfam annotation: Domain name=Arm; Domain location=13-61; Score=18.2; E_value=0.03; Accession=PF00514.13; Description=Armadillobeta -catenin-like repeat
  Pfam annotation: Domain name=Arm; Domain location=200-240; Score =32.1; E_value=1.9e-06; Accession=PF00514.13; Description =Armadillobeta-catenin-like repeat
  Pfam annotation: Domain name=Arm; Domain location=241-281; Score =19.5; E_value=0.012; Accession=PF00514.13; Description=Armadillobeta- catenin-like repeat
  Pfam annotation: Domain name=Arm; Domain location=315-355; Score=1.2; E_value=8.6; Accession=PF00514.13; Description=Armadillobeta-catenin -like repeat
  Pfam annotation: Domain name=Arm; Domain location=356-396; Score =15.9; E_value=0.13; Accession=PF00514.13; Description=Armadillobeta -catenin-like repeat
  Pfam annotation: Domain name=Arm; Domain location=63-103; Score=34.8; E_value=3e-07; Accession=PF00514.13; Description=Armadillobeta -catenin-like repeat
  Pfam annotation: Domain name=HEAT; Domain location=110-147; Score =11.9; E_value=1.5; Accession=PF02985.12; Description=HEAT repeat
  Pfam annotation: Domain name=HEAT; Domain location=206-242; Score =18.0; E_value=0.033; Accession=PF02985.12; Description=HEAT repeat
  Pfam annotation: Domain name=HEAT; Domain location=252-283; Score =4.6; E_value=12; Accession=PF02985.12; Description=HEAT repeat
  Pfam annotation: Domain name=HEAT; Domain location=321-357; Score =3.1; E_value=18; Accession=PF02985.12; Description=HEAT repeat
  Pfam annotation: Domain name=HEAT; Domain location=69-105; Score=2.7; E_value=20; Accession=PF02985.12; Description=HEAT repeat
  Pfam module annotation: Pfam domain module=Arm::Arm::Arm::Arm::Arm::Ar m::Arm::HEAT::HEAT::HEAT::HEAT::HEAT; Domain location=105-145::13 -61::200-240::241-281::315-355::356-396::63-103::110-147::206 -242::252-283::321-357::69-105
MGNPNMCNVCLEFPEHQQLIVDSSALTHLVDLLKRHRNGLTSRAINSLIRRAADAITNLAHENSNIKTRVRMEGGIPPLAHLLDFADAKVQRAAAGALRTLAFKNDENKNQIVECNALPTLILMLRSEDAAVHYEAVGVIGNLVHSSPNIKKEVLLAGALQPVIGLLSNNIQSDIFRGSSCCSESQREAALLLGQFAATDSDCKVHIVQRGAVRPLIEMLQSPDVQLREMSAFALGRLAQDPHNQAGIAHNGGLVPLLKLLDSKNGSLQHNAAFALYGLADNEDNVSDFIRVGGVQRLQDGEFIVQATKDCVAKTLKRLEEKIHGRVLNHLLYLMRASEKGCQRQVALALAHLCSSDDQRIIFIDHYGLELLIGLLGSSSSKQQLDGAVALSKLANKALTLSPVDAAPPSPTPQTILLAGKRFYAHRICLLASSDAFRAMFDGGYTPTKASSGNGYCSPVNKARSEVVPV

SEQ ID NO: 193418 - protein, 73 aa, Glycine max
  Coding DNA Sequence Number=SeqID_76640
MWVQAIGLFARATCAPEMLKSKTVQSEITRLARWWGCRKTTKRSELSRIGCGTNGLSYLKKGGRIKIQRLFPN

SEQ ID NO: 193419 - protein, 140 aa, Glycine max
  Coding DNA Sequence Number=SeqID_76641
  Subcellular localization annotation: CTP_CleavageSite=55; ConfidenceScore=5.16e-01
MAKIDLIGPAFYKNWSCASHHPTVKLEFLMMGTACFPTTNVVLKPQNLSGNFSTLCDNFRCLRFLTPKPPHLRSSHSKLGNRVKLTSFSMSKATHLKVSQAALSSTEESLSSSPRVIGEHDLLIVGPGVLGRLVAQKWSQ

SEQ ID NO: 193420 - protein, 230 aa, Glycine max
  Coding DNA Sequence Number=SeqID_76642
  Gene Ontology: Mol. function=RNA-directed DNA polymerase activity; Biological process=RNA-dependent DNA replication
MKQMVDKSTIDFIEGFRKAGSHCSVQFLEVECTTMEKEQRRVNKGRGSHLISLVNIDEDNGEIWEEEAKIMVAEMLRGKPCSCPALKPGKEQGCCWRWKDSHKISSPEELKGKNYCKWHNSYIHFTANCIVFQQVVQRAFKEGHFKLADRGIAEMVVDTDPFPKLDIHIVSYEHPTAKRKMKQVEGISNGPIYPITGPKLVDMRQAKRRNEEALKFEKLRQQIHREAEVG

SEQ ID NO: 193421 - protein, 430 aa, Glycine max
  Coding DNA Sequence Number=SeqID_76643
  Gene Ontology: Mol. function=protein binding; Cellular component =nucleus; Biological process=regulation of transcription, DNA -dependent
  Homolog annotation: Hit_ID=Q84UE8; Match level="QueryCoverage=99%, HitCoverage=100%, E-value=0.0, Identity=74%"; Hit description =Proliferating floral organs protein
  Pfam annotation: Domain name=F-box; Domain location=36-83; Score =40.9; E_value=4.5e-09; Accession=PF00646.23; Description=F-box domain
  Subcellular localization annotation: CTP_CleavageSite=50; ConfidenceScore=5.69e-01
MEGFHPSMSSPFSYTFPISGAGTSNYSTSTPWMNSRIWSKLPQRLLDRVIAFLPPPAFFRARCVCKRWYALLFSNTFLELYLQVSPHQHWFLFFKHHKTRKSYIYKNNNNGTSGGCGHHGGAFEGYLFDPYEMAWYRISFALVPSGFSPASSSAGLLCWVSDEAGPKTMLLSNPLIGSLTQLPPTLRPRLFPSIGLTISPTCIDVTVAGDDMISPYAVKNLTSESFHIDGGGFFSLWGTTSSLPRLCSLESGRMVYAEGKFYCMNCSPFSVLAYDITSNTWFKIQAPMRRFLRSPNLVECKGKLLLVAAVEKSKLNVPKSLRVWSLQACGTMWVESERMPQQLYVQFAELEDGNGFECVGHGEFIVIMIRGTDKALLFDICRKRWQWIPPCPYIAHDGFELHGFAYEPRLATPVTGLLDQLALPFQSFNA

SEQ ID NO: 193422 - protein, 230 aa, Glycine max
  Coding DNA Sequence Number=SeqID_76644
  Gene Ontology: Mol. function=RNA-directed DNA polymerase activity; Biological process=RNA-dependent DNA replication
MFDVQEEVDHGKEVFPIKRKSPSFEAQDPLEENVGYQSKKGLNHIDNLQEDVTHNFCHKSREKLKGCWELDLNLATPKDEYVIPIADMLVDATTKHGVLNFMDGHSDYNPIFMVVEDVHKTTFKCLRTLGMALDKRLQEDYTKDEGEVPKVELSYWRASYPKHSLGGEASSSMAYSLVDDASSHLFSFIFHCKSIAENHHWRTSLKLKDPVFIEASQASFLQVVSEHMSF

SEQ ID NO: 193423 - protein, 86 aa, Glycine max
  Coding DNA Sequence Number=SeqID_76645
MDEAKPMTIPMHPSIVIDQDKKDSNLVQRKQNFSLTPPKNEDKRKGKAIEASSGSDSEATITITRPRAKGIVIGSPTKRSFVKEEN

SEQ ID NO: 193424 - protein, 682 aa, Glycine max
  Coding DNA Sequence Number=SeqID_76646
  Gene Ontology: Mol. function=cellulose synthase (UDP-forming) activity; Cellular component=membrane; Biological process=cellulose biosynthetic process
  Homolog annotation: Hit_ID=Q2IB42; Match level="QueryCoverage=96%, HitCoverage=61%, E-value=0.0, Identity=80%"; Hit description =Cellulose synthase 2
  Pfam annotation: Domain name=Cellulose_synt; Domain location=1-670; Score=1219.5; E_value=0; Accession=PF03552.5; Description=Cellulose synthase
MDPRRCNSLSYSFVFAPLQRVYEEFKVKINALVEKAQKKPDEGWVMQDGTPWSGNNTRDHPGMIQVYLGSGGALDVEGKELPRLVYISREKRPGYNHHKKAGAMNALVRVSAVLSNAHFMLNLDSGHYINNSKAIREAMCFLMDPQLGNKLCYVQFPQRFDGIDRHDRYANRNFVFFDINLKALDGIQGPVYVGTGCVFNRQALYGYDPPVSEKRPKMTCDCCPSWSCCCCGGSRKSKSKKKSGGGGGGLFSRLYSKKKKMMGKNYVRRGSESMFDFEEIEEGLEGYDGIEKSSLMSQKQFEKRFGQSPVFIASTLMENGGLPEGTNSQSLIKEAIHVISCGYEEKTEWGKEIGWIYGSVTEDILTGFKMHCRGWKSAYYMPKRPAFKGFAPINLSDRLHQVLRWALGSVEICLSHHCPLWYGYGGKLKWLERLAYTNTIVYPLTSITLLVYCTISAVCLLTGKFIIPTIILSLADKFYSMQLTNLASVWFMALFISIIVTSVLELRWSGVSIEDLWRNEQFWVIGGVSAHLFVVFQGLLKVLGGVDANFTVTARATYDTEFEELYLFKWTTLLIPPTTLIILNMVGVVAGVSDAINNGYGSWGPLFGKLFFAFWVIVHLYPFLKGLMGRQNRTPTIVVLWSILLASIFSLIWVRIDPFLPKQTGPVLKHCEVECQGIGVAL

SEQ ID NO: 193425 - protein, 212 aa, Glycine max
  Coding DNA Sequence Number=SeqID_76647
  Gene Ontology: Mol. function=nucleotide binding; Biological process =translation
  Homolog annotation: Hit_ID=Q67YQ9; Match level="QueryCoverage=92%, HitCoverage=62%, E-value=1e-58, Identity=54%"; Hit description=MRNA, complete cds, clone: RAFL24-13-K22
ELPGSQVYGQTVTTDHHNELIQMGINPSLKWTEATHKFPNVIYCAPPSRTPDYAGNIRLAALSWNGEGSFLFTSSSAPYDCNDNGPCDEDSPVVPIGRSPRVDVLLKAENVVLDGAYDGDKIGAHFDMLPHQDAASLSVAILKKNFRGQIFLGCDNHPLSRQEMMDLVNKSGKFSKKFDKFTGTDGPLGKRLNNTRTSQGILAVDGEFIRHA

SEQ ID NO: 193426 - protein, 135 aa, Glycine max
  Coding DNA Sequence Number=SeqID_76648
  Gene Ontology: Mol. function=protein binding
  Homolog annotation: Hit_ID=UPI0000611F29; Match level="QueryCoverage =73%, HitCoverage=43%, E-value=5e-07, Identity=30%"; Hit description =UPI0000611F29 related cluster
MCFIAWQEKEARDIEIPNIRWEVFELMMRSIDVTLDIALDLLRAANQYLLEGLKRLCEYTIAQDISPENVSSMYELSEAFNAISLRHACILFILEQFDKLSSRPGHSLLIQRIIPEIRNYFVKALTKANSHDNQL

SEQ ID NO: 193427 - protein, 145 aa, Glycine max
  Coding DNA Sequence Number=SeqID_76649
MRFSAVYFVLLLFVVAELEATTCFTFNKEKKLSEFKTKVHEKIQKLSAPASSSETKKSGRVLYVSEYGADPTGNEESSDGILKAVEDAFALQKGVEFVGGVNDLGGVVIDLEGGNYKISKPISFPSSGGANLVVSIPFPLFCYIP

SEQ ID NO: 193428 - protein, 82 aa, Glycine max
  Coding DNA Sequence Number=SeqID_76650
MRPTGGVLNTESFDEGVEAIYGSWKASKCLSGSVVSSYRSRLSDFHPKGMSTSIMRSIKGCQWTVCVVGRCMRETQIVCNVA

SEQ ID NO: 193429 - protein, 242 aa, Glycine max
  Coding DNA Sequence Number=SeqID_76651
  Gene Ontology: Mol. function=nucleoside-triphosphatase activity; Cellular component=intracellular; Biological process=protein metabolic process
  Homolog annotation: Hit_ID=Q4IYV3; Match level="QueryCoverage=99%, HitCoverage=26%, E-value=5e-76, Identity=63%"; Hit description=AAA ATPase, central region:Clp, N terminal
  Pfam annotation: Domain name=Clp_N; Domain location=24-76; Score =26.4; E_value=0.0001; Accession=PF02861.11; Description=Clp amino terminal domain
MSEISRAVLFGKLDTLLFTSLESATAFCKLRGNPYVELVHWLHQLMQQQDGDLQRVISHFSLDENALTRDIVAALDRLPRGASAVSDLAEHIDSAVERAWVYASLKYGATRIRGGHLLIGMLKTFNLASVLKGISGQFGRINADALLEQFDTLLASSKEAQQALVAQPGVESAAPAASTSTLAQYAQDLTARAREGRIDPVTGRDEEIRQMVDILMRRRQNNPLLTGEAGVGKTAVVEGLAL

SEQ ID NO: 193430 - protein, 73 aa, Glycine max
  Coding DNA Sequence Number=SeqID_76652
MFSINSALKSARLAPPNTPVFCRAKTRVLIRGDEIPGTVLSGDGKLGYSTWLGHQPAPAPRGDLVFSVEQSDA

SEQ ID NO: 193431 - protein, 127 aa, Glycine max
  Coding DNA Sequence Number=SeqID_76653
MKKTVCRTLISSRDNCLSTYGFLLVTLSCLEPIVTRSVRFHDVSDGNKPKTQNGGELINLGGVLQPWAHLGPSGSFYMKQPAHLGEHVTSGLSHQLAWASWVASSSPILAINGRGRLRGRGQHPAKE

SEQ ID NO: 193432 - protein, 72 aa, Glycine max
  Coding DNA Sequence Number=SeqID_76654
MTRGKRYVEVKDEDSVVHKKKTAVKKSIDGKKNEESIIMEGNCSAVIQKILPSKLKDPGNSSLYSKFNPWKL

SEQ ID NO: 193433 - protein, 393 aa, Glycine max
  Coding DNA Sequence Number=SeqID_76655
  Homolog annotation: Hit_ID=Q1LC72; Match level="QueryCoverage=88%, HitCoverage=64%, E-value=4e-99, Identity=53%"; Hit description =Hypothetical protein precursor
  Pfam annotation: Domain name=Abhydrolase_3; Domain location=129-318; Score=-88.2; E_value=0.055; Accession=PF07859.3; Description =alphabeta hydrolase fold
  Pfam annotation: Domain name=DLH; Domain location=114-299; Score= -64.8; E_value=0.0081; Accession=PF01738.9; Description=Dienelactone hydrolase family
  Pfam module annotation: Pfam domain module=Abhydrolase_3::DLH; Domain location=129-318::114-299
MANLPWRVSVRVIALAKKMAMVAGIVVVVLLAVRVYLSQQGPELHLWHTWRADEMSVRELDNADFAGYLTREKAIFADLDNAVTVKTGHEEQTPLNRYYRQSLVWSGQFSPDANRSFVLMPPGKPRGAVVLLHGLTDSPYSVRHLALNYQQHGFVAVVPRLPGHGTAPGALTDVDWEMWLAATRLAVREATRLAGEHVPLHLVGYSNGGALAMKYALDALDAPALRKPQQVILLSPMIGVTAFARFAGFAGLPALLPAFAKAAWLNIAPEYNPYKYNSFPVNAARQSWLLTKALQEQIGRAARENRLENLPPVLAFQSVMDSTVSTRAVVTGLFDQLPANGSELVVFDINQAASFRPLFKPSSWTATSALLPVAQRRYSVTVITNADEHSFPA

SEQ ID NO: 193434 - protein, 187 aa, Glycine max
  Coding DNA Sequence Number=SeqID_76656
  Gene Ontology: Mol. function=DNA binding; Cellular component=nucleus; Biological process=regulation of transcription, DNA-dependent
  Homolog annotation: Hit_ID=Q9FX36; Match level="QueryCoverage=98%, HitCoverage=81%, E-value=5e-26, Identity=38%"; Hit description=Myb -like transcription factor, putative
  Pfam annotation: Domain name=Myb_DNA-binding; Domain location=15-60; Score=47.4; E_value=4.9e-11; Accession=PF00249.21; Description=Myb -like DNA-binding domain
CRLRWRNHLDPRVNRNPFTGEEEERLLAAHEVYGARWALISKLFNGRTDNAVKNHWHVMRARKRRESKQKNWPGVFQDSYASSSSNTVLHPNGPNPHDMVCPSNGSSSSAKFGTIPSFADSTPVNGSDHFGLFNGADDAMLQRSLFDNSFAEFGSSSSSVQVQADEESNGSGQKEVPFFDFLGVGDD

SEQ ID NO: 193435 - protein, 51 aa, Glycine max
  Coding DNA Sequence Number=SeqID_76657
MANSSAAAEDITNRLRVNYWKKDEDVKLLQQVREHGPQNWRSIASHLEGRT

SEQ ID NO: 193436 - protein, 80 aa, Glycine max
  Coding DNA Sequence Number=SeqID_76658
MDLRLGYGDYVVSIQKRSIISSSTYENRKEDANQLPQNPGMQFLPSEMLSNMIEKAGEQMFARRSDQLRILQLVNKNERN

SEQ ID NO: 193437 - protein, 238 aa, Glycine max
  Coding DNA Sequence Number=SeqID_76659
  Homolog annotation: Hit_ID=Q9AVH2; Match level="QueryCoverage=16%, HitCoverage=14%, E-value=7e-14, Identity=90%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPRQNEREPTNGSLFWPNIVEEERDTGLIGEGRIKATRAESQWIVAARPLCHLQYPVAYLSRLQRILPAARWELRFKASRRANPPHEVIIQRTVASRHWLFNQARRPNVRINGSSRTRLPYYCDTVISR

SEQ ID NO: 193438 - protein, 67 aa, Glycine max
  Coding DNA Sequence Number=SeqID_76660
MCSKHQHRLTEKLVEAFVNAIVDENHPVVYAGSINAPKVLANILQSIVAFSMSTKTSTFKHYGHCVR

SEQ ID NO: 193439 - protein, 148 aa, Glycine max
  Coding DNA Sequence Number=SeqID_76661
  Pfam annotation: Domain name=zf-CCHC; Domain location=94-111; Score =27.5; E_value=2.9e-05; Accession=PF00098.13; Description=Zinc knuckle
MSLATLFGKLQEHEMELMRLNQHEENDKKKKAIALKASSSTQEGSDKEDSIEIDKDDDLSLFVKGFNKFLRVRGNQRRSNFKSKKRAEDSSSTPRCYECNQPGHLRVDCPILKKRIEKSEKKFLMKRRPALHGMTLIWTHIKIQKTKL

SEQ ID NO: 193440 - protein, 131 aa, Glycine max
  Coding DNA Sequence Number=SeqID_76662
MKLAKYRLKAQVEKNEGPSGEGQSPRVEKDEGPSNPCGVYPDLSSFTGSGVYPDLSSFTGSGVYPDLSSFTGSGVIQKLYSLYQAFRPVRFTSSGIRALALDTAYSNSVWGKNCLIAELLNCQICLMMIAY

SEQ ID NO: 193441 - protein, 405 aa, Glycine max
  Coding DNA Sequence Number=SeqID_76663
  Gene Ontology: Mol. function=nucleoside-triphosphatase activity; Cellular component=membrane; Biological process=transport
  Homolog annotation: Hit_ID=P33916; Match level="QueryCoverage=99%, HitCoverage=91%, E-value=1e-125, Identity=53%"; Hit description =Hypothetical ABC transporter ATP-binding protein yejF
  Pfam annotation: Domain name=ABC_tran; Domain location=40-215; Score =127.7; E_value=3.2e-35; Accession=PF00005.17; Description=ABC transporter
SGRAARWKISRCASTQAKRWSGGRIVIGQERDGAVDYASAAAAAGELSAGARSCFDGRDVLQASEREMRGLRGNQMAMIFQEPMVSLNPLHSVEKQLYEVLSLHRGMRREAARAEILSCLDRVGIRQAATRLQDFPHQLSGGERQRVMIAMALLTQPKLLIADEPTTALDVTVQAQILQLLRELQRELNMGMLFITHNLNIVRQLAHSVTVMRNGREVEHNRSLYPRAAGRRAGRRTGTADRRAAAVAAHRGGKNRATQSQFYPAARRKPRVSRRIRVRQKHHRPGAAAPDCCARRDLVRRPAAASAEREAATAAAPAHSGGVSGSQLFTQSAHDGTAGDCRRAGGAPAAAQRCRTGSQSHCGDGRGWPGGSEPQPLPGGILWRSAPAYRHCPRADPAAAADRAG

SEQ ID NO: 193442 - protein, 362 aa, Glycine max
  Coding DNA Sequence Number=SeqID_76664
MESLFDALLNSSSVKGFGMYLTHESVTILHVKGGTLRASDTFPGDRHLIELWSSNSGKLETKESLNADVFKSIKAQNNAIYYEDITFRDILFDSSYRGGGIFIVDSARTRINNCFFLHFTTEGILVQQGHETFISSCFLGQHSTVGGDKGEKDFSGVAIDLASNDNAVTDVAIFSAAIGVVLRGQANILTGVHCYNKATYFGGIGILVKLAVMEDPVQVHVTNGLFLGDANIVLKSIKGQIFGLNIVDNMFNGDPNKKVPIVKLDGEFSSIEQVVIDRNNVNGMSLRSTVGKLTASGNGTKWVADFSSVLVFPNRISHFQYSFYAQDEAKFVALSMTNVSDNVVVVESEKEAKGFVSFKVEQ

SEQ ID NO: 193443 - protein, 104 aa, Glycine max
  Coding DNA Sequence Number=SeqID_76665
  Homolog annotation: Hit_ID=Q1SDG1; Match level="QueryCoverage=61%, HitCoverage=5%, E-value=5e-07, Identity=46%"; Hit description =Integrase, catalytic region; Zinc finger, CCHC-type
MWEDVVENGNCIPLDENLKEIPHSRWSDEDKKTYLLNSKAGNAIICALLEEKYTKMHSTKSVKQISFPRQWRPHVTTLKVSKDLARLSLERLIGILKAYEIELQ

SEQ ID NO: 193444 - protein, 128 aa, Glycine max
  Coding DNA Sequence Number=SeqID_76666
MTEARQKGLWIFWDAFIHIEAVVTAWASPSFFFAPTTGALLLLLGAHWKHIRTCLFVVRINPFSGEDEIRKVSWHVANQLFIVERGCRQRIKLNVLMMPKDYMNHMLLKDLLKTKKLKIFKMDDQDSL

SEQ ID NO: 193445 - protein, 45 aa, Glycine max
  Coding DNA Sequence Number=SeqID_76667
MEMNMLASSFTGYAKPFASVNPSLLPFRASSLRHDYPLASKIVVK

SEQ ID NO: 193446 - protein, 136 aa, Glycine max
  Coding DNA Sequence Number=SeqID_76668
  Gene Ontology: Mol. function=methyltransferase activity
  Homolog annotation: Hit_ID=Q6YUR7; Match level="QueryCoverage=75%, HitCoverage=19%, E-value=1e-09, Identity=34%"; Hit description=SAM -dependent methyltransferase-like protein
MYILGLQRQHGAINLLEAVNSYFSSHGLFCTLNTSSFTVDVAASKDDCDSILRNELHIINKSINCQPTQKTSNGSSLNLSSERLCFRISVFQQIPGTLLVKGSLQDRNCAVSVALCLEIALEECVLCLCFRDILIG

SEQ ID NO: 193447 - protein, 1281 aa, Glycine max
  Coding DNA Sequence Number=SeqID_76669
  Gene Ontology: Mol. function=ubiquitin-protein ligase activity; Cellular component=intracellular; Biological process=protein modification process
  Homolog annotation: Hit_ID=Q8GY23; Match level="QueryCoverage=96%, HitCoverage=32%, E-value=0.0, Identity=61%"; Hit description=E3 ubiquitin protein ligase UPL1
  Pfam annotation: Domain name=HECT; Domain location=952-1279; Score =536.6; E_value=2.7e-158; Accession=PF00632.15; Description=HECT -domain (ubiquitin-transferase)
LQANEPMSVQPVSLNIMPNGFDCTVIEGNVTHDENVAQAFVNSSINSDAAIQCESGADVPTSIHNVPIESMEFNGSSNADGQPPNIELGGSGFETPNPGDSHASSIYASADVDMGGTDAEGNQSEQPTVFEDGRGEMLSTQNTEVAPDATQADQVSANNEASGANTIDPTFLEALPEDLRAEVLASQQAQSVQPPAYAPPSAEDIDPEFLAALPPDIQAEVLAQQRAQMVAQQAEGQPVDMDNASIIATFPAELREEVLLTSSEAVLSALPSPLLAEAQILRDRAMSHYQARSLFGSSHRLNNRRNGLGFDRRPVMDRGVGVTIGRRSALTDSLKVKEIEGEPLLDGNALKALIRLLRLSQPLGKGLLQRLLLNLCAHSVTRATLIYLLLDMIKPEAEGSVSRPATLNSQRLFGCHSNTVYGRSQLLDGLPPLVFRRILEILTYLATNHSAVAKLLFHFDQSIIPDSSCPVKVHMNEKGKEKVIEGRPSPNSSGAQTGDVPLVLFLKLLNRPLFLRSNAHLEQVMGLIQVVVDTAASKLESQSQSEKGMADTQNLSASEAPSNTEKDAPSVESDSNQQDKHADTNPCHSEGKKNVDMYNIFLQLPQSDLRNLCSLLGREGLSDKMYMLAGEVLKKLAFIVSSHRKFFTLELSESAHALTGSAISELVTLQKTNMLGLSAGSMAGAAILRVLQALSSLTSLNTLGDLDMENDADQHDDQATIWNLNTALEPLWQELSNCISAAEMQLGQSSFSPNMSNINVAENLQGSSTSPPLPPGTQRLLPFIEAFFVLCEKLQANESFMQQDHCNATAREVKESAGCSASTSVKIGGDSLRKFDGAITFTRFAEKHRRLSNAFIRQNPGLLEKSLSMMLKAPRLIDFDNKRAYFRSRIRQQHDQHLSGPLRISVRRAYILEDSYNQLRMRPTQDLKGRLNVQFQGEEGIDAGGLTREWYQLLSRVIFDKGALLFTTVGNNATFQPNPNSVYQTEHLSYFKFVGRVVGKALFDGQLLDVYFTRSFYKHILGVKVTYHDIEAVDPDYYKNLKWMLEEKTDCGCRERELWSLVYSLVSENDVSDIPDLTFSMDADEEKHILYEKNEVTDYELKPGGRNIRVTEETKHEYVDLVAEHLLTNAIRPQINSFLEGFNELVPRELISIFNDKELELLISGLPEIDLDDLKANTEYTGYTVASNVVQWFWEVVKTFNKEDMARLLQFVTGTSKVPLEGFKALQGISGPQRFQIHKAYGAPDRLPSAHTCFNQLDLPEYTSKEQLQERLLLAIHEASE

SEQ ID NO: 193448 - protein, 1124 aa, Glycine max
  Coding DNA Sequence Number=SeqID_76670
  Gene Ontology: Mol. function=ubiquitin-protein ligase activity; Cellular component=intracellular; Biological process=protein modification process
  Homolog annotation: Hit_ID=Q8GY23; Match level="QueryCoverage=99%, HitCoverage=30%, E-value=0.0, Identity=48%"; Hit description=E3 ubiquitin protein ligase UPL1
  Pfam annotation: Domain name=UBA; Domain location=5-45; Score=50.9; E_ value=4.2e-12; Accession=PF00627.21; Description=UBATS-N domain
  Pfam annotation: Domain name=UIM; Domain location=50-67; Score=20.9; E_value=0.0045; Accession=PF02809.10; Description=Ubiquitin interaction motif
  Pfam module annotation: Pfam domain module=UBA::UIM; Domain location =5-45::50-67
MPPPPDEATIATIVEMGFSRARAEEALRRVETNSVEMAMEWLFSHADDPVQEDDELARALALSLGSSSESTKAESAEKTIDVLTEEGHVKKPPVDDILAASVKLFQSSDSVPFQLTDLLVTLCSQSKGDDRPKDNCALSVLAHILALLLFEDGSTREIAAQNGIISTIIDILTNFKGRQELGKELPVPKCISALLLILDQMVQSRPKVENMEGTQTGSLPDSSGEQFSDTVLPKEKNSNGIEKEPAMAFENILGKSTGFATIDESHKLLDIACDLIKQHVPAVVMQAVLQLCARLTKTHALALQFLENGGLAALFNLPRTCLFPGYDSVVSAIVRHLLEDPQTLQTAMELEIRQTLSGNRHSGRVSPRSFLTSLAPVISRDPMVFMKAAAAVCQIETSGGRTVVVLSKEKEKEKSKSSSVEVGLSSNECVRIPEIKSHDGLGKFLKSHKKVPVNLTQVIDQLLEIVLKYPLVKGQEDSECDSTFMDIDEPTMKVKGKSKVEEAGILEPESERSTGLVKVTFVLKLLSDILLMYGHAVGVILRRDSEMCQFRGSNQPSGHSGIIHHVLHRLLPLSVDKSAGPDDWRGKLSEKASWFLVVLCGRSGEGRKRVTNELVKELMSFSHLESNSMKSSLLPDKRLFTFVDLVYSILSKNSSSGSLPGSGYSPDIAKSMIDGGIILSLTSILQVVDLDHPDAPKIVNLILKGLEGLTRAANASEQIFKSDGTEKKRSAVLNDRSDDQITAPSAAEAVAHDQNAGSQEASRDAMDNAHNQGTSQGDDRADNPDQSMEHDIRVEEGGTMAQNQTMELGMDFMREEMGEGGVLHNPDQIEMTFHVENRADDDMGDEDDDMGGDEDEDEDDDEGEDEDEDIAEDGGGMMSLADTDVEDHDDVGFGDEYNDEMIDEDDDDFHENRVIEVRWREALDGLDHLQILGQPGFIDVAAEPFEGVNVDDLFRLQSFERRRQTGRSSFERSATEVNGFQHPLLVRPPPSGDFVSMWSSSGNSASRDSETLSSGNLDVAHFYMFDAPILPYDHVPSSLFGDRLGGAAPPPLTDYSVGMGSLHLPGRRVLGNGRWTDDGQPQGSAQAAAIAQAVEEQFLAQLCSVAPASSPVERQLQNSGEQEN

SEQ ID NO: 193449 - protein, 88 aa, Glycine max
  Coding DNA Sequence Number=SeqID_76671
MACLDQQYSGKEGQIVVVVEDLPISELDDSSNWDYICCLKYHNYSAVIGFVAEGVYYKCLQYKLQKNIDHRVLQQVQISDSWQAELLG

SEQ ID NO: 193450 - protein, 60 aa, Glycine max
  Coding DNA Sequence Number=SeqID_76672
  Subcellular localization annotation: CTP_CleavageSite=15; ConfidenceScore=5.07e-01
MKWAKRASTAKCSFSATEESGRASISRPCAKREISVLSTTVVFSQAQRTSGAKLKSPYLH

SEQ ID NO: 193451 - protein, 98 aa, Glycine max
  Coding DNA Sequence Number=SeqID_76673
MTRPKIEGEDPNKGVVQSSSTIHSTEQIVRCRNQTKPSLPVTYPSNQCVYEEGILMRFARLFMIMEAKYQQVVGQSDTGLNPLKKGLKFEYCGLRKRG

SEQ ID NO: 193452 - protein, 181 aa, Glycine max
  Coding DNA Sequence Number=SeqID_76674
MGGSDLGGSIQQPLVEWEVIPIGDSSSKETCHKAFDSESSSFERLLDLRHVDEGKGDNVVVRVSPHNKRSRSARMSSPPPFIDHFFKVKATNVISNELSVKQVGPTEDDVPPTPLVICEPSVGEGSHPKARVDPPRLCEVDKDEVVEVTPNVPPPVSAKRKCNEGAERSSQRKKSRALFNL

SEQ ID NO: 193453 - protein, 125 aa, Glycine max
  Coding DNA Sequence Number=SeqID_76675
  Gene Ontology: Mol. function=disulfide oxidoreductase activity; Cellular component=extracellular space; Biological process=antigen processing and presentation of exogenous peptide antigen via MHC class II
  Homolog annotation: Hit_ID=Q5QLT3; Match level="QueryCoverage=96%, HitCoverage=49%, E-value=1e-27, Identity=41%"; Hit description =Putative legumaturain
NGPDECELNSLEACALNVLDDVNKHYALIYCFEFLAIEGRHKNWQDCFSQLDLPLEPILSCYNRGNGTELGQKYINETTLFYTPHEFLPWVVVNNQSIGKEYENFTRYVCEAYKGIPAPAACNRR

SEQ ID NO: 193454 - protein, 224 aa, Glycine max
  Coding DNA Sequence Number=SeqID_76676
RVRRYMEKNEETTMEEKVKLKINEASMVIFNHGGIAEDNREEEELHHQDSVLDKKLREEASMEEKNQREKGGDEIEGEKEGEKLNFEVYFTSFTFIKGVTEKYSKNMPNASYHIPRMCQKLSIFPLDVTGMKEIYLEVHENPKALFKNSSTILLEPCAHGSCDWSLPREDCIRHIGRKDKGNLIFLSFTEVSKYCATIYLHNLLLGTSLSLSSLWTLARRTRCW

SEQ ID NO: 193455 - protein, 343 aa, Glycine max
  Coding DNA Sequence Number=SeqID_76677
  Gene Ontology: Mol. function=serine O-acetyltransferase activity; Cellular component=cytoplasm; Biological process=cysteine biosynthetic process from serine
  Homolog annotation: Hit_ID=Q8W2B8; Match level="QueryCoverage=86%, HitCoverage=84%, E-value=1e-107, Identity=66%"; Hit description =Serine acetyltransferase 4
  Pfam annotation: Domain name=Hexapep; Domain location=228-245; Score =12.7; E_value=1.4; Accession=PF00132.14; Description=Bacterial transferase hexapeptide (three rep
  Pfam annotation: Domain name=Hexapep; Domain location=260-277; Score =17.9; E_value=0.036; Accession=PF00132.14; Description=Bacterial transferase hexapeptide (three rep
  Pfam annotation: Domain name=SATase_N; Domain location=70-174; Score =205.1; E_value=1.6e-58; Accession=PF06426.4; Description=Serine acetyltransferase, N-terminal
  Pfam module annotation: Pfam domain module=Hexapep::Hexapep::SATase _N; Domain location=228-245::260-277::70-174
MAHLSHKTLVYLPEMRPEHEAEEGQPRKSLGSFSSWPHRLENVFPVYAMGTSNPAVLDSSLHTSDCLDPIWDAVREEAKLEAEKEPILSSFFYATILSHDCLEQALAFALANRLQNPTLLATQLMDIFSNVMKHDKGIQQSIRLDIQAFKDRDPACLSYCSALLYMKGYQSLQVYRVAHALWGQGRKVLASALQSRVSEVFGVDIHPAAKIGDGILVDHGTGVVIGETVVVGNRVSLMQGVTFGGTGKETGDRHPKISEGVLIGAHATILGNITIGECVMIAAGSLVLQEVPPHSIVAGVPAKVIGRVHEHYPSLTMQQDENKHLSEEFFYSKDETTENYYIN

SEQ ID NO: 193456 - protein, 420 aa, Glycine max
  Coding DNA Sequence Number=SeqID_76678
AKEEKIQVADDLLNEADPLSKCHPLSEASNSLSGWETQEEKESEMCLSSGQPTHPPRILSLLALSTPSLVKPKFTYSRLASLWKLKGPRTFKTLNGSSSLALPISSLSVLPLAAPASSSHPSVSLDHVYTSCDMNSMWSMGYRPEQKTPIDFVSPFDQNLNRQLGSLAILEENRQRHQEALNKVGSLETEVAKWRVSRLDNDKVFGRCKNFLKEMNGLASSVECIAEEKKKLIAIVAESAKVIIDLLAQLKESESKMKEFELEAAKEKEVNKELEKKLLAFKKEAMEQHENGFYKAIKEQDADEEEDDGANVLGATLAFLTGLYEIENEITSDNLVFDFNLVEGALEIHRDSPRVNLGFDEPLRFVEAHQGSTLENCQSSPRADLGFEEPWRFIEAHQGRTLGLTSLRESSRLTKGGPWV

SEQ ID NO: 193457 - protein, 108 aa, Glycine max
  Coding DNA Sequence Number=SeqID_76679
MAEPWRNIDVEKLISYSDDLVKVLSQGPRDFNNLSHSLQQKLALSSSCDSDLDDVRSSLQDYQKKVDTCKQKIEEARSETAADADLDLLQRELEEELEKEHLLKEEFR

SEQ ID NO: 193458 - protein, 92 aa, Glycine max
  Coding DNA Sequence Number=SeqID_76680
MKGVTLAPGKGICHKNMPKEYSKNMLKEYSKDMPKGGKLHTPLWIPYKPKMAKIQDPKEEEPILIFIEKSGTNLGPWALKSTLRFMRNLRPS

SEQ ID NO: 193459 - protein, 742 aa, Glycine max
  Coding DNA Sequence Number=SeqID_76681
  Gene Ontology: Mol. function=transmembrane receptor activity; Cellular component=membrane; Biological process=defense response
  Homolog annotation: Hit_ID=Q1T1A2; Match level="QueryCoverage=75%, HitCoverage=63%, E-value=1e-121, Identity=44%"; Hit description=TIR; Disease resistance protein; AAA ATPase
  Pfam annotation: Domain name=NACHT; Domain location=208-362; Score= -33.2; E_value=0.022; Accession=PF05729.3; Description=NACHT domain
  Pfam annotation: Domain name=NB-ARC; Domain location=170-465; Score =143.9; E_value=4.2e-40; Accession=PF00931.13; Description=NB-ARC domain
  Pfam annotation: Domain name=TIR; Domain location=12-144; Score =156.2; E_value=8.8e-44; Accession=PF01582.10; Description=TIR domain
  Pfam module annotation: Pfam domain module=NACHT::NB-ARC::TIR; Domain location=208-362::170-465::12-144
MTSSSTSIKKDVFISFRGPDVRKGLLSHLKKELCRRQIEACVDEILDRGDEISSSLLRAIEESQILLVIFSKDYASSQWCLEELAKMIECLERNKQILVPVFFNVDPSDVRQQHGEYGDALAKHEEKLKENMFKVQSWRSALKKAANLSGFHYPGNFDDESDLVDKIVEDISEKLSKSSPSESNGLVGNDQNIVQIQSLLLKESNEVIFVGIWGMGGIGKTTIAHAMYDKYSPQYEGCCFLNVREEVEQRGLSHLQEKLISELLEGEGLHTSGTSKARFFDSAGRKMGRKKVLVVLDDVNTSEQLKYLVGKPICFGPGSRVLITSRDKRVLTSGGVYQIHKVKEMDPRDSLKLFCLNAFNESHPKMGYEKLSEEVVKIAQGNPLALKVLGADFHSRSMDTWECALSKIKKYPNEEIQSVLRFSYDGLHEVEKKAFLDIAFFFEEDDKDYVTRKLDAWGFHGASGVEVLQQKALITISDNRIQMHDLIREMGCEIVRQESIICPRRRSRLRDNEEVSNVLRQNLGTDEVEAMQIDVSGIKNLPLKLGTFKKMPRLRFLKFYLPLHAELSLLQSHDGPIWSPEKQDELLLSAGCKQLMRVASEIHIKCLHYLLIDDCSDPSLLDELTSTEMSMLQNIAQDAGVEIILNSSIGQLSSLECSDVVDQQFKNLPNELLCLRCTYYLKLSKSRQQDIGKPKLHILFDSLRYYQRISVSQLYKPVVVFPPKSRAEMWLKGAKKERYFTR

SEQ ID NO: 193460 - protein, 253 aa, Glycine max
  Coding DNA Sequence Number=SeqID_76682
  Gene Ontology: Cellular component=membrane
  Homolog annotation: Hit_ID=Q00WF6; Match level="QueryCoverage=98%, HitCoverage=83%, E-value=5e-16, Identity=27%"; Hit description =Homology to unknown gene
  Pfam annotation: Domain name=HlyIII; Domain location=21-223; Score= -71.9; E_value=0.1; Accession=PF03006.10; Description=Haemolysin-III related
MWESVVLTVAATAGNNIGKILQKKGTIILPPLSFKLKAWALLMLRALSLAPVSVIQPVSGCGLAILSIFSHFYLKEVMNAVDWVGITLAGFGTIGVGAGGEEQEVVALSIFHIPGLAFVVFILFILLSGWLRICKCQRREQEMVEYDVVEEVIYGLESGILFGMSSVISKMGFLFLEQGFPKLLVPMCIMISVCCSGTGFYYQTRGLKHGRAIVVSTCAAVASILTGVLAGMLALGERLPSEPKARLALLLGW

SEQ ID NO: 193461 - protein, 204 aa, Glycine max
  Coding DNA Sequence Number=SeqID_76683
  Gene Ontology: Cellular component=endoplasmic reticulum
  Homolog annotation: Hit_ID=Q10LS6; Match level="QueryCoverage=92%, HitCoverage=79%, E-value=1e-55, Identity=57%"; Hit description =Reticulon family protein, putative, expressed
  Pfam annotation: Domain name=Reticulon; Domain location=13-202; Score= 140.8; E_value=3.6e-39; Accession=PF02453.8; Description=Reticulon
MSESEAQLPTAFVADVLLWKRWHVSLGIIVVATVAWVLFEWTSLPFLTICSDVLLILIVLLFLHANYAALRNKYDSYPLQPPTLPELVVSEEMVNNVAASFRVKINNMLLIAHDITIGKDFRIFFKVVICLWLLSVIGSAFSFFTLAYIGTLLMITIPALYSKYGGYVDKCCGVIHRQFSRHYRIVDESVFNRLPRNISKDKES

SEQ ID NO: 193462 - protein, 173 aa, Glycine max
  Coding DNA Sequence Number=SeqID_76684
  Gene Ontology: Mol. function=helicase activity; Biological process =protein amino acid phosphorylation
  Homolog annotation: Hit_ID=Q1SN45; Match level="QueryCoverage=98%, HitCoverage=11%, E-value=1e-35, Identity=44%"; Hit description=AAA ATPase
  Pfam annotation: Domain name=DUF889; Domain location=1-173; Score =122.8; E_value=9.4e-34; Accession=PF05970.5; Description=Eukaryotic protein of unknown function (DUF889)
MRLQIGSSDFDVSERKQFLDWILGIGNGTIGHSNDVDINVSIPDDLLLQSKDNMNDVAFFQDRVILTPRNDIVDLINQYMLSLLPGDEKSYLSLDTPYFVNENNDTPNIVHTAEFFNTITTSRLSNHVLKLKVGVPIMLLRNLDQSVGLCNGTRMIVTKLGKYVIEAKVISGT

SEQ ID NO: 193463 - protein, 84 aa, Glycine max
  Coding DNA Sequence Number=SeqID_76685
  Homolog annotation: Hit_ID=Q9FKP3; Match level="QueryCoverage=87%, HitCoverage=23%, E-value=2e-19, Identity=46%"; Hit description =Similarity to auxin-independent growth promoter
MIENQEWAWVDMAAHSACDFGGGKAEKLALAKYRQVYGGEARLATLSKLCPLMEDKKSLVSIEELAKVKGKASLLATVDYYVSM

SEQ ID NO: 193464 - protein, 103 aa, Glycine max
  Coding DNA Sequence Number=SeqID_76686
MEKEPCKRKRKTQKDSLERNPETIFQPTEAKNCQTKQKSFSLWKDSLEKNPKIIFRPTQAKNCQTKPKKLRPLGFPLGRENNQARAFEFFVKTKQTENENAEE

SEQ ID NO: 193465 - protein, 124 aa, Glycine max
  Coding DNA Sequence Number=SeqID_76687
  Gene Ontology: Mol. function=protein kinase activity; Biological process=protein amino acid phosphorylation
  Homolog annotation: Hit_ID=Q1SM23; Match level="QueryCoverage=86%, HitCoverage=60%, E-value=2e-15, Identity=45%"; Hit description =Unnamed protein product; contains similarity to helicase gene _id:T13C12.11-related
MGFTIGRLHFVPPANDLVLTPEELKSFALIDSEKLLQSNNKSLMDFPSMPQPDIDLIGEKGIGKTYIWKALFAAFRSKTEIVLTVAFCGIATFLIPRGRIVYSRFAIPINVDENSICNIKQGSP

SEQ ID NO: 193466 - protein, 334 aa, Glycine max
  Coding DNA Sequence Number=SeqID_76688
  Pfam annotation: Domain name=Transposase_21; Domain location=12-153; Score=7.9; E_value=2.8e-15; Accession=PF02992.5; Description =Transposase family tnp2
MSKCPRCGVSRHKIKDDEECSSDENSKKDPSVKRKYMTLSMMISGPRQLGNDIDVYLSPLIEDLKTFWDEGVLVFDGFQNETFQMRAMLFCTINDFPVYGNLSGYNVKGHHACPISKEDTSYIQLKHADSTNRDHVEESITEKVTWKLILSFSQMQSQLQAQIHALPLEPEVGPSAARASTKGSCVDPLVTDPDTGIHSGSQHPLLHGQVKVSVEEVKDADALILVPTDEAAVSPAKPIDRVFNQEFPLYIKHEDLSEIAHNDQCLSISVIQLWILAHWQMVFILPKENLVVWLCSLHNRPDNYLKGIINSALKELDDTPQPKSKAGARWIIVK

SEQ ID NO: 193467 - protein, 141 aa, Glycine max
  Coding DNA Sequence Number=SeqID_76689
  Gene Ontology: Mol. function=signal transducer activity; Cellular component=membrane; Biological process=regulation of transcription, DNA-dependent
  Homolog annotation: Hit_ID=Q8W419; Match level="QueryCoverage=65%, HitCoverage=23%, E-value=6e-23, Identity=56%"; Hit description=Twin LOV protein 1
MPMELELELGSTTIQRSFDARYTRHTRDLLDELPDSFTVTDPSILGHPIVFASPGFLKLTGYSLREVLGRPTAIFQGPLTFPKSVIEIRKVVREERNAQVPLQKKEGSGVRDFGFECCRRKSLWDAEVEREELCEASDDEK

SEQ ID NO: 193468 - protein, 188 aa, Glycine max
  Coding DNA Sequence Number=SeqID_76690
  Gene Ontology: Mol. function=NADH dehydrogenase (ubiquinone) activity; Cellular component=mitochondrion; Biological process =mitochondrial electron transport, NADH to ubiquinone
  Homolog annotation: Hit_ID=Q37626; Match level="QueryCoverage=96%, HitCoverage=97%, E-value=4e-56, Identity=71%"; Hit description=NADH -ubiquinone oxidoreductase chain 6
  Pfam annotation: Domain name=Oxidored_q3; Domain location=11-121; Score=84.0; E_value=4.5e-22; Accession=PF00499.10; Description=NADH -ubiquinoneplastoquinone oxidore
  Subcellular localization annotation: CTP_CleavageSite=21; ConfidenceScore=5.21e-01
MTSLFYFFSSLALISGVMVIQARNPVHSVLFLILVFFNSAGLLVLLGLEFFAMIFLVVYVGAIAVLFLFVVMMLNIKLAEISEKRLRYLPIGGLLGMLFLGEIFLIVDNDLIPWLGSAHLSEWAELSAMEWTPWSHLAEGVTPLEGPDPVGGNDRGHSSDAPQGGSCKASRGFPSKQQRVCETVGKLS

SEQ ID NO: 193469 - protein, 1626 aa, Glycine max
  Coding DNA Sequence Number=SeqID_76691
  Gene Ontology: Mol. function=RNA-directed DNA polymerase activity; Biological process=RNA-dependent DNA replication
  Pfam annotation: Domain name=AT_hook; Domain location=2-14; Score =14.1; E_value=0.085; Accession=PF02178.9; Description=AT hook motif
  Pfam annotation: Domain name=Lysine_decarbox; Domain location=1512 -1626; Score=79.6; E_value=1e-20; Accession=PF03641.4; Description =Lysine decarboxylase family
  Pfam module annotation: Pfam domain module=AT_hook::Lysine _decarbox::RVT_1; Domain location=2-14::1512-1626::864-1132
MSRGRGRPKKTAPSSPASQTNIAEQAIGNNQDEDSTKHQVVEEIEVVDDDSSVSMPETLIPKLTCDAQDDPKEERKLWIDVLNDNRNPAKGMAIEYVQPTLVDGEIEIAIDEEDIVSEKKFWENALVMYVLGGELSMNGVKQFITKAWNFVQLPAIYYHDDGYFLLKFKTHKDMDDVMLRGPYTLPLHLWGARSLGKIGSALGKPITTDECTAKKYRVSYARILVEVDVTQKLPNDITIRDSEGKKLKQPVHYEWKPMFCDKCQKFGHHCEEVKAKKVWQMKSKQGSTSHAQPKENNTGLYNIETVDNGLESKKSVENGLKSTQAAGKNASSSGVKGTNSADFQANTSTTVLNLVASDDIGNVAEYTHEWSSRRKNGKDNGKKIVVDCTPNLIRCTNGFEALEDLNDPLVYQDGKLKEIGSRLLELRPTITILIETRVKQVKARNIRNKLRLQGEFLDNYSSHSNGRIWLNWDTNKRSMPLISWISVELCGLISNVFMAINMVLGSCLVTNNVLKAKDRVGGNLVTESEYEDLAKMMRNTGTFEKDSTGDYYTWSNKQTDGMIYSRIDRVLGNVEWFQDNMDTMLQILPPSVSDHALLCLADPGNTAGRQFHFKFSYCLTDLEEYHSTVSNSWNEPLNGRPMYVLWEKLKRLKPALNKINRPLHHIQSRIMEARQNLQHAQQSLVEDRWNSSKIDTVKRYTEEVINWNSLEEKTLQQKSKIDWLRLGDGNNSYFHATIKAKKSSKRLNLLHKDDGTVITSRDEIQDEVLNFYEGLMGTKDGNVRHINIMAMRGGPQLSMEQREQLVAPIADQEIRKALNGIGDTKSPGIDGFGAKFFKTSWNIIGKDVVAAVRDFFENDRIYKAFNCTLVTLIPKNEEAKAIKEYRPIAGCTTVYKIISKIITARMGRVMDSIVGKNQAAFVPGQKIHNHILLAYELIKGYSRKGGTPRCMMQIDLQKAYDMVNWDALECILKEIGVPQQFIRWIMIAVTTVSYRFNVNGCHSNLLQAKRGLRQGDPMSPLLFVIVMEYPNRILYDMQKNPNFNHHAKCEKLSITNLAFADDLLLFSRGDPISVDLMVKAFKNFSESTGLIANPSKCKIYFGGVGDDSKRNILNLTGFTEGLLPFRYLGVPLTSKKLSIHHYMPLVDKIVGRINHWSTNLLTYAGRVKLIRSVTFAIANYWMQCFPIPKYVVHKIEAICRSFLWTGGQEIKRKSPVAWDSVCKPKDYGGLNIIDLSVWNKVTMLKLLWNLSGKSDSLWVKWVNAYYLNKDTLMNVSVKIHNSWIMKSILKHRSSILDIQSIWDSMLEKNRFGMKEVYKSLCTNTSKVRWRNLFRGNTARPRALMTLWLACHGRLATKNRLKKFGMIEDSKCCFCPAEESINHLFYGCPKLKIIWTKVLDWVQIKRVPREWNDELEWLISSTKGKGKRHAILKLAAAETLYGIWRYRNDKSFGNTVDNTKIANNIIDMIVYRGWYSGNSGNRQFFSDATIELANELVKRNIDLVYGGGSVGLMGLISQRMYDGGCHACCYWFNNFVYKGIPKALMPLEISGEPVGEVRIVSDMHEPKAAMAQGADAFIALPGGYGTMEELLEMITWAQLGIHKKQRGARNILVTASPAKELMMKMEV

SEQ ID NO: 193470 - protein, 147 aa, Glycine max
  Coding DNA Sequence Number=SeqID_76692
MAFTFLSNIVAGRTKWKLKVRVIRLWSLPVFENPKVIRSLEMILLDEKLQSCLSACVSRLVVRRVCLLRVLLAVIPCLSSRASNSHPCLVRRSVAGFFGGLSSRGSRSHPLPPTVPCSPTSNEMCLQSLVRPNPVRTQTIFSVWVEC

SEQ ID NO: 193471 - protein, 267 aa, Glycine max
  Coding DNA Sequence Number=SeqID_76693
  Gene Ontology: Mol. function=translation elongation factor activity; Cellular component=intracellular; Biological process=translational elongation
  Homolog annotation: Hit_ID=P56292; Match level="QueryCoverage=85%, HitCoverage=55%, E-value=5e-97, Identity=77%"; Hit description =Elongation factor Tu
  Pfam annotation: Domain name=GTP_EFTU; Domain location=50-254; Score =345.1; E_value=1.2e-100; Accession=PF00009.17; Description =Elongation factor Tu GTP binding domain
  Pfam annotation: Domain name=MMR_HSR1; Domain location=53-179; Score=- 1.4; E_value=0.0014; Accession=PF01926.13; Description=GTPase of unknown function
  Pfam module annotation: Pfam domain module=GTP_EFTU::MMR_HSR1; Domain location=50-254::53-179
  Subcellular localization annotation: CTP_CleavageSite=39; ConfidenceScore=5.07e-01
MRSTAWPRQTRHLQRADSKDFSRSLRPVGSVVGPRRDLSFMARGKFERKKPHVNIGTIGHVDHGKTTLTAAITMALASQGGGKGRKYDDIDSAPEEKARGITINTAHVEYETENRHYAHVDCPGHADYVKNMITGAAQMDGAILVVSGADGPMPQTKEHILLAKQVGVPNVVVFLNKEDQVDDEELLELVELEVRETLDNYEFPGDEIPIVAGSALLALEALTENPQLKAGENKWVDKIYELMRQVDSYIPTPERETDKPFLMAVED

SEQ ID NO: 193472 - protein, 161 aa, Glycine max
  Coding DNA Sequence Number=SeqID_76694
STLEDPTAPEAEAAGPSQAPQPGISRRQLSAQGAEQDIVQRWLAFSLKASSTVAELKRFLLDRGQRPVIFTRSALLARVEGLLRFEHPEGGLEPSAAAVEEITAAVEAAAQPARQRPARQKAPKKSQLQMEAAKSIVNKGEWALSAGSSDHLVTVAHPRRL

SEQ ID NO: 193473 - protein, 186 aa, Glycine max
  Coding DNA Sequence Number=SeqID_76695
  Gene Ontology: Mol. function=oxidoreductase activity, acting on iron -sulfur proteins as donors; Cellular component=chloroplast; Biological process=chlorophyll biosynthetic process
  Homolog annotation: Hit_ID=Q6VQA8; Match level="QueryCoverage=99%, HitCoverage=36%, E-value=3e-93, Identity=87%"; Hit description=Light- independent protochlorophyllide reductase subunit B
  Pfam annotation: Domain name=PCP_red; Domain location=137-181; Score =101.3; E_value=2.9e-27; Accession=PF08369.1; Description=Proto -chlorophyllide reductase 57 kD subunit
MGIRVSCSGTYCKHDADWFREQVQGFCDEVLITDDHTHVGDMIARIEPAAIFGTQMERHIGKRLDIPCGVISAPVHIQNFPLGYRPFLGYEGTNQVADLVYNSFTLGMEDHLLEIFGGHDTKEVITKSLSTEGGLVWAPDGLAELTKIPGFVRGKIKRNTEKFASDNNISKITLEVMYAAKEAAGA

SEQ ID NO: 193474 - protein, 81 aa, Glycine max
  Coding DNA Sequence Number=SeqID_76696
MACFFLRARRELNPRPRASETRALPSGCLPLSWVGLNKGPLSETGLPHRPHSPCKACPFLGPIAWLCEASTSTPAEHTSNF

SEQ ID NO: 193475 - protein, 271 aa, Glycine max
  Coding DNA Sequence Number=SeqID_76697
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56308; Match level="QueryCoverage=99%, HitCoverage=57%, E-value=1e-145, Identity=87%"; Hit description =Photosystem II 44 kDa reaction center protein
  Pfam annotation: Domain name=PSII; Domain location=1-271; Score =347.3; E_value=2.5e-101; Accession=PF00421.9; Description =Photosystem II protein
MNLFEVAHFVPEKPMYEQGLILLPHLATLGYGVGPGGEVIDTFPYFVSGVLHLISSAVLGFGGVYHSLVGPETLEESFPFFGYVWKDKNKMTTILGIHLIVLGIGAWLLVWKALYFGGVYDTWAPGGGDVRIISNPTISPAVIFGYLLKSPFGGDGWIVSVDNLEDIIGGHIWIGTLLILGGVWHILTKPWAWARRAFVWSGEAYLSYSIAAVSIMAFVSCCMSWFNNTAYPSEFYGPTGPEASQSQAFTFLVRDQRLGANVASAQGPTGL

SEQ ID NO: 193476 - protein, 673 aa, Glycine max
  Coding DNA Sequence Number=SeqID_76698
  Gene Ontology: Mol. function=ubiquitin-protein ligase activity; Cellular component=intracellular; Biological process=protein modification process
  Homolog annotation: Hit_ID=Q8GY23; Match level="QueryCoverage=99%, HitCoverage=20%, E-value=0.0, Identity=61%"; Hit description=E3 ubiquitin protein ligase UPL1
  Pfam annotation: Domain name=DUF913; Domain location=20-296; Score =197.7; E_value=2.7e-56; Accession=PF06025.3; Description=Domain of Unknown Function (DUF913)
MREAGFIPTLLPLLKDTNPQHLHLVEKAVRILEAFMDYSNPAAALFRDLGGLDDTISRLKIEVSNVENSGKQPDDNSESSANAAGLPSAFLDAIMVDVLNSAEAITCIPQCLDALCLNSNGLQAVKDRNSLRCFVKVFTSRTYLRALAGDTPASLSSGLDELMRHASSLRGPGVEMLVEILEAISKIGSAVDSSSLSPDPCSSTSVPMEMDGEDKNLILPNNKESSNANDTEQITEPSHDVPIVNVESFLPDCVNNIARLLETILQNADTCRIFVEKKGIEAILQLVTLPLMPPSVSVGQSISVAFKNFSPQHYVSLARAVCSFLREHLKSINELLDLVGGTQLALVESAKQTKVLKYLASLEAVLTLSVFLLKGSTTVVSELSTLDADVLKDLGKTYKEVIWQISLCNDSKAEGKKNADQEPEVAQVPPSTAVERESDDDSNIQTVRYTNPVFARNGSHSLWSGEREFLSVVRAGESMHRRSRHGLSRIRGGRTGRHLEALNIDSEASSSALEAPLSQDLKKKSPDVLVLEILNKLASTLRSFFTALVKGFTSPNRRRADSGSLSSASKTLGAVLATNFFEALSFSGHSTYAGLEMSLSVKCRYLGKVVDDMAALTFDSRRRSCYTAMVNNFYVHGTFKELLTTFEATSQLLWTLPCSLPSSDIDVGKKGEG

SEQ ID NO: 193477 - protein, 347 aa, Glycine max
  Coding DNA Sequence Number=SeqID_76699
  Gene Ontology: Mol. function=DNA-directed RNA polymerase activity; Cellular component=chloroplast; Biological process=transcription
  Homolog annotation: Hit_ID=Q20EX3; Match level="QueryCoverage=74%, HitCoverage=13%, E-value=5e-65, Identity=52%"; Hit description =Beta'' subunit of RNA polymerase
  Pfam annotation: Domain name=RNA_pol_Rpb1_5; Domain location=24-278; Score=-131.6; E_value=0.0058; Accession=PF04998.8; Description=RNA polymerase Rpb1, domain 5
MVSQWDFIPKSVRKAEGGNSHHIGQHPNGEPATTRGKGNVLFTQADHTSLSNKGHDLKRCVGEFVSIGDEIISGYATPTSGQIVAIEKDKITLRRTQALLFYAQGVMHVNHGEWVEKNAPILTLTYQKLITGDIVQGIPKIEQFFEAPATKEGEPLPNSLQARLRRSFQRLKQLYPVPQAVKRSLEEIQQILVEGILKVYLSQGVRIADKHLEIVIRQMISKGQVLDVGNTGLFQGEHVRLDRIERINLATYGQKADYEPAVLGITQASLDSESFISAASFQETTRVLSRDTIIGKTDFLRGLKERVVLGDLIQAGTGVDDNINYGLLFGIAPACDPAGDAPSLAWL

SEQ ID NO: 193478 - protein, 77 aa, Glycine max
  Coding DNA Sequence Number=SeqID_76700
MSVVVTASDWFGHDGGGENEDVGFFFKHINKHERKNVISKRKRLILRYFYMFIPVHLTMEDDEEERPKIHNNITKNH

SEQ ID NO: 193479 - protein, 246 aa, Glycine max
  Coding DNA Sequence Number=SeqID_76701
  Gene Ontology: Mol. function=ubiquitin-protein ligase activity; Cellular component=cytoplasm; Biological process=ubiquitin cycle
  Homolog annotation: Hit_ID=UPI0000163167; Match level="QueryCoverage =94%, HitCoverage=5%, E-value=7e-76, Identity=61%"; Hit description =UPL1 (UBIQUITIN-PROTEIN LIGASE 1); ubiquitin-protein ligase
  Pfam annotation: Domain name=DUF908; Domain location=84-245; Score= -31.3; E_value=1.5e-06; Accession=PF06012.3; Description=Domain of Unknown Function (DUF908)
MCFRMKVILLCWSQPPKIRCFIDRVTSVPLEKIEEPLKAFVWEFDKGDFHHWVDLFNHFDSFFEKYVKPRKDLQIDDDFLDLDPLFPRESVLQILRVIRIILDNCTNKHFYSSYEQHLSALLASTDPDVVEASLDTLATFLKKTVGKYSIRDASLNSKLYALAQGWGGKEEGLGLIASAVPNGCDPIACELGRTLHFEFYAVNESESDIKVTEPLVQGLQIIHLSDVNKCVETDLELLHKLVTEYK

SEQ ID NO: 193480 - protein, 220 aa, Glycine max
  Coding DNA Sequence Number=SeqID_76702
  Gene Ontology: Mol. function=RNA-directed DNA polymerase activity; Cellular component=intracellular; Biological process=RNA-dependent DNA replication
VVIRFIKKEIISGMVLPRKIIKDNATNLKNKMMKEMCEDFKIQYHNSTPYRPKMSGAIEAANKNIKKIVQKMTVSYKDWHKMLPFALHSYQTSVRTSTGATSFSLVYGMEVMLPVEVEVPSLRILAESGLAAMSHGQLYQSRVKNAFDKKVRLCKFCEGDLVLKKVSQAQKDHRGKWAPNYEGPFVVKKAFSGGALLLATMDDEELPSPVISNIIKRYYA

SEQ ID NO: 193481 - protein, 81 aa, Glycine max
  Coding DNA Sequence Number=SeqID_76703
MHPLAKLYVCPLRGCEVVATRAWFPMAHIPMFHFPMLAILLATWQHLATLGNTQPRHAAASRSHDKGSRDPQEGILELPGP

SEQ ID NO: 193482 - protein, 260 aa, Glycine max
  Coding DNA Sequence Number=SeqID_76704
  Gene Ontology: Mol. function=riboflavin synthase activity; Cellular component=riboflavin synthase complex; Biological process=riboflavin biosynthetic process
  Homolog annotation: Hit_ID=O80575; Match level="QueryCoverage=68%, HitCoverage=73%, E-value=1e-46, Identity=57%"; Hit description=6,7 -dimethyl-8-ribityllumazine synthase, chloroplast precursor
  Pfam annotation: Domain name=DMRL_synthase; Domain location=89-215; Score=60.5; E_value=5.5e-15; Accession=PF00885.10; Description=6,7 -dimethyl-8-ribityllumazine synthase
  Subcellular localization annotation: CTP_CleavageSite=54; ConfidenceScore=5.35e-01
MASFVSTHRILPSHHQSGLGFVHDQARSCDRTNTFHLQNAPKIPRSLSFLLSVPASESRPDAVVVQSNGRSSFSQTAAVRHLTGSVTRPHGLRFAVVVARFNEIVTKPLLEGALGTYKNYSVQVEDIDVVWVPGSFEIGVVAERLGKSGKYHAIICIGAVVRGDTTHYDAVANSAGVLSAGLNSGAIPKRDTFFVGYKERCFLSLCRMGFGLVLVVVMVVAMEVGCGGWVVAREPPHSSRFGEEEDQAFLLLVLGPHSCG

SEQ ID NO: 193483 - protein, 186 aa, Glycine max
  Coding DNA Sequence Number=SeqID_76705
  Pfam annotation: Domain name=VQ; Domain location=48-78; Score=30.2; E_ value=7.1e-06; Accession=PF05678.4; Description=VQ motif
  Subcellular localization annotation: CTP_CleavageSite=80; ConfidenceScore=5.56e-01
MDATMSSSSEGMMMLRPTNSHNYTTSGHNLTPKGCAFKPIRRRSRTSKSTPITLLKANTSNFRALVQQFTGCPTTTTMSLAIHKGPITLNFQQDGTKQHIHHDQHHTKITTRGAMPPFATISSNQNHASVPFPKQQLMQEQQSGYFLPTYSGNSYRPISCMDDGLIFDNDFSLHELTVNAISNDSD

SEQ ID NO: 193484 - protein, 169 aa, Glycine max
  Coding DNA Sequence Number=SeqID_76706
MESGDMRRYRMVTRTFRQPGAKEPVDAERLTSSSALFGHPGTASRVAGFYSHRLETFKPDDTRDSSLLGGDDKVQWRREVSWLSRFIAFEDTEISKEGQLSYSNFNRGPLSGGMQPSLDHLEFRNILEVERKHCCVIRKVQQHSGSQKGHCCVICKVSQHSGKKMGVFT

SEQ ID NO: 193485 - protein, 165 aa, Glycine max
  Coding DNA Sequence Number=SeqID_76707
MNNGHPIIHMKFDGLSEVRADLKIYESIIINFFACDDNTIFDLHFTPPLNQQTCGRPILHSRVHAWRTEITQCILGAPQPLEIQSHARKYLKQCENHLTILRKNAPPLQWDVVTLDRDIKDKSIVRPWYKFLRENDFHHGDEVSFYYRPHERIWEIVIRRERKWL

SEQ ID NO: 193486 - protein, 240 aa, Glycine max
  Coding DNA Sequence Number=SeqID_76708
  Homolog annotation: Hit_ID=Q84VH5; Match level="QueryCoverage=80%, HitCoverage=39%, E-value=2e-59, Identity=84%"; Hit description =Envelope-like protein
MDLIKAAGLLKTVTKLGDCYEGLVREFIVNIPSDITNRKSDDYQKVFVRGKCVRFSPAVINKYLDRPTDGVMDIAVSEHQIAKEITAKRVQHWPKKGKLSAGKLSVKYAILHRIGAANWRESPLSLHYKLFEGTHVPDIVSTSGKAAASGAVSKDALIAELKDTCKVLEATIKATIEKKMELERLIKRLSESGVDDGEAAEEEEAAEQEEEEAEEEEEEVDEEDAAEDTESNDDDSEATP

SEQ ID NO: 193487 - protein, 89 aa, Glycine max
  Coding DNA Sequence Number=SeqID_76709
MKKILGLQAPMELASKRVLNQMMMKDNYRLKDTLLSFKVFWTGLMDSKPMLWTCDSMQWTQGSQRLKKMPPSFAIALIYLHHHQFKLYY

SEQ ID NO: 193488 - protein, 251 aa, Glycine max
  Coding DNA Sequence Number=SeqID_76710
  Gene Ontology: Mol. function=nucleic acid binding
  Homolog annotation: Hit_ID=Q2HRL0; Match level="QueryCoverage=37%, HitCoverage=17%, E-value=1e-21, Identity=45%"; Hit description=RNA -processing protein, HAT helix
METGKHDETEDENKLDGEKLIEERSKEVETPKDDPKGNQEARRLWVDVISENRNPTKGRMMSYVAPKMVEGQIEIEIEDEDIESEIRYWENALILYVLGGDLNMNTIKNFMERNWNFVQLPNLYYHDDGYFLLRFKSHDDMEVVVMKGPYTIRSMPVVLKEWRTDFSLKQDMLRTIPIWIKLPKLPLYLWGERSLNKIGSAIGTPMVTDECTTHKLRVSYARMLVEVDITRKLVEEIAIKDKDGRKMMQPI

SEQ ID NO: 193489 - protein, 205 aa, Glycine max
  Coding DNA Sequence Number=SeqID_76711
  Gene Ontology: Mol. function=helicase activity; Biological process =viral genome replication
  Homolog annotation: Hit_ID=Q2R1R7; Match level="QueryCoverage=99%, HitCoverage=12%, E-value=1e-39, Identity=43%"; Hit description=AT hook motif-containing protein, putative
MFAFTSPGVKVDTSYNTGRGPPTLRIHGQSHHLIGSLLPMPDNSPKFAQLYIYDIENEVNNRLSQYPIKNNVDEDIIIGIKNMLDTHNRYAQKFRMSRDKLHSSAVCDLKLKLISGRQSDGRLYNLPNATEVATLIIGDEHIVNNRDIIIEKQTSMLQRINELHPAYLPLQYPLLYPHGEDGYRPNILHKDNPHSQVAKRNKVTM

SEQ ID NO: 193490 - protein, 166 aa, Glycine max
  Coding DNA Sequence Number=SeqID_76712
  Gene Ontology: Mol. function=DNA binding; Cellular component=nucleus; Biological process=regulation of transcription, DNA-dependent
  Homolog annotation: Hit_ID=Q52H28; Match level="QueryCoverage=53%, HitCoverage=21%, E-value=2e-28, Identity=60%"; Hit description =Putative auxin response factor 10
MEMIFMYNSNMIGPWRRWHPTAILDENDSVAGDELLMIDKLAPADGEEVVAWRAMVDVAEAPLDAVDVSDREELDRQIGAKVEWREARVGAEAWHREVVAIVGVGGSCCCDCERRVRRNMAGDEGERADERAEYKASPVLREDDTWQDLGRVGLCWGSRHDRSAGT

SEQ ID NO: 193491 - protein, 93 aa, Glycine max
  Coding DNA Sequence Number=SeqID_76713
  Gene Ontology: Mol. function=acyl-CoA binding; Biological process =lipid transport
  Homolog annotation: Hit_ID=Q10B01; Match level="QueryCoverage=80%, HitCoverage=11%, E-value=1e-26, Identity=76%"; Hit description=Acyl -CoA binding family protein, putative, expressed
  Pfam annotation: Domain name=Kelch_1; Domain location=15-60; Score =14.9; E_value=0.08; Accession=PF01344.15; Description=Kelch motif
MEWSRPTQLGEIPSPRAGHAGVTVGENWFIVSGGDNKSGVSETIVLNMSTLTWSVVTSVQGRVPVASEVYVLKPSHKSTLQSKIIENSIPDSV

SEQ ID NO: 193492 - protein, 559 aa, Glycine max
  Coding DNA Sequence Number=SeqID_76714
  Gene Ontology: Mol. function=nitrate reductase activity; Cellular component=periplasmic space; Biological process=electron transport
  Homolog annotation: Hit_ID=Q6D2V4; Match level="QueryCoverage=99%, HitCoverage=62%, E-value=0.0, Identity=65%"; Hit description=Nitrate reductase
  Pfam annotation: Domain name=Molybdopterin; Domain location=1-409; Score=335.9; E_value=6.9e-98; Accession=PF00384.12; Description =Molybdopterin oxidoreductase
METALDAAADGLRRIIDAHGPEAVAFYGSGQLLTEDYYVANKLMKGFLGVANIDTNSRLCMASAVTGYKRAFGADAVPCCYEDLDEAEVVILVGSNAAWAHPVLFQRLKQAKVQRPEMQVVVIDPRRTASCEFADLHLPLRPGSDPALFSGLLHWLEQHDGIDVTMLPHLDGVDTTLRAARQWDGAAVAAHCDISHEVIAAFYGLFTRHERVLTLWCMGINQSQSGSDNNNAILNAHLLSGKIGRPGCGPFSLTGQPNAMGGREVGGLANQLAAHMSFTAEDCDRLQRFWRSPRMAREPGLTAVDLFDAIDRGAIKAVWIMGTNPAVSMPEGNRIARALAACPLVIVSDVLAQTDTTAFAHILLPAQGWGEKNGTVTNSERRISRQRAFMPPAGEAKPDWWLLAQVAQRLGFHEGFTWTHPAAIFREHAALSGFENNGQRAFDISGLAGMSDAQWDAMKPVQWPINARYPEGCARLFSDRHFYHPDGKARLLPPATPQPVVCETAYPLLMNSGRIRDQWHTMTRTGLVPRLMQHCDEPFAALHPHDAKRYGLRAGALAR

SEQ ID NO: 193493 - protein, 225 aa, Glycine max
  Coding DNA Sequence Number=SeqID_76715
  Gene Ontology: Mol. function=ATP binding; Cellular component =chromosome; Biological process=DNA metabolic process
  Homolog annotation: Hit_ID=Q1H394; Match level="QueryCoverage=97%, HitCoverage=43%, E-value=7e-56, Identity=58%"; Hit description=DNA repair protein RecN
  Subcellular localization annotation: CTP_CleavageSite=4; ConfidenceScore=5.21e-01
MALRASSALNLMSCLNCWPSNCNVSQSWRVLPMMVPWLSRQQAAHKLAKTITEQMQALSLKGGQFAVALTPGEPAAHGLEQVEFLVAGHAGVEPRPLNKVASGGELSRISLALQVTTASLGTVPCMIFDEVDVGIGGGVAEVVGRLLSELGQHRQVLVITHLAQVASQAQQHLQVSKSEQQGATLSRIRPLGADERVEEIARMLGGLQITETTRNHAREMLGLIT

SEQ ID NO: 193494 - protein, 44 aa, Glycine max
  Coding DNA Sequence Number=SeqID_76716
MFSKTNADKHFSTDNDWDELVDGVDNDDTGDWHYPAPNPSGKDM

SEQ ID NO: 193495 - protein, 87 aa, Glycine max
  Coding DNA Sequence Number=SeqID_76717
MAFIRQGDQIIIVYFTKLRVIWDELKSCRPDPTSYNQATIHRIMNIHVPIIGKIITLYIDAIGRMVFLRIMLPEEEKEVKAILAEEI

SEQ ID NO: 193496 - protein, 79 aa, Glycine max
  Coding DNA Sequence Number=SeqID_76718
  Homolog annotation: Hit_ID=Q1S3I6; Match level="QueryCoverage=65%, HitCoverage=3%, E-value=8e-10, Identity=57%"; Hit description =Integrase, catalytic region
MALELNDTLVLTDLPHIRMLLAVSRQDYRDTFSPMAKLTTIKLLLALTTINKWYLKQLDVNNAFLHGDLNEEVYMILPQ

SEQ ID NO: 193497 - protein, 177 aa, Glycine max
  Coding DNA Sequence Number=SeqID_76719
  Homolog annotation: Hit_ID=Q1T493; Match level="QueryCoverage=93%, HitCoverage=31%, E-value=5e-15, Identity=28%"; Hit description =Nucleic acid-binding, OB-fold, subgroup
MMGKFRVCDHEYKLCFTGVTVVRQCDMEQFPFRKFRFVAFSSVIAGHFKIGLLVDVIGVVDEVVFRYVSSKNTRVVLNLKDLSGQVLSYTLWENYCLQFLSYLNDIEDERLIVILLTHARIKEAQGSYPASVSNSFKASKLMINDLMLEIQEFRESLLDLGIEVRSILTPIGQGSSQ

SEQ ID NO: 193498 - protein, 69 aa, Glycine max
  Coding DNA Sequence Number=SeqID_76720
MADKLLKLLLPPLKIDFRDLSGFIGLDSTSVSLTLLILATNKGSSRAAHALCLCFRATSLRHVVLFDST

SEQ ID NO: 193499 - protein, 131 aa, Glycine max
  Coding DNA Sequence Number=SeqID_76721
  Gene Ontology: Mol. function=DNA binding; Cellular component=oxygen evolving complex; Biological process=DNA integration
  Homolog annotation: Hit_ID=Q1SLU3; Match level="QueryCoverage=98%, HitCoverage=9%, E-value=2e-41, Identity=62%"; Hit description =Integrase, catalytic region
MEDDFSFRRLIGRLIYLTNIRPDITYVVQHLSQFVAAPTSVHQQPAVRILRYIKGSPIVGIFLFATSKIQLKGISDCDWVGCIDIRRSITSYAMYIGDSLISWRSKKQATVSKSSSEAEYRALASAICELQ

SEQ ID NO: 193500 - protein, 224 aa, Glycine max
  Coding DNA Sequence Number=SeqID_76722
MASRKRKSTTSRPAAQYDTRRFQSLEAWNRYTGNILSRNILPERNVKIYHTEFDKFKVELERHNLHKCLTNLQDGSIDVAVVKEFYANLYSPEDQPPKQARVRGHLIKIHADNLNEFLQTPVVLEEGESLPTYSRFCMSRSNPQEIEAMFCIPHKGFVLNAEGQPWKFLRKNLTTLTQMMQSYPLRLSSSFLRKLLKEASQGSFTRKLLREASQGSFSRKLPRL

SEQ ID NO: 193501 - protein, 71 aa, Glycine max
  Coding DNA Sequence Number=SeqID_76723
MNEVGNLLGLKMLSEDWMQNARLKLEDVMCEFQKGDVAGKFLKYMGAKKRTKRVVQIRNPATRPKPGSRPA

SEQ ID NO: 193502 - protein, 65 aa, Glycine max
  Coding DNA Sequence Number=SeqID_76724
  Homolog annotation: Hit_ID=Q99366; Match level="QueryCoverage=50%, HitCoverage=5%, E-value=7e-09, Identity=90%"; Hit description=DNA -directed RNA polymerase
MDKKYKFESIVIIKYTSQIIIKFKVNLLCNVNHTPLDETVKLFRLQFCRSRELSNQNLPTTSMCS

SEQ ID NO: 193503 - protein, 681 aa, Glycine max
  Coding DNA Sequence Number=SeqID_76725
  Gene Ontology: Mol. function=protein serine/threonine kinase activity; Cellular component=cell surface; Biological process =protein amino acid phosphorylation
  Homolog annotation: Hit_ID=Q5DMV1; Match level="QueryCoverage=96%, HitCoverage=97%, E-value=0.0, Identity=53%"; Hit description =Receptor lectin protein kinase-like
  Pfam annotation: Domain name=Lectin_legB; Domain location=22-266; Score=308.5; E_value=1.2e-89; Accession=PF00139.10; Description =Legume lectin domain
  Pfam annotation: Domain name=Pkinase; Domain location=352-620; Score =164.8; E_value=2.1e-46; Accession=PF00069.15; Description=Protein kinase domain
  Pfam annotation: Domain name=Pkinase_Tyr; Domain location=352-620; Score=92.8; E_value=1e-24; Accession=PF07714.7; Description=Protein tyrosine kinase
  Pfam module annotation: Pfam domain module=Lectin_legB::Pkinase::Pkina se_Tyr; Domain location=22-266::352-620::352-620
MASPTLVFVFLLFLSLLPQVIASKAVIFEGFDDENSELNLEGSSIIKTSRLLKLTNRSTNIVGHAFYATPFQMLNNTNQPYAYSFSTNFVFSIVSPSSGSGGFGLAFTIAPSTQFPGAEAGHYLGLVNSTNDGNESNHIFAVEFDTMNGYKDDSDTEGNHVGVNINGMDSNITEPAAYIKEGTDKVKEDFRMAKVDAVQAWIEYDGENKTLNVTIAPLSKPRPSKPIIKNHIIDLYNVMEESMYVGFSASTGQETSSHYLLGWSFAVNGVAPQLKISNLPNPPPKEKEPTSFPWVNIAIGVLSASTFCLLCILFCITCYRRYYMDFEVLEDWEMDCPHRFRYKDLHLATKGFIESHLIGVGGFGAVYKGVLPSTGAEVAVKRIVRSPFHGMREFAAEIESLGRLRHKNLVNLQGWCNKKNDLLLVYDFIPNGSLDYVLYKPNNNNFVLNWGQRFNILKGISAGLLYLHEEWEQVVIHRDVKTSNILIDAHLNARLGDFGLARLYNHGQLSHTTSVVGTIGYIAPELTRTGKASTSTDVYAFGVVLLEVATGKRPLDSDQFFLVEWVIEKYHLGQILEVVDPKLDSLYDEEEIELVLKLGLLCTQHRADYRPTMKQVTRYLNFDEPLPDIVDWGHGVSGSSRLSSGFLEVTYSMGTVETLGYLSSISMSTKSIDAGRQQIII

SEQ ID NO: 193504 - protein, 211 aa, Glycine max
  Coding DNA Sequence Number=SeqID_76726
MERSDSIYDGDIDTPRLRPPPCLWHPLKEATKADNGALAFDQDDGCDADDDEDDDKQNDVFSDAVDVLSLSEASDIMQQSEAAHSDSKDGLRLKLSESNGGPSPTYMINRFLPDANALVASSSAHFSNDAKVCDNCSHEGYLKGSTRHSHATSPKGCGLEFLFSWLMKNKLCAIKSPVLPSFTNVQKHRYSSKHTKHRTSVHKPCTNVKDV

SEQ ID NO: 193505 - protein, 149 aa, Glycine max
  Coding DNA Sequence Number=SeqID_76727
MGVEEVKIQMLPSCTTDEVSLVGQSIHTFLAWPTHLVKPLSQQATVSLAKPPQKPNPEIDDLLYLMALTISELFLRPYQRTLADGGHCAQGTPSCQCNRQKGSTECDYYVMHWMSTIILGSFRNNWETTIGAREIKGASNPVGTILSLS

SEQ ID NO: 193506 - protein, 88 aa, Glycine max
  Coding DNA Sequence Number=SeqID_76728
MNVPLNTELNADAIFVHLILGYKRALLWIKTNLFQIWGSVLELHSKRFERGLKNWSNVLNASTTAQREEPTWRPGLACLWRLSAHLAT

SEQ ID NO: 193507 - protein, 94 aa, Glycine max
  Coding DNA Sequence Number=SeqID_76729
RFVSKRPFRGNTGSNKIEENHSKCINLTQCEAKKSLAHRQGWAFSPGVKVYGELGFWLKACRMVGHDICQGTGLASGSGIKEMSHIISMIHMQQ

SEQ ID NO: 193508 - protein, 43 aa, Glycine max
  Coding DNA Sequence Number=SeqID_76730
MRKLIKERMENKVANFVGLNKVKWWLDRNIEMAITEVTGLQMR

SEQ ID NO: 193509 - protein, 178 aa, Glycine max
  Coding DNA Sequence Number=SeqID_76731
MARTRGLGRVIGRLVGRDRQDDHDAADVPERRRPTASARRQRVHQTTADARDMTEDIANMTNDVPDVAAEALEMRADIQGADGAEGSDADDAAEGFLGGPCDPLVLASFADHVAHAVWSGQEHPYLKLVSHGRKVTLIERSVPEIEGLVAATRLSPLIDCSVIIGDPGLISAFVERWH

SEQ ID NO: 193510 - protein, 63 aa, Glycine max
  Coding DNA Sequence Number=SeqID_76732
  Gene Ontology: Mol. function=zinc ion binding; Cellular component =intracellular
MERVVATVSNYHGSERFNLIKLISQTGGNYIGAMSKSITHLVSCFSGVSNGWHYRGTTDDITI

SEQ ID NO: 193511 - protein, 227 aa, Glycine max
  Coding DNA Sequence Number=SeqID_76733
  Gene Ontology: Mol. function=unfolded protein binding; Cellular component=cytoplasm; Biological process=protein folding
  Homolog annotation: Hit_ID=Q1H2B1; Match level="QueryCoverage=88%, HitCoverage=69%, E-value=3e-43, Identity=48%"; Hit description=Hsp33 protein
  Pfam annotation: Domain name=HSP33; Domain location=3-210; Score =143.5; E_value=5.7e-40; Accession=PF01430.10; Description=Hsp33 protein
MQGKLILQLQSQGSLQLLVVECTSDLNIRATAKVHGELLGDSLTEWLKQGQLVITLMPEEGEPYQGIVPLEGDNIASMLENYMLRSQQIDTRLWLTAEGDRAAGLLLQKLPQQQEQDLDCWNRVQHLAGTVTDPELLELDTTTLLQRLFVEEDVRLFSGRQIQAFCSCSQTNVTNMLQMLGLAEVRSILEEQGSIEIQCDFCHKHYVIDEEEALALFNDDDEHEVTH

SEQ ID NO: 193512 - protein, 91 aa, Glycine max
  Coding DNA Sequence Number=SeqID_76734
  Homolog annotation: Hit_ID=Q08068; Match level="QueryCoverage=44%, HitCoverage=68%, E-value=5e-12, Identity=80%"; Hit description=40S ribosomal protein S20
  Pfam annotation: Domain name=Ribosomal_S10; Domain location=3-68; Score=-8.4; E_value=0.0004; Accession=PF00338.12; Description =Ribosomal protein S10pS20e
MLATGNRLLPYVCVDLVRGAKDKQLRIKGPVRMPTKVLHITTRKSLCGEVLNMHALCIRSSFAIYLLVCKVWNVLNGKFGWRLLKEKGRLS

SEQ ID NO: 193513 - protein, 100 aa, Glycine max
  Coding DNA Sequence Number=SeqID_76735
MATKSNSNCRIKRSHNMSLATLFGKLQEHELELIRLHQHEENDKKRKGIALKAASSSIQEESNKEDLNEIKEDDDFRFFVKRFNKFLRNKKSKEIKHQSK

SEQ ID NO: 193514 - protein, 98 aa, Glycine max
  Coding DNA Sequence Number=SeqID_76736
MKEEHQTKNNVEVDYGCNSVVPQPHFLFSLISLQFLLILKVQPLPQPLSRLFIGHEGTWWTWSSLRLIRQVGEVLIFTRSLSQSAGLASHPLSETFLG

SEQ ID NO: 193515 - protein, 79 aa, Glycine max
  Coding DNA Sequence Number=SeqID_76737
MAIAENPQGKLVIKIFSPEKEGGYCACGVQEQREEEAKGGACNDDGPLQKDAMLGDVELCPPMCVLVGSHISFRASTYW

SEQ ID NO: 193516 - protein, 69 aa, Glycine max
  Coding DNA Sequence Number=SeqID_76738
MWYHFSVKNLVGRLGVHDWTCLTMGRPVRVTLFCENAPTMWDRHRLTGALKPDDPQGLHSEKSVKASPS

SEQ ID NO: 193517 - protein, 120 aa, Glycine max
  Coding DNA Sequence Number=SeqID_76739
  Homolog annotation: Hit_ID=Q1SK64; Match level="QueryCoverage=77%, HitCoverage=10%, E-value=1e-07, Identity=34%"; Hit description =Transposase
YALNEIAGEFECVPYASKNSSRCGCVMRTTYGLPCSYQGLCETEVTITEEMKTISKRFEQLDICGKVHLKTKLREIAYPDLNFMCPPPEKNPNRATGGGALESTRDATIANGERLRDYVE

SEQ ID NO: 193518 - protein, 122 aa, Glycine max
  Coding DNA Sequence Number=SeqID_76740
MEQHGHGMYYTPPTFSQYPSQMYQYPFEGHDTDISASEHSFGGVAKTHPHFSWPTMTPSQQHDAPMATPNAPLAPQWNVPRTIPDMGDLLGVDLRHEFSTEAEQVEAGRHRSRRNPDRQARR

SEQ ID NO: 193519 - protein, 241 aa, Glycine max
  Coding DNA Sequence Number=SeqID_76741
  Pfam annotation: Domain name=Transposase_23; Domain location=27-95; Score=-9.4; E_value=0.012; Accession=PF03017.5; Description =TNP1ENSPM transposase
MKNSHGNYSHSCMHIFYVVSRGIIVASNDQLDGLYEENPSRLVALGRLYEGSTTIHNIPLLHVQVKVGVEEVKDAEALVPVPTNEVTLVGQTLNTFLAWPTHLVKRLSEQAAVSPAKPPESPDEEVDDPLYLMTLTIPQLFLKPLQVMWDATIFGVFNQNFPLYIKHEDLSEIAHGGQCLSISVIQLWILHLTETSVRARNSMDSLSHSPFRDLDNHNLNMKVTSRVGYRVQNEMFTLEPT

SEQ ID NO: 193520 - protein, 60 aa, Glycine max
  Coding DNA Sequence Number=SeqID_76742
MDKDGKKSSDPKGDKRYNDLILEKTRALKKTMEKWDAQLATSSSSENNKGDSKGKKCEKY

SEQ ID NO: 193521 - protein, 52 aa, Glycine max
  Coding DNA Sequence Number=SeqID_76743
GLDCQNFAQADYRSTSAVNKSADNSGGVRLFPAICISVGIVWRQSLIDITGE

SEQ ID NO: 193522 - protein, 129 aa, Glycine max
  Coding DNA Sequence Number=SeqID_76744
MFLGILLCLVISSRVCIISVYLSERAESWLLHLIYTHLRSLSTRPPGAEEPVVHVDPATGKADGPYRKKLRTYLGIVARDKVDVTYENWKEVPTTQKDLIWEDIQAEFEIQEASDNSTKRKLLQTVGER

SEQ ID NO: 193523 - protein, 190 aa, Glycine max
  Coding DNA Sequence Number=SeqID_76745
  Homolog annotation: Hit_ID=Q1SPG0; Match level="QueryCoverage=30%, HitCoverage=15%, E-value=9e-07, Identity=45%"; Hit description=Zinc finger, SWIM-type
MVATVLGLGWWETTMGSGAGMGAAVGGDLGEDGVVLGEAIYNLFKAVHDGRVAVVSVHGWREAKLHYANYTNSDASLRVAMVFLCCLLGVAGVVLLSHQLPPFFLKFTNVNVPKNATLELFGKCIVIVRCCIPSQIPCTQSVMSIRKHPYRIPHGMRRGERRRHPLENKPWKEKLHHQESALDKKLRKKA

SEQ ID NO: 193524 - protein, 72 aa, Glycine max
  Coding DNA Sequence Number=SeqID_76746
MDYQSIWFNKQSWIGVLTVGRQGGMEECSKNNGGEGQTRHNKEGKEGHKRMKEACRRMKEKLMSDECRNNNP

SEQ ID NO: 193525 - protein, 189 aa, Glycine max
  Coding DNA Sequence Number=SeqID_76747
  Gene Ontology: Mol. function=hydrolase activity
  Homolog annotation: Hit_ID=Q2HRX8; Match level="QueryCoverage=95%, HitCoverage=27%, E-value=1e-20, Identity=34%"; Hit description=IMP dehydrogenase/GMP reductase
  Pfam annotation: Domain name=DUF1723; Domain location=43-92; Score =53.0; E_value=1e-12; Accession=PF08330.1; Description=Protein of unknown function (DUF1723)
ERPDLKLVSHGRKVDKFGRPTAEIKGMIAATGLDPLIRCSVITTDPRLISAFVERWHRETSSFHLPVGEVMITLDDVSSLLHIPITSALHSFEPLVTSDAVALLTELLEVTADEATAETRQAGGPHVRLSWLRDMYQSRCRARQWVAAARTYLLHLVGCTLFANKSATHVHVVHLQAFRDLGQAGAFSL

SEQ ID NO: 193526 - protein, 63 aa, Glycine max
  Coding DNA Sequence Number=SeqID_76748
MARKLNSIMSYSKGDLENYCTMIKMWVIRRVARINIEMILMDEKADRIVAQIENVDPVLILTT

SEQ ID NO: 193527 - protein, 79 aa, Glycine max
  Coding DNA Sequence Number=SeqID_76749
MALTRIWEGGKEALFGTDTDCLQLFMWEMRPGGMFVQRREAAADNGGGGNGNMTTTVLITVVHASSHYDLHLPTNSTFC

SEQ ID NO: 193528 - protein, 105 aa, Glycine max
  Coding DNA Sequence Number=SeqID_76750
  Gene Ontology: Mol. function=transcription regulator activity; Cellular component=nucleus; Biological process=regulation of transcription
  Homolog annotation: Hit_ID=Q5MP56; Match level="QueryCoverage=58%, HitCoverage=27%, E-value=4e-22, Identity=83%"; Hit description =Barren stalk1
  Pfam annotation: Domain name=HLH; Domain location=46-93; Score=33.3; E_value=8.8e-07; Accession=PF00010.16; Description=Helix-loop-helix DNA-binding domain
  Subcellular localization annotation: CTP_CleavageSite=66; ConfidenceScore=5.28e-01
MECINNPTSCEGSSSSSKHPNKSNREKKGVRKSNKGGGGGVRLSTDPQSVAARERRHRISDRFKILQSMVPGGSKMDTVSMLECAIHYVKFLQTEILLHQALIDF

SEQ ID NO: 193529 - protein, 181 aa, Glycine max
  Coding DNA Sequence Number=SeqID_76751
  Gene Ontology: Mol. function=oxidoreductase activity; Cellular component=membrane; Biological process=electron transport
  Homolog annotation: Hit_ID=Q2MIZ9; Match level="QueryCoverage=45%, HitCoverage=17%, E-value=6e-19, Identity=58%"; Hit description =Cytochrome P450 monooxygenase CYP710A15
MYILKRIHNIISPNIVPISLKGIRLRTKLHELHLDNNKICFLSVDADSAEKTKKTDSPPLNIRFLNPSISGDTSPQFSTNAEIGGYLFNFLFMAQDASTSSLLWAVALLESHLEVLAKVRAKVSGIWRWHRSEASHGRIGRNGANKESDEEFRVLICKTKEETWVLISLSHSTLVLQESMS

SEQ ID NO: 193530 - protein, 99 aa, Glycine max
  Coding DNA Sequence Number=SeqID_76752
MMYVVYVLMFMVSMLTSNNMRIWHVQFLEFGTFTLSFIQPDREISNGPNLSWVYCDAILPRRGPITRVMARGLQENWIRDVGEGFRILMNLRVDFGFMG

SEQ ID NO: 193531 - protein, 1004 aa, Glycine max
  Coding DNA Sequence Number=SeqID_76753
  Gene Ontology: Mol. function=protein binding; Cellular component =integral to membrane; Biological process=defense response to fungus
  Homolog annotation: Hit_ID=Q1T2V8; Match level="QueryCoverage=87%, HitCoverage=90%, E-value=0.0, Identity=42%"; Hit description=Leucine- rich repeat
  Pfam annotation: Domain name=LRRNT_2; Domain location=11-53; Score =36.7; E_value=7.9e-08; Accession=PF08263.3; Description=Leucine rich repeat N-terminal domain
  Pfam annotation: Domain name=LRR_1; Domain location=107-127; Score =5.9; E_value=23; Accession=PF00560.23; Description=Leucine Rich Repeat
  Pfam annotation: Domain name=LRR_1; Domain location=138-160; Score =12.3; E_value=1.4; Accession=PF00560.23; Description=Leucine Rich Repeat
  Pfam annotation: Domain name=LRR_1; Domain location=162-184; Score =10.2; E_value=3.5; Accession=PF00560.23; Description=Leucine Rich Repeat
  Pfam annotation: Domain name=LRR_1; Domain location=186-209; Score =12.8; E_value=1.2; Accession=PF00560.23; Description=Leucine Rich Repeat
  Pfam annotation: Domain name=LRR_1; Domain location=210-232; Score =6.5; E_value=18; Accession=PF00560.23; Description=Leucine Rich Repeat
  Pfam annotation: Domain name=LRR_1; Domain location=234-256; Score =9.3; E_value=5.3; Accession=PF00560.23; Description=Leucine Rich Repeat
  Pfam annotation: Domain name=LRR_1; Domain location=282-303; Score =11.1; E_value=2.4; Accession=PF00560.23; Description=Leucine Rich Repeat
  Pfam annotation: Domain name=LRR_1; Domain location=305-328; Score =17.5; E_value=0.048; Accession=PF00560.23; Description=Leucine Rich Repeat
  Pfam annotation: Domain name=LRR_1; Domain location=330-352; Score =8.9; E_value=6.1; Accession=PF00560.23; Description=Leucine Rich Repeat
  Pfam annotation: Domain name=LRR_1; Domain location=354-375; Score =7.0; E_value=14; Accession=PF00560.23; Description=Leucine Rich Repeat
  Pfam annotation: Domain name=LRR_1; Domain location=379-401; Score =12.5; E_value=1.3; Accession=PF00560.23; Description=Leucine Rich Repeat
  Pfam annotation: Domain name=LRR_1; Domain location=403-426; Score =10.4; E_value=3.2; Accession=PF00560.23; Description=Leucine Rich Repeat
  Pfam annotation: Domain name=LRR_1; Domain location=428-444; Score =7.0; E_value=14; Accession=PF00560.23; Description=Leucine Rich Repeat
  Pfam annotation: Domain name=LRR_1; Domain location=449-471; Score =14.7; E_value=0.34; Accession=PF00560.23; Description=Leucine Rich Repeat
  Pfam annotation: Domain name=LRR_1; Domain location=473-494; Score =6.0; E_value=21; Accession=PF00560.23; Description=Leucine Rich Repeat
  Pfam annotation: Domain name=LRR_1; Domain location=497-518; Score =13.9; E_value=0.57; Accession=PF00560.23; Description=Leucine Rich Repeat
  Pfam annotation: Domain name=LRR_1; Domain location=543-565; Score =14.2; E_value=0.47; Accession=PF00560.23; Description=Leucine Rich Repeat
  Pfam annotation: Domain name=LRR_1; Domain location=567-586; Score =11.4; E_value=2.1; Accession=PF00560.23; Description=Leucine Rich Repeat
  Pfam annotation: Domain name=LRR_1; Domain location=591-613; Score =13.6; E_value=0.74; Accession=PF00560.23; Description=Leucine Rich Repeat
  Pfam annotation: Domain name=LRR_1; Domain location=615-637; Score =12.5; E_value=1.3; Accession=PF00560.23; Description=Leucine Rich Repeat
  Pfam annotation: Domain name=LRR_1; Domain location=639-660; Score =9.5; E_value=4.7; Accession=PF00560.23; Description=Leucine Rich Repeat
  Pfam annotation: Domain name=LRR_1; Domain location=689-712; Score =6.0; E_value=22; Accession=PF00560.23; Description=Leucine Rich Repeat
  Pfam annotation: Domain name=LRR_1; Domain location=762-784; Score =4.2; E_value=46; Accession=PF00560.23; Description=Leucine Rich Repeat
  Pfam annotation: Domain name=LRR_1; Domain location=786-808; Score =15.1; E_value=0.25; Accession=PF00560.23; Description=Leucine Rich Repeat
  Pfam annotation: Domain name=LRR_1; Domain location=810-832; Score =14.6; E_value=0.37; Accession=PF00560.23; Description=Leucine Rich Repeat
  Pfam annotation: Domain name=LRR_1; Domain location=83-105; Score =14.1; E_value=0.51; Accession=PF00560.23; Description=Leucine Rich Repeat
  Pfam annotation: Domain name=LRR_1; Domain location=834-855; Score =10.9; E_value=2.7; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1; Domain location=11-53::107-127::138-160::162-184::186-209::210 -232::234-256::282-303::305-328::330-352::354-375::379-401::403 -426::428-444::449-471::...
  Pfam module annotation: Domain location=473-494::497-518::543 -565::567-586::591-613::615-637::639-660::689-712::762-784::786 -808::810-832::83-105::834-855
VYFTGVSAHIVEDQQQSLLKLKNSLKFKNENSTKLVSWNSSIDCSEWRGVTCDKEGRVIGLDLSGESINGGLDNSSTLFKLQNLQQLNLAANNLGSEIPSGFNKLKRLTYLNLSHAGFVGFLPDKGNEWCNALLQLHSLQELGMSNCNLSGPLDPLLTRLENLSVIRLDQNNLSSSVPETFADFQNLTTLHLSSCELTGIFPDKIFKVATLSDIDLSFNYHLYGSLPEFSVNGPLRTLIVRDTEFSGSIPASINNLRQLFVIDTSNCYFNGTLSSSMSRLRELTYLDLSFNDFIGPIPSLNMSRNLVYLDLSHNDFTGSITSVHLEGLPKLVQFDLQDNFLNGNLPSSIFSLSLLQSIQLSNNNFQGQLNKFLNISSSVLEILDLSSNDLEGPIPTDIFSLRSLNVLRLSSNRLNGTLKLDVIQQLENLTTLSLSHNELSIDMNVTDTQITTLDLSSNYIQGSIPTWIWQLDSLVQLNLSHNLLINLEGAAQNTSSNLRLLDLKSNQLQGKLPIFPKNIIYLDYSSNNICFTIPSNVGTYLSSIIFLSLSNNSLSGNIPHSLCNNSNLLVLDVSYNQFNGKIPECLTQSDTLVVLNLQHNQFNGSIPDKFPLSCALKTLDLNSNLLRGPIPKSLANCTSLEVLDLGNNQVDDGFPCFLKTISTLCVMVLRGNKFHGHIGCSHTNSTWHMLQIVDVAFNNFSGLLPAKCFKTWKAMMLDEYHDGSKLIRIGSQVLIYSGIYYQDSVILTSKGLQMEFVKILSIFTSVDFSSNNFEGTIPEELMNFTRLIFLNLSHNALAGQIPSSIGNLIQLESLDLSRNRFDGEIPSQLASLNFLSYLNLSYNRLVGKIPVGTQLQSFDASSYAGNAELCGVPLPKNCSDMSNAEEKVPEVHTDFGVKFDWTYVSIGVGFGVGAGLVVAPSLFLEILKKWSNHKIDKVLLVVLPMFGLTWIPIDDDEAEEDTEENNSDMEEECDYNEEQTILCHQRFQGRYCVLCSKLDIRKKK

SEQ ID NO: 193532 - protein, 570 aa, Glycine max
  Coding DNA Sequence Number=SeqID_76754
  Homolog annotation: Hit_ID=Q5XWK4; Match level="QueryCoverage=22%, HitCoverage=32%, E-value=1e-25, Identity=48%"; Hit description =Expressed protein-like
  Pfam annotation: Domain name=DUF616; Domain location=420-570; Score =15.4; E_value=4e-14; Accession=PF04765.4; Description=Protein of unknown function (DUF616)
MSTVATRWRQFKSFLTSKFVYADNEGQQISDPTMKYGLDPATWAEFAKSRQTPNWQGIRKKGSFVPHGRQDIVNTTIGRPEHLGRVRVAGTCVTINQYFGQASRSSSTSPPSITQQQLADIIGDLKDQVRKEVEEENKQQQEAWRREVESVEIKVLGARVSTKGSCTEPETKGVAKEPSDVVVDLMGLYVVHDQSTMLVALGKLYDTSSSTHNVPYANDVVRVSVVTVYHGDAQIPFLMSEVRFVSQAVGIFVAWPKHLFKVVSHEDSQKPLPNSVGSAERGTTMAAVDSLGELVKNLFHVYQKPVELSWDGNLVVWFCSLRKKPDVHIKAAINSAMKKIFTTLEGKADGPAPRWIEPKSHLQAGGYECRYYVMHWMWCIFSGGLKNEWNKAACPVCYLPVDEAIALMPKLPSPSPVLKNLAFIYEETLSRNGEFGGTKPDHNTGFDMDEDDLIEMEQCHDVVDALAIFGNFDEINDPTNISDYSKETICFLMFVDEEIESNLRSSARLGTRKKIGLWRIIVSHNLPYTDPRGTGKIPKLLLHRMVPNAHYSIWLDRKLELLVDPYQILE

SEQ ID NO: 193533 - protein, 119 aa, Glycine max
  Coding DNA Sequence Number=SeqID_76755
MGKLDHLEERLRAIKGGEDYSFANLKELFPIPNIITPLKFKVLDFDKYKGTTCPKNHLKMYCRKMGAYAKDEELLIHSFQESLTGVVVTWYTNLEPSRVHSWEDLMVAFVRQCQYNGFG

SEQ ID NO: 193534 - protein, 87 aa, Glycine max
  Coding DNA Sequence Number=SeqID_76756
MKADMEAIKEKMATMMEAMMSVKKIMEANTVAIVATNVVAKHAFPPYGLPLNYTPPNVAYTPNKNVNNSTPIPIESQQPQTDHAHVY

SEQ ID NO: 193535 - protein, 150 aa, Glycine max
  Coding DNA Sequence Number=SeqID_76757
  Homolog annotation: Hit_ID=Q1SLU2; Match level="QueryCoverage=44%, HitCoverage=6%, E-value=7e-12, Identity=50%"; Hit description =Leucine-rich repeat, plant specific
MVIDEDHDGFPYFLNTISTLWVMVLRGNKLHGNIECSQTNGIEHMVQIVDRASNSFSGSLLAKCFKTWKAMVVDEDHDEFPYFLNTISTLHVMVLRENKLHEKVEDWNSSLNAQDRPKASTCLAANSSLARKRPTKKLKGVLSANPALSA

SEQ ID NO: 193536 - protein, 149 aa, Glycine max
  Coding DNA Sequence Number=SeqID_76758
MDAGCQSNCVGAHRIDVTSASIARLCGRKLRVMMVGVDLILIHAVRGLHTLSALQIHQLAKPNPLPSTTEGYILCGTSRGCIYLGCNTENKRGYISCGSVQVEGTSIWLFKENKGGYILCGSLLVKDFTRLLEISRTSGCLGTGRRHGL

SEQ ID NO: 193537 - protein, 87 aa, Glycine max
  Coding DNA Sequence Number=SeqID_76759
MEEEELSKLSQDIGEMWLRLVKGLRKALLLSYEEVKNKNNNLDKSKAEIKVHNGKVKSVGKKKTNTRFILVRSQPVPTSSPQATTGS

SEQ ID NO: 193538 - protein, 220 aa, Glycine max
  Coding DNA Sequence Number=SeqID_76760
  Homolog annotation: Hit_ID=Q1SLU2; Match level="QueryCoverage=23%, HitCoverage=4%, E-value=6e-09, Identity=60%"; Hit description =Leucine-rich repeat, plant specific
  Pfam annotation: Domain name=LRR_1; Domain location=16-38; Score=0.7; E_value=2.1e+02; Accession=PF00560.23; Description=Leucine Rich Repeat
  Pfam annotation: Domain name=LRR_1; Domain location=40-62; Score =14.4; E_value=0.43; Accession=PF00560.23; Description=Leucine Rich Repeat
  Pfam annotation: Domain name=LRR_1; Domain location=64-86; Score=8.5; E_value=7.5; Accession=PF00560.23; Description=Leucine Rich Repeat
  Pfam annotation: Domain name=LRR_1; Domain location=88-111; Score =9.2; E_value=5.4; Accession=PF00560.23; Description=Leucine Rich Repeat
  Pfam module annotation: Pfam domain module=LRR_1::LRR_1::LRR_1::LRR _1; Domain location=16-38::40-62::64-86::88-111
MVVDEDHNGSNFNHIAFAFVDFSFNNFEGSILEELMSFTTLISLNLSHNALAGKIPSSMGNLKELQSLDLSSNNLDGENSSQLQSLTLLSYLNLSYNRLVGKIPIIVFVAANDGGGCQPLTMPIRCLLGNYEALEGARASLLIFIGFGLAKLLGRVVCCDYVFSGPDSALKGACASLLIFTGFGLAKVGLFGMTVFSLCISSCHHHFVFDVVEYEHTNDL

SEQ ID NO: 193539 - protein, 72 aa, Glycine max
  Coding DNA Sequence Number=SeqID_76761
MLPVINQSALKRVKEHGEEREGLGGVGGSPEVAWRCCLAAMVIMKNDEVCTLLEVIWGVVINYQTLKYEFQV

SEQ ID NO: 193540 - protein, 162 aa, Glycine max
  Coding DNA Sequence Number=SeqID_76762
MSANDHAILHDRTHQPTKKSLLELSSYDALLTHNKLLSKQLEILTEILGCTICGEAHETGQCIPIKENTQEIHYIGNQQRQGYTQVGFLGFQQGLYNQQGQWKSHLGNQFNKDQGGPSSRPIQQGPNIFQRIAKLEETLTQFMQVIVRLPASAPDRTSSIKR

SEQ ID NO: 193541 - protein, 111 aa, Glycine max
  Coding DNA Sequence Number=SeqID_76763
IVPARHPVDSKKSNRVLGFLALITGLCKFYGVPVAQSKVIRPPINQTFIEKYCAPRQAQGETPQQPRNGRQQATDAPPPPPKPLSSSSKAGALPTTCGRQQATKSKAKDKQ

SEQ ID NO: 193542 - protein, 45 aa, Glycine max
  Coding DNA Sequence Number=SeqID_76764
MAQAVSIGVKYSRGDSTMAMFDVLRALHVLSVARGIMAPPTLSSL

SEQ ID NO: 193543 - protein, 88 aa, Glycine max
  Coding DNA Sequence Number=SeqID_76765
MAIVDFSTATVCLRRVFASGKCTGSHKYYKTDTLALVGALFLGINEHKFFTMEEGETYKINGSGMEKDERLLDTPLQGEDESRTSSSP

SEQ ID NO: 193544 - protein, 275 aa, Glycine max
  Coding DNA Sequence Number=SeqID_76766
  Gene Ontology: Mol. function=RNA-directed DNA polymerase activity; Biological process=RNA-dependent DNA replication
MSSYAKHWKEILSNNGKLENFGIVGLNEESFAILRKLLPKTKDPDKFTIPCLIEGSYFDKCLCDLGASVKLIPYFIFKKLGIIDLEPTNITLHLANRSVVYPRGEIEDELIKGVFLSVGMPDPLEKVLSNEDFDWELNLDVEEILTFLHSQHGPKPSSFERLEWGNGPKPYVEESSNLALKAFPSSIKYVFPKTLSSLPILIFEVLHEIEVEKLLWVLRDNKEAFGINTEECFPPKQIFQRKLNPNMMEVVDGENVKPTFMMNAHRVKAYNKGFQ

SEQ ID NO: 193545 - protein, 107 aa, Glycine max
  Coding DNA Sequence Number=SeqID_76767
MEEGYSTNKPPMFRGVKYDYWKEQMILCFKSIHIDLWDNVENEEYTKVHNIKSAKQMWDTLAITYEGMPQVKRNKLSPYTQFIKPQSFNVIVSDYNRGGYQHDRSAP

SEQ ID NO: 193546 - protein, 106 aa, Glycine max
  Coding DNA Sequence Number=SeqID_76768
MAPKKLLAKRARKDAVGEGSSVAPQERRVQLREGEYAEFQEAVDSTCSAHGIRVFLESSIQYLWGKRVQKIPKMEGKRVIWKTFLTPGSPRLAFGSPGPSNNLGVK

SEQ ID NO: 193547 - protein, 326 aa, Glycine max
  Coding DNA Sequence Number=SeqID_76769
  Gene Ontology: Mol. function=structural constituent of ribosome; Cellular component=intracellular; Biological process=electron transport
  Homolog annotation: Hit_ID=P76342; Match level="QueryCoverage=68%, HitCoverage=66%, E-value=5e-92, Identity=70%"; Hit description =UPF0190 protein yedY
  Pfam annotation: Domain name=Oxidored_molyb; Domain location=194-326; Score=64.1; E_value=4.5e-16; Accession=PF00174.9; Description =Oxidoreductase molybdopterin binding d
MAREAEQHGIIVMQFQLFGIDDGHQACQPLRQFLRQIKLKAQPTSISNIASKLNKPTVRASRAGANLSKLSQLPIQISARPAPGFATLRREYNVKLIDLPEKAMKRTHILTEADVTPESIFNLRRRQVLKALGLGAAAASLPGGAHADVLSWFKGNDRPPAPAGRDLQFSKPAQWQADLPLTPFDKVAGYNNFYEFGLDKADPAANAGTLKTDPWQLRIEGEVAKPMTLDMDDIFKRFAMEQRIYRMRCVEAWSMVIPWVGFELNKLLKLAEPTSNARYVAFQTLYAPDQMPGQKDRFIGGGLDYPYVEGLRLDEAMHPLTLLSTG

SEQ ID NO: 193548 - protein, 826 aa, Glycine max
  Coding DNA Sequence Number=SeqID_76770
  Gene Ontology: Mol. function=signal transducer activity; Cellular component=membrane; Biological process=signal transduction
  Homolog annotation: Hit_ID=P0A9X4; Match level="QueryCoverage=39%, HitCoverage=94%, E-value=1e-180, Identity=99%"; Hit description=Rod shape-determining protein mreB
  Pfam annotation: Domain name=Actin; Domain location=507-826; Score= -184.4; E_value=0.00012; Accession=PF00022.9; Description=Actin
  Pfam annotation: Domain name=EAL; Domain location=281-480; Score =74.7; E_value=2.9e-19; Accession=PF00563.11; Description=EAL domain
  Pfam annotation: Domain name=FtsA; Domain location=658-826; Score= -15.0; E_value=0.0023; Accession=PF02491.10; Description=Cell division protein FtsA
  Pfam annotation: Domain name=GGDEF; Domain location=106-267; Score =68.4; E_value=2.2e-17; Accession=PF00990.12; Description=GGDEF domain
  Pfam annotation: Domain name=MreB_Mbl; Domain location=507-826; Score= 760.9; E_value=8.2e-226; Accession=PF06723.3; Description=MreBMbl protein
  Pfam module annotation: Pfam domain module=Actin::EAL::FtsA::GGDEF::Mr eB_Mbl; Domain location=507-826::281-480::658-826::106-267::507-826
MALRVVVLDPAKTWFRSFTGAYTLIILLTVVAIMSALLVMTHRWLNRRWQHMERLEARAERILAGERAPRSDTIAEWPPKASRAIDLLLGDLQEAGEQRLRIDTLIRTFAAQDSRTGLNNRLFFDNQLATLLEDQEDVGTHGVVMMVRLPDLDTLHETLGPTLVDEYLFDLVNMLSTFVLRYPGALLARYFRSDFAVLLPHRTLKEANSIADQLINAVDSLPPMRMVDRDDLIHIGISAWRSGESVSQVMENVELATRRAALQGGNNWSVGEGNTLEMGRGSVRWRTLLENTVNRGGPRLYQKPAVLLDGKVHHREMLARVFDGDKEVVSAEFMPLVLQLGMADSWDRQLVMRIAALSEVWPDETLALPADVCQHINRLVPVFRMLTAFGCRIAVDQAGLTVVSSAYIKQFPIELIKLDPGLIRNIERRTENQLFVQSLLEVCKSTPTKVFAAGVRTRAEWQTLAGLGVAGGQGDFFAPSLPADFIFRPQLAGLSLSMFKKFRGMFSNDLSIDLGTANTLIYVKGQGIVLNEPSVVAIRQDRAGSPKSVAAVGHDAKQMLGRTPGNIAAIRPMKDGVIADFFVTEKMLQHFIKQVHSNSFMRPSPRVLVCVPVGATQVERRAIRESAQGAGAREVFLIEEPMAAAIGAGLPVSEATGSMVVDIGGGTTEVAVISLNGVVYSSSVRIGGDRFDEAIINYVRRNYGSLIGEATAERIKHEIGSAYPGDEVREIEVRGRNLAEGVPRGFTLNSNEILEALQEPLTGIVSAVMVALEQCPPELASDISERGMVLTGGGALLRNLDRLLMEETGIPVVVAEDPLTCVARGG

SEQ ID NO: 193549 - protein, 693 aa, Glycine max
  Coding DNA Sequence Number=SeqID_76771
  Homolog annotation: Hit_ID=P0A8T1; Match level="QueryCoverage=40%, HitCoverage=95%, E-value=1e-129, Identity=80%"; Hit description =Ribosomal protein L11 methyltransferase
  Pfam annotation: Domain name=Carb_anhydrase; Domain location=474-691; Score=94.8; E_value=2.6e-25; Accession=PF00194.11; Description =Eukaryotic-type carbonic anhydrase
  Pfam annotation: Domain name=Cons_hypoth95; Domain location=293-437; Score=-67.1; E_value=0.035; Accession=PF03602.5; Description =Conserved hypothetical protein 95
  Pfam annotation: Domain name=MTS; Domain location=292-456; Score= -52.7; E_value=6.9e-05; Accession=PF05175.4; Description =Methyltransferase small domain
  Pfam annotation: Domain name=Methyltransf_11; Domain location=329 -421; Score=12.6; E_value=0.0032; Accession=PF08241.2; Description =Methyltransferase domain
  Pfam annotation: Domain name=Methyltransf_12; Domain location=329 -425; Score=28.6; E_value=2.3e-05; Accession=PF08242.2; Description =Methyltransferase domain
  Pfam annotation: Domain name=PrmA; Domain location=176-459; Score =526.9; E_value=2.1e-155; Accession=PF06325.4; Description=Ribosomal protein L11 methyltransferase (PrmA)
  Pfam annotation: Domain name=UPF0020; Domain location=299-460; Score=- 51.3; E_value=0.0083; Accession=PF01170.9; Description=Putative RNA methylase family UPF0020
  Pfam module annotation: Pfam domain module=Carb_anhydrase::Cons _hypoth95::MTS::Methyltransf_11::Methyltransf_12::PrmA::UPF0020; Domain location=474-691::293-437::292-456::329-421::329-425::176 -459::299-460
MHRGIILGTIVVVILMLGMHLAGALGRAVLPDLAIPDRVIPTLMITVLPPMAAGVFLAAPMAAIMSTINAQLLQSSATLIKDLYLRIAPQHSENEARLRLLSGTITFVLGLLLLLAAWNPPDMIIWLNLLAFGGLEAWHGGGSRMLYAACQPENRTVGLSPYRAIVDIKPAGLPGGTGEHAETLSDALMDVGAVSVTFQDTHDNPVYEPLPGETRLWGDTDVIGLFDAETAMDDVVAELSQHPLLGSGFRHKIEQIEDKDWEREWMDNFHPMRFGERLWICPSWRDVPDPDAVNVMLDPGLAFGTGTHPTTSLCLSWLDGLDLQGKTVIDFGCGSGILAIAALKLGAAQAIGIDIDPQAIQASRDNAERNGVAGRLSLYLPHQQPENLQADVVVANILAGPLRELAPLISVLPKAGGHLGLSGVLASQAKSVCEAYAERFALDAVAEKEEWCRITGTAAPGDSAIPVNRAAAAWDYAQPQQWGDLSPDFHVCKQGVNQSPIDIRQALHASLPALTLTLELQARQAAIVNNGHTVQINLQQGDTLTLDGETFTLKQFHFHTPSENLIDGKRYPLEGHFVFSDEQQQLAVIGVMFEAGAANPVLTTLLDTLPAQVNQPATLQQDVDITPLLPADRRYYRFSGSLTTPPCSEGVRWLVMKQPVTASAQQLQAFSAVLGEHGNSRPVQPLNGRLVVE

SEQ ID NO: 193550 - protein, 450 aa, Glycine max
  Coding DNA Sequence Number=SeqID_76772
  Gene Ontology: Mol. function=transferase activity, transferring nitrogenous groups; Cellular component=cytoplasm; Biological process= ethylene biosynthetic process
  Homolog annotation: Hit_ID=Q9SEE8; Match level="QueryCoverage=99%, HitCoverage=94%, E-value=0.0, Identity=83%"; Hit description=1 -aminocyclopropane-1-carboxylic acid synthase
  Pfam annotation: Domain name=Aminotran_1_2; Domain location=16-397; Score=399.6; E_value=4.5e-117; Accession=PF00155.11; Description =Aminotransferase class I and II
EYEKNPYDKVHNPKGIIQMGLAENQLSFDLLESWLAKNLDVAGFKRDGKTIFRELALFQDYHGLPSFKKALVDFMAEIRGNKVTFDPNHIVLTAGATSANETLMFCLAEQGEAFLLPTPYYPGGEPGLRLFQYNATVPIASKSRRQALRQAYEDAKKRNLRVKGVLVTNPSNPLGTTMSRSELNLLVDFIKEKNDMHLISDEIYSGTVFSSPGFVSVMEVLKERNDVVTDNGVWNRVHVVYSLSKDLGLPGFRVGAIYSENDTVVAAATKMSSFGLVSSQTQYLLSAMLGDKKFTRNYIAENKKRLKRQQRMLVSGLLKTGISCLDSNAGLFCWVDMRQLLHSNTFKAEMELWKKIVYQVGLNISPGSSCHCTEPGWFRVCFANMSEETLALAMKRLKNFVAAESQRNSSSGCSAGALLNNNNGSFKRKSLTKWVFRLSSRDHHREQEER

SEQ ID NO: 193551 - protein, 181 aa, Glycine max
  Coding DNA Sequence Number=SeqID_76773
MASWKRRVVPAQGGDSTWDSSRFTFETAWHRYQDNVHLRNIIPERNVELALDLGTPGRGFVLNADGAPWKLLRKDLTTLAQTWSDKTDLRSCNKDGHGLGQFHLRIARTPQIHPSHSSSPVILALELAHQTPRYSHNHHHRPHVTNTHPLQLSWIYIERCSSPSIRANRSSSNIFIDFPFT

SEQ ID NO: 193552 - protein, 114 aa, Glycine max
  Coding DNA Sequence Number=SeqID_76774
MAKAEHPRRKLVIKIFPPGSKVSYSCGANTPKDSIVSKVCELKNKKGYYAMTMWVNTENPSESCVTDSRISRTEMATRVNTKNQSKVCESKKKKEDSVRVECKNREKKKQKVEH

SEQ ID NO: 193553 - protein, 60 aa, Glycine max
  Coding DNA Sequence Number=SeqID_76775
MVMLMQAERLLLCAWREMMVFQTTTFRGDELGVVEEEEEVAVGDHSSKRLRAERGVYGSF

SEQ ID NO: 193554 - protein, 124 aa, Glycine max
  Coding DNA Sequence Number=SeqID_76776
MWRLWRNVVPVKKNLKAKIESFDPTCPFCGKEEEMVEHEFLFRKERRNEWVFEGKSIPIKLILDRAFWVTYPDLEIKRDQALNHPSHRSPTLQDEGVKQNFDEATKENFGIGMGLIVETITGRS

SEQ ID NO: 193555 - protein, 106 aa, Glycine max
  Coding DNA Sequence Number=SeqID_76777
MATSQQEDATVATTGVHQPNKEVQLVSKTKKRIAKFDIAEATKVKTKVMSTVATRWRQFKSTLTSKFVFAKSEGQQTQDVVTKYGLDPEAWKQFEETRLTPNWEVS

SEQ ID NO: 193556 - protein, 50 aa, Glycine max
  Coding DNA Sequence Number=SeqID_76778
MIKTKRETSNNLKVVHSGTKEFKIASNKRDLFLGFSEHQEGLRKKLALEE

SEQ ID NO: 193557 - protein, 61 aa, Glycine max
  Coding DNA Sequence Number=SeqID_76779
  Subcellular localization annotation: CTP_CleavageSite=19; ConfidenceScore=5.21e-01
MKSLQGTTQALTRGSQRLRASDNTPQTLGGIAAKTSRAVSLWLTKSRVVRDFRSKDYGFGD

SEQ ID NO: 193558 - protein, 188 aa, Glycine max
  Coding DNA Sequence Number=SeqID_76780
  Gene Ontology: Mol. function=protein serine/threonine kinase activity; Biological process=protein amino acid phosphorylation
  Homolog annotation: Hit_ID=Q49N12; Match level="QueryCoverage=53%, HitCoverage=9%, E-value=1e-15, Identity=50%"; Hit description =Putative receptor-like protein kinase 2
MEIVDKRLGEHFNKTEAMMMINVALLCTKVSLALRPTMSLVVSMLEGRTRIQEVVLDKREVLDDDKFEIMQQYYQHRGENNIIESQNLSDPTGESSKLFADTSSSEFNEWKNTSFSTVDSLTIKTMNIPHRVQGLISSWILKVEDKPLPTRFAILELRDQSPNLLLFLCLVVRKEREGMKVNEKRIEK

SEQ ID NO: 193559 - protein, 49 aa, Glycine max
  Coding DNA Sequence Number=SeqID_76781
MNYSNSKIILITLGLYLHYIYLASERQRAVPVSGGWPPNPSSSYVGLQV

SEQ ID NO: 193560 - protein, 322 aa, Glycine max
  Coding DNA Sequence Number=SeqID_76782
MQFPLFRRPLHHPRTRALNPTLLMQPHYDMANTFYEELTLDAYNSSTLSPNHSGHQFHLQHFYPQFHHNPRHKQRHTQQSQEYQHSYQLCQQHPNQFQPSQQHEQPQYLGAFDYHQPQEESTTTVSFWKAFNTVLSDANGNVQEVNENFGELEAVYINARNKQKADSTIAVENTCNVANVGVPVTNECQMLATEATGVDGVRTKKGRKRRRKKKVEEEMGLMGSFFKRLVKRVIKHQEVLQNKFLDAIERMEKERAEWEEGWRVREREIHDREAIVKARERDLASKRDSSIVSNLEKITGQSFVLVSSGKSSHEQLSTINEN

SEQ ID NO: 193561 - protein, 96 aa, Glycine max
  Coding DNA Sequence Number=SeqID_76783
MEAKSFEKILKYSNHLEHLVRVKCTRELTREDLPTLERRERRIWGLTTMLEPGKIVESSTSSGSMLGGMNSWDSKEEEGRGLVVGVLEALLKWERG

SEQ ID NO: 193562 - protein, 708 aa, Glycine max
  Coding DNA Sequence Number=SeqID_76784
  Gene Ontology: Cellular component=membrane
  Homolog annotation: Hit_ID=Q69NN6; Match level="QueryCoverage=96%, HitCoverage=96%, E-value=1e-122, Identity=39%"; Hit description =Mechanosensitive ion channel domain-containing protein-like
  Pfam annotation: Domain name=MS_channel; Domain location=546-697; Score=-54.2; E_value=0.0087; Accession=PF00924.9; Description =Mechanosensitive ion channel
GYEWMVLKGGEVSMSEKKREVMVAIPHEGGAESLMPKQQSRVNSPHRALNDNEVAAKSPPLNCASPEIRFMPSPNKPPKVPTSNAILTRRKSLTRSVYSKPKSRFGEQSYPIDGTLLEENATSTLQENLTVGSPYKASPNNNNKPGTVNRTFSILSVVTPKTPLMASPGLAGEDFDEIIYKKVELSKNMRSRRLTVKVLFEWFVFVCIASSLVASLTVGKLKRTEIWGLGFWRWCVLVMVTFCGMLVTRWFMLIVVFLIETNFLLRKKVLYFVHGLKKCVQFFIWLGLVLLTWVLLINRGVHRTELASKILNGVTWTLVSLLIGAFLWFVKTLLLKILASNFHVKSFFDRIQESLFHQYILQNLSGPPLVEEAEKVGASYSVGRFSFRSTDGKGGTKKETIDIAKLHRMKQEKVSAWTMKVLVDAMTTSGLSTISSALDESFDEGENEQTDKEITNEMEATAAAYYIFRNVAAPGCTSVIMNRYIDEDELRRFMIKEEVRMVYPLLAEAETGQITRKSLTDWLVYQERRALAHALSDTKTAVKQLNKLVTVLLVVVTIIVWLLLMEIATTKVLVFLSSQLVLAAFMFGNTCKNIFEAIIFVFVMHPFDVGDRCVIDGVELLVEEMNILTTVFLKLNNEKELEDVNKIKMGLNVTHTMNFQEFGEKTKRRTELVMELKKIFEELNIRYNLLPQGIHLRHIESNSSLLNI

SEQ ID NO: 193563 - protein, 199 aa, Glycine max
  Coding DNA Sequence Number=SeqID_76785
  Gene Ontology: Mol. function=heat shock protein binding; Cellular component=integral to membrane; Biological process=protein folding
  Homolog annotation: Hit_ID=Q84VQ4; Match level="QueryCoverage=77%, HitCoverage=73%, E-value=2e-31, Identity=48%"; Hit description=DnaJ domain family
  Pfam annotation: Domain name=DnaJ; Domain location=90-151; Score=9.3; E_value=0.00055; Accession=PF00226.21; Description=DnaJ domain
  Subcellular localization annotation: CTP_CleavageSite=45; ConfidenceScore=5.66e-01
MAVSSTTATVCIPAKNIPTTQAPKIGFSSTIAFAAKPRRRLLRIRSSSAETSGTEVDSETSIEVPEETSSLISALNVEKILRGLPITDADHYGRLGIPRGCPFDLVGGAYNIKVQELKSQNLEEDELEKKLELLKESYTILSSEEERRIYDWSLARAENTDKFVWPFEVDITQSKISKEDPPQLVGGSCSSIYLLVVRK

SEQ ID NO: 193564 - protein, 101 aa, Glycine max
  Coding DNA Sequence Number=SeqID_76786
SAINGQIELGEKIGQGTTGEIHRGTWRGFDVAPPHHAWVVTEEWLHGPGKRPKNRTVPLPPFKDSHMGLGNSPSHAVSPRAKTQSGSSQFQAQQYLLGNRQ

SEQ ID NO: 193565 - protein, 311 aa, Glycine max
  Coding DNA Sequence Number=SeqID_76787
  Gene Ontology: Mol. function=chitin binding; Cellular component =extracellular region; Biological process=chitin metabolic process
  Homolog annotation: Hit_ID=UPI0000DBF0F4; Match level="QueryCoverage =98%, HitCoverage=93%, E-value=3e-31, Identity=36%"; Hit description =Choline-phosphate cytidylyltransferase B (EC 2.7.7.15) (Phosphorylcholine ...
  Homolog annotation: Hit description=transferase B) (CTP:phosphocholine cytidylyltransferase B) (CT B) (CCT B) (CCT-beta).
  Pfam annotation: Domain name=Leu_leader; Domain location=194-217; Score=2.5; E_value=8.3; Accession=PF08054.2; Description=Leucine operon leader peptide
  Pfam annotation: Domain name=Leu_leader; Domain location=41-65; Score= 7.5; E_value=1.2; Accession=PF08054.2; Description=Leucine operon leader peptide
  Pfam annotation: Domain name=Leu_leader; Domain location=74-97; Score= 4.9; E_value=3.3; Accession=PF08054.2; Description=Leucine operon leader peptide
  Pfam module annotation: Pfam domain module=Leu_leader::Leu _leader::Leu_leader; Domain location=194-217::41-65::74-97
ELDVLTFRGLHVLAFRGRHAPTIRGPHALTFRGLYVLTFRVLHALAFRGLLVLAFRGLLVLAIRGLHVLTFRGLHVLTFRGLDAFTFRGLEVLAFRGMHALGFRGLDVLAFRGLHAFAFRGLDVLVFRGLDVLAFKGLHVFTFRVLYVLTFRGLDVLAFRGLHALAFKGLRAPTFRGLRALTFRGLHVLTFRGLHVLTFRGLHALAFRGLHVLAIRGQHVLAFRGLHILTFIGLHVLTFRELLVLTFRGLRALTFKGLHVLALRGLHAFTFKGRYVLDFRGLHAFAFRRLCVLTFNGLHIRTLREFKVLCP

SEQ ID NO: 193566 - protein, 163 aa, Glycine max
  Coding DNA Sequence Number=SeqID_76788
  Homolog annotation: Hit_ID=Q9SJZ7; Match level="QueryCoverage=29%, HitCoverage=10%, E-value=4e-13, Identity=68%"; Hit description =Putative DnaJ protein
MHHKHRAPIAVENTAALHLLYKMLHYKTQQQVELVGPTMLTSQMVHGYFKGFGIFHFVGLYSTPKLWRSRPGCLINENSISHLPAVNDMLCMQGDWRNLNNLQYMFWGWSGQKHLSGWRGKQVNVQRDGLRLSIFWILYPNDAKPQAVHSTEAMEPHRGAHQV

SEQ ID NO: 193567 - protein, 282 aa, Glycine max
  Coding DNA Sequence Number=SeqID_76789
  Subcellular localization annotation: CTP_CleavageSite=25; ConfidenceScore=5.20e-01
MGLKVESVAINSSADRLKKKWLGVIAAASWRTKVMGRSESVTKVYVRRKVVLPSRGQAQYPKSPTVNSVTGLQSVCIPSDQEEELERQYALVKDLGLTHGGAASKVQQFMKDMDTRHNKMAVEIQEQVDLISMMGNFDQDRWRWNFKWRRNLFDYESDQAVNFMDEINSIHIQRYVKDVMLWKADPSGDIACPLCGDEQEEVGHLFFNCKKIVGLWWESMSWIQVMGPLPASPVDHFLQFCDGFGAEKNHSTCCGWWVALTSTIWKHRNFLIFQDKPFEPQK

SEQ ID NO: 193568 - protein, 757 aa, Glycine max
  Coding DNA Sequence Number=SeqID_76790
  Gene Ontology: Mol. function=oxidoreductase activity, acting on the aldehyde or oxo group of donors, NAD or NADP as acceptor; Cellular component=mitochondrion; Biological process=metabolic process
  Homolog annotation: Hit_ID=Q6DAH3; Match level="QueryCoverage=60%, HitCoverage=95%, E-value=0.0, Identity=73%"; Hit description =Succinate-semialdehyde dehydrogenase [NADP+]
  Pfam annotation: Domain name=Aldedh; Domain location=221-673; Score =729.1; E_value=3e-216; Accession=PF00171.12; Description=Aldehyde dehydrogenase family
IGTLGALIGTINVLVLDNPMKFEFNVFLDNALGQWIGSFVAMMVILLIRDKSKARTGRKLLNRFMYAAVAALTTNQARRRENHLPALYQQLFLLLNLFPGDIDKYRIALTLIIGHQRLRNAEVPVNADLSAYHRQLRATADRIIAASSDDKRRYYFERLLQELDVYQQKLQHYAAPASVTEPVKRLSMMLDKMLTDRRITMSTSLQQHELFNTGYFADGQWHTASSTFDVTNPATGEVLAQVAKAGKAETEQAIAAAQRAFPAWRDKTAKQRSEILYRWYQLIIEHKSWLGQLMTAEQGKPLQEAEGEVEYAASFIQWFAEQAKRANGEIIPPAKAGSRILATREPIGVVAAITPWNFPMAMLTRKLGPALAAGCTGIIKPANNTPLSAFALVALAQKAGVPDGVLNAVAGDTHAISDAIMASRAVRKISFTGSTAVGKTLMRNAAETMKKVSMELGGNAPYIVFDDANIDAAVQGAIANKFRNAGQVCVSVNRFYIHNAIYDRFVHQLAEAVGKLKVGNGVEPGVVVGPLIEPSAVEKVAEHVKDALSKGGKLLVGGERHPLGGNFWQPTVIADAHEEMQLAQEETFGPVAACFRFDDEAEVIARANNTEYGLAAYFYTQNLQRVFRVSAALEAGMIGINECAVSTELAPFGGVKESGLGREGSDVTMRTERFDFNEIVDQAHFYRQFCERFALADRTIHDLDDLWEMIIGEQIPLPLEIAFINLGKGQKRRYGALILLFDEAEEELEGQLRFNVQ

SEQ ID NO: 193569 - protein, 183 aa, Glycine max
  Coding DNA Sequence Number=SeqID_76791
  Homolog annotation: Hit_ID=Q8ZLP6; Match level="QueryCoverage=34%, HitCoverage=71%, E-value=5e-12, Identity=55%"; Hit description =Putative outer membrane protein
  Pfam annotation: Domain name=DUF1471; Domain location=1-88; Score =102.8; E_value=1e-27; Accession=PF07338.3; Description=Protein of unknown function (DUF1471)
  Pfam annotation: Domain name=DUF1471; Domain location=96-183; Score =128.1; E_value=2.5e-35; Accession=PF07338.3; Description=Protein of unknown function (DUF1471)
  Pfam module annotation: Pfam domain module=DUF1471::DUF1471; Domain location=1-88::96-183
  Subcellular localization annotation: CTP_CleavageSite=21; ConfidenceScore=5.05e-01
MKTKLSIAVLSLASVLSFGASAATLVTNTQAENLQPLNQTISVSGVDGDQTNIRQELSQKADAQGASHYRIIENNQDNTFHVTAELLLILMRRRIMKIKTTIATATLLSLFAFGASAAQLVTDESAQNLQSTGQTITVSGTGGSPMDYRAQLSQKADEQGASAYKVIEARTGDSYHLTAELYK

SEQ ID NO: 193570 - protein, 75 aa, Glycine max
  Coding DNA Sequence Number=SeqID_76792
QGGDTTPKGTRSDTWWWSEQWLGFFFLVVGNAMSGWARRSRRWDDFRQQSACALGFCYSFFEDARVFNHRETRSI

SEQ ID NO: 193571 - protein, 460 aa, Glycine max
  Coding DNA Sequence Number=SeqID_76793
  Gene Ontology: Mol. function=DNA topoisomerase type I activity; Cellular component=chromosome; Biological process=DNA unwinding during replication
  Homolog annotation: Hit_ID=P45771; Match level="QueryCoverage=34%, HitCoverage=88%, E-value=8e-74, Identity=75%"; Hit description =Hypothetical protein yrdD
  Pfam annotation: Domain name=DUF494; Domain location=148-302; Score =287.9; E_value=1.9e-83; Accession=PF04361.4; Description=Protein of unknown function (DUF494)
  Pfam annotation: Domain name=SMF; Domain location=4-84; Score=-99.2; E_value=0.0082; Accession=PF02481.6; Description=SMF family
  Pfam annotation: Domain name=zf-C4_Topoisom; Domain location=297-328; Score=26.0; E_value=0.00013; Accession=PF01396.10; Description =Topoisomerase DNA binding C4 zinc finger
  Pfam annotation: Domain name=zf-C4_Topoisom; Domain location=339-377; Score=70.4; E_value=5.7e-18; Accession=PF01396.10; Description =Topoisomerase DNA binding C4 zinc finger
  Pfam annotation: Domain name=zf-C4_Topoisom; Domain location=381-421; Score=56.7; E_value=7.5e-14; Accession=PF01396.10; Description =Topoisomerase DNA binding C4 zinc finger
  Pfam module annotation: Pfam domain module=DUF494::SMF::zf-C4 _Topoisom::zf-C4_Topoisom::zf-C4_Topoisom; Domain location=148-302::4- 84::297-328::339-377::381-421
RAESSLSEKPSAAGTGDHRQRWRAGFRTAAVDGAPCASLKSGSLVTARYALEQNRNVYALPGALGNPGCEGTHWLIQQGALLVAHPNNILEDLHSALHWLPASISETIYSQLSDDVPLPFPSVLANVGDEVTPVDVVAERAGQPVPVIAAQLLELELAGWIAAVPGGYDKLTDDLTDAGFHREDIYNALNWLERLADYQDGLVAPVLLANDPLSMRIYTEEESQRLDAECRGFILFLEQIQVLNMETREMVIERVMALDTLEFDLEDLKWVVLMVLFNIPGCENAYQQMEELLFDVNEELVIRAGKHGPFLGCVNYPTCDYIRPLKSQGDGHIVKVLEGHACPQCGADKVLRQGRFGMFVGCSHYPECDYTETIDKPDETAIACPQCASGKLVQRRSRYGKTFHACDRYPDCQFAINATPLEGVCPHCQFPLLIEKKTAQGMKRFCASKRCGKPIAQDEE

SEQ ID NO: 193572 - protein, 77 aa, Glycine max
  Coding DNA Sequence Number=SeqID_76794
MKKYSPEPPNTSFCPYLRNMEGWKNMVFKGEEAIDGGVNPRAFKSIMTKVWNVKEGVDIRDIAHNLFTFWFMEKKDM

SEQ ID NO: 193573 - protein, 119 aa, Glycine max
  Coding DNA Sequence Number=SeqID_76795
MLSCGGYEFLENKLLEEKKKKQLAKAAKSGSTHTVIDPLSPIRRHVKWKMNRTKKAGQMTSETIKEIADKIDVLIAAIGRPEHPGRVRAARAGVTIKQYFVSALRTSRTSSSMAPEDLE

SEQ ID NO: 193574 - protein, 188 aa, Glycine max
  Coding DNA Sequence Number=SeqID_76796
MDNNNNNNINSSVFVSYACRDPFVSPLLDNFNEPDPALVYLLPEPNLRNDEQQPLQGHVSSTDSTIHDQSHHYCNDNFTIGGGVFPNYEFVEGSSKNKRKYPFTDTDIEDQSFMHDFEAGPSNLNQPASGNMGPRNWPPMPRPFFCTCCQVLRQTIHTNGTDFERIEIHGRIGLIRHIIIQNQSITPG

SEQ ID NO: 193575 - protein, 551 aa, Glycine max
  Coding DNA Sequence Number=SeqID_76797
  Gene Ontology: Mol. function=transferase activity, transferring hexosyl groups; Cellular component=mitochondrion; Biological process= metabolic process
  Homolog annotation: Hit_ID=Q69L95; Match level="QueryCoverage=87%, HitCoverage=90%, E-value=1e-54, Identity=25%"; Hit description =Putative fertility restorer homologue
  Pfam annotation: Domain name=PPR; Domain location=161-195; Score=4.3; E_value=2.3; Accession=PF01535.11; Description=PPR repeat
  Pfam annotation: Domain name=PPR; Domain location=229-263; Score =42.5; E_value=1.4e-09; Accession=PF01535.11; Description=PPR repeat
  Pfam annotation: Domain name=PPR; Domain location=265-299; Score =50.4; E_value=5.9e-12; Accession=PF01535.11; Description=PPR repeat
  Pfam annotation: Domain name=PPR; Domain location=300-334; Score =35.4; E_value=2e-07; Accession=PF01535.11; Description=PPR repeat
  Pfam annotation: Domain name=PPR; Domain location=335-369; Score =34.2; E_value=4.6e-07; Accession=PF01535.11; Description=PPR repeat
  Pfam annotation: Domain name=PPR; Domain location=370-404; Score =35.0; E_value=2.7e-07; Accession=PF01535.11; Description=PPR repeat
  Pfam annotation: Domain name=PPR; Domain location=405-439; Score =30.9; E_value=4.3e-06; Accession=PF01535.11; Description=PPR repeat
  Pfam annotation: Domain name=PPR; Domain location=441-475; Score=2.9; E_value=3.3; Accession=PF01535.11; Description=PPR repeat
  Pfam annotation: Domain name=PPR; Domain location=476-510; Score =16.8; E_value=0.076; Accession=PF01535.11; Description=PPR repeat
  Pfam annotation: Domain name=PPR; Domain location=511-544; Score=9.8; E_value=0.52; Accession=PF01535.11; Description=PPR repeat
  Pfam module annotation: Pfam domain module=PPR::PPR::PPR::PPR::PPR::PP R::PPR::PPR::PPR::PPR; Domain location=161-195::229-263::265-299::300- 334::335-369::370-404::405-439::441-475::476-510::511-544
  Subcellular localization annotation: CTP_CleavageSite=14; ConfidenceScore=5.08e-01
MAAQPFRKAIAKPLCSSSTAPIPNLSLVTCITTILQNINPQNPDYSPLREFSSHLTPNLVIHVIKNQNNPQHALHFFNWASNPNPNPNNYSHTPLCYTAITDLLLSHSLFSTAFSLLRHSNRLSDNLVCRFINALGHRGDIRGAIHWFHQANTFTRGRCVFSCNAILGVLVRANRVNIAKAIYDQVLAEAVLEPDVYTYTTMIRGFCKVGKVESARKVFDEMRCEPNIVTYNTLIHGFCKKGDMDGARRVFDRMVESQSCKPDVVSFTTLIDGYSKRGGFQEALECLKEMVERGCSPNAVTYNALVEGLCLSGEVDEARKMMSRMRLNGLKDDVATNTSLLKGFCIVGKSDEAVKHLREMVSRGMKPDVKAYGVVVNEYCKIRKPSEAVLLLREMVVRGVKPNVSSFNAVFRVLVDEGKIDEGLHLLKQMPKMGCSPNFLSYCTVICGLCEVKGRMQQVEELVSNMLQNGHNLDATMYNCLLLGYCEDRDEEMAQKTVYDIMDKNFVINQDIFCTFVKLLCAKGKLKEAETVSEEMRRRCQLNGKAETEEH

SEQ ID NO: 193576 - protein, 381 aa, Glycine max
  Coding DNA Sequence Number=SeqID_76798
  Homolog annotation: Hit_ID=Q287W0; Match level="QueryCoverage=54%, HitCoverage=59%, E-value=1e-07, Identity=26%"; Hit description =Expressed protein
MYTTKREQQRLRFQNHAKKPSFSSILLDQIYRSIDEGNDMKLYNETMAKQQNRVFVEEEEEEEEITAASIRRACLLDKWKESEKAGSQWKTQTEGKSRWHHHHNHEHDQEVMFFSSTSSSSDSSSGLLSSSDTESLYGMRSKSRVSCFAPSRPKPVVTSASNEVGLIKSESRALKIYNNLKKVKQPISPGGGSVKKTKTYDDDAKASTKSGQDSTCSSASSFSRSCLSKASTSSKDKLRDGVKRTVRFYPVSVIVGEDSRACGHKCLYEEDTRVTEVSVPTAWKIGRKKNQEDEELRVVDRSRRVEEAAREFLKEYHRSQKKSDFTNLDVEDDGDASSCSSSDLFELDHLAVMGNDRYGDELPVYETTYVSTNRAIANGLI

SEQ ID NO: 193577 - protein, 220 aa, Glycine max
  Coding DNA Sequence Number=SeqID_76799
  Gene Ontology: Mol. function=zinc ion binding; Cellular component =integral to membrane
  Homolog annotation: Hit_ID=Q06A76; Match level="QueryCoverage=86%, HitCoverage=85%, E-value=3e-63, Identity=60%"; Hit description=PHD4
  Pfam annotation: Domain name=C1_3; Domain location=163-195; Score =8.2; E_value=0.055; Accession=PF07649.3; Description=C1-like domain
  Pfam annotation: Domain name=PHD; Domain location=164-216; Score =43.6; E_value=6.8e-10; Accession=PF00628.19; Description=PHD-finger
  Pfam module annotation: Pfam domain module=C1_3::PHD; Domain location= 163-195::164-216
MEMEAGGAQSQRYNYNYDYNPCSVITSVIQLCDTKMENLFLYGFPRELWEVNVPPDLLVPTLGINFDRDGKQNKDWLSLVAMHSDAWKQLFDVINDLPTINEVVTGMTKKQGKEKSSVPNHSKPKSNSKRGSKPQGKYSKAMQSKDEDEDDLEVDDEEEHGETLCGTCGLNYAGEASEFSICCDNCDKWFHGKCVKITPARVEGIKRYKCPSWSSKRARP

SEQ ID NO: 193578 - protein, 224 aa, Glycine max
  Coding DNA Sequence Number=SeqID_76800
  Pfam annotation: Domain name=RWP-RK; Domain location=120-171; Score =26.3; E_value=7.3e-06; Accession=PF02042.6; Description=RWP-RK domain
MRNAMFTSQSFTFCLQLLITFIWFCVWGIIISFTNGSPAEVKGFLEDYIARKDKLGYIIAEESFSEFYEAVCTKLDWVGKRTNNEDDDLTPQNVEEEPEPEPEPPKERRRKRSRKDQSDRINSMTLDDLSGVFHITMKAAKNVLDMSVTAIKSICRKCRLYKWPHRQLQPLARRLKVLKRALESSQDPVVIQTTSMEVRRIKQHMTQLCGGVTPTGIEIPEVEE

SEQ ID NO: 193579 - protein, 82 aa, Glycine max
  Coding DNA Sequence Number=SeqID_76801
MADIYFPFLPPLSQILPPPLKEPRGRLKVKVVGGLFREFMISIIFRQGLLGWGAVATIAMSSVEEEGDGKTEEKEGYFAKVS

SEQ ID NO: 193580 - protein, 44 aa, Glycine max
  Coding DNA Sequence Number=SeqID_76802
MVRRVGKFMRKFTLRDNANMDKKISVISQDGLSEDGPGLQFSQV

SEQ ID NO: 193581 - protein, 255 aa, Glycine max
  Coding DNA Sequence Number=SeqID_76803
  Gene Ontology: Mol. function=methyltransferase activity; Cellular component=nucleolus; Biological process=ribosome biogenesis and assembly
  Homolog annotation: Hit_ID=Q6Z6L6; Match level="QueryCoverage=69%, HitCoverage=44%, E-value=2e-58, Identity=57%"; Hit description =Putative Williams Beuren syndrome critical region 20A isoform 1
MAKLPKLLLLVPILTSCTLQIYFKVLDACAAPGNKTVHLAALMKRKDIQVLNDDFLNLNPKDPSYSKVKAILLDPSCSGSGTAASRLDHLLPSKAAGQDADMERLNKLATFQRKALQHALLFPAVERIVYSTCSINQIENEDVIKSVLPIAESNGFQLAKPFPGWECRGLPVFEGSECLVRTDPAKHGEGFFIALFTRKDANFSGRSNKNETRISDSTAEIKNARRKKKRVPFVSTNPFKTWLYDSKIVKSWRSN

SEQ ID NO: 193582 - protein, 262 aa, Glycine max
  Coding DNA Sequence Number=SeqID_76804
  Gene Ontology: Mol. function=methyltransferase activity; Cellular component=nucleolus
  Homolog annotation: Hit_ID=Q6Z6L6; Match level="QueryCoverage=62%, HitCoverage=34%, E-value=2e-42, Identity=50%"; Hit description =Putative Williams Beuren syndrome critical region 20A isoform 1
MKKTKKSGEENGGKLKFKGAERSAYFARREAAKVLKVILEGDAKRRALASIKSLIYQPSVRNKKATFALICQTLKHLPIIKDVLEAASILNTKWKRQRELIYIIVYDILLGQAVSLVGDAEKYLMRHQDALRSTLKQLLLQRNVKTVKQLIALHQVPDISVPRYVRVNTLKLDVDSALLELQKKYSVQKDNLLPDLLILPPGTDLHDHPLVKNGSIFLQVGIIPPLYIFFRDIRLVRIQAKSAFESFFTRNLEFFPVEKLLN

SEQ ID NO: 193583 - protein, 239 aa, Glycine max
  Coding DNA Sequence Number=SeqID_76805
  Gene Ontology: Mol. function=sequence-specific DNA binding; Cellular component=nucleus; Biological process=regulation of transcription
  Homolog annotation: Hit_ID=Q5ND90; Match level="QueryCoverage=57%, HitCoverage=77%, E-value=9e-36, Identity=58%"; Hit description =Putative WRKY transcription factor 10
  Pfam annotation: Domain name=WRKY; Domain location=100-152; Score =86.6; E_value=7.6e-23; Accession=PF03106.6; Description=WRKY DNA -binding domain
MTDKNPRPPDSPDDDFTNQWPLELSEYLNFDDDQWPDDYPESFVSGHVFSHNNQANEVGNFGGSSTHFEESSSRDVGNEREKKEVRDRVAFKTKSEVEILDDGFKWRKYGKKMVKNSPNPRNYYRCSVDGCQVKKRVERDKDDPRAMKIKQKKLACFLSTTMDFGRFTHKNVLGILGYASVVKGETDHMISNSIEQIPGTNIKQNKSLENVTVMLDELGKDYPALKNGKRDYPRCHLNS

SEQ ID NO: 193584 - protein, 326 aa, Glycine max
  Coding DNA Sequence Number=SeqID_76806
  Gene Ontology: Mol. function=protein serine/threonine kinase activity; Cellular component=phragmoplast; Biological process =protein amino acid phosphorylation
  Homolog annotation: Hit_ID=Q5SNF8; Match level="QueryCoverage=95%, HitCoverage=51%, E-value=1e-125, Identity=72%"; Hit description =Putative serine/threonine kinase 38
  Pfam annotation: Domain name=Pkinase; Domain location=126-318; Score =89.0; E_value=1.4e-23; Accession=PF00069.15; Description=Protein kinase domain
  Pfam annotation: Domain name=Pkinase_Tyr; Domain location=126-315; Score=-45.2; E_value=1.1e-09; Accession=PF07714.7; Description =Protein tyrosine kinase
  Pfam module annotation: Pfam domain module=Pkinase::Pkinase_Tyr; Domain location=126-318::126-315
MEDLEEEENGAEEVLGSSLTMEKVAAAKKFIENHYRAQMKNIQERKESLTEGIEYLRHGNQSIYIPGVRLDGRMGFIWSSQRWVLERKLASSDVPNEERINLIKDLERKETEYMRLKRHKICVNDFELLTIIGRGAFGEVRLCREKKSGNIYAMKKLKKSEMLRRGQVEHVRAERNLLAEVASHCIVKLYYSFQDAEYLYLIMEYLPGGDVMTLLMREDTLSENVARFYIAQSVLAIESIHKHNYIHRDIKPDNLLLDKNGHMKLSDFGLCKPLDCIALSTLHENQTIDDETLAEPMDVDDADNRSSWRSPREQLQHWQMNRRKLV

SEQ ID NO: 193585 - protein, 456 aa, Glycine max
  Coding DNA Sequence Number=SeqID_76807
  Gene Ontology: Mol. function=protein serine/threonine phosphatase activity; Cellular component=protein serine/threonine phosphatase complex; Biological process=protein amino acid dephosphorylation
  Homolog annotation: Hit_ID=O81709; Match level="QueryCoverage=85%, HitCoverage=72%, E-value=1e-76, Identity=44%"; Hit description =Protein phosphatase 2C
  Pfam annotation: Domain name=PP2C; Domain location=269-456; Score =36.0; E_value=4.9e-08; Accession=PF00481.12; Description=Protein phosphatase 2C
VSQSEDKAVRREKKEREGKEGRKEETRLYMAVISVGCEGNFLYYIDKDFDGGDVNHGYSAMERLLSNSITKVSDETFIGSDENHDSGCHEDEIGITAVTAPEQQREGEIPMLDMISQNISSLVVGDEVLTPEIEEDDLISLEGDPIIDSSSLSVASEHSSICGDEFISSEVSSDLGTTSSKDIGKSISTVKIAARATDLSMSNVEADVAVSLEETGVRSGSKPTTGVFHQLTLERSVSGTVGRSVFELDCTPLWGFTSVCGKRPEMEDAVATVPRFLKIPIEMLTGDRLPDGINKCFGQQTIHFFGVYDGHGGSQVAKYCRERMHLALAEEIESVKEGLLVENTKNDCRDLWKNTFTNCFLKVDAEVGGEVNREPVAPETVGSTSVVAIICSSHIIVSNCGDSRAVLCRGKEPMALSVDHKPNRDDEYARIEAAGGKVIQWNGHRVFGVLAMSRSI

SEQ ID NO: 193586 - protein, 62 aa, Glycine max
  Coding DNA Sequence Number=SeqID_76808
MGENMLTTKDLSFVGYTYKNFDAVKEGLRQSFGDSMQEYASKRAAEETSLQMLASSGDPMVP

SEQ ID NO: 193587 - protein, 141 aa, Glycine max
  Coding DNA Sequence Number=SeqID_76809
  Gene Ontology: Mol. function=protein binding; Cellular component =membrane; Biological process=intracellular protein transport
  Homolog annotation: Hit_ID=Q1SEN5; Match level="QueryCoverage=87%, HitCoverage=12%, E-value=6e-56, Identity=84%"; Hit description=SecA protein
  Pfam annotation: Domain name=SecA_SW; Domain location=9-98; Score =24.8; E_value=8.9e-12; Accession=PF07516.3; Description=SecA Wing and Scaffold domain
MSKPQAQYIIYLEVQDIVEQQAAGLMKEAERFLILSNIDRLWKEHLQALKFVQQAVGLRGYAQRDPLIEYKVEGYNLFLDMMAQIRRNVMHSVYQFEPVLVEQDQDKTENRKSGKRNARTQVNPNPDPVGTVEPSTSSTTS

SEQ ID NO: 193588 - protein, 677 aa, Glycine max
  Coding DNA Sequence Number=SeqID_76810
  Gene Ontology: Mol. function=membrane alanyl aminopeptidase activity; Cellular component=extracellular space; Biological process=proteolysis
  Homolog annotation: Hit_ID=Q9SN00; Match level="QueryCoverage=99%, HitCoverage=68%, E-value=0.0, Identity=61%"; Hit description =Aminopeptidase-like protein
  Pfam annotation: Domain name=Peptidase_M1; Domain location=1-134; Score=-118.7; E_value=6.9e-06; Accession=PF01433.10; Description =Peptidase family M1
MIAIPDFAAGAMENYGLVTYRETALLYDDQHSAAANKQRVATVVAHELAHQWFGNLVTMEWWTHLWLNEGFATWVSYLATDSCFPEWKIWSQFLHESTEGLKLDGLAESHPIEVEINHACEIDEIFDAISYRKGASVIRMLQSYLGAECFQTEDLWAALEEGSGEPVNKLMTSWTKQKGYPVVSVKVNDQKLEFNQSQFLSSGAQGEGHWIVPITLCFGSYDVHKSFLLQSKSETHDVKDFLGSTHKGLNCWIKLNVDQAGFYRVKYDELLAARLRYAVEKQLLSASDRFGILDDSFALCMARQESLTSLINLMGSYREEVDYTVLSNLITISLKVQRIAADAVPDLLEYFKQFFINLFQYSAERLGWEPKPGESHVDAMLRGEILTALAMFGHDLTLDEASKRFQAFLENRNTPLLPPDIRKAAYVAVMQRASKSNRSGYESLLKVYKEADLSQEKTRILGSLASSRDPDLILEALNFMLSSEDAVFGLAVTREGRDVAWAWLKENWEHLIKTYGSGFLITRFVGAVVSPFASFEKAKEVEEFFATHAMPSIARTLRQSLERVNINANWVQSVQNENRLGDAMKELAYRENWEHLKKTYGSGLMITWFVSAVVSPFASFENAKEVEEFFATHAMPCIARTLRQSLERVNINANWVQSVQNENELGDAVKELAYRKY

SEQ ID NO: 193589 - protein, 476 aa, Glycine max
  Coding DNA Sequence Number=SeqID_76811
MEKTTLFVLLLNVLLVFSASLVSAEQQSHASAVGDPGMQRDGLRVAFEAWNFCNEVGQEAPHMGSLRAADCFDLSGSLTHKVTQADNRLGVGDSFPGINPENINNTDLYAIEKELYLGSLCEVADTPRPWLFWMVMLKNGNYDTRSGLCPQDGKKVPPFSPGRFPCFGQGCMNQPIVCHQWTQLKDGSMQGGFSGTYDLDSGCGGEQDGVSYYEVVWEKKVNVGSWMFKHKLRTSKKYPWLMLYLRADATKGFSGGYHYDTRGMLKTESKSKTSISLPESPNFKKLSLDIKKGGGGKSQFYPLDIGSCWKNNGTPCDGDVLTDVARYSEMIINPENPAWCSPKGLANCPTFHITPDNKKIFRNGTANFPYSAYHYYCAPGNAQHLEQPVSTCDPYSNPQAQEIVQLLPHPIWGQYGYPTKKGDGWVGDARTWELDVGRLSSRLIQGTSPAKRIWTSIDSGTKIFVSDKDEGLNKWH

SEQ ID NO: 193590 - protein, 224 aa, Glycine max
  Coding DNA Sequence Number=SeqID_76812
  Homolog annotation: Hit_ID=Q9SYH9; Match level="QueryCoverage=72%, HitCoverage=84%, E-value=2e-35, Identity=49%"; Hit description =Putative RNaseP-associated protein
  Pfam annotation: Domain name=Ribosomal_L7Ae; Domain location=87-182; Score=8.0; E_value=0.0048; Accession=PF01248.16; Description =Ribosomal protein L7AeL30eS12eGadd45 family
MPSRNSAKTPKNDGNNSNSSLASLENNCYEGERLTSLLQSIRRGIQSARHLDGSSLPEKIWLKQQFSIGVNDVTRVLERMKPCTELESSTELISLRSNHTASSVKLQVDFLCLSNVEYAVLVASDCNPRWLTKHLLSLASSRNVPLVFVRDTKQGSLRLGELVQLKTAIAIGIKVKGSTINKIIQQVIQGDRFELSPEGQNSARIFDAQSNFQDPDKKMLSNVI

SEQ ID NO: 193591 - protein, 159 aa, Glycine max
  Coding DNA Sequence Number=SeqID_76813
  Gene Ontology: Mol. function=protein serine/threonine phosphatase activity; Cellular component=protein serine/threonine phosphatase complex; Biological process=protein amino acid dephosphorylation
  Homolog annotation: Hit_ID=O81709; Match level="QueryCoverage=66%, HitCoverage=20%, E-value=4e-43, Identity=75%"; Hit description =Protein phosphatase 2C
MVVALFMIFLFVAFFLPVVWSSVSSCRRVLVHDVRLHVLEKLLLRPVLLARYLKPWIIPDPEVTFLPRAKDDECLILASDGLWDVMTNEEVCDIARRRILLWHKKNGLALPSERGEGIDPAAQAAAEYLSNRALQKGSKDNITVIVVDLKAQRKFKSKT

SEQ ID NO: 193592 - protein, 136 aa, Glycine max
  Coding DNA Sequence Number=SeqID_76814
MDKSLKVEEEKRRERERRSTKFSASREIWFNPLIQDQVQDSPLSVLRCHEPSHGLKIYPKAHENPRVFSYISDPIYLESSIQCPCGRKVEPERGEEFKKLRGNHAWGGEGFAILTIMAHESIKMNGRVINISHAPH

SEQ ID NO: 193593 - protein, 176 aa, Glycine max
  Coding DNA Sequence Number=SeqID_76815
MEAVKEKMATMMEAMMSMKITEVNAAVVAAIAEVDPTPLSSLNQINHPTSNMVGRGGKELGSTGGPYFVQVQNEHHFPAYGLPPNYMPPNVAHTPTENVNNSNPILVESQQPQSNHAHVSQPMGETHEIPHHNLVDFEPSLEYATKGQAIGGVPLPNTLEDPQFFPQPQPLHCVAG

SEQ ID NO: 193594 - protein, 335 aa, Glycine max
  Coding DNA Sequence Number=SeqID_76816
  Gene Ontology: Mol. function=DNA binding; Cellular component=nucleus; Biological process=regulation of transcription, DNA-dependent
  Homolog annotation: Hit_ID=Q9M2Y9; Match level="QueryCoverage=89%, HitCoverage=98%, E-value=2e-61, Identity=43%"; Hit description =AtMYB84
  Pfam annotation: Domain name=Myb_DNA-bind_2; Domain location=13-70; Score=-6.9; E_value=0.058; Accession=PF08914.1; Description=Rap1 Myb domain
  Pfam annotation: Domain name=Myb_DNA-binding; Domain location=14-62; Score=49.4; E_value=1.2e-11; Accession=PF00249.21; Description=Myb -like DNA-binding domain
  Pfam annotation: Domain name=Myb_DNA-binding; Domain location=68-113; Score=43.3; E_value=8.6e-10; Accession=PF00249.21; Description=Myb -like DNA-binding domain
  Pfam module annotation: Pfam domain module=Myb_DNA-bind_2::Myb_DNA -binding::Myb_DNA-binding; Domain location=13-70::14-62::68-113
MGRAPCCDKANVKRGPWSPEEDTRLKSYIEEHGTGGNWIALPQKLGLKRCGKSCRLRWLNYLRPNIKHGNFSEEEDNIICSLYVTIGSRWSIIAAQLPGRTDNDIKNYWNTKLKKKLLGKQRKLEQQAQARKVFNQKQQIKRESEDLMLPVGVTTRTPYWPEQQYSWPIPVANNASIQYSNLNNNNQTSSFSKHFPNNIVTATTMNSQHSSRDISLTQNQLHDLHPSTLMNMISTDTCHTSNVFQGFVNFSSDFPCVNQQQIDGTMRVFYGLETMDMATNGSTNTTSTESTSWGDINSLVYSPLLVSDHEACQQRIIMPQDVTFEESSCFAMQRQ

SEQ ID NO: 193595 - protein, 40 aa, Glycine max
  Coding DNA Sequence Number=SeqID_76817
MARVECRRSNNGVERAYSGILKYFFIVVTSPVLEDKIVYI

SEQ ID NO: 193596 - protein, 91 aa, Glycine max
  Coding DNA Sequence Number=SeqID_76818
  Gene Ontology: Mol. function=RNA-directed DNA polymerase activity; Cellular component=chromatin; Biological process=RNA-dependent DNA replication
MGLGGLLMQNGQVVAYASRQLKTNERNYLTHDLELTAVVFSIMIWKNYLFGSKFEVFSDHKSLKYLFSQKKQNMRQRTMILSLVIIPAKPM

SEQ ID NO: 193597 - protein, 823 aa, Glycine max
  Coding DNA Sequence Number=SeqID_76819
  Gene Ontology: Mol. function=protein kinase activity; Cellular component=nucleus; Biological process=protein amino acid phosphorylation
  Homolog annotation: Hit_ID=Q9FLH0; Match level="QueryCoverage=71%, HitCoverage=60%, E-value=1e-120, Identity=40%"; Hit description =Putative nuclear matrix constituent protein 1-like protein
MILERQSLSERQKGLQQEQERLLQSQSLLNQREEHFLSRSQELNRLQRELEDTKGKIEKEHEALHDEKTTLKLKEATLIQREEELTKWKSELSKKEQELLEFQAKLSNRESDETQKVVAGQEAALRTKKYNLEVELQMLRKLVENEIEEKRRAWELKEVDLKHCEDQILQRQHELEVLSRSLSEKEKDLKDLSSALEEKDQMLSASEKKFELNKVLLQKEKDDVEQANQDLQKSLASLEDKIRQVDIDKEKLEAMKSETGDMSILEVKLKEEIDLVRSQKLELLAEADKLKTEKAKFEADWELLDEKKEELRKEAEFIAKEREAVSTFIKNERDQLREEKENLRNQYNQDLGYLASEREKFMNKMAHEHAEWFGKMQQERADFLREIELQKQELNNLIEKRREEVESSLKEREKAFEEEKNTELQYINALKEKATKELEQVSLEMKRLQTERAEINLDRERRNREWAELTKCIEELEVQRDKLRKQRELLHADRIEIYAQTEELKKLEDLKAVSDDNAITEMLKSDMESNQKKISARKNLKHQSLTQGGDKINNGFDTPLVQKSPVSPPSPVRFSWIKRCTELIFRNSPEKPLERNEDSLMGSDTGNVCNGKQYSENDESLGNIGKGQQIGFAFEEPKVIVEVPSLDDARRSEIESEAKDVNGKSALLLPDGHHAGRRKRGRGNVTDKVGDPLVDVGQNKKSRAEQSNEKVQSGVSKVQQVLTSSNQTQGNTEETRVVMVDKVIHVSEVTSEKLDALPILSQEPRDNMQSPTFGADQCILHGETIDRSNSKTRQEDILPCASSVLGSTEEISKGNNDQVSEHC

SEQ ID NO: 193598 - protein, 103 aa, Glycine max
  Coding DNA Sequence Number=SeqID_76820
  Gene Ontology: Mol. function=RNA-directed DNA polymerase activity; Biological process=RNA-dependent DNA replication
MAKPKVQLVACISLNYNLGEAKLEPREAKPKVDPAKEDGEKTIFMTNMTNGCYSIMPFNLKNVKATYQRLINKIFMNHLGKNLEVYVDDMVVKSTSTTSHAEE

SEQ ID NO: 193599 - protein, 276 aa, Glycine max
  Coding DNA Sequence Number=SeqID_76821
  Gene Ontology: Mol. function=serine-type peptidase activity; Cellular component=lysosome; Biological process=proteolysis
  Homolog annotation: Hit_ID=Q9FLH1; Match level="QueryCoverage=62%, HitCoverage=37%, E-value=1e-67, Identity=61%"; Hit description =Lysosomal Pro-X carboxypeptidase
  Pfam annotation: Domain name=Peptidase_S28; Domain location=7-276; Score=-207.7; E_value=0.0057; Accession=PF05577.2; Description =Serine carboxypeptidase S28
MLKVSRRQYWRHQGVPQAVLAAPPSLTCAANSIGGTHPTHPLSPVPQMPSAAHPHPSLLLSTCPASGTSGTLLTAIGTGGSSFPPVLMAAPTSERDPALLAAWMRLKYPHVAVGALASSAPILQFEDIVPPETFYDLVSNAFKSWNEMASAGQTNNGLELLTKTFNLCQKLNRTKDLYDWVEAAYSYLAMVNYPYPAEFMMTLPEHPIRERIYEGVNVYYNYTGEAKCFELDDDPHGMSGWDWQACTEMIMPMSSSQESSMFLPYEYNTLLSKRNA

SEQ ID NO: 193600 - protein, 224 aa, Glycine max
  Coding DNA Sequence Number=SeqID_76822
MTTTTLLVIVFPAFLLVTSSLLVVWLLLMSMSLPLLVVSLLLKPEGGLHPNSNVRENLREDEAESPFSKPPPNVINLDLEATDVHIIAPCPSIFPSPLPPRKPMIMAKFNYKSVKKAQGNKVEKVKVVEAQAGRPRARSMPKLKTTGERVELVLIVTPSTVEHHPAFLSMKERETKLKKVETWEETLKVKLAIVEDSAKALQKEIKCLNKEFVLLKVNVEKVDE

SEQ ID NO: 193601 - protein, 675 aa, Glycine max
  Coding DNA Sequence Number=SeqID_76823
  Gene Ontology: Mol. function=protein dimerization activity; Cellular component=chromatin; Biological process=DNA integration
  Homolog annotation: Hit_ID=Q2R1C3; Match level="QueryCoverage=84%, HitCoverage=90%, E-value=1e-110, Identity=37%"; Hit description=HAT family dimerisation domain containing protein
  Pfam annotation: Domain name=DUF659; Domain location=204-354; Score =117.8; E_value=3.1e-32; Accession=PF04937.6; Description=Protein of unknown function (DUF 659)
  Pfam annotation: Domain name=hATC; Domain location=467-556; Score =49.0; E_value=1.6e-11; Accession=PF05699.5; Description=hAT family dimerisation domain
  Pfam annotation: Domain name=zf-C2HC_plant; Domain location=58-108; Score=19.2; E_value=0.00022; Accession=PF07567.3; Description =Protein of unknown function, DUF1544
  Pfam module annotation: Pfam domain module=DUF659::hATC::zf-C2HC _plant; Domain location=204-354::467-556::58-108
MWFYFLVDGFASHLQWCLLLDDGFFFNSSLHWQFCKHSCCRQFSSSSVPIIVVSCLWEKIGDGGGNRLWSCNFCEKVVKSSYSRVKAHLLRICGSGIATCPKVTDAYLVDLRRVCEEAENILKSKNVPLPTDKRTPTPPTLPPKRRKSSNIENAFNIEDRNHLRAEIARMFYSAGLSFHLARNPHFVSSYSFTANCNLSGFLPPSYNTLRTSLLQQERSHIERLLQPIKSLWSLKGVTLVVDGWTDAQRRPLIKFMAISEEGPMFLKAIDGSKEYKDKHYKFDLLKDVIKEVGPQNVVQVITDNALVCKAAGLLIEAEFPHIFWIPCVVHTLNLGEDDVRKAAHVKELILNDIWRDKVDYILSFMDPIYSMIRICDTDASNLHLVYEMWDSMIEKVKTTIYRHDELENEVSSFFEVIHEILNSSDNWLNEVPNRVPPHRDDELSSQRNKCLKRYFPHVNVRTKVYEEFSKFSSCAGDFGSFDSIEDRWALDPKTWWVMHGSSTPILQKLALKLLVQPCSSSCYERNWSTYSFIHSLKRNKMDPKRVEDLVFVHSNLRLLSRKEEGYKKGETRLWDINGDAHDPLDDSAGVLEMTNLSLDEPDLEAMLFLDDGNGGEENETIREDALNGACPTEEKSDCLEAGDETNIALDPLFMFVFHLGVNGAAIAHVINLRFS

SEQ ID NO: 193602 - protein, 151 aa, Glycine max
  Coding DNA Sequence Number=SeqID_76824
MAFASSSGGIVCARALSAILNRLEHISEFRLNAFFSRSTDGLKRHAFVKWWSQFDTSKAAPEQVKNWFQSNPEFLKPADPETSLFLNQKSQLAAFLASSKSKESLAQNLKEVLQLLQQEEEEELPKKEAESSENNDDQEDDPFYQNEDDCF

SEQ ID NO: 193603 - protein, 101 aa, Glycine max
  Coding DNA Sequence Number=SeqID_76825
NKCWWRLRAPSSLGRHTHEPRVALPLKGRLRQKKSEKDGKWWNGIKLSLEYLPFDLMIKFAQFQVKRGYNLEVLKGAVALSSPFGLNTHPTLSTASACLAR

SEQ ID NO: 193604 - protein, 108 aa, Glycine max
  Coding DNA Sequence Number=SeqID_76826
PNDRAQRVSERGSGRAPNTQTASPRALADSLMQLARQAHDHGEATHVPRSYDVHTHPRTVLSPPLTTLHLYPKRICLLFICVSASGPSCLNFVPTLYAYLNCSSSPYI

SEQ ID NO: 193605 - protein, 95 aa, Glycine max
  Coding DNA Sequence Number=SeqID_76827
MNDLVYVMYNLKLKNNLQVEQEQPLGESGSGSNIDLVGGNLTDPTLDAFDIDNLVLNDNVKDHFSIEKELEDDGDADDGGGGDIGDDFIRGLMNI

SEQ ID NO: 193606 - protein, 467 aa, Glycine max
  Coding DNA Sequence Number=SeqID_76828
  Gene Ontology: Mol. function=transposase activity; Cellular component= mitochondrion; Biological process=transposition, DNA-mediated
  Homolog annotation: Hit_ID=UPI00005459F6; Match level="QueryCoverage =78%, HitCoverage=45%, E-value=3e-47, Identity=30%"; Hit description =PREDICTED: similar to Kruppel-like factor 7 (ubiquitous)
  Subcellular localization annotation: CTP_CleavageSite=24; ConfidenceScore=5.09e-01
KGKPNPINNTVQRPVSLRQFQFVTAKMNEPTRKYRKKNEEGSRSTQKNNKKKELKSILTSLLFVDAGEKNEEQHKKKEDLMDGYYSEVEESNYPKKRKKLAGGDSGSLRRVWVKERSGAWWEECNKPEFPEQEFKKAFRMRRLTFEAICEELNSVIAKEDTTLRSAIPVKQRVAVCLWRLATGDPLSVVSRRFGLGISTCHKLVLEVCTAIKTVLMPKYLQWPNVVALRDIKGEFENISGIPNVVGSMLTSHVPIIAPKMNVSAYFNKRQTERNHKTSYSVTVQGVVDHRGVFTDVCIGWPGSMGDDQVLEKSALFHRANNAGLNLSGVWVVGGCGYPLLDWVLVPYTQQNLTWTQHAFNEKIGEVRRVAKGAFGRLKGRWGCLQKRTEVKLQDLPFVLGACCVLHNICELKNEEMDPELLENIDDDGDYAEVMEPEVAFRSVSSLKARDAIAHNLLHHGLAGTSFV

SEQ ID NO: 193607 - protein, 611 aa, Glycine max
  Coding DNA Sequence Number=SeqID_76829
  Gene Ontology: Mol. function=protein serine/threonine kinase activity; Cellular component=ubiquitin ligase complex; Biological process=protein amino acid phosphorylation
  Homolog annotation: Hit_ID=Q9LYH3; Match level="QueryCoverage=87%, HitCoverage=80%, E-value=1e-142, Identity=49%"; Hit description =Putative receptor-like kinase
  Pfam annotation: Domain name=Pkinase; Domain location=405-611; Score =75.1; E_value=2.2e-19; Accession=PF00069.15; Description=Protein kinase domain
  Pfam annotation: Domain name=Pkinase_Tyr; Domain location=405-611; Score=37.1; E_value=9.5e-15; Accession=PF07714.7; Description =Protein tyrosine kinase
  Pfam annotation: Domain name=TolA; Domain location=206-485; Score= -151.9; E_value=0.064; Accession=PF06519.2; Description=TolA protein
  Pfam module annotation: Pfam domain module=Pkinase::Pkinase _Tyr::TolA; Domain location=405-611::405-611::206-485
MAKLNKNERTVEEERWERLVPVPSSEERARARARARLLFSLLSLFLFRPPSFLVDVDPTPAAALPHVTNVFPPDEEDVANIFNTLRGMCTRKAVKMKEAVIDDSDVVRGLLEYANRNAIHSIVDIPTAMIKSAPDYCSVYIISKLKIVSARSAVRSMSKGFMAPKQLPVQACPPSEPEGGSVRGQPPRSRSTYEGPVEPMRIQARERPRSAGSMSIDINIDVHTHPRHWSMDEREIAGLVTMDVTKQDSIPDVSDSFGTSGPQSSVSVTEKKELEAEMKRLRLELKQTMDMYSSACKQAISAKNQAEQIRQWKMEEDRKVEVVRLSQEAALALAEREKIRAKAALEAAEEARRRAEQDAQRRKDAEMKARLEAEEKERALSALAHNDNRYRKYTIVEIEAATEKFYPLNKIGEGGYGPVYKGHLDHTPVAIKILRPDAVHGMKQFQQEVLSCIRHPHMVLLLGACPEHGCLVYEYMDNGSLEDRLYRKNNSRPISWRKRFQIAAEIATALLFLHQNKPEPIVHRDLKPSNILLDRNYVSKISDVGLARLVPASVADTMTQYYMTSAAGTFCYIDPEYQQTGILTTKSDVYSLGIMLLQIITAKPPMGLAHI

SEQ ID NO: 193608 - protein, 174 aa, Glycine max
  Coding DNA Sequence Number=SeqID_76830
  Gene Ontology: Mol. function=structural constituent of ribosome; Cellular component=intracellular; Biological process=translation
MDPTIDLDEVLDQMIDEELEDNSDEEIIRLILESQQQLHGNTTSRSQRRRVVHRNREEGHHRLFNDYFSENPVYTEIQFRRSNHDEYFQMRVDALRRKGLSPLQKCTTTIHILAYGSPADSVDEYVRIGETTAVECLERFVLGICTIFGNEYLRRPNNEDIKRLLQMGAAHGFP

SEQ ID NO: 193609 - protein, 76 aa, Glycine max
  Coding DNA Sequence Number=SeqID_76831
METRDATMAGDTTMAGDETIFGDPTMCFIVDASKVKVRPREGVAVVAGGVDECGHGGEEEDREEERGKLLEVLLER

SEQ ID NO: 193610 - protein, 223 aa, Glycine max
  Coding DNA Sequence Number=SeqID_76832
  Gene Ontology: Mol. function=DNA binding; Cellular component=nucleus; Biological process=RNA-dependent DNA replication
  Homolog annotation: Hit_ID=Q2HUH8; Match level="QueryCoverage=92%, HitCoverage=65%, E-value=3e-25, Identity=31%"; Hit description =Histidine triad (HIT) protein; Homeodomain-like
MVECIKGFNYRSRPNIKEYWARIKNAYNNDDVHQSGQFCERSWTQLKSRWNRIHPPVQKFNGCYKQADKHRRSESSEKDILADAHMIYSQDTEFMSKCSKRTKVSTSGNYLLSSNLETPIEVEEYDTPSPMSRPIGQKATKRKSKGKECPNTLDLSGIESVMKDKNMNTSKLIQLKEAQEKRLQEHERRMEYEILMKDTSNMSEQQRKDHEKYCDHIRKKLGY

SEQ ID NO: 193611 - protein, 100 aa, Glycine max
  Coding DNA Sequence Number=SeqID_76833
  Gene Ontology: Mol. function=aminoacyl-tRNA hydrolase activity; Cellular component=ribonucleoprotein complex; Biological process =mRNA processing
  Homolog annotation: Hit_ID=Q1SCZ8; Match level="QueryCoverage=52%, HitCoverage=30%, E-value=8e-16, Identity=64%"; Hit description =Peptidyl-tRNA hydrolase
MEPMDIVRKAKEDASLPKVFSPTFAAEDMLHRLSRCCFCIVTPRPWLFMGLGNPSDKFKGTKHNVGFEMIDAFAKSQGIPMDTVHFKAIFGKGFVGESQW

SEQ ID NO: 193612 - protein, 70 aa, Glycine max
  Coding DNA Sequence Number=SeqID_76834
  Homolog annotation: Hit_ID=Q1SSC0; Match level="QueryCoverage=92%, HitCoverage=30%, E-value=4e-17, Identity=54%"; Hit description =Thaumatin, pathogenesis-related
MAKEGPAEEEEPAAVIGGVALVLVDVEGATVVAPEAPGLEGDLEASAGQNGLSYTRLDPRPHWIGALVLE

SEQ ID NO: 193613 - protein, 350 aa, Glycine max
  Coding DNA Sequence Number=SeqID_76835
  Homolog annotation: Hit_ID=Q5Z9P5; Match level="QueryCoverage=89%, HitCoverage=78%, E-value=5e-77, Identity=48%"; Hit description =Putative brain and reproductive organ-expressed protein
  Pfam annotation: Domain name=BRE; Domain location=4-313; Score=-80.5; E_value=0.00056; Accession=PF06113.3; Description=Brain and reproductive organ-expressed protein (BRE)
MAAAGPENVPPFIAAQLSHLLSHFGLTVKAIINQINSLSFHFHPHSYSPNTNTFFSFSGDVIYDAESPNTAPDVIFSPEDDDFHPFHMFPSSSEPANNCLSDWNYKDPTRLLTLIQYLRDQYVLYQRKRVGEVDDDRLTFEISTILSREGIEMHMSSGAEKSEEVKFAVPLLDMNINKMVACCPWRYSQRIYLQVVYPVGRKYMSVPSAPRLKLVSSPELKAVFSIDDVKLPPWLDGMCLAEYLPNLEEYLGKQVLEAVSLIEVRRHFIEALSSPLGRPVEADAVSSRDTYSQIARVFCRKATFLAASGVFSFLLMTLVTVTCDQGRAEIYCWYLSFDLTGVSCLAKREN

SEQ ID NO: 193614 - protein, 162 aa, Glycine max
  Coding DNA Sequence Number=SeqID_76836
MEATKEKMCVVEAAKKRGALLMGTRSCGFIAWVLPTMGPTKVVAMHDMFKSVFLFSRFCGLMFKLGFYFLGGTMVGYVKDEGVTGEKPLRATRGENATATDGIASGLVACAGDIAVHWIQTDYIQCMAISPAQAARPLGYSASDNSIFATCCTQGLLASNTG

SEQ ID NO: 193615 - protein, 1073 aa, Glycine max
  Coding DNA Sequence Number=SeqID_76837
  Gene Ontology: Mol. function=cellulose synthase (UDP-forming) activity; Cellular component=membrane; Biological process=cellulose biosynthetic process
  Homolog annotation: Hit_ID=Q6XP46; Match level="QueryCoverage=99%, HitCoverage=100%, E-value=0.0, Identity=85%"; Hit description =Cellulose synthase
  Pfam annotation: Domain name=C1_3; Domain location=18-51; Score=7.4; E_value=0.07; Accession=PF07649.3; Description=C1-like domain
  Pfam annotation: Domain name=Cellulose_synt; Domain location=250 -1068; Score=2153.4; E_value=0; Accession=PF03552.5; Description =Cellulose synthase
  Pfam annotation: Domain name=PHD; Domain location=19-68; Score=13.8; E_value=0.0023; Accession=PF00628.19; Description=PHD-finger
  Pfam annotation: Domain name=zf-C3HC4; Domain location=20-65; Score =5.7; E_value=0.041; Accession=PF00097.15; Description=Zinc finger, C3HC4 type (RING finger)
  Pfam module annotation: Pfam domain module=C1_3::Cellulose _synt::PHD::zf-C3HC4; Domain location=18-51::250-1068::19-68::20-65
MESEGEAGAKPMKTLGGKICQICGDNIGNNANGDPFIACDVCAFPVCRACYEYERKDGNQSCPQCKTRYKRHKGSPAILGDREEDGGADDGASDFNYNSENQNEKQKIEHMLGWQMAYGRAEEAIAPNYDKEVSHNHIPLLSGGQEVSGELSAASPERLSMASPGGRGKRAHNLQYSSDLNHSPNIRVGDPGLGNVAWKERVDGWKMKQDKNVAPMSTGQATSERGAGDIDASTDVLVDDSLLNDEARQPLSRKVSIPSSRINPYRMVIALRLVILCIFLHYRITNPVPNAYALWLISVICEIWFAISWILDQFPKWLPVNRETYLDRLALRYDREGEPSQLAAVDIFVSTVDPLKEPPLVTANTVLSILSVDYPVDKVSCYVSDDGAAMLTFEALAETSEFARKWVPFSKKYNIEPRAPEWYFAQKIDYLKDKVQPSFVKDRRAMKREYEEFKIRINGLVAKAQKIPEEGWVMQDGTPWPGNNTRDHPGMIQVFLGQSGGLDTEGNELPRLVYVSREKRPGFQHHKKAGAMNALVRVSAVLTNGPFLLNLDCDHYINNSKALREAMCFMMDPNLGKNVCYVQFPQRFDGIDRNDRYANRNTVFFDINLRGLDGIQGPVYVGTGCVFNRTALYGYEPPIKPKHKKPGFLSSLCGGNRKKRSKSSKKGSDKKKSSKNVDPTVPIFSLEDIEEGVEGAGFDDEKSLLMSQMSLEKRFGQSAVFVASTLMENGGVPQSATPETLLKEAIHVISCGYEDKSEWGSEIGWIYGSVTEDILTGFKMHARGWRSIYCMPKLPAFKGSAPINLSDRLNQVLRWALGSVEILFSRHCPIWYGYSGRLKWLERFAYVNTTIYPVTSIPLLMYCTLPAVCLLTNKFIIPQISNIASIWFISLFLSIFATGILEMRWSGVGIDEWWRNEQFWVIGGVSAHLFAVFQGLLKVLAGIDTNFTVTSKASDEDGDFAELYMFKWTTLLIPPTTLLIINLVGVVAGISYAINSGYQSWGPLFGKLFFAFWVIIHLYPFLKGLMGRQNRTPTIVVVWSILLASIFSLLWVRIDPFTTRVTGPDVEQCGINC

SEQ ID NO: 193616 - protein, 107 aa, Glycine max
  Coding DNA Sequence Number=SeqID_76838
MVPVKLAIQLSSCWHWRFGRVSPLALVKHVTWSRGETFQKGLASGSGGITFSPIKHPYTNEWKQAADPGEFCLLLATLWLGGCYLMLVAKSLKWVLLLLSQILYFVL

SEQ ID NO: 193617 - protein, 72 aa, Glycine max
  Coding DNA Sequence Number=SeqID_76839
MEVLHFLQLTNSPMSLLAPQVPNLSGVGLALVSPPSCVVEEQEVGIICCMEKTLIRGEEVGDARELAQPSRC

SEQ ID NO: 193618 - protein, 267 aa, Glycine max
  Coding DNA Sequence Number=SeqID_76840
  Gene Ontology: Mol. function=nucleic acid binding; Biological process= RNA-dependent DNA replication
MRQEGHMDEETISPRVTLKDHATWIEPLHFNTIARPTFTNVVKLEMKLALIHLIQNNQFHRHSHENPYAHSSTLIDICITVKINHVLDEALCLCLLPFSLAGDTISWLGSFPPNSLSMPPNIVAKFLHKYFTRSKKHEKYLETCSGGLRAQSKLMLDALTGVKISSKTQREAIKIIKNMVVNANEFQNNRVMVPSKKLLEVNTQDGLLAQQKFLTRKIEELTQQITYLPQHFKLQIIASTPKFKCFIYESCGGGHATIECAKIHEEV

SEQ ID NO: 193619 - protein, 110 aa, Glycine max
  Coding DNA Sequence Number=SeqID_76841
MDKEIKGGRRDELTNPKINHKVLRVEIKSPKGRNSKPTKHPTTQPNPLILLISSLNNVIKIEFNHTIRKNYDVTIGRAEAKGIMDVVRVMIQGVECLTRFIRTTRWVLIP

SEQ ID NO: 193620 - protein, 53 aa, Glycine max
  Coding DNA Sequence Number=SeqID_76842
MGRRKKEKNPKDWRNGLRLRCVHMNENDLFSKRTHVRFSPCSKFPWASSNHAS

SEQ ID NO: 193621 - protein, 137 aa, Glycine max
  Coding DNA Sequence Number=SeqID_76843
MDKIEIKHALPALKCIMHMLQQITPIPNVGGSTSPCPRPRPRPHPHPENFTNSQYMVLYFTLSCGKKRKHSQCDEDMTKSKGKDSLEGLGGPMTRARARKAKEALQQVLSILFEYKPKFQGEKSKVVSCIMAQMEED

SEQ ID NO: 193622 - protein, 728 aa, Glycine max
  Coding DNA Sequence Number=SeqID_76844
  Gene Ontology: Mol. function=nucleic acid binding; Biological process= regulation of transcription
  Homolog annotation: Hit_ID=Q1T5G4; Match level="QueryCoverage=96%, HitCoverage=100%, E-value=0.0, Identity=75%"; Hit description=Zinc finger, CCCH-type
  Pfam annotation: Domain name=Ank; Domain location=119-154; Score =34.9; E_value=2.7e-07; Accession=PF00023.20; Description=Ankyrin repeat
  Pfam annotation: Domain name=Ank; Domain location=84-117; Score=21.1; E_value=0.004; Accession=PF00023.20; Description=Ankyrin repeat
  Pfam annotation: Domain name=zf-CCCH; Domain location=298-323; Score =26.4; E_value=0.0001; Accession=PF00642.15; Description=Zinc finger C-x8-C-x5-C-x3-H type (and similar)
  Pfam module annotation: Pfam domain module=Ank::Ank::zf-CCCH; Domain location=119-154::84-117::298-323
MCGGPEKSKSLSTSSSSAVEGSSNSKDMKNLTVHTEDSFSCLLELASNNDFEDLKLALDRDASLINEVGLWYVRQIGSKQIVLQPRTPLMVAAMYGSIDVLKLLLSCPEADVNFSCGTDKSTALHCAALGGSVNAVDVVKLLLSAGADVSCVDANGNRPVDVLVVPPKLEGLKATLEDLLSDSTSVGSVGDCFIPVSVNSSCSDSAAHLSSPENGLPFSAMASKFADTAVNSASEKKEYPIDPSLPDIKNSIYATDEFRMFSFKVRPCSRAYSHDWTECPFVHPGENARRRDPRKFHYSCVPCPDFRKGACRRGDMCEYAHGVFECWLHPAQYRTRLCKDGTSCNRRVCFFAHTAEELRPLYVSTGSAVPSPRSSASTPNVMDMAAAMSLFPGSPSSISSMSPSPFAQPMSPSTSGISHSSNAWPQPNVPALHLPGSNIQTSRLRSSLSARDMPPEDFDVLQDFDGQQHLLSDLGCFSQPRPGAISVSRSGRSKTLTPSNLDELFSAEISSSPRYSDPAVASVFSPRHKSTIMNQFQQLQSSLSPINTSVSSPRNVEHPLLQASFGVSSPGRMSPRSMEPISPMSSRLSAFAQREKQHQQLRSLSSRDLGANVPASMVGSPVNSWSNWGSPHGNGKVDWSVNGNELGRLQRSSSFELGNNGEEPDLSWVQSLVKESPSEIKEKLTGSGPVASVDGPSSNPKSNPQVESVDHSVLGAWLEQMQLDQLVV

SEQ ID NO: 193623 - protein, 129 aa, Glycine max
  Coding DNA Sequence Number=SeqID_76845
MKVGLQPKKRPVLKEKCLPPPITLPGYTWVDAEVGTYFFRYIYESDLLNLLSWLSISAIMKLEYCLVTLCTIRSDATPHLEFVYMNREGMNMDLFYMALDRRLQEDWAKNAREGPRVLMSLRVDFGPMG

SEQ ID NO: 193624 - protein, 837 aa, Glycine max
  Coding DNA Sequence Number=SeqID_76846
MGEKGCPVLKEVVPCRGSLCDVWGSSLDKQRVTSLSSPQVWMSIVLCQMSVMDMSLACQVSMCNTCNTLAYVSLTEWACTGVVDLSLSSSTNFQKVLPSTRMSSFLFDFAIGLGGSDSGGSIEQPTMDREVISIGGSSSEDTHRGASDSESSSSERERASCRIGGGVSRPRGGAWYFVASRELVPVTVILPPFAFGGTRRGSGGGDVKVSPHVHHSLSVRPPSSTLAVAGYEWVKLANPEGSCKLAVRACESDDFLFFRVVPGCSSFFFMYKCLFEFLGVILPLTIFQCALLEHLNVASSQLHPNSWAMVRAFEVLCPFFNIWPSVLIFLFFFKMKLSGEIGWVSLNNVSKKLFEFDSNIFGHFKDHLFKVLATDVVADGTPLMLNRDGELHFLFYWVDKVILEQLSASLDARAILYHPSVSDHVTAFDGIMGDFAWRPLVKQVGLAGETVSLSAVAPSTGEEGQPTGEVGLVAIAIEVTPSVFSSVLEKRKRDDGTGPSDHKKLKAFMSLYALRQVTGLMPNAGRLLIAQDVPLAPPTIEAPVVAARVTPVAVAVVMLATQSDFVVAPLSTVATPLLCVGVVAAGASTVLPPSSMASVASPSALLAVVVLPSSSSRPRVLFDHLYTFRDADSLWGAIYKPEQKTPIGFVSTFDKNLIRSTRTVQKVAFLEVEIAKWRATAHTFWRVECPKVVNATVAFAELFKCCKDLQAEKMDLGGKVESMMAEKDELAKVIADLEARLKESEFELRAAKEREASRELKEELILYKKEAMDQHEKGFQKAVRQVDFFAKDLDLGLFDPFKDVKDGVLLDEKEIVADEEAADEGQGVVEQGDDAYV

SEQ ID NO: 193625 - protein, 61 aa, Glycine max
  Coding DNA Sequence Number=SeqID_76847
MTTQLKIKVSHLNHTHSHYSHSHSQQRENPKILPPRWICIDNNEDLYLGDVDLDSTNGPTI

SEQ ID NO: 193626 - protein, 319 aa, Glycine max
  Coding DNA Sequence Number=SeqID_76848
MTSEVPTEPRAMPQFRSKLQLDKLFNGFWASVGGAVSRVYVKFIAQAGLINAPGKLALTEGGHEVHVASGLDSHLQSRGVDLCGVQDINGTALVDEDPEHHKVCYNDEDNHRVILVDEVLVLVEVVAHAAVAAVFVCLGLLLFFCLLLGSYATSLDGPTVFGVASDPGLGDFVWGVFHARIWALWREAGACLACAFRPTFTDQGGRGHVVRPASSVLCTESFKQGVEAAMDLGFPMSGRHLDALLDLFPHRTVGSVVPLYHKRMSMDSSCCWTVHVGEAQIICSVACALGPLAGHGQLLALQLFFVASLHLCDVVLELL

SEQ ID NO: 193627 - protein, 90 aa, Glycine max
  Coding DNA Sequence Number=SeqID_76849
MHRRPQTHCHHLIRLIQLGHFAWSSIYSTWFASRRPTTGDQFRAEVAWPRDWPKAQAGEAPAEAPGDAEEARMDEEMTDLLGFLGGSGAM

SEQ ID NO: 193628 - protein, 214 aa, Glycine max
  Coding DNA Sequence Number=SeqID_76850
  Gene Ontology: Mol. function=transferase activity, transferring nitrogenous groups; Cellular component=mitochondrion; Biological process=biosynthetic process
  Homolog annotation: Hit_ID=P0AB77; Match level="QueryCoverage=100%, HitCoverage=53%, E-value=7e-95, Identity=79%"; Hit description=2 -amino-3-ketobutyrate coenzyme A ligase
  Pfam annotation: Domain name=Aminotran_1_2; Domain location=42-214; Score=-96.2; E_value=0.015; Accession=PF00155.11; Description =Aminotransferase class I and II
MSDQFYSQIRQQLETTRQDGLFKQERTLTSAQQAEINVANSPPVINFCANNYLGLANHPALIQAAKDGMDTHGFGMASVRFICGTQDSHQLLERRLAEFLGMEEAILFSSCFDANGGLFETLLGAEDAIISDALNHASIIDGIRLCKAQRYRYANNDMAELRARLQEARDKGARHLLIATDGVFSMDGVIANLQGICDLADEFNALVMVDDSHA

SEQ ID NO: 193629 - protein, 83 aa, Glycine max
  Coding DNA Sequence Number=SeqID_76851
MWFPGSFPFTSYPNFVNINQCTLRVRLIASEPNLRSCLMDEGLTGERPELKLSFHGKKVQKFGRPAPEIEGLVTAIGLSPLIA

SEQ ID NO: 193630 - protein, 81 aa, Glycine max
  Coding DNA Sequence Number=SeqID_76852
MVTKRTKSKKWRGSGKKLPNSEQQEDIIQRFNHEPFNLVTSSGESEVKPENIPERESLVPTGNAHSVSQPALTTEHTNYKN

SEQ ID NO: 193631 - protein, 142 aa, Glycine max
  Coding DNA Sequence Number=SeqID_76853
MASGMYARARCLKLRSDNPLVDPPKSLQNPRLDKIQGKHVTDPRLDKPKVHPWNTSISKTQGPPLVHILEKPKVEVILTPHNHQRRNLVGQEIYPQTSWQDLQLGESQTYSSQALRKKLHKVEGSLTKWVTRPLNRLKSNLR

SEQ ID NO: 193632 - protein, 557 aa, Glycine max
  Coding DNA Sequence Number=SeqID_76854
  Subcellular localization annotation: CTP_CleavageSite=46; ConfidenceScore=5.24e-01
AQYANRLSPRVGRFINAAGTTGFPTGKRAVSATQLIAGSSSSTLVVAGYEWVRDNILKYKSFVTFAVSIVALQCQVTLASLEGSCKIVVQACDFSFLRALNVSPSQLHPNSWAMVRAFEILCPFFNIRPSVPDHFFKVLATGVMVDGLPLIFSRDGEPHFTFYWQFDPTSNPLATLDDKVPNLVLFCVRGIMGDFAWRPLVKQVEPTGGIVPLFVSPIVIVAKDDGAGPSSHKNMSLRALKQVVGLTPSAGLPSSVQNVPSTPPTVEASAANAVTPSPSPPLVVPLQEATPVVAKVSVLAALVGSVVTPPSTVITPLLSVGVATTSAPVVSPPSFLALPSSSSRPRVFLDYLYTSSDADSLWGASYKPEQKTPTSFVSSFDKNLIRSAGVQNATDSFSRERVECPDVANSTIAFVEAVKLNCQLSSKVGGVLAKLLHARLDGDELFKCCKDLQVWLKESEFKLEEFELQAAREKEANKELEEELLIYKKEVMEHHEKGFNKTIKQAEFFTKDLELGLFDPFKDVNDGVLIDEEEIAREEEAVDEEHGVAEQGDDACV

SEQ ID NO: 193633 - protein, 217 aa, Glycine max
  Coding DNA Sequence Number=SeqID_76855
  Homolog annotation: Hit_ID=O21999; Match level="QueryCoverage=23%, HitCoverage=33%, E-value=6e-22, Identity=100%"; Hit description=LacZ- alpha
MGGIDFGGSIEQPMRDWEVISIGGSSSEDIHRGASDNESSSSERVRVSCRIGGGTSRPRGRAQPSIAFGEPVPVIMILPTSASWGWVRDNILKYKSFVTFAVSIVALQCQVTLASLEGSCKIVVQACDFSFLRALNVSPSQLHPNSWAMVRAFEILCPFFNIRPSMQAWHWPSFYNVVTGKTLALPNLIALQHIPLSPAGVIAKRPAPIALPNSCAA

SEQ ID NO: 193634 - protein, 85 aa, Glycine max
  Coding DNA Sequence Number=SeqID_76856
  Homolog annotation: Hit_ID=Q1T2H8; Match level="QueryCoverage=61%, HitCoverage=36%, E-value=2e-11, Identity=66%"; Hit description =Putative folylpolyglutamate synthase-related
MWDLLERFSQDRSKYAITFVRVYMFRLLLTEAAIAGGETRTTPTSLLRDSWIKASDELHIGIVHDEMAEYSELLKGCGYWLLSHL

SEQ ID NO: 193635 - protein, 78 aa, Glycine max
  Coding DNA Sequence Number=SeqID_76857
MSHAVKDNRGKWAPNYEGPFVVKRAFSGGALILTNMDGEELPSPERTQMEDRVTTDRSSSLPGVGQAENVVARQPSIL

SEQ ID NO: 193636 - protein, 67 aa, Glycine max
  Coding DNA Sequence Number=SeqID_76858
MEGIMILLLENFSCSEFLRVFPWTKFPLTTLESTTYVHRPTDITGSRGVIVTAPLILLKTLLSPLKQ

SEQ ID NO: 193637 - protein, 52 aa, Glycine max
  Coding DNA Sequence Number=SeqID_76859
MPNIVNLMCFNFNFSSTTASGSILFAKPAHGPPSESCRPIRAAELAKRDPSR

SEQ ID NO: 193638 - protein, 119 aa, Glycine max
  Coding DNA Sequence Number=SeqID_76860
MLAIINKYKEELDLATTHEHKVADEYAWVEGTITKRTPRHPYRPRSKPRTMGDLEEVQEQMKVDMSTLKEDMASMMEAMLGMKQLMESNATTAAAPSTTIEGDLILPTVAYHPILDIRG

SEQ ID NO: 193639 - protein, 133 aa, Glycine max
  Coding DNA Sequence Number=SeqID_76861
MESRKRARMKDIPSSSTLAPPSVTVGQEVQGSQTLVPMLQSLFRGQFIIMHNLQELAHNRPIITMEHFLEQVAWPEAQLPLVRPNEATPPEPTCAAAPPDSPKGETADLPTSLVGGISDSSSGEAFTLTDSPV

SEQ ID NO: 193640 - protein, 59 aa, Glycine max
  Coding DNA Sequence Number=SeqID_76862
MSAREKMQADQQFPTNAWLSARIKPLSEVCRSEKLQLSLSQAMAGLAKMMHLKYRGACA

SEQ ID NO: 193641 - protein, 60 aa, Glycine max
  Coding DNA Sequence Number=SeqID_76863
  Gene Ontology: Mol. function=metalloexopeptidase activity; Biological process=proteolysis
  Homolog annotation: Hit_ID=Q6Z8B5; Match level="QueryCoverage=88%, HitCoverage=10%, E-value=1e-19, Identity=83%"; Hit description =Putative Xaa-Pro dipeptidase
MASRLGAAFMPHGLGHFLGIDTHDPGGYLKGLERRKEPGLKSLRTIRDLREGMVSYGFSQ

SEQ ID NO: 193642 - protein, 147 aa, Glycine max
  Coding DNA Sequence Number=SeqID_76864
MTGRLLAGSLTFDCRIMHYIIVRILLPRSSNLAQASEEDLILMWAFQTGRQIDWTHLVRYRMHKALRANAPLPYPHLVTLFLHHFNVPLDDEPFVKVKSYRKDVDGQWVRKHDLPSPIPDERTPSPPPQRGDSTSFLTEVLIELRGL

SEQ ID NO: 193643 - protein, 157 aa, Glycine max
  Coding DNA Sequence Number=SeqID_76865
  Gene Ontology: Mol. function=hydrolase activity; Cellular component =nucleus; Biological process=metabolic process
  Homolog annotation: Hit_ID=Q5NUF4; Match level="QueryCoverage=99%, HitCoverage=58%, E-value=8e-46, Identity=60%"; Hit description=2 -Hydroxyisoflavanone dehydratase
  Pfam annotation: Domain name=Abhydrolase_3; Domain location=1-153; Score=-18.0; E_value=1.6e-06; Accession=PF07859.3; Description =alphabeta hydrolase fold
LAPENPLPAAYEDSWEALKWHGDFNRFYIGGDTAGANIAHNAVLRAGVESESVSLLGGMEITGAVLAFPLFWSSEPVEGFEESSAMQVALINPLASGAPSLASLGCHKVLIFVAGKDDLRDRGIWYCDAVKESGWEGGGTASSGGRGTLLSDLPSSN

SEQ ID NO: 193644 - protein, 422 aa, Glycine max
  Coding DNA Sequence Number=SeqID_76866
  Gene Ontology: Mol. function=nucleic acid binding; Cellular component= SWI/SNF complex; Biological process=negative regulation of transcription from RNA polymerase II promoter
  Homolog annotation: Hit_ID=Q9SFG5; Match level="QueryCoverage=98%, HitCoverage=36%, E-value=1e-157, Identity=68%"; Hit description =Putative transcriptional regulator
  Pfam annotation: Domain name=Helicase_C; Domain location=66-145; Score=102.4; E_value=1.3e-27; Accession=PF00271.21; Description =Helicase conserved C-terminal domain
MQLRKCCNHPYLFVGDYDMYRRKEEIVRASGKFELLDRLLPKLRRAGHRVLLFSQMTRLMDTLEVYLRLHDFKYLRLDGSTKTEERGNLLRKFNAPDSPYFMFLLSTRAGGLGLNLQTADTVIIFDSDWNPQMDQQAEDRAHRIGQKKEVRVFVLVSVGSIEEVILERAKQKMGIDAKVIQAGLFNTTSTAQDRREMLEEIMRRGTSSLGTDVPSEREINRLAARSDEEFWLFEKMDEERRQKENYRSRLMEEHELPDWVYSPMNKDDKAKDFNSGVTGKRKRKEVVYADTLSDLQWMKAVENGEDISKFSGKGKRRDHHSSDSIAQASDNTGAEESLELKTESVPMENERTSEDSFHVTPPAKRFNPEGTFLKQTYEDVGSGLNHHLLSWNTHKKKRSSFLGQGSLSETRGHSSNGRANWN

SEQ ID NO: 193645 - protein, 156 aa, Glycine max
  Coding DNA Sequence Number=SeqID_76867
  Homolog annotation: Hit_ID=Q9SFG5; Match level="QueryCoverage=62%, HitCoverage=8%, E-value=1e-24, Identity=57%"; Hit description =Putative transcriptional regulator
MSFHTISIKWEWSLSWSSDNFTEDLCYCVDPELPSSRGEDLQTKCLLELYGLKLAELQMKVRSDVSSEYWLNAKCAYPDRQLFDWGMMRLRRPLYGVGDPFAVDADDQLRKKREAERLLFAMILAAAARCDATALGGVAGCHSASLQHDCGTTGHN

SEQ ID NO: 193646 - protein, 358 aa, Glycine max
  Coding DNA Sequence Number=SeqID_76868
  Gene Ontology: Mol. function=nucleic acid binding; Cellular component= nucleus; Biological process=chromatin modification
  Homolog annotation: Hit_ID=Q9SFG5; Match level="QueryCoverage=86%, HitCoverage=25%, E-value=1e-116, Identity=68%"; Hit description =Putative transcriptional regulator
  Pfam annotation: Domain name=DEAD; Domain location=201-355; Score= -46.4; E_value=0.047; Accession=PF00270.19; Description=DEADDEAH box helicase
  Pfam annotation: Domain name=ResIII; Domain location=197-346; Score= -13.1; E_value=0.00058; Accession=PF04851.6; Description=Type III restriction enzyme, res subunit
  Pfam annotation: Domain name=SNF2_N; Domain location=203-358; Score =40.1; E_value=2.9e-10; Accession=PF00176.13; Description=SNF2 family N-terminal domain
  Pfam module annotation: Pfam domain module=DEAD::ResIII::SNF2_N; Domain location=201-355::197-346::203-358
MSGHKWHAKCKLLKTPEAPGASTLSVVLQTSIGFHVAWHGRQRQRATRAEKLRFQALKADDQEAYMRMVKESKNERLTLLLEETNKLLVNLGAAVQRQKDNKYSNGIEPLEDSEADLLESDASKNGVSKESPLDEDIDLIDSDHNGDSSDLLEGQRQYNSAIHSIQEKARGFLILQMHCCIIFCFYEVTEQPSMLQGGELRPYQIEGLQWMLSLFNNNLNGILADEMGLGKTIQTISLIAHLMEHKGVTGPHLIVAPKAVLPNWVNEFTTWAPSITAILYDGRLDERKAMKEELSGEGKFNVLLTHYDLIMRDKAFLKKIQWQYLIVDEGHRLKNHESALARTLDNGYDSTLLMTQIN

SEQ ID NO: 193647 - protein, 240 aa, Glycine max
  Coding DNA Sequence Number=SeqID_76869
  Gene Ontology: Mol. function=deoxyribose-phosphate aldolase activity; Cellular component=cytoplasm; Biological process=deoxyribonucleotide catabolic process
  Homolog annotation: Hit_ID=UPI000060F465; Match level="QueryCoverage =67%, HitCoverage=42%, E-value=3e-32, Identity=45%"; Hit description =UPI000060F465 related cluster
  Pfam annotation: Domain name=DUF171; Domain location=2-205; Score =39.9; E_value=1.7e-12; Accession=PF02598.7; Description =Uncharacterized ACR, COG2106
MLKLKHFYHWHCYYMFVILLHCYYGQVLIYCNNFIGVTVKERDSNSGATLVDVGLVKNVIVDQIFEPGRRVTVAMGTDRNLDSDLPRQVISSSKPREEGTYWGYQVRYAHNISAVFKDCAYKRGYDFIIGTSEHGQIIKSSDLEIPSFRHLLIAFGGLAGLEESIEEDDNLKGKKAQDAFNLYLNTCPHQGSRTIRTESSVPSIHVTSEGIDVNVLYDCVKLHDHSAFSLCLEPYKDSSN

SEQ ID NO: 193648 - protein, 326 aa, Glycine max
  Coding DNA Sequence Number=SeqID_76870
MAAIVHHGLQSHLESQHAESIALKLRLPSSKPPLPQLIDLAFKPSFWDSNSTIKPHNEENNKSTPSNPNSWSFLEALSNITKEPSQNQTTYVHPQQKRSSLSLSPKSLQLCTENLGNESGSDSGSDSDENSIDMLSSLNGNSGTREQAQQRQPRQLSTAKKAKTQNFPPPLTTIRGSDSLRVRPHREDGRLVIEVTKVPPSPSCFHAERSHGRLRLCFLTNHTPSFDTEAAEDDVEENEPFANEKELENEISGQVKDTKEEHEETENETGEEEEEGGEEECVACGYVESDVIIMEKYERLRSCNEGGDHENYEFLNWSEPRLVATS

SEQ ID NO: 193649 - protein, 95 aa, Glycine max
  Coding DNA Sequence Number=SeqID_76871
MASKFLPSTELDKFEFPLLRCVLFTVTIAHVADGFIADGRLFFLPRNRSKLPSMFALVEVPTMRQNLGPLKQSQRLEPNLKQQHIAGPDIPPVTM

SEQ ID NO: 193650 - protein, 82 aa, Glycine max
  Coding DNA Sequence Number=SeqID_76872
MEVPISQKAIAFYTHCNLCHRPLKFSLELGQRKTKPMGHHGDTGKGQTRTYFILLPHRLCQKDAYCCSSSPRRQNKITKKKR

SEQ ID NO: 193651 - protein, 1515 aa, Glycine max
  Coding DNA Sequence Number=SeqID_76873
  Homolog annotation: Hit_ID=Q9LUW1; Match level="QueryCoverage=99%, HitCoverage=98%, E-value=1e-100, Identity=33%"; Hit description =Arabidopsis thaliana genomic DNA, chromosome 3, P1 clone: MCB17
MAANGLTRRRHRTNNSLRDSPEEDGAMELQEPSRLRDRGGSGKKDRDRERERERERDRLGRSKKRRGDRLMHSSREDGGEDTSEESINDEDDDDDEDGGGGGSGSGSASVRMLPLNPSSLSNQHHRKSFPPAKVLRPTPPTTWKAADEMIGVSVPRKARSASTKRSHECWASSGGGIVAEQNHRQPSTSPVRAAAPASPSSSNASVRKKIVSFGIRNGGAKFRPPKTTTSSSSKPSSSAQDEIEIEIAEVLYGMMRQPQGPSKQEIIANDSTKFDSRESNKSSTDAKSPISNPQNSSSSATPMSAVAPKRKRPRPVKHEDENPASLIVRSSPISSTTKAESDQPSKMETCSSNLDKNNVGSVSENLAHSQTVQIMPEPVKPENNEFKPAATEEAEKQKDVGLSEVVVSPQLPKKESPVRQVADDDREDVKATKANHSISESDNQREEKFQIDLMAPPPPSRSSPERDVENNNNMVIDAEKEVKPMTKEDEKVLRMNKEVAMVIEMEKVKAKAEETDSQKPSFVQKERGIDLQLDLEKVDRVDTSGNVGSMVNKKQQHQNVQRQQTNSEKNVQSNSLPLPLSVPSWPGGLPPMGYMTPLQGVVSMDGTPVTSAAIPQIARMNSFWPAAAGSASLYGAKPSNLNVVPSTELHGNVPGRAANSSQDKGHGIAMFPGHIGKDKASQPAIVDNSSRKQILLQQALPPGAAPSNILHGPAFIFPLNQQQAAAAASVRPRSVKSLPVSSNGAPSSVSNSAPSNASGTGTVAVAAAAAAAAPTMSFSYPNMPGNETPYLAILQNNAYSFPIPAHVGGPPGYRGTPHAQAFPFFNGSFYSSQMLHPSQIQQQQLPAQSQQQNQQGHQNTSMSSGSSSSQKQHAQNQQQKPNNNATGSNGGASLQGFPVTKTPPSQPLQLQQQQPQQRQNHHTSHPARQVESEMGGEDSPSTADSRLARATMNIYGQNFTMPMQSPNFALMTPASIGAGGSNGSHSEKKQPQQHPGPKAGGETAPAFAMSFASMNGATGASGLDLSSIAQNNHSIMQSNHNYHIMAAQAASAQLKKSYHAAEEGKSVVNPSNLDEDRKAISAGKIPATMGQSIAFGRPDVSDPSLASLSGGNNVIDTSGRNLNLGSASSRASASVMPAAISTNAASSQQQMQRNQQQQILQHQKQNQFAAAAAAAAARNKTPSTSNGSVYSDNLPSTSSMANKFPSAVSAFPQNLVQSSNTVAQSPSQWKNSLRATTTSQSPPSMASTTPSSSVKSHPQQQARSQQPHTQISFATNPKSSAAQVQPASSTQSPSPPVMVGSPTTSSISKNTGSPRTTSASTTNNKISQSSSLSSQQAKNSSAVPARKSSPVGSRNVPSILNVPQLTPPSSTGSKSQLPQQQQKQQQQIPKQALPQAQLFFSNPYMHPQSNSSTSTTTVPSGYYLQHQHHHQQHQQRRGPEQMQRPGSSGTSPAVNNVKGSSALPTQGLLHPAQVAAMQPSGSHPQFVPTGFSYASYHVHSVPSVQVKPAEQKQPA

SEQ ID NO: 193652 - protein, 443 aa, Glycine max
  Coding DNA Sequence Number=SeqID_76874
  Gene Ontology: Mol. function=sugar porter activity; Cellular component=integral to membrane; Biological process=carbohydrate transport
  Homolog annotation: Hit_ID=Q1SDF6; Match level="QueryCoverage=63%, HitCoverage=53%, E-value=1e-126, Identity=79%"; Hit description =Sugar transporter superfamily; Major facilitator superfamily MFS_1
  Pfam annotation: Domain name=MFS_1; Domain location=4-378; Score= -49.5; E_value=0.058; Accession=PF07690.6; Description=Major Facilitator Superfamily
  Pfam annotation: Domain name=Sugar_tr; Domain location=7-417; Score =226.2; E_value=7.1e-65; Accession=PF00083.14; Description=Sugar (and other) transporter
  Pfam module annotation: Pfam domain module=MFS_1::Sugar_tr; Domain location=4-378::7-417
  Subcellular localization annotation: CTP_CleavageSite=65; ConfidenceScore=5.10e-01
MAIRSFTNLPSVITHAQNSPSLLKTQTCTIKLSGHRVSHLHLRAIVHHLLVSTWVAMWNNREVIRKEVVGGVPMAGREGGKGEFEPIIGRTGGEGANFLFTIVEAINLDEGVVKCLGSIRKRERIKGGWGWRLSLGLGGLPALLLTLGAFLVVDTPNSLIERGHLEEGKSVLRKIRGIDNIEPEFLELLDASRVAKEVKHPFRNILKRKNRPQLVISIALQIFQQFTGINAIMFYAPVLFNTLGFKNDASLYSAVITGAVNVVSTVVSIYSVDRLGRKMLLLEAGAQMFLSQLVIAVIIGMKVKDHSEDLSKGFAVLVVVLVCIFVSAFAWSWGPLSWLIPSEIFPLETRSAGQSIAVCVNLLCTFVIAQAFLSMLCFFKFGIFLFFSGCVLIMSTFVLLLLPETKNVPIEEMTERVWKQHWLWNRFIDEDDCVKEEKVVTGN

SEQ ID NO: 193653 - protein, 63 aa, Glycine max
  Coding DNA Sequence Number=SeqID_76875
MSCTAMEGSGVTCGAQVEWALRPLECHPLGPAEASRLQRPHPLPKEKARLLARPPSAETPPCS

SEQ ID NO: 193654 - protein, 229 aa, Glycine max
  Coding DNA Sequence Number=SeqID_76876
  Gene Ontology: Mol. function=helicase activity; Biological process =protein amino acid phosphorylation
  Homolog annotation: Hit_ID=Q1SN45; Match level="QueryCoverage=99%, HitCoverage=13%, E-value=2e-52, Identity=43%"; Hit description=AAA ATPase
  Pfam annotation: Domain name=DUF889; Domain location=1-229; Score =360.1; E_value=3.7e-105; Accession=PF05970.5; Description=Eukaryotic protein of unknown function (DUF889)
FGGDFRQILPVIPRGTCSDIVNAAINSSYLWDSCEILTLTKNIRLHNNLESVDEQETATFAKWILDIGDGIIDDENDGYATIQVPAHLLITQYDDPISAIVKSTFPDIDQHHNNPKFFKSKAILASTNETVEQINHYVLSFIPGDHMEYISSDSVDKSETTEDSYFQSITTEFLNSLNTSGLPTHSIKLKIGSPIMLLRNLDQNQGLCNGTRLVVTKMAKHVIAAEIIS

SEQ ID NO: 193655 - protein, 65 aa, Glycine max
  Coding DNA Sequence Number=SeqID_76877
MYRNFTYCETKGAKYLEAIKQRLHAMKQWSPEEIRRTRPAQRAYSQSGQLMLSVKKVHEKAQGHA

SEQ ID NO: 193656 - protein, 81 aa, Glycine max
  Coding DNA Sequence Number=SeqID_76878
MVMGPPSLLMSVVLRCCREVVAGQVGLSAIGANKVSGNFVEEYAMATHQFSSYCESKSMMIRTLLLTMTSMTTWGEMRETS

SEQ ID NO: 193657 - protein, 235 aa, Glycine max
  Coding DNA Sequence Number=SeqID_76879
  Homolog annotation: Hit_ID=Q2HVB5; Match level="QueryCoverage=29%, HitCoverage=27%, E-value=1e-17, Identity=63%"; Hit description =Ribosomal protein L25
IIYNAVSKTVLKDRLRIGGAYDSEVSERASELPQPLTHSTVAVLRAPGPEPLTYLDDFPRPDPNHDETILVIPRAASGKNISAKERRAGQLRSIVFEQEDGQHGGKKCLIYPPSFVAKLVAREDDVRECATTVQAANSYVPSGIRFSRPVFHHDGSWPVAYFTDAFDLASSKGGGGSGNISALLSSVPRDVNMQLLHVGDVKQKVNFVHKAPKKVATVDQNSGHSKLKITIPREP

SEQ ID NO: 193658 - protein, 106 aa, Glycine max
  Coding DNA Sequence Number=SeqID_76880
MDEWQNGIDLRQEESHYPCIDDPPLFVVKTLDGSLEFISLGVLGVGDLVEIHDDAVWSDEVMGGAEVECVEMREKERGAQSERVVESMHARDSNFNNASSTSIFAQ

SEQ ID NO: 193659 - protein, 169 aa, Glycine max
  Coding DNA Sequence Number=SeqID_76881
MKSPQESIECPGRRSRLRDSEEVNDALSYNLGTDKVEAMQIDVSQITNLPLEVDTLKRMSPLPFLKFNLPTPAEAELSMSPNPAPFRSPENQDALLSSAGCKELMSIANEIHIKCHDYLLIEGCSDPSLPSSIEISRLQKITHPVMEIILNSPIGHLNDLKDLDYQQFN

SEQ ID NO: 193660 - protein, 184 aa, Glycine max
  Coding DNA Sequence Number=SeqID_76882
MVIDVVVWKEVAGLDMGGVHKFDEIADVYNKMQTYRGNFLGPTKRLRNHLGVGGLTVEDRMLVYLITYIFTPRSSNHAQVTDDDMQIVYGLKSGIKMNWILLIEDIMLKCRRLVDYEFSYVFLTSRFINYFKASQEAWYEYADHEWIMAREPTTGNIEEMEEDDEAEAQHDPTPKWSPFESLMI

SEQ ID NO: 193661 - protein, 180 aa, Glycine max
  Coding DNA Sequence Number=SeqID_76883
  Subcellular localization annotation: CTP_CleavageSite=81; ConfidenceScore=5.89e-01
MPRAASSSSANLPAVPQASLLHPRGGYSSSARCVFVPPASVSSSSVLPRDFVLHRVYFRMSRSHVSSSRWTSVNEELEHLVANMPKHGEWKELANMMQHVVAPPEALFQTISARDQTGWTHLYLGNVAECQLVFNHWRKSLKIGAGWKHFYETLSFIADMEIVFEFIDPDVNCVLCWPCL

SEQ ID NO: 193662 - protein, 555 aa, Glycine max
  Coding DNA Sequence Number=SeqID_76884
  Gene Ontology: Mol. function=oxidoreductase activity; Cellular component=nucleus; Biological process=protein modification process
  Homolog annotation: Hit_ID=Q1RVE5; Match level="QueryCoverage=72%, HitCoverage=72%, E-value=1e-152, Identity=72%"; Hit description =Ubiquitin family, putative
  Pfam annotation: Domain name=UBA; Domain location=512-552; Score =44.9; E_value=2.7e-10; Accession=PF00627.21; Description=UBATS-N domain
MAAPWLPWWISANHYRQYVIGSLLWWHHRLQCLCIREVWVKWKNRIMLLHMYPRGECSQVALSKESKWEVFMEKCLEADHTVHLVRGSAPANPTGGTNTSSTNTNTTTNNARGAGANEGGGLGGLGFGASLFPGLGVNGTGGNGLFGEGFPDLEQMQQPFISNPNLVREIMNSPTMQNLMNNPEIVRNLIMNNPQMQELMDRNPELAHILNDPSTLRQTLEATRNPEIMREMMRNTDRAMSNIESSPEGFNMLRRMYENIQEPFLNATTMAGNTGNNNAAVSGTHGGHARDRSTNPSTTSSEATAGSPLPNTNPLPNPWSSTGTGGAQNNPRRSLTTGVDARQQGPTGLGGLGLPDLESMMGGSAMPDAALLTQLMQNPAISQMMQSMLSNPQTLNQILGANTEQRGMPDLNSLREVMQNPEFLRLFSSPETLQLIFLQFCLIAQFQQLLSFQQALMSQLGQQQSTRESGQTGGGTGPMNNLGLEMLSSMFGGLGAGSLAVPNRSNEPPEQLYASQLSQLQEMGFFDTQENIRALIATSGNVHAAVERLLGNSGQ

SEQ ID NO: 193663 - protein, 96 aa, Glycine max
  Coding DNA Sequence Number=SeqID_76885
  Subcellular localization annotation: CTP_CleavageSite=69; ConfidenceScore=5.31e-01
MEIFRKKLLPGTFRMTFFRKLSVNTSGRHKLFFRKKLILLTGFNMSKNSLRPKDHQREVHKTRRFESTRINFAKSGWMFVGACKKGWYKIRMNLNF

SEQ ID NO: 193664 - protein, 107 aa, Glycine max
  Coding DNA Sequence Number=SeqID_76886
MSESDNKGEMEVALLDYVQVKDLPDQLRLAYANLVLEIGNGDPLRPAERNQLGTNTSSSKTLIPLPKPDRKATGWPSCSKIVLNPLLNASICRIKCFEKFGIVKLDV

SEQ ID NO: 193665 - protein, 72 aa, Glycine max
  Coding DNA Sequence Number=SeqID_76887
MTEDFESYESIKIGDFESYERKTRTLSPMKDKCEDFESYERKTRTFSPMKDKYECNLHLEILVMQKVLIHEH

SEQ ID NO: 193666 - protein, 91 aa, Glycine max
  Coding DNA Sequence Number=SeqID_76888
MRKIPKGRGKRVIPGNFLDPGSPRLASGSPEPPNCLGMKETANLGELQVQQVPFYAINRHLKNYVGLNSSSHLRIRKNKGTPLSTPKNRET

SEQ ID NO: 193667 - protein, 88 aa, Glycine max
  Coding DNA Sequence Number=SeqID_76889
MSHPLSIVTSISRHPYKMKHSDESWRKNKCNESWRRRKLRETLSQPTLQRACGRKAKGASSKKENASESPPTFIQGKHYKNQQGVCEY

SEQ ID NO: 193668 - protein, 66 aa, Glycine max
  Coding DNA Sequence Number=SeqID_76890
MDTLMNTYLLVGRENIVRYGKSMKVLRLHYLRRTSDQYILHTAEAQNITLSFACRHASGDRGVSEP

SEQ ID NO: 193669 - protein, 91 aa, Glycine max
  Coding DNA Sequence Number=SeqID_76891
MLQPCGISTCLKEHSNRVTLKAYTPKNPLGPLPPDSGKEKVTMQRVFLSNPTSFVISNGENSWKSVENLVFKFHRDPTVNGSKIIIFLRRV

SEQ ID NO: 193670 - protein, 124 aa, Glycine max
  Coding DNA Sequence Number=SeqID_76892
MLQSYGISIGLKEHSNPVTPKAYTPKSPSGPLPPNSALGFCGKEKCYNERGISLISDAISKFPTVRMLRNGFRTCCLNFTTIQRLMSPRSSFFQDRFDGLREKERVLGEKERKNEIGRQRRLRS

SEQ ID NO: 193671 - protein, 42 aa, Glycine max
  Coding DNA Sequence Number=SeqID_76893
MEAGKKDGEVNGNEKKAIGMVTHFRIASFLPRRGTTNNAIIL

SEQ ID NO: 193672 - protein, 71 aa, Glycine max
  Coding DNA Sequence Number=SeqID_76894
MSILDDPVVKVHLYKNGYKPNYRIQTDHSEEMSHDDLLVDDNFVGASRSDVHLAHGGQFVSMQERLCVSLK

SEQ ID NO: 193673 - protein, 81 aa, Glycine max
  Coding DNA Sequence Number=SeqID_76895
MTSTQPGDPPRHPFVVHDDRYVEPDIPQYPVAATVMEETPVDAHSNVDQPRHALVGTVVEPKDSDRRYRSIQCHGRLPKDH

SEQ ID NO: 193674 - protein, 140 aa, Glycine max
  Coding DNA Sequence Number=SeqID_76896
MAASIQDAKNRISQIERVFCSKLHPLFKSDIALKRRRIHCEGEKATLLARIDELDEKLRLKTREIEEADGKLLERVEALTCELRDEKLKRNRVTEAYKRLKSQHVYLRRKVGLGEENVVQENKLECASELEMLQSPIVKP

SEQ ID NO: 193675 - protein, 130 aa, Glycine max
  Coding DNA Sequence Number=SeqID_76897
FYDWTLKHLQFTCTLQFVFLNHILFTETNLSPKQRRLLALAALELRKRGVSLRLGVAERGLFGVQQLLEVLDAAAFQCDVGFKERVELRAKDTLDLRDAVLGVLNRCGHDGAEACDEVSVSGGGGGEGKP

SEQ ID NO: 193676 - protein, 77 aa, Glycine max
  Coding DNA Sequence Number=SeqID_76898
MISFNTSEVFVEHVYLKDFKSHCRSKLHDDEPNNFDDAKSPSNFDEPNKTSRSSIKNPIQDSRFKRRNQEATSQDFI

SEQ ID NO: 193677 - protein, 58 aa, Glycine max
  Coding DNA Sequence Number=SeqID_76899
MKPKDVYGLQDVEVDPEEVDMPDRSTIQEQWDKEAYDLVESGNVVGELVDDFEIFFDE

SEQ ID NO: 193678 - protein, 160 aa, Glycine max
  Coding DNA Sequence Number=SeqID_76900
  Gene Ontology: Mol. function=nucleic acid binding
MLTRSQKGEIVECDLEIKKAFRRNNVETTRRKNGRWWRTGANLVESPHPLYGNHYSHTTPQFGDQSCELRHGLINMIERIQFHSLLLEDPMVHLRKFLRFTNTMRSLANVSDNIRLATFAFSLGGKAGDWLGDFPGISIITSDQCSLAFLTRFFPVEKSE

SEQ ID NO: 193679 - protein, 220 aa, Glycine max
  Coding DNA Sequence Number=SeqID_76901
  Gene Ontology: Mol. function=nucleic acid binding
MTDVAVEIIEVVTSNANNDNIYIGPQYHDQRPKQEENRPTFQDLVMEYITKSGERFKSLESTMSNLVTLMYQRTPGTLPSQTEANPKNEEVNVMSTRSGKSKAEPKKKEKTTLTLGKWLSSRKLKDEQKDRQFSTFVEMFKKLHVNIHFAKAIAKMPKYAKFLKEIISNKKKLDDFAIVSLNEECFVVALKKLPPKLKDPGIFQSLVSLESYPLIKHCVA

SEQ ID NO: 193680 - protein, 408 aa, Glycine max
  Coding DNA Sequence Number=SeqID_76902
  Gene Ontology: Mol. function=protein serine/threonine kinase activity; Cellular component=chloroplast; Biological process=protein amino acid phosphorylation
  Homolog annotation: Hit_ID=P27450; Match level="QueryCoverage=92%, HitCoverage=78%, E-value=1e-100, Identity=50%"; Hit description =Probable serine/threonine-protein kinase Cx32, chloroplast precursor
  Pfam annotation: Domain name=Pkinase; Domain location=96-400; Score =143.8; E_value=4.6e-40; Accession=PF00069.15; Description=Protein kinase domain
  Pfam annotation: Domain name=Pkinase_Tyr; Domain location=96-400; Score=139.0; E_value=1.3e-38; Accession=PF07714.7; Description =Protein tyrosine kinase
  Pfam module annotation: Pfam domain module=Pkinase::Pkinase_Tyr; Domain location=96-400::96-400
  Subcellular localization annotation: CTP_CleavageSite=30; ConfidenceScore=5.22e-01
MPIFGSVPLPLFPGSASTNCKNVGITKTTSSSTENRQFTVIASGSIDDEESIHYLLRRVYHRPLRLPLPPPDGQILKWPNLKVFDFEELKSATNNFSSDTLLGEGGFGRVYKGWLDGDTLAPTKAGSGMVVAIKWLNPQSTQGFDQWQTELNIMRRFSHPNLVNLLGYCWDDDEHLLVYEFMPKRSLDNHLFKRNRNLGFLSWNTRLKIAIGAARGLAFLHASENNIIHRDFKSSNILLDGNYNPKISDFGLATLVSYEGQSHNYSPEISDFDLAKWGPSEGESHVTTRVMGTVGYAAPEYVATGHLYVKSDVYGFGVVLLEILTGMRALDTNRPTGQQNLVEWTKPLLSSKKKLKTIMDAKIVGQYSLQAAWQAAQLTMKCLQSIPEERPSMKDVVEALEAIEAIQN

SEQ ID NO: 193681 - protein, 153 aa, Glycine max
  Coding DNA Sequence Number=SeqID_76903
  Gene Ontology: Mol. function=protein serine/threonine kinase activity; Cellular component=chloroplast; Biological process=protein amino acid phosphorylation
  Homolog annotation: Hit_ID=Q1RVG1; Match level="QueryCoverage=69%, HitCoverage=87%, E-value=1e-15, Identity=45%"; Hit description =Protein kinase
  Subcellular localization annotation: CTP_CleavageSite=21; ConfidenceScore=5.04e-01
MGSIPLFSGSARTGSKNVGFSATGKSQFSEIASGSDDREESLGRILKWPNLKVFSFEELISASRRFRYDIQGLVIGKGCFGPVYKGCLDENTLTPAKGGYGMAVAIKMFNQDYVRGFEEWQEMKTDEVFLNQTGLSATQTVDAVEKLGEGRLK

SEQ ID NO: 193682 - protein, 311 aa, Glycine max
  Coding DNA Sequence Number=SeqID_76904
  Homolog annotation: Hit_ID=Q9FFW5; Match level="QueryCoverage=32%, HitCoverage=15%, E-value=3e-13, Identity=44%"; Hit description =Similarity to protein kinase
  Subcellular localization annotation: CTP_CleavageSite=73; ConfidenceScore=5.84e-01
MTSTNPSPNASPVAVPPALGGILSPPPSSSSPTNSSKSPSPPNSPQPNQTQTPNSPAPSSPSAPPPSPPSPPQAVPVTPPPSISLSPPPTLPPPSPPDSPPPLPPASPPSPPATTAPPPAETPPSLPNLSPPSPPDGSPPPQSPPTTIPPPSRPVSPSPPPPANVPRPPSTSTPPQKQSPPKTTPSHASPPSVSESPPKPPSSDVHPPSTLPSDTSGSSPPATLPDPPTNTTAAQGPTVSLPSLPTEKPTARPTNDGTNSMSSNNTPSHSGGLSTGGSVAIGIVVGFTVLSLVMAVWFVQKKKKKGTGSRG

SEQ ID NO: 193683 - protein, 80 aa, Glycine max
  Coding DNA Sequence Number=SeqID_76905
MLLGYTKKGCNPSLLYLYFIVPIHVPDNNKIPLLNLEMLETPICCHLQPDCVADEDEDKGKKSLTYGIGDKDRGLVGGRE

SEQ ID NO: 193684 - protein, 149 aa, Glycine max
  Coding DNA Sequence Number=SeqID_76906
  Gene Ontology: Mol. function=unfolded protein binding; Cellular component=mitochondrion; Biological process=protein folding
  Homolog annotation: Hit_ID=P37900; Match level="QueryCoverage=55%, HitCoverage=12%, E-value=8e-29, Identity=74%"; Hit description=Heat shock 70 kDa protein, mitochondrial precursor
MAAFASSMSTMDRIETSITELTFDQLHFIFSNVLKPSSTSSSEKTAIGMVPQPNIKYGGTPSKPQVVPNPPNTLLDTKWLIGRRFDDAQTQKEMKIVPFNIDKAPNGDVWVVANGQQYFPSHINAFVVTKMKEIAEAYLGKAAEPGELS

SEQ ID NO: 193685 - protein, 133 aa, Glycine max
  Coding DNA Sequence Number=SeqID_76907
  Homolog annotation: Hit_ID=Q9ZPW2; Match level="QueryCoverage=41%, HitCoverage=29%, E-value=6e-19, Identity=80%"; Hit description =Anaphase-promoting complex subunit 10
  Pfam annotation: Domain name=APC10; Domain location=17-133; Score= -71.2; E_value=0.0035; Accession=PF03256.7; Description=Anaphase -promoting complex, subunit 10 (APC10)
MMRTLASFSRTLKYECFFAHELVEKDIVGSKRRTSYRRKVEENPTLLLELCGSKKPYTALGTVVGAQSSKLSTLPVNKLIVLFLVFKLDESYTPSKVSIRADDGFHNLKEIKTVELVKATGWVYLSLSGADPR

SEQ ID NO: 193686 - protein, 149 aa, Glycine max
  Coding DNA Sequence Number=SeqID_76908
  Gene Ontology: Mol. function=DNA binding; Cellular component =chromatin; Biological process=DNA integration
  Homolog annotation: Hit_ID=Q1SJY5; Match level="QueryCoverage=99%, HitCoverage=16%, E-value=8e-40, Identity=50%"; Hit description =Integrase, catalytic region
MSDAKEMKTPMHPTTHLGLDEESTKVDGNHYKAMIGLLLYLTTFQKELREFLLTSVKRVFKDLIGTSNHGLLFKRRESFRLTSYCNADYAGDKVERKSTSGSCHLIGGNLVIMICKKQGSNALSMVEAKYMSAASYCTQLLWLKNQLED

SEQ ID NO: 193687 - protein, 106 aa, Glycine max
  Coding DNA Sequence Number=SeqID_76909
MSPNKASIVAPQIEDEAFFVVDKSTASNNDGIVIHDMEVLGSFDLHMGKMTWMYGSNVWNKKVKKRLSFEVQKVAVGLSAHPPLSAASTRLARRRIWQSISIKAAH

SEQ ID NO: 193688 - protein, 584 aa, Glycine max
  Coding DNA Sequence Number=SeqID_76910
MASANTPIMEAIPTLEITAIHIDNEPFIHVEHLSISKNSKKTDKDLWRHVEFINKKTIASKVLGLKVVLYSNTVTKATGYDYHVTRALYKDNANKVGDQKTIIYNLMCEKEKIWVNILNNSVFFKADSKKTLFDLHKDEEEKELLAKEHKTKRRHESVASVSECPLTVNPLAQRLKDLSEIDDDDNKGLVRVALQKQKIVVLDAPAPKKAKKAQLVAKPYNPKIGEKEWTVSFTKNKEDVASFLLDGEFTNSTPIMLLHKSTPITQPHPPSSPLDLERFRREALRDPLSNAQRFPLAFVHSNPTPITPFSEAIFFEPMVRETIKVHWLPPMWTRLVQPSFIKMPPHWLAHGIQQRVRPSTEGLFARSESSQGLVQKKGSPMEAYYKTVATTTYPPGLHTRATNIKMVVDGVYPCLPVWDAATKKGFELYCKEQLPSRQMKSQIMWMNSQKASASSNDGSDITVSCNVVQVLQLSRKYHTGEASNAAMADGVEPLILDLVSKKSITSNEATSRDKDDHDVLIVYSTSSGTTILNYAQSTTIICDQNVITMQFSNLGVILSLNIQQAQLKMLGVVVAPAPASAPTP

SEQ ID NO: 193689 - protein, 67 aa, Glycine max
  Coding DNA Sequence Number=SeqID_76911
MRAPERSLPRKWRAQVTTLRALKNLESMSHEELIGTPKVHEQELQQDEGLEREKSLTLGSQKNKKEP

SEQ ID NO: 193690 - protein, 161 aa, Glycine max
  Coding DNA Sequence Number=SeqID_76912
MVQLIYDTIYCLQKSHPQRHPVDPEKSSRALGFPALVTGLCSPTGCPFPLARSRHHDIGIAPARHPVDPKKSNRVLELPNSNYGPLSVLRSACRPQQGHQAPYYSSFHQEVLRPQVGAGRNTTAARGWPAAGNRRTAITSRVHLSSSTKRLERCLRPMADQ

SEQ ID NO: 193691 - protein, 136 aa, Glycine max
  Coding DNA Sequence Number=SeqID_76913
MYLGHNSKGSSNPRFALGESRISKGSLNLRFALSESHKLIKPKLHPWVKAHLVQSSANPRSALGVPLGSKNFAFVEILGTLQTQGLPLVRTILQTQGTPLIASLLGNYDYNSQRSRFDKSEQPTTRLVDKTFNQFL

SEQ ID NO: 193692 - protein, 119 aa, Glycine max
  Coding DNA Sequence Number=SeqID_76914
  Gene Ontology: Mol. function=DNA binding; Biological process=DNA integration
  Homolog annotation: Hit_ID=Q1SKC8; Match level="QueryCoverage=66%, HitCoverage=19%, E-value=3e-22, Identity=63%"; Hit description =Integrase, catalytic region
MRRNAYEPSTLYKEQIEVYHDMKIQHKEIRLGQFVLLFNSRLRLFLGKHKCKWSSPFLVKDVKPYGAVELEYPITKRSWIMAPPRKHTHTIPSSKKMKGQASSHQELEPMHKEEEHGNP

SEQ ID NO: 193693 - protein, 196 aa, Glycine max
  Coding DNA Sequence Number=SeqID_76915
  Gene Ontology: Mol. function=amino acid transporter activity; Cellular component=membrane; Biological process=amino acid transport
  Homolog annotation: Hit_ID=Q9C6S5; Match level="QueryCoverage=44%, HitCoverage=21%, E-value=2e-29, Identity=60%"; Hit description=Amino acid permease, putative
MYDTLESDSKNPLYPGCKKSLTLLLEVLSLVNVKAKYGWSDKSFTSLPKVVTARRFMLASYKVLKVVAFSPLVRKVLVRCFVLPRIVISGGVDCYWALFESQISCCLVDLNYWDSINTLAGEVVLGYFFPLLVATGVVPLNRELWTDGYFSIIAEIVGGVWLRWWLQAAAAMSNMEIFVAEMSSDSFQLLGMAERG

SEQ ID NO: 193694 - protein, 239 aa, Glycine max
  Coding DNA Sequence Number=SeqID_76916
MGGLRASGRKEITGSIAQDRLFFLAAMGRSKKRRLTQLRSAVRDAYLLLRERGKGQPILLIIRKGVASTGVLHPVGVRDESPFAVGLPEMVPTVHEANNRCPPTTDATFSRLGEFWAVIWKPSQWSEVKQPNVEIEDPDLSGSVSRYRLFASWTVGTISGNPTAKGDSSLTPTGSTPWQQEKKGDLVLYSGDLFPTEARKPPSCPRSHSVNRKGKPTHPSAPLVDRCGFTKRLSTVHSR

SEQ ID NO: 193695 - protein, 98 aa, Glycine max
  Coding DNA Sequence Number=SeqID_76917
  Homolog annotation: Hit_ID=Q1SQN8; Match level="QueryCoverage=32%, HitCoverage=7%, E-value=5e-07, Identity=78%"; Hit description =Protein kinase
MEHFRSSYMIRGFILLCKYSEPLAAPAAILILDSFKEQSSQGSFVPHGRQDVLTAAIGRPEHPGCVHAAGASVTIKQYFGSAPRMSRSSSLLPPEELQ

SEQ ID NO: 193696 - protein, 47 aa, Glycine max
  Coding DNA Sequence Number=SeqID_76918
  Gene Ontology: Mol. function=DNA binding
  Homolog annotation: Hit_ID=Q1EMS1; Match level="QueryCoverage=81%, HitCoverage=15%, E-value=9e-09, Identity=70%"; Hit description =Putative DNA-binding protein
MNLFFLLSKKFDWGTGETPRRSTRINEKVKSTPPTDSDTPKKRARKS

SEQ ID NO: 193697 - protein, 85 aa, Glycine max
  Coding DNA Sequence Number=SeqID_76919
  Gene Ontology: Mol. function=oxidoreductase activity; Cellular component=integral to membrane; Biological process=electron transport
  Homolog annotation: Hit_ID=Q9XGL7; Match level="QueryCoverage=58%, HitCoverage=9%, E-value=4e-12, Identity=66%"; Hit description =Cytochrome P450
MKVAIQLVLQMFSWRRSVYSSNQEILMFELLDYILRDPKHWDDHLEFRPERFLSDDHESGKMGQVGVRGQHYQLFPFGSGRRGCP

SEQ ID NO: 193698 - protein, 66 aa, Glycine max
  Coding DNA Sequence Number=SeqID_76920
  Gene Ontology: Mol. function=DNA binding; Biological process=DNA integration
MGSIGAPFLEMLIIFLPPSCYNLSSQTNGQAEVLNKEIKQVLQKVVLPNRKDWSKQLEDALWAHRT

SEQ ID NO: 193699 - protein, 253 aa, Glycine max
  Coding DNA Sequence Number=SeqID_76921
  Gene Ontology: Mol. function=transferase activity; Cellular component= flagellum; Biological process=biosynthetic process
  Homolog annotation: Hit_ID=Q4UUG0; Match level="QueryCoverage=99%, HitCoverage=21%, E-value=3e-84, Identity=57%"; Hit description=O -antigen biosynthesis protein
  Pfam annotation: Domain name=Glycos_transf_2; Domain location=103 -251; Score=87.1; E_value=5.5e-23; Accession=PF00535.16; Description =Glycosyl transferase
MARHWLYNRNVLLNVGGFDPAYHKASEFELIVRLVEQYGINSIGHLPEPLVISESFLLTDEPEYRDILQKHLHRRGYTNGWVKNTWPGLYSLRYEHANQPLVSIIIPTKDQLPVLITCVTSLLEKTHYKNYEIIVVDNNSESTEAQQWLAGLAEIDPKRIRVLSYPHPFNYSAINNFAAREARGEYLVLLNNDTAIISENWLDELLNHAQRPEVGIVGAKLLYPDGRVQHAGVILGLRGPAEHPFIGEAADAP

SEQ ID NO: 193700 - protein, 362 aa, Glycine max
  Coding DNA Sequence Number=SeqID_76922
  Homolog annotation: Hit_ID=Q53LP7; Match level="QueryCoverage=48%, HitCoverage=62%, E-value=4e-09, Identity=27%"; Hit description =Expressed protein
MFDPRRNQPTISFPLSNEIGQITHGYDTWGATNTDFMASKKPPKNYKNCHSYNDMEVQLGTGSKVDDNESGICSPPLWTTNPPKSPHHRKNYYRCLSPASKTQAIARGQRELMEMVKNMPESSYELSLKDLVEHPRVEVAQEKGAEERKKLGNKNVGNRKKVDMNKKGQVKRSGNIDSGGFYLKMVFPISLGFKKKTKNESLVNSGSNKVSPRTSVSDGSKSLDKEWWKKSLSASGGESDSGVSSINSGSKKSSGSSNSSSSSRSNSRMTLANVDSANVNSKISHVGPRVPFVKREHATCHVYFVDLGQYTSPPSSKSACEKKRLSSVEAPKCGQVLSGADSVVQGGHALVLQARPDVSGGR

SEQ ID NO: 193701 - protein, 87 aa, Glycine max
  Coding DNA Sequence Number=SeqID_76923
PNNYLKGIINSALKGLDDIPQPKSKAGARWIVVKCNRQKGSTECGYYVMHWMSTIILGTFRNNWEMYFNDVRPLEAERLKALRIQWA

SEQ ID NO: 193702 - protein, 137 aa, Glycine max
  Coding DNA Sequence Number=SeqID_76924
  Gene Ontology: Mol. function=methylated-DNA-[protein]-cysteine S -methyltransferase activity; Cellular component=intracellular; Biological process=regulation of transcription, DNA-dependent
  Homolog annotation: Hit_ID=Q8G2F4; Match level="QueryCoverage=99%, HitCoverage=37%, E-value=3e-62, Identity=84%"; Hit description=Ada regulatory protein
  Pfam annotation: Domain name=DNA_binding_1; Domain location=54-137; Score=160.2; E_value=5.3e-45; Accession=PF01035.11; Description=6-O -methylguanine DNA methyltransfera
MGDDPEELIRDLEKRFPQANLIGADRDFEDMVAEVVGFVEAPRIGLDLPLDLQGTAFQQRVWQALREIPVGKTVSYTEIAERIGAPKSVRAVAQACAANKIAVAVPCHRVVRNDGGLSGYRWGVERKRDLLKREGQA

SEQ ID NO: 193703 - protein, 52 aa, Glycine max
  Coding DNA Sequence Number=SeqID_76925
  Homolog annotation: Hit_ID=UPI00006DBC96; Match level="QueryCoverage =100%, HitCoverage=25%, E-value=7e-14, Identity=67%"; Hit description= COG3826: Uncharacterized protein conserved in bacteria
DEGCGTRLPCRVAPLQEGIMGGRKPDIRSQSFAPPIGDGSQLKIELLAQIPN

SEQ ID NO: 193704 - protein, 74 aa, Glycine max
  Coding DNA Sequence Number=SeqID_76926
MKNVFGNGVLGKDEHSHPGSRFMVSWDFGSRLVERLDMIYVKALILLDLVASIILRGIGLECRRSNNNQFNNVL

SEQ ID NO: 193705 - protein, 151 aa, Glycine max
  Coding DNA Sequence Number=SeqID_76927
SFGVPVTPSKVIQSPITRAFIEKYCTPRQAQGDAPQATDAPPPPHQADPVGSLGMERYLQHLVHQQAANHRGKVQIHECLYQLSLSQQGQGFVPFACPTPDQFRAEVAWPGDWPEAQAGEAPAEAPSDVEEARMDEEMTDLLGFLGGSGAT

SEQ ID NO: 193706 - protein, 53 aa, Glycine max
  Coding DNA Sequence Number=SeqID_76928
MGLWDDNESVFFFRKMQMFIEFSVEVLEVVFEISEVIIRRFWCLLGKDKMIVN

SEQ ID NO: 193707 - protein, 105 aa, Glycine max
  Coding DNA Sequence Number=SeqID_76929
  Gene Ontology: Mol. function=hydrolase activity, hydrolyzing O -glycosyl compounds; Biological process=carbohydrate metabolic process
  Homolog annotation: Hit_ID=Q1RUU3; Match level="QueryCoverage=52%, HitCoverage=12%, E-value=3e-14, Identity=62%"; Hit description =Putative beta-d-xylosidase
MGEFGELMLTVIIFQYFCCKGLVCETRGHCKVRLGCSLCNPFRQLTRSHSKAQQLVNVNIHVCKVLCMVERFGTRRVPMGLHNVDIGDVKHYVSLQAETPGIIKS

SEQ ID NO: 193708 - protein, 284 aa, Glycine max
  Coding DNA Sequence Number=SeqID_76930
  Homolog annotation: Hit_ID=Q1W1G0; Match level="QueryCoverage=84%, HitCoverage=77%, E-value=2e-09, Identity=30%"; Hit description=CK25
MGCCISTPTKQTQNQNNKTTQKNHHHEPPPPLEEESVKEVLSETPISKPHQVPILKPETKTLLPLIQDPPPNFEANPKAPPIEEVSEVISQLSETCSISDSFSAATTATTATATTTTVTVADKREEDEATSKIHKWDRSPSRKRPYAPGGNLACGRDWRLKSPAMRPEPSPEKKIKGGSRPIRGREIRDSGTAANRKRNVGPASLRGDAGEGSGRRSRSPACARNGKVGAGGKRKEFAPAKVVANEVEKQKNSESEEVGEKNDVVSQEECLENPHVSMECFIFL

SEQ ID NO: 193709 - protein, 188 aa, Glycine max
  Coding DNA Sequence Number=SeqID_76931
MGFEATTPMVAPFGSNTQRPDHWKHFDDSVNAVSFGFVATAILISMFLLLAIFERFLRQRSSEANNVATPMDLEHQMHLGGKLENLSSKINVTDASAITVTKKVQNFDDMAKITCKVPILVSVEVNQMTIYGRGVLVLMPGEQIPSFIALPSPAPCSRQPMSWPIQVQHNSCFHAPLALTRNYNLTSN

SEQ ID NO: 193710 - protein, 158 aa, Glycine max
  Coding DNA Sequence Number=SeqID_76932
MMLYGIITEQDGVIAMRDFVARAVKRGGDNRAMGATVLSLGWWKTSKGGGADVGAVVGGGCAEEEGTDVGAVGGGGCAEEDETVVSGGGSGGVGMVMGVVSVGDRVGLNGGGSDDGERHPMRIRGGVERWQGWPRQPQGSPRQPWMLCLTSGSYGRQP

SEQ ID NO: 193711 - protein, 571 aa, Glycine max
  Coding DNA Sequence Number=SeqID_76933
  Gene Ontology: Mol. function=ligase activity; Cellular component =cytoplasm; Biological process=response to auxin stimulus
  Homolog annotation: Hit_ID=Q9ZNS2; Match level="QueryCoverage=96%, HitCoverage=93%, E-value=0.0, Identity=66%"; Hit description =Putative GH3-like protein
  Pfam annotation: Domain name=GH3; Domain location=18-571; Score =927.6; E_value=5.3e-276; Accession=PF03321.4; Description=GH3 auxin -responsive promoter
MEPILSYNNGNGNNSDYDVMNWFEDLSQNAGFVQTQLLCQILEQNYGVEYLKKWLGSYNILEMDACALESLFSSVVPLASHADFEPFMQRIADGDTTPLLTQQPITTLSLSSGTTEGRQKFVPFTRHSAQTTLQIFTLAAAYRSRVYPIREGGRVLEFIYSSNRFKTKGGLTVGTATTHYYASEEFKIKQHKTKSFTCSPQEVISGGDYKQSTYCHLLLGLYFSDQVEFITSAFIYSMVQAFTTFEELWREICNDIRDGTLSSRIKSSKMRKAALDIISPSPNLASKLEDSCKELEGVDWFGLIPKLWPNAKYVYSIMTGSMQPYLKKLRHYANGLPLVSAEYGSTESWIGVNVDPSLPPEDVTFAVVPTFSYFEFIPLHRHEKKLSSGGDDFMEDKPIPLSQIKVGQEYEVVLTTFTGLYRCRLGDVVEVASFHNGIPKLNFVCRRKLILTVNIDKNTEKDLQLVVERGSHILNKASRAELIDFTSYADVSNQPGHYVIYWEIKGEVEDNVLGACCNEMDKSFADHGYVVSRKTNSIGPLELCVLESGTFKKILDNFIANGAALSQFKTP

SEQ ID NO: 193712 - protein, 263 aa, Glycine max
  Coding DNA Sequence Number=SeqID_76934
  Gene Ontology: Mol. function=two-component response regulator activity; Cellular component=endoplasmic reticulum; Biological process=two-component signal transduction system (phosphorelay)
  Homolog annotation: Hit_ID=Q949H5; Match level="QueryCoverage=100%, HitCoverage=34%, E-value=1e-100, Identity=75%"; Hit description =Ethylene receptor
  Pfam annotation: Domain name=GAF; Domain location=75-221; Score=46.5; E_value=9.3e-11; Accession=PF01590.16; Description=GAF domain
MVALTVFKILTALVSCATTITLLTLIPMLLKVKVRELMLKKKTWDLGREVGIIMRQKEAAMHVRMLTQEIRKSLDRHKILYTTLVELSKTLGLQNCAVWMPNVEKTEMNLTHELNGRNVNCSIPITNPDVVRIKGSDEVNIIDSDSVLATTSSGISGGAGPVAAIRMPMLRVCNFKGGTPELRQTCYAILVLILPSEEPRSWSAQEMEIIKVVADQVAVALSHASILEESQLMREKLEEQNRALQVEKMNAMMASQARASFQK

SEQ ID NO: 193713 - protein, 52 aa, Glycine max
  Coding DNA Sequence Number=SeqID_76935
MVHDIFVKVKLEVTGTSTALNVFGSRRSSDKWVYDPNMVGSWYLTHATKNAS

SEQ ID NO: 193714 - protein, 90 aa, Glycine max
  Coding DNA Sequence Number=SeqID_76936
  Gene Ontology: Mol. function=iron-sulfur cluster binding; Cellular component=mitochondrion
  Homolog annotation: Hit_ID=Q1S6K5; Match level="QueryCoverage=71%, HitCoverage=49%, E-value=7e-20, Identity=67%"; Hit description =HesB/YadR/YfhF
  Pfam annotation: Domain name=Fe-S_biosyn; Domain location=2-65; Score= -9.0; E_value=0.0079; Accession=PF01521.11; Description=Iron-sulphur cluster biosynthesis
MKKLEGSESSTDGKTLYVFNLDDRINSDDKVFEKGVKLVVDNISYDFVKGATVDYVEELIRSAFVDFIIVVTTREESFFVHVWELMAFEE

SEQ ID NO: 193715 - protein, 59 aa, Glycine max
  Coding DNA Sequence Number=SeqID_76937
MDNVDIFVPHPLTNTSLLIQLPPECEYVHVTSFYHSGKFVFLEKRVVKNRMLDKWPQLS

SEQ ID NO: 193716 - protein, 141 aa, Glycine max
  Coding DNA Sequence Number=SeqID_76938
  Gene Ontology: Mol. function=RNA-directed DNA polymerase activity
  Homolog annotation: Hit_ID=Q1SYP9; Match level="QueryCoverage=92%, HitCoverage=13%, E-value=2e-07, Identity=25%"; Hit description=Myb, DNA-binding
MNLRGRQVEISDPMCPLCNNSEEVAAHLFFNCSKVFPLWWESLSWVNSVGAFSKEQKDHFMQHSRRNATQTKDIRWSYWWIALTRTIWKHRNKVVFDNQTFNASKLMDEALLLVWSWLKAMEKDFDTHFNQWSSNLTDAFV

SEQ ID NO: 193717 - protein, 192 aa, Glycine max
  Coding DNA Sequence Number=SeqID_76939
  Gene Ontology: Cellular component=cellulose and pectin-containing cell wall
  Homolog annotation: Hit_ID=Q9C568; Match level="QueryCoverage=87%, HitCoverage=73%, E-value=7e-32, Identity=40%"; Hit description =NDR1/HIN1-like protein
MSLLKLDGGTGESNGVVPIAGDPEVCRTVDINMVISGNPSSNLPLHSSADFDVNQNSSGGSVLLEDLESERGDGDGGGVEVGGPDGGFSVALVGGGEGGGDGELLAAVGGVGVKFGVDDSDAVVGVEGSEGDLQGEGEGVGGWIDGGRGGAGGGEVEGVDGGVLEDEEGFGGAEDDPDEEDEEEDGAEDRRE

SEQ ID NO: 193718 - protein, 81 aa, Glycine max
  Coding DNA Sequence Number=SeqID_76940
FDDESCEGTNTEDPAVDFEREANRLEVEEDEGMEFPAELEMMVAQEGREMKPHQEETEVVNLDVDNEKKEVKVGTGMTTPI

SEQ ID NO: 193719 - protein, 101 aa, Glycine max
  Coding DNA Sequence Number=SeqID_76941
  Pfam annotation: Domain name=GRP; Domain location=8-70; Score=-27.7; E_value=0.052; Accession=PF07172.2; Description=Glycine rich protein family
MFSLVPELADRLLMGLDDSARGWRWKNEEDEPVWAAAGPGVNWGLDCEGGGGEGGGGRDTVGGGGHSGERWRHWAAWGEEALTANVDSLCLLPCCNSTPYP

SEQ ID NO: 193720 - protein, 51 aa, Glycine max
  Coding DNA Sequence Number=SeqID_76942
MDTKNFKPRQVSKEIGKKRLMPPFFTVANKLYSVMFRAPNILRKKNVDDKS

SEQ ID NO: 193721 - protein, 61 aa, Glycine max
  Coding DNA Sequence Number=SeqID_76943
MVIDYSFVNQFEKQCWLLALFPYPEDQTTPVLSPNTSLTATPMLHLTGEEDVQTQDTQDRS

SEQ ID NO: 193722 - protein, 129 aa, Glycine max
  Coding DNA Sequence Number=SeqID_76944
MHKALRANAPLPYPQLVTLFLRHFQISLDDEPFVQVKRSFAIGAGAVTSFGYRKDHNGQWLKKDALPPQDKHTPSPPPQRDDSALMTEVLSELRGLRTYVGMDIRLMQLEEDVGYIHQSFDLPPPPPPS

SEQ ID NO: 193723 - protein, 286 aa, Glycine max
  Coding DNA Sequence Number=SeqID_76945
  Homolog annotation: Hit_ID=Q5XM22; Match level="QueryCoverage=35%, HitCoverage=76%, E-value=2e-22, Identity=51%"; Hit description =Resistance-like protein HAAS-2
MASLLHLPITGALHTFEPLVTSDAIGLLTELLEGQTMGCSSPHVSAPLGGLYCFHQQEFNPCTCRAPKGFQGPGPAALVHMYDHLNDASLASTRQLGGYITLLHCWIYEHFPTVHTSVVHDAYDEGSPHACRWLTGKAHMMRIKGASYRRRLDALSVTDIVVYVRPERVLRQFGYLQTVPPPSVAPDYMEWFFRISHPFVTRTEETAVRRHPPPPHHEEFVEPPISEVSVATDLPTHSVVHCEGCQGMAQDLGAIAEDLERVINLRMVTEGTDLHDIMTRCLRRAR

SEQ ID NO: 193724 - protein, 114 aa, Glycine max
  Coding DNA Sequence Number=SeqID_76946
MSRNFTDCLTMGVKFLEAVKRRLHTIKQWSSDEIRVLKRNLGQHKFACPLKLMLTVVIIFMNLVLGCGCDSNNTNAILPRKGPVTRAMSKRLQEDWARAAEEGPRVLMNHRVDF

SEQ ID NO: 193725 - protein, 79 aa, Glycine max
  Coding DNA Sequence Number=SeqID_76947
MSGGKCESRLYNDRCRKCSIGVIRRFFLFKPRSLIFPHPRRLAFLSISIGESSFLPRWANVVVAEQMKTCRCRSNHNFG

SEQ ID NO: 193726 - protein, 282 aa, Glycine max
  Coding DNA Sequence Number=SeqID_76948
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=1e-36, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LGVLTFRGLHVLAFRGLHVLSIRRLHVLTFRGLHVLTFRGLHVLTIRGLHVLTFRGLHVLTFRGLHVLTFRGLDVVAFRGLHVLTFRGLHVLTFRRLDVLAFRGLDVLVFGGLHALIFRGMHVLTIRGLHVLTFRGLHVLTFRGLHVLAFRGLHVLTFRGLHTLAFRGPGVLAFRGLDVLVFRGLHALTFRGLHVLAFRGLHVLAFRGLHVLAFRGPHALAFRRLPILAFKGLHVLAIRGLHTLAFRGLHTHAFRGMHALAFRGVHILTFRGLHICALREFK

SEQ ID NO: 193727 - protein, 133 aa, Glycine max
  Coding DNA Sequence Number=SeqID_76949
MLGFTSDSPQFSANPHQLDFAPYASRPYNAQWNAPGLLHDKHAWGLRKPSRGMAFVDNWVVGKEKGCYLLCNDIVELVGEFPCRNSSRRMGFSFILTLFICPNFLIRPSRMIKFSSFQIRFDPFPGEDQIRKA

SEQ ID NO: 193728 - protein, 180 aa, Glycine max
  Coding DNA Sequence Number=SeqID_76950
  Subcellular localization annotation: CTP_CleavageSite=20; ConfidenceScore=5.39e-01
MDRLTTMMNALLSAQNSQAAAAAVEQPLVSTTPLSTVTSPPLFLPPGCTWGMPPPVCGSPQPAVSEVPLPFAQQSAPVPQPGTSFPQAAMTYSAPLIHTIQQEVEPIFQAENVVAFDKMEELQERFDGMQREVEALRGRDLFGKDACELCLVPNVTIPHKFKVPDFEKYKGNSCPRSHLV

SEQ ID NO: 193729 - protein, 46 aa, Glycine max
  Coding DNA Sequence Number=SeqID_76951
MTTSQSLTDLAQALKTTSSSSFVLYESRWIQGFLMMTKSSKVKITS

SEQ ID NO: 193730 - protein, 244 aa, Glycine max
  Coding DNA Sequence Number=SeqID_76952
  Pfam annotation: Domain name=Transposase_23; Domain location=18-83; Score=-16.0; E_value=0.064; Accession=PF03017.5; Description =TNP1ENSPM transposase
MVGPSGPRVSTKECCVDPSRNDLETANPPRLVTLGIVYKGSTIHNIPLLPGQVKVGVEEVKDAQAPVLVPTDEVTLVGQTLNTFLAWPTHLVKPLSEHGNYLTMFDQHAAVSPTKPPQRPDPAVDDPLYLMTLTIPELFLKPFQVNWDATMFGVFNPHFPLYIKHEDLSGIAHSGQCLSTFVIQLWILHLTETSMRAGNSDVYGFLKPQSIQRSGQSQFCSESYIKSWMQSSKRDVYLGAYLNG

SEQ ID NO: 193731 - protein, 90 aa, Glycine max
  Coding DNA Sequence Number=SeqID_76953
MKYRAFVSGFWILPLFHGEIQARFPFNSKSLIINTKGLWTKTLRFHFTHNLKLTQLYLMAYQVEIMQEISIIASKGLAEVMFSSPFKENH

SEQ ID NO: 193732 - protein, 146 aa, Glycine max
  Coding DNA Sequence Number=SeqID_76954
  Gene Ontology: Mol. function=zinc ion binding
  Homolog annotation: Hit_ID=Q1S9M8; Match level="QueryCoverage=84%, HitCoverage=15%, E-value=8e-26, Identity=51%"; Hit description=FAR1; Zinc finger, SWIM-type
MALEDSVSHHFNLNDLGLPVTDLNTPSMAPVSIHRDDILVIALIDYHLSMQVVLTCFKSMTWIISNKNSSSSSKIAVINMKLQDYGKGPLGETEVQFRVTRVTLEPMLRSMTYISQQLNAPVNRVAIINLRKDVLSMTNYPKPLNF

SEQ ID NO: 193733 - protein, 386 aa, Glycine max
  Coding DNA Sequence Number=SeqID_76955
  Gene Ontology: Mol. function=RNA-directed DNA polymerase activity; Cellular component=chromatin; Biological process=chromatin assembly or disassembly
MTTAEECKRGKGFLGLTGYYREFIRDYGKRARSLSELTKEEWFKWTPRAQEAFDWLKQQLTTALVLALPISHKNSSSRGHHDGSTELGGQTIGVQPLVHQPAWEGIQEAIEEVHSDEKLLAIIDALRQGRESKPVFTYKKGTLFYEGRLVLSSTSSWIPKMLKEFHETPQGGHSGMVQQFVMGCDIGLRRKYLAAAPGGYLGSGGSTFQPPYLSDRDPIFVNSFLAGAVQVAMDSSQNEYSISSPNGWPNRGGQSLFGDILAPPVLSRFLSEVCVEAVTRKLNDIDEALRQLKYQLQVAAVAYKLRLPEAARICPVFHVSLLKKVVGEHSVEETLPSELASDNTMTPEPKAGLKEATWEEEFNIKSQFPQLRLEDKSPFELLKEGY

SEQ ID NO: 193734 - protein, 149 aa, Glycine max
  Coding DNA Sequence Number=SeqID_76956
  Gene Ontology: Mol. function=nucleic acid binding; Cellular component= chromatin; Biological process=chromatin assembly or disassembly
  Homolog annotation: Hit_ID=Q1RVR4; Match level="QueryCoverage=69%, HitCoverage=29%, E-value=1e-19, Identity=39%"; Hit description =Peptidase aspartic, active site; Aldehyde dehydrogenase
  Pfam annotation: Domain name=RVP_2; Domain location=1-115; Score= -6.7; E_value=3.3e-06; Accession=PF08284.2; Description=Retroviral aspartyl protease
MKVRVRINGVPALMLVDSGATHNFVSRKLVKAMGWPVVASKVMQTKSGDGYKAHAQGMCKGVTLETDSLQFIVDTVLFDLEGIDLILGVAWLVPLGEMQVDWVAGDSTTVGKREQELQNLLQGFEEVFKEPHGLPLRRSKEHAITLLEG

SEQ ID NO: 193735 - protein, 51 aa, Glycine max
  Coding DNA Sequence Number=SeqID_76957
MAVGLADNVGEGSSYPSLFARPIAFNNVALNIFVNGDLIGRHWARVGTQHI

SEQ ID NO: 193736 - protein, 66 aa, Glycine max
  Coding DNA Sequence Number=SeqID_76958
MEEERRKRNLSSLYGRWHQAQGKGGGGSGGLPGATTSGGAPGATTSGSLSGASTSAELKRVEALYT

SEQ ID NO: 193737 - protein, 127 aa, Glycine max
  Coding DNA Sequence Number=SeqID_76959
MEAKVPALEKEVVGLKTTMQSMQLKAKENHERLIALLSKTSMEDGSAMKTSSQFPKGVLEEFRQLVKNVELPMFSIEDPAGWIVRAEVCFQVQESCPHVKEGIKGRAHSMCTLGPSPRSRMMNLDRA

SEQ ID NO: 193738 - protein, 45 aa, Glycine max
  Coding DNA Sequence Number=SeqID_76960
MSCMNGRAFAKHDTQWLSARKNPEEDELSGSLSAPLQVIKLQLIR

SEQ ID NO: 193739 - protein, 155 aa, Glycine max
  Coding DNA Sequence Number=SeqID_76961
MPFSGTTPSLSSYFIVPSYHAYLEFFWNLSFYLFYKPPTRKNHNLRTSMSHHSCSVNGEGRHRSNLRPHSHRREKERKPQETNINLPYFHGKDNVEANLDWKIRVEKQLKRKSTSKSYGSNSYPKKYQGQGILGVTPSKPKDDKGKTIEKQPLKA

SEQ ID NO: 193740 - protein, 90 aa, Glycine max
  Coding DNA Sequence Number=SeqID_76962
MRLPGKESLLMKSPITINEILDVSISFLNDHLEETLGSTKIEEIHSKCINLAQVYGESGFWLKACRMARHDTCQGLVWFKDKKGCPTLFP

SEQ ID NO: 193741 - protein, 241 aa, Glycine max
  Coding DNA Sequence Number=SeqID_76963
  Gene Ontology: Mol. function=nucleic acid binding; Cellular component= nucleus; Biological process=DNA integration
  Pfam annotation: Domain name=rve; Domain location=123-239; Score =49.2; E_value=1.3e-11; Accession=PF00665.16; Description=Integrase core domain
MVDNNVNWILDTGASKHLCANKELFHQIEDADDGECVFMGNSTTAGVLGKGKILLKLTSGKTLSLSDVLTCEHGRLGHVNVNSIKKLRNMNLINVLDINNFSKCPICVEAKYAKKPFKPVKNRTTELLELIHTDLADFKTQYAKVYLLRTKDEAEEMFLKHKAEVENQLDRKIKRLRSDRGGEYGTIFLENFCEKNGIIHETSAPYTPQQNGIAERKYRTLKEMMNAMLLSSGSSTRYQED

SEQ ID NO: 193742 - protein, 137 aa, Glycine max
  Coding DNA Sequence Number=SeqID_76964
MGTRGCISYNLVLAIRQLGYPMRGAPLEDELAPVISRGFNKTNVETLQKVRKAWEVLQKKDKELRGSNNGPIGGYRKWLKAHVQGLDWLPSLRTAKREEVEAPEEDEEVQALREELEQAQTVKERFKSEALKIRKEM

SEQ ID NO: 193743 - protein, 140 aa, Glycine max
  Coding DNA Sequence Number=SeqID_76965
  Homolog annotation: Hit_ID=Q9LUZ0; Match level="QueryCoverage=46%, HitCoverage=7%, E-value=1e-07, Identity=51%"; Hit description =Phosphoinositide-specific phospholipase C-line
MAAIMHSYGVVKALERETMTEKENTTCTLVQLSQNKEEEKATIGKVGVITHLVKLLEGRGLRGKKATVIALYAPCLLLKKWGLCRKKDSTIVRYVLCSAAKENKVNVGVMRALVEYGVLGERRGGDGGREGGAGKKASLL

SEQ ID NO: 193744 - protein, 283 aa, Glycine max
  Coding DNA Sequence Number=SeqID_76966
  Gene Ontology: Mol. function=hydrolase activity; Cellular component =mitochondrion; Biological process=metabolic process
  Homolog annotation: Hit_ID=Q56XU5; Match level="QueryCoverage=78%, HitCoverage=57%, E-value=8e-94, Identity=74%"; Hit description=3 -hydroxyisobutyryl-coenzyme A hydrolase
  Pfam annotation: Domain name=ECH; Domain location=71-240; Score=51.8; E_value=2.4e-12; Accession=PF00378.10; Description=Enoyl-CoA hydrataseisomerase family
MVLTLKTYFNSIIKVKGNLIDDEALQFVVVEGRQDVAKVVGERYGVERFPFCIDMLILFLVVVGEEIEHVRVITLNRPRQLNAISPELVSLLATYLEKWEKDEEAELVIIKGSGRAFCAGGDLRVFYDGRKIKDACLEVVYRFYWLCYHISTYKKTQVALVHGISMGGGAALMVPLKFSVVTEKTVFATPEASFGFHIDCGFSYYHSRLPGHLGEYLALTGGRLSGKEIVAAGLATHFVPFEKIVELENRLISLNSGDENAVRSVIEEFSSEVKLDEESILNK

SEQ ID NO: 193745 - protein, 837 aa, Glycine max
  Coding DNA Sequence Number=SeqID_76967
  Gene Ontology: Mol. function=protein binding; Cellular component =cytoplasm; Biological process=intracellular protein transport
  Homolog annotation: Hit_ID=Q8RZ91; Match level="QueryCoverage=99%, HitCoverage=94%, E-value=0.0, Identity=51%"; Hit description =Vacuolar protein sorting-associated protein VPS16-like
  Pfam annotation: Domain name=Vps16_C; Domain location=509-830; Score =194.1; E_value=3.4e-55; Accession=PF04840.3; Description=Vps16, C -terminal region
  Pfam annotation: Domain name=Vps16_N; Domain location=6-412; Score =226.6; E_value=5.4e-65; Accession=PF04841.4; Description=Vps16, N -terminal region
  Pfam module annotation: Pfam domain module=Vps16_C::Vps16_N; Domain location=509-830::6-412
MANVSVAAEWQLLYNRYYRKPELYPMPWKHVDLARTKVAAAPFGGPVAVIRDDSKIVQLHAESALRKLRLFSSSGRPLADAVWRHPGGRLVGMSWTDDQTLLCVVQDGTVYRYDVHANLIEPNLSLGKECFEDNVADCAFWGHGLVCITEANQLFCIADFRNPSAVKLADPGIDEMPHCMAVIEPQYTVSGNVEVLLGVDDAVVLAVEEDGVQRLGEGLLRGPLQKMVVSRDGKWLASFTHDGRLLVTTSDLTGVIIERDCESALPPQQIAWCGMDAVLLYWDDMLLMMGPEGEPVHYLFDEPIILIPECDGVRILSNTSMEFLQRVPDSTVSIFTIGSTSPAALLYDALDHFDRRSAKADENLRLIRSSLPEAVEACVDAAGHEFDVSRQQTLLRAASYGQAFCSNFQRDRIQEMCKILRVLNAVRSPEIGIPLSIQQYKLLTPSVLIGRLINAHQHLLALKVSEYLGMNQEVVIMHWACSKITASLAIPDVTLLEILLDKLKLCKGISYAAVAAHADKNDRRKLAALLVEHEPRSSKQVPLLLSIGEEDIALIKATECGDTDLVYLVLFHIWQKRQPLEFFGTIQARPLARDLFVTYARYVALDHIPEGKTDVAFLLWKESWELGKNPMASKGSPLHGPRIKLIEKAHGLFAETKEHTFESKAAEEHAKLLRIQHELEVTTKQAIFVDSSISDTIRTCIVLGNNRAAMKVKTEFKVSEKRWYWLKVFALATIKDWVALEKFSKEKKPPIGYRPFVEACIEADEKGEAIKYIPKLADPRERAESYARIGMAKEAADAASQAKDGELLGRLKLTFAQNAAASSIFDTLRDRLSFQGA

SEQ ID NO: 193746 - protein, 58 aa, Glycine max
  Coding DNA Sequence Number=SeqID_76968
MGKGRGSFTSTRLWGRALPTETDVHPKIYRMKLWATNEVLLEKAKEGKEKQWANVSHQ

SEQ ID NO: 193747 - protein, 101 aa, Glycine max
  Coding DNA Sequence Number=SeqID_76969
  Homolog annotation: Hit_ID=Q00M75; Match level="QueryCoverage=36%, HitCoverage=6%, E-value=2e-09, Identity=83%"; Hit description=PPR -repeat containing protein
MGVQAARYLYNESLGYEVLDPVVTSHQSRDILTKLRTPLPRGSSLCKGMGEGCCTQPYPCICKEAISGFEPMTNRSPRHNFTAAPGLALKRYTNNIGKLNF

SEQ ID NO: 193748 - protein, 107 aa, Glycine max
  Coding DNA Sequence Number=SeqID_76970
  Homolog annotation: Hit_ID=Q1RYI2; Match level="QueryCoverage=61%, HitCoverage=10%, E-value=3e-07, Identity=49%"; Hit description =Ribonuclease H
MGFIVHPKEERRIWSQKSEFGEPIPLLMKAGWNLCTKPNDIWVKEVCAKYQCDNDIFPVVDQRRPGSWLIQSNHEDNILVCFYVNANAAWDMRRISNELPLNIAHSI

SEQ ID NO: 193749 - protein, 71 aa, Glycine max
  Coding DNA Sequence Number=SeqID_76971
MAWLAARAQARARPDRAQICDGMVGGMSTDLRLQPRMTADLQWCSDVVAANTVEREQGLPNVDLCVVVCFY

SEQ ID NO: 193750 - protein, 410 aa, Glycine max
  Coding DNA Sequence Number=SeqID_76972
  Gene Ontology: Mol. function=pepsin A activity; Cellular component =cellulose and pectin-containing cell wall; Biological process =proteolysis
  Homolog annotation: Hit_ID=Q9SJG1; Match level="QueryCoverage=91%, HitCoverage=65%, E-value=1e-111, Identity=56%"; Hit description =Putative chloroplast nucleoid DNA binding protein
  Pfam annotation: Domain name=Asp; Domain location=190-402; Score= -197.1; E_value=0.058; Accession=PF00026.14; Description=Eukaryotic aspartyl protease
MVLRVSLILVLLVLHCSCTVESIWGHHNDLNKNGSSLAAVKFPDHAHFNAVSSSTETGCSFSKSEKFEPSVATMASNEDTDGKEGEAFVAAKQHKQSVKLNLRHHSVSKDSEPKKSVVDSTGRDLKRIQTLHRRVIEKKNQNTISRLEKAQEHSKKSYKPPTVAAAAPPEYLSGQLMATLESGVSLGSGEYFMDVFVGTPPKHFSLILDTGSDLNWIQCVPCYACFEQNGPYYDPKDSSSFKNITCRDPRCQLVSSPDPPQPCKGETQSCPYFYWYGDSSNTTGDFALETFTVNLTTPEGKPELKIVENVMFGCGHWNRGLFHGAAGLLGLGRGPLSFATQLQSLYGHSFSYCLVDRNSNSSVSSKLIFGEDKELLSHPNLNFTSFVGGKENPVDTFYYVQIKSIMVGGE

SEQ ID NO: 193751 - protein, 103 aa, Glycine max
  Coding DNA Sequence Number=SeqID_76973
MGAKYLEVVKRGSYPNNGWSLDKIRTKKKDEDKGNVIKGPMRLRKEEGLQMRVTTNVDSVVAMPREVPMPSMTELQCHERLQIRVPKRSSKSGQNESERIQSY

SEQ ID NO: 193752 - protein, 193 aa, Glycine max
  Coding DNA Sequence Number=SeqID_76974
  Gene Ontology: Mol. function=transferase activity; Biological process= DNA integration
MDVKTAFLNGDLREEIYVEQPKGYVIQGQENKVWSVMFLMNCTRPDIAYAVSRLSRYTHNPGGGAISWKSSKQTCIARSTMESESIALDLAGQEAEWLRNLLADVPLWGKRSIPVSLHCDSEAAIGIAKNNVYNGKRRHIRIRHSSVRELLKNGVISLQFVRSENNLVDPFTKGLTKKVVLESSRGMGLKPLC

SEQ ID NO: 193753 - protein, 51 aa, Glycine max
  Coding DNA Sequence Number=SeqID_76975
MAEDLHRITHGNVSDVLRKRLSVDFLHGNDFFFTNFKKMWEELATELAQAS

SEQ ID NO: 193754 - protein, 132 aa, Glycine max
  Coding DNA Sequence Number=SeqID_76976
  Gene Ontology: Mol. function=mismatched DNA binding; Cellular component=intracellular; Biological process=mismatch repair
  Homolog annotation: Hit_ID=Q1XBQ8; Match level="QueryCoverage=94%, HitCoverage=13%, E-value=6e-51, Identity=82%"; Hit description=DNA mismatch repair protein
MNRVIRKRSFQGGVRLQMCRKLSTVQLTERLDYSNLPGLNPNMKNGSLKEGTLNWEMLQFKPKFPRQVLLCRVGEFYEAWGINVCILVAYEGLNPFGGLQSDSIPRAGCPVVNLQQTLDDRTQGGYSVHSSK

SEQ ID NO: 193755 - protein, 219 aa, Glycine max
  Coding DNA Sequence Number=SeqID_76977
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=UPI000034F02F; Match level="QueryCoverage =87%, HitCoverage=9%, E-value=3e-58, Identity=60%"; Hit description =ATGSL11 (GLUCAN SYNTHASE-LIKE 11); 1,3-beta-glucan synthase/ transferase, transferring glycosyl groups
MREMNLQLLTNPLIWSDVSQNSEEKGCRFYALEKAHVMDPLSAGRGVRRFKTYLLQKLEKENELTVRSIERSDPWELQTYYQQFYEKKIRDGEFSQRPEEITNNVQIATVLYEALKTIVPPQKIEAKTRRYAEDVERKRGLYEHYNILPLYAVGVKPAIMELPEIKEAFIALRRVDNLPMPIIRARPDTFHDDSTMPTDRLKKVNDILDWIASVFGFQV

SEQ ID NO: 193756 - protein, 119 aa, Glycine max
  Coding DNA Sequence Number=SeqID_76978
METLASSTIHSNHNICCAFWVVEEEKKIEEETINLVALVVAVVAGPWPAPVAQMILLGLQEVADLIRSLFTDNSNRRLMQEGDDLDIGDVPSSLASLVPIVIAALQIEEENPRVAYLCE

SEQ ID NO: 193757 - protein, 86 aa, Glycine max
  Coding DNA Sequence Number=SeqID_76979
MALYGIVAMEQEYTCKVKLNVVAYSNSRTIFVRKSHIACLNSWGATYIFAGQLHSVYPLLDHAANQQASIQLLCGDTTTVTSTIQA

SEQ ID NO: 193758 - protein, 85 aa, Glycine max
  Coding DNA Sequence Number=SeqID_76980
AANHKGHVQTYECLYQLSLSLQSQGYAPFPCPTPDQFRAEVAWPRDWPEAQVGEAPAEAPDDGEEARMDEEMADLLDFLGGSGAT

SEQ ID NO: 193759 - protein, 184 aa, Glycine max
  Coding DNA Sequence Number=SeqID_76981
  Gene Ontology: Mol. function=RNA-directed DNA polymerase activity; Biological process=RNA-dependent DNA replication
  Homolog annotation: Hit_ID=Q1T5S5; Match level="QueryCoverage=46%, HitCoverage=39%, E-value=1e-13, Identity=52%"; Hit description =Ribonuclease H
MKVYAKDGTTVKDFIVNGSWTPSPEAQYQIRWNETDSGTLSLKEAFLIRNPSGLKLSVLNAECASWYLPVVYTKQQRKPRIIISLTALLLKSGHPKKAPSIIQVDWTPPICNWIKCNTDGAAKGAPGPAELLGAIMDIEIANDKGWCNLWPESDFKFVILALHNPNLEILVPISLPPLAPLHKA

SEQ ID NO: 193760 - protein, 94 aa, Glycine max
  Coding DNA Sequence Number=SeqID_76982
MSNLKTSFTKGAITLMQIELLMAMTAEDQPLGLASSLDPTLSISWPGPALKAEYHSLAATESYGFSHCCKNFKCTSPLIRSTCLLANPAQPPTA

SEQ ID NO: 193761 - protein, 257 aa, Glycine max
  Coding DNA Sequence Number=SeqID_76983
  Gene Ontology: Mol. function=ATP binding; Biological process=apoptosis
  Homolog annotation: Hit_ID=Q8LJ95; Match level="QueryCoverage=87%, HitCoverage=37%, E-value=4e-30, Identity=38%"; Hit description=NBS -LRR resistance protein RGH1-like
MDGQNEAVGGPSTWSIFELPPSIFQLESLAVLGLKACHNLETLPNDIESLKNIRWSDLSQCYLLERMPKRIEKLTNVEVLKGFVIGSSSKSSYQISDLADLKNLERLSIHIGSGAIIDENEFESLKGLSKLEHLIISWGVCGTRYTDDIRISLLSNLKKLHLDEDFPEESIPRLLKPTNLPVSLKDLNLAGGKLASMDHGKLDHSDSCKLEIIHLKYLKHLIVDPEKLQTLFPSSVYVEIKDLQNLLYHEWIKDEER

SEQ ID NO: 193762 - protein, 67 aa, Glycine max
  Coding DNA Sequence Number=SeqID_76984
MEVEMWYGMRFQTCGVHFGRLSVLMEERMWTCRAKVRQISIETKWVVLDLHGSEHYLLLPTFEYTSL

SEQ ID NO: 193763 - protein, 66 aa, Glycine max
  Coding DNA Sequence Number=SeqID_76985
  Subcellular localization annotation: CTP_CleavageSite=34; ConfidenceScore=5.30e-01
MVKLSASSTSTTSTLLLTDLSCKACQRRNVKHSRSMPKDGDIRDRESNMSNIVNNLRLKLEAQGKA

SEQ ID NO: 193764 - protein, 75 aa, Glycine max
  Coding DNA Sequence Number=SeqID_76986
IRHGGLESSNIIRVGGQQFPYHPCFPVYGRVSPSEGHKMTCTSKSGCRLGKNLLEIGQQHEQHEDLALKLEEELK

SEQ ID NO: 193765 - protein, 141 aa, Glycine max
  Coding DNA Sequence Number=SeqID_76987
DRECAELIGETADDVNRVKIELVNLCCFWQDGDLDLNASPQALDKLLGHVLAFKVRIQSKFKNAVVLRYSKDLDLINVVLEMLPDSEQSLSVTADHDPVAGLPLTPKKRMSSDEADDELGSSQISPAQLSSNKLTRHSHKS

SEQ ID NO: 193766 - protein, 150 aa, Glycine max
  Coding DNA Sequence Number=SeqID_76988
  Gene Ontology: Mol. function=protein serine/threonine kinase activity; Biological process=protein amino acid phosphorylation
  Homolog annotation: Hit_ID=Q0WPH8; Match level="QueryCoverage=43%, HitCoverage=12%, E-value=6e-15, Identity=47%"; Hit description =Protein kinase like protein
MERATHLNGSRIAFGWKRWRRGYRESSEVPRAIPPQKQVLHKGLELTTSIGERSVVACLALYVLKKIRLARQNERCRRSTHQEHPYIVQFKEAWVEKGCIDEKINWGLLSRECSNIFLTKDQDVRLGFMLTIILSSFYNIVESYMLASKE

SEQ ID NO: 193767 - protein, 128 aa, Glycine max
  Coding DNA Sequence Number=SeqID_76989
MDWLRRGLSRGSRNSKTPNIQTQSNSEVQQHLEESIYGITEELINHIKTFTLDTFKNFPLQDEVEGSYGEDTQSSSTKVRNELSQWQEKHAILVLSRVKVKGFNKFYIDCRVSNITVLYSSQGPAMRP

SEQ ID NO: 193768 - protein, 78 aa, Glycine max
  Coding DNA Sequence Number=SeqID_76990
MKTNCPVAGKGGSVLLVKCDTDSYIYQRKLQCRKYYQRFKTSMSQVEGLNRRVSLGRACGSSVLVKLCLGRRNGKVVV

SEQ ID NO: 193769 - protein, 462 aa, Glycine max
  Coding DNA Sequence Number=SeqID_76991
  Gene Ontology: Mol. function=nucleic acid binding; Cellular component= nuclear pore; Biological process=DNA integration
  Homolog annotation: Hit_ID=Q1S7C5; Match level="QueryCoverage=97%, HitCoverage=37%, E-value=3e-49, Identity=33%"; Hit description =Integrase, catalytic region
MGENKSNKFVNSHKLEFWSHECIFLGYSTSHKGYKSLSPSGRSLISKDVVFNELRFPYKELFDITPNPNPTPSPSTHFSPTSIPIIPTVQIPTSVSPQSPSSNSLESHHSPVSGPSNVPARSSEAVPNASEHSAQSSEAVPNASEPPSDNSDPHIQFLHPYTLLPLHHIMSRLPQIPLPHLPIMFLLALNLLTLIQRKPDPIKENADGSINRYKARLVAKGFHQVQGFDFHETFSPVVKPVTIRLIITLAITNHWDLFQLDVNNAFLHGILEETSNSHTIYLLACVDDIVITGSSSQTLKDYSLVLTQSKYIRNLLQKTKMTNAQLISSPKVTNCKLTKSGADLFSDPTFYRFVIGALQYTTITRPERSVGWSKIWRVYARRNKGEKRKGEVAVGITELPKSAVLGHPFPIRALCDADWASEFDDRRSTSGAAVFLCPNLISWWSCKQQVVARSSTEAEYRS

SEQ ID NO: 193770 - protein, 187 aa, Glycine max
  Coding DNA Sequence Number=SeqID_76992
  Gene Ontology: Mol. function=mismatched DNA binding; Cellular component=intracellular; Biological process=mismatch repair
  Homolog annotation: Hit_ID=Q1XBQ8; Match level="QueryCoverage=85%, HitCoverage=15%, E-value=3e-41, Identity=56%"; Hit description=DNA mismatch repair protein
MYLQTEKLASKSTVDGLHQPREIPRNSGKEEESARTILYRLQMCRKLSTVQLTERLDYSNLPGLNSNMKNGSLKEGTHNWEMLQFKPKFPRQVLLCRVGEFYEAWGINVCILVEYEGLNPFGVPAILPVYEYMLLINFGLNTALWRRQAQGPTQARSRKRLFISGLKEGRGIWTEVKASSITDRNPT

SEQ ID NO: 193771 - protein, 812 aa, Glycine max
  Coding DNA Sequence Number=SeqID_76993
  Gene Ontology: Mol. function=RNA-directed DNA polymerase activity; Cellular component=nucleus; Biological process=RNA-dependent DNA replication
  Pfam annotation: Domain name=Exo_endo_phos; Domain location=4-220; Score=-0.9; E_value=0.014; Accession=PF03372.13; Description =EndonucleaseExonucleasephosphatase family
  Pfam module annotation: Pfam domain module=Exo_endo_phos::RVT_1; Domain location=4-220::365-629
MGKLKEISSRLLQLDPMIIVLIETRVKKSKATNIRKKLRFKGMYLDNYVDHDNGRIWLCWDNNRIDLKFVHSSSQLVHCGVYGLDGIFRYWLTAIYALNKLENRRSLWKDIVTLHSHQQGPWCLIGDYNNVTKAQDRIGGKMVTEAEYTDFSDMLEQTGLAKMDSQGDYFTWSNKHVEGTIYSRIDRVMANVSWFQNNLDVNLHIMPPNVSDHALLWLQHRDRAQLDLSIDLMNSTNIAKVKKYTDELIYFQELEENVLRQKAKIDWLKLGDGNNSFFYATVKSRANAKGMNMLRKIDGTVCATQEDIENMVLEFYGELMGKKSTNLKHIDANAMRRVSDQEILKVLNGIGDLKSPGIDGSGAKFFKSSWDTIKDDINNAHEKIVSVKDYRPIAGCTILYKIISKILTARLGKVLNSIVSPCQAAFVPGQQIHNHILLAYELIRGYARKNGTPRCMIQLDLQKAYDMVDWFALETILLETGIPKQFVKWIMLTVTSVTYRRLQIVEMLMQTLNTFSETIGLLVNSSKCNIYFGGVDAPMKTDIMKLTGFKEGPLPFKYLGVPLTSKKLSISHYLSLVDRITGKINHWSNKLLSYAGRLQLIKSVTFSIANYWMQCFPLPKPRKYGGLNVIHLQTWNHVTMMKLLWSLSEKSDLDQKDKGKFSMKTLYLKMRCEGSNEVVWNRLLCGNPARPRALMTLWQACHGRLPTKDHLLRFGMLGDKICCFCEGPESHDHLFFGCSVLGDVWKQVLEWIQVKHHPQEWNEELKWIIRHGKGKGHKASILKLAMTESVYGIWKHRNAKIFEETIDNTNNS

SEQ ID NO: 193772 - protein, 44 aa, Glycine max
  Coding DNA Sequence Number=SeqID_76994
MLIFECDYLPICCLNGLADPFFLEIIAKVLIASRISVLLLELQP

SEQ ID NO: 193773 - protein, 72 aa, Glycine max
  Coding DNA Sequence Number=SeqID_76995
MVVILPKENVFIWFCSLHNRSYNYLKGIINSALKGLDDTPQSKSKAAARWIIVKYFNDARSLESERLKALHI

SEQ ID NO: 193774 - protein, 63 aa, Glycine max
  Coding DNA Sequence Number=SeqID_76996
MRKRKKKRILLKWILMIIEVILNEVKNKIKGFLSLDLVTGDPPQQKRSLIIEIEEELKNITKG

SEQ ID NO: 193775 - protein, 73 aa, Glycine max
  Coding DNA Sequence Number=SeqID_76997
MTLPNIIIAIQSSITDNGVTPIINTLWYRCPVYQLNGEVQYRAIQIIDEEVIIVYICIISEMRSNVRPNPHMH

SEQ ID NO: 193776 - protein, 41 aa, Glycine max
  Coding DNA Sequence Number=SeqID_76998
  Subcellular localization annotation: CTP_CleavageSite=15; ConfidenceScore=5.06e-01
MASSGLGGVSSSSPSATTAASSSKAGSWAAEALPPPPEREG

SEQ ID NO: 193777 - protein, 226 aa, Glycine max
  Coding DNA Sequence Number=SeqID_76999
  Pfam annotation: Domain name=Transposase_23; Domain location=69-139; Score=-2.5; E_value=0.0021; Accession=PF03017.5; Description =TNP1ENSPM transposase
QLTQQIRDQLEESITEKVTRQVMASFSQLQSQMQSQGLAVPPEPLVGPSGPRVSTKGSCVDPSGNDPEMGDSDRCGLYIKADPARLVAMGRVYEGSTIVHNTSLLPGQVKVSVEEVTDADALVPIPTDAVSLVGQALHTFLAWPTHLAKSLSQQSSQSDVYLGAYLNGGHWQMVVILPKEDLVVWFCSLHNRLDNYLKGIINSAIKGLDDAPQPKSKASARWIVVK

SEQ ID NO: 193778 - protein, 130 aa, Glycine max
  Coding DNA Sequence Number=SeqID_77000
MDGKIERFAVYSFPVVVKELADEYQLGSYVGVGIDDPGKYLRFSLAPNDFQSMIIKNGIAEFVEPLNREKTVYGVHPKTDKSKEGFLCSMNESLLDKEEINKLYQKGSAFSNQTTNFAKSSDKKYRTMRL

SEQ ID NO: 193779 - protein, 463 aa, Glycine max
  Coding DNA Sequence Number=SeqID_77001
  Homolog annotation: Hit_ID=UPI00006DAAC0; Match level="QueryCoverage =46%, HitCoverage=58%, E-value=8e-78, Identity=66%"; Hit description =COG2141: Coenzyme F420-dependent N5,N10-methylene tetrahydromethanopt erin ...
  Homolog annotation: Hit description=reductase and related flavin -dependent oxidoreductases
  Pfam annotation: Domain name=SBP_bac_3; Domain location=298-462; Score=11.4; E_value=8.1e-09; Accession=PF00497.10; Description =Bacterial extracellular solute-binding proteins, family 3
MRCATDCDEYLDVVAGPLNIGRTPQGRPIVFQAGASDDGKKLAAKHADAIFTHHETLDEAKAFYRDVKQQLETHGRRPSDLHIFQGVSVIVGKDADDVENQYQTTAALVSINDALNYLGRYFEHHDFSQYPLDEPFPDIGDLGKNSFRSTTDEIKRNARERNLTLRQVALEAASPRPRFSGRHAGHLPALCGPGRAGSAGTRPVPHRLPGHHAARKPGSGPTEKSLYTTIKENTAMQKTSLILALALAFTPAVWAENVNINGTGVSIEANKTPINTAKNGDAIARLPKDYRFAVPGKFTVAVAGLNQPPLTVFSDDNKTLLGSEVDVARLVADSLGLELNVVPTSWEDWPLGVASGKYDAAISNITVTKERKQKFDFATYRKDSLGFYVKSTSPITSLQKAEDIAGLRIIVGSGTNQESILLAWNAENLKKGLKPFTPIYTKDDAAQTLALQSGRADAYFGPN

SEQ ID NO: 193780 - protein, 143 aa, Glycine max
  Coding DNA Sequence Number=SeqID_77002
  Subcellular localization annotation: CTP_CleavageSite=60; ConfidenceScore=5.01e-01
MVLEISFQPYKNPFTSKDPQGMYPPLFSLNNLVDVPSTRTDPQEMYHLLFSVTTTQVDVPSTYTTKDVPSNVLRQSSQAVSPLKLCQGGNKRILKREKGDTKEFRRLVLRSFGKGRRETQKEFRRLVLGEFFLAKGEGNEKDE

SEQ ID NO: 193781 - protein, 107 aa, Glycine max
  Coding DNA Sequence Number=SeqID_77003
MVGYAPSSFANLVFAGERIEAGLERDKFDHPALMNEKTVANEEYENEGETLAVTVIPTWPNFPSIQQSKVPQPPFFRGYDSNATCAYHGGAPGHSIEHYRTLKHKVQ

SEQ ID NO: 193782 - protein, 130 aa, Glycine max
  Coding DNA Sequence Number=SeqID_77004
LTVSETMRDIITPNLFQCRFLTLNFDTSLDIVNVGKRWGWSSVVRKMGSGGKREMEIKRKKDVISFAMVHDEWWKFFESLRLLLLLFTVDMSGFMDLSYFDDAKESSVKQIPKIQESSFKIEESSFKNNQ

SEQ ID NO: 193783 - protein, 97 aa, Glycine max
  Coding DNA Sequence Number=SeqID_77005
MLSLSRPPGCARNSPPPIGDQPGSPKADIPIARFPDPNYGVKTGSSQCGFSMENNDGLWWLMVAVGDGESSWNFRNGFGRKKEEEMTFFLSYTKAKA

SEQ ID NO: 193784 - protein, 57 aa, Glycine max
  Coding DNA Sequence Number=SeqID_77006
MVEACMESTSKDKKESSSDATRNPRGSLALAFGHVHRLDVVYGRGGHCALTFQGLWH

SEQ ID NO: 193785 - protein, 74 aa, Glycine max
  Coding DNA Sequence Number=SeqID_77007
MPNDVEVRCISIKDCQAMRGRKDDVDHVGYPTGFDACHIVWWFTWGLKAHPHNQLLGFDGPICHDWTIHPYPMF

SEQ ID NO: 193786 - protein, 544 aa, Glycine max
  Coding DNA Sequence Number=SeqID_77008
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=99%, HitCoverage=74%, E-value=0.0, Identity=91%"; Hit description =Photosystem I P700 chlorophyll a apoprotein A2
  Pfam annotation: Domain name=PsaA_PsaB; Domain location=8-544; Score =1060.4; E_value=0; Accession=PF00223.9; Description=Photosystem I psaApsaB protein
MALRFPRFSQGLAQDPTTRRIWFGIATAHDFESHDDITEERLYQNIFASHFGQLAIIFLWTSGNLFHVAWQGNFEAWVQDPLHVRPIAHAIWDPHFGQPAVEAFTRGGALGPVNIAYSGVYQWWYTIGLRTNGDLYTGALFLLFLSTISLIAGWLHLQPKWKPSVSWFKNAESRLNHHLSGLFGVSSLAWTGHLVHVAIPGSRGEYVRWNNLLSILPHPEGLGPFFTGQWNLYAQNPDSNSHIFGTPQGAGTAILTLLGGFHPQTQSLWLTDIAHHHLAIAFLFLVAGHMYRTNFGIGHSIKDLLEAHTPPGGRLGRGHKGLYDTINNSIHFQLGLALASLGVITSLVAQHMYSLPAYAFIAQDFTTQAALYTHHQYIAGFIMTGAFAHGAIFFIRDYNPEQNEDNVLARMLDHKEAIISHLSWASLFLGFHTLGLYVHNDVMLAFGTPEKQILIEPIFAQWIQSAHGKTSYGFDILLSSTNSPAFNAGRSIWLPGWLNAVNENSNSLFLTIGPGDFLVHHAIALGLHTITLILVKGALDARGS

SEQ ID NO: 193787 - protein, 67 aa, Glycine max
  Coding DNA Sequence Number=SeqID_77009
MEALVGTARRRRRRAVLFGLLGCVARVYLVGRVQPRVSYYSTVSGDGGGNGHRVAPESYLHACLVRV

SEQ ID NO: 193788 - protein, 200 aa, Glycine max
  Coding DNA Sequence Number=SeqID_77010
MGFVTWWEKYYSTRSVGDTTIMISRLESGFAQPTIENIRSSLQARGKAPITKRSAETSRADVRPKKPTGVKIQEGKQEEKEEEERPLIRKRKLPTTSTKSADQTEAGNSQAQMPKKKKKVKQVEPEPSVAVEGGEPAKKKKKKTKSSKEQGDKQPVDVQPPSTDIDGTEVEAAPSIAEMGNPVEQPNLPQEQPAVEVSFS

SEQ ID NO: 193789 - protein, 86 aa, Glycine max
  Coding DNA Sequence Number=SeqID_77011
MEREMIKMIVDTLSVFYYEKMVGYTPSSFADLVFADERIEVDLRRGKFDYPAMMNRKPWENGEDKKEGGTHGVTVVPTWPNFPPVQ

SEQ ID NO: 193790 - protein, 541 aa, Glycine max
  Coding DNA Sequence Number=SeqID_77012
  Gene Ontology: Mol. function=transporter activity; Cellular component= integral to membrane; Biological process=transport
  Homolog annotation: Hit_ID=Q98FS3; Match level="QueryCoverage=47%, HitCoverage=86%, E-value=3e-82, Identity=58%"; Hit description=ABC transporter, permease protein, MalFG family
  Pfam annotation: Domain name=BPD_transp_1; Domain location=337-536; Score=54.3; E_value=3.9e-13; Accession=PF00528.12; Description =Binding-protein-dependent transport s
  Pfam annotation: Domain name=BPD_transp_1; Domain location=51-300; Score=51.0; E_value=4.1e-12; Accession=PF00528.12; Description =Binding-protein-dependent transport s
  Pfam module annotation: Pfam domain module=BPD_transp_1::BPD_transp _1; Domain location=337-536::51-300
MLLVMLLLTAWPLLRTIWLSFTDAALIGSGGEAPQWIGLENYLYAITDADFQTSLWRTLYFTVVSVAIEGVIGVLVALLLNQKFAGRNVLRVLVILPWALPTIVNAMMWRLNFNPDYGSINALLTQLGIIDGYRSWLGSPASALNAVMFADIWKNYPLVTLLVLAALQSVPEDLYEAARLDGASAWRRFRAITFPAIVGSLSVALVLRTIDAFKIFDIIYVMTRGGPVDSTKTLSFYVYQESFSYLRAGSGAAYAIAVGEVPMKVKLRTCAKYAAALLVALSVVAPMGWLFLMSVSATSDLTRVPLEWLPRQWDFSRYGRLISLEPGQPGALFLHALGNSLLVSTGATLVCLLLAIPAAFSFSRYRGRDGWLFASLAIYMVPPVAFVLPLYFLLQQFDLLNTRPGLIIVYCSLILPFLTWMLKNQFDALPQDIEQAARLDGLRVWQVLLRITLPLAKPVLGAAALFGWLLAWDEFFYALLFTSNIAAQTLPVTIAGFTAGRATDDGLIAAVGILASVPPLFIAIWLQKTLVSGLASGGSKG

SEQ ID NO: 193791 - protein, 69 aa, Glycine max
  Coding DNA Sequence Number=SeqID_77013
MTSPGRVQVTTLVTACNRGDDVSQYLQSCLASYGYQMRLFHSVGRKTWTSPERVQVTTLVTACNLKDSK

SEQ ID NO: 193792 - protein, 259 aa, Glycine max
  Coding DNA Sequence Number=SeqID_77014
  Gene Ontology: Mol. function=oxidoreductase activity; Biological process=electron transport
  Homolog annotation: Hit_ID=Q1Z557; Match level="QueryCoverage=62%, HitCoverage=16%, E-value=5e-39, Identity=52%"; Hit description =Xanthine dehydrogenase family protein, small/large subunits
  Pfam annotation: Domain name=FAD_binding_5; Domain location=1-70; Score=-63.0; E_value=0.022; Accession=PF00941.11; Description=FAD binding domain in molybdopterin dehydrogenase
  Pfam annotation: Domain name=Fer2; Domain location=176-236; Score =26.9; E_value=6.9e-05; Accession=PF00111.17; Description=2Fe-2S iron- sulfur cluster binding domain
  Pfam module annotation: Pfam domain module=FAD_binding_5::Fer2; Domain location=1-70::176-236
IRNRATIGGNIVNAAPCGDSIPPAILYDARIELRSLNGVRTLGLAEFLLSGYKTQRQPDELLTKVILPPPVRPRAKGFYHQLGRRNALNITRQSLSALLDFADDGTVSYCRLVDGALFSKPQRLLDIERCLLGKPLNSDTINSACEVLDKLIYAAIGRRWAPERPVQDRAMSTIKVKVNGKLVEAKVEGNMRLLDLVRDTLHLTATKEGCSIGECGACTVLMDGNAVCSCLVLAEQCDEAEIETLEGAACSAGSVRREY

SEQ ID NO: 193793 - protein, 54 aa, Glycine max
  Coding DNA Sequence Number=SeqID_77015
MNALSAPAALSLFITTVKILDFQMNALSGPALSLTCQAKRHFAFAKRQPAALST

SEQ ID NO: 193794 - protein, 52 aa, Glycine max
  Coding DNA Sequence Number=SeqID_77016
MVTQRRTGVRLPIGVPMLNSSAKDQSLSQSPGSSQYSEKDKFFYKVEVKSLA

SEQ ID NO: 193795 - protein, 183 aa, Glycine max
  Coding DNA Sequence Number=SeqID_77017
MGEVEEVQEQVKADTEALKEQMATRMEAMMSIKEIMEVNAVAIAVTNTIVEVDLTPSYGLNQINHPTSDMVGLEGKELGGAGGPHLVRKTGIPSHHMACLPIICHPMWRTLPMRMSIAPLLYSLRANNLNLIMHIFATYPSAGGRRMTRGIIFQERNMRGVATNVYLRKTSEKPEKTWSTNFK

SEQ ID NO: 193796 - protein, 84 aa, Glycine max
  Coding DNA Sequence Number=SeqID_77018
  Homolog annotation: Hit_ID=O64438; Match level="QueryCoverage=43%, HitCoverage=15%, E-value=2e-14, Identity=94%"; Hit description=ARG10
MMIIHNMRIFTLTLSMFCFFFVSQNWCFYSTAVGGLRCYENPKNKITAIPAEEEEIWGAFFKVILELKKLELNILYVTRIVSCN

SEQ ID NO: 193797 - protein, 101 aa, Glycine max
  Coding DNA Sequence Number=SeqID_77019
MGEAHEIPHHNLADFEPCLRYATEGQAVGGIPMPNTLEGPQFRPQPQPLHFAVGRAPPTMAEKGKVDHLKERLRAIEGGEDYAFANLEELFLIPKHGHYQV

SEQ ID NO: 193798 - protein, 72 aa, Glycine max
  Coding DNA Sequence Number=SeqID_77020
MVGYAPSSLADLVFADERIEASLKRCKFNHPPGANEKTGANEEGENEGETHAAIAVPTWKLPICQTMSLLSQ

SEQ ID NO: 193799 - protein, 48 aa, Glycine max
  Coding DNA Sequence Number=SeqID_77021
MAYPGHGAEDVPVLSKSDRNEVALDKRKKRLEPAPPAKGTWTLQKAQV

SEQ ID NO: 193800 - protein, 83 aa, Glycine max
  Coding DNA Sequence Number=SeqID_77022
MEAGLVDLTLSWCSKGGEMSPTEGGGVRVKARGLGLDGGTCEGGEDNFEPLKGRWLRGVDAGEVVAKEEEDEREVYQVEVGVR

SEQ ID NO: 193801 - protein, 84 aa, Glycine max
  Coding DNA Sequence Number=SeqID_77023
  Homolog annotation: Hit_ID=Q86AI8; Match level="QueryCoverage=90%, HitCoverage=17%, E-value=1e-07, Identity=35%"; Hit description =Similar to Homo sapiens (Human). Mucin 2
  Subcellular localization annotation: CTP_CleavageSite=77; ConfidenceScore=5.77e-01
MARACNPLKVRTCSPLMARACSPLKVRTRSPLMARACSPLKVRTCSPLKVRTHSPLKVRACSPLLARTCSPLKTRVLVPEGPSL

SEQ ID NO: 193802 - protein, 574 aa, Glycine max
  Coding DNA Sequence Number=SeqID_77024
  Gene Ontology: Mol. function=nucleic acid binding; Cellular component= cytoplasm; Biological process=DNA recombination
  Homolog annotation: Hit_ID=P33919; Match level="QueryCoverage=95%, HitCoverage=93%, E-value=0.0, Identity=78%"; Hit description =Hypothetical protein yejH
MAQQRLQRHHISGGLPAELHAGRTLMWPHKQLLKGGALRRGAQAKALADAGAILIIIGGLQPLAFIIASVRQRHTTAAQYARVFQLQRRFQHIIGVDQYLVALLAAARGDIIFCTAVRAAFKAETVVALRAIALVIVEHALTAAAKVLNDVAIFGRLAPEGIRKAAGRTKHLHRLVIAGAFRCADFGRKEIVRVSGVIEDQAVGFARCQPQPATDNLLIQADRFGRAQNGDQIDVWRVKAGGQHRHVNQKLKLLRFELLNQPVTLLHRGFRRYQRTVFRQQAENFPRVFNGCGKYHHAAARLSELDDLSHDLRRDALLLFQFAVKIGLTEQAIILRDQPTEIILHHRHIQPLGRHQKAMFDHIAQRQFVDAVAEQRIIIAAHHAVIVVLVNPAFAQAEWRGGQPQQTQLRIVLAQMGEQLLILALLVVADAMALIDNHQRKGAVKTGQIARHRLHAAEHHFTVALLALQARGEDVRLQAIRLIFTVVLLHQFFDVSQHQHATARQPRQFGNHQAFAGAGRQHNHRWRGVAAKMGNGGINGFLLIGAQGEGSGYTAHTFSTVNPAHNYAGARRAT

SEQ ID NO: 193803 - protein, 381 aa, Glycine max
  Coding DNA Sequence Number=SeqID_77025
  Gene Ontology: Mol. function=nucleic acid binding; Biological process= DNA recombination
  Homolog annotation: Hit_ID=P33919; Match level="QueryCoverage=99%, HitCoverage=65%, E-value=1e-179, Identity=78%"; Hit description =Hypothetical protein yejH
  Pfam annotation: Domain name=Helicase_C; Domain location=68-141; Score=52.3; E_value=1.7e-12; Accession=PF00271.21; Description =Helicase conserved C-terminal domain
MPVVQYDFSRLIPQNNGLFSEADLNRELKQQQRVTPQIMRQIIEFAETRRGVMVFAATVEHAREILSLLPENSALVSAETPVKERDRLIQQFKAQQLKFLVNVAVLTTGFDAPHVDLIAILRPTESVSLYQQIVGRGLRLAPGKTDCLILDYAGNPHDLFTPEVGAPKGASDNQPVQVFCPACGFANTFWGKATEDGHVIEHFGRRCQGVLDDDEGNRAQCDYRFRFKSCPDCGAENDIAARRCQQCDKVLVDPDDMLKAALKLKDARVLRCSGMTLAHGRDDKGEWLQATYYDEDGTSVSERFRLRTPAQRTAFEQLFMRPHQRAPGVELGWQTAADVVALQPLLRHPDFVVARAKGHFWQVREKMFDYQGRYRRANELR

SEQ ID NO: 193804 - protein, 83 aa, Glycine max
  Coding DNA Sequence Number=SeqID_77026
MAGNNPNDGVGLSQVQMQALTQHLERLMKQRDDALHERLDQMENRDHNEEEKRRRGNTELMVLNSTFLPLKERMIWRPTWSGR

SEQ ID NO: 193805 - protein, 117 aa, Glycine max
  Coding DNA Sequence Number=SeqID_77027
RAGAGGSGGGGGDVSGSGGGGGEVSGSGDCGLRRALPPTMPQEDADGRGGVEAVAEVDLGGCCGTAAEGERESPKRRGGLGRKGCEEEEQRRSRQGSAPELQRRLLRVSENNNFFAV

SEQ ID NO: 193806 - protein, 143 aa, Glycine max
  Coding DNA Sequence Number=SeqID_77028
  Subcellular localization annotation: CTP_CleavageSite=14; ConfidenceScore=5.42e-01
MGTTKACYGTSRIVQQRVPSTSKRSNKGCMPSNNGPWTKLGDRARKTPNGLGEVQQGLGVSSSDYGPLSSGPLLTELSSRSTVSPGRRRVRHHRTPGMVDSGQPMHRRHLQSPSAHLQRLEHCLRPIADRRVTMSKAKDKQKY

SEQ ID NO: 193807 - protein, 88 aa, Glycine max
  Coding DNA Sequence Number=SeqID_77029
MAFLGETSSQTIVNSRLAFIFPNGTVIHNECGVYFQSSSPVPMRVPNLCDFSTLKSRIHISLLLNNNQVVDEFHYRRPVEDTEQQMQF

SEQ ID NO: 193808 - protein, 95 aa, Glycine max
  Coding DNA Sequence Number=SeqID_77030
MEKSDKMNFKEKKAYITWEDNVINSSSDSENKIISLGIMMKDYENGEEQSRYNNKQRPHFSPRKVNLKKSEYMIYGDNKDHLINKPNKWYQMIPT

SEQ ID NO: 193809 - protein, 368 aa, Glycine max
  Coding DNA Sequence Number=SeqID_77031
  Gene Ontology: Mol. function=sequence-specific DNA binding; Cellular component=excinuclease ABC complex; Biological process=response to DNA damage stimulus
  Homolog annotation: Hit_ID=P0A8G0; Match level="QueryCoverage=92%, HitCoverage=55%, E-value=1e-160, Identity=81%"; Hit description =UvrABC system protein C
  Pfam annotation: Domain name=GIY-YIG; Domain location=45-127; Score =119.2; E_value=1.2e-32; Accession=PF01541.14; Description=GIY-YIG catalytic domain
  Pfam annotation: Domain name=GerE; Domain location=1-52; Score=20.0; E_value=5.2e-05; Accession=PF00196.10; Description=Bacterial regulatory proteins, luxR family
  Pfam annotation: Domain name=UVR; Domain location=232-267; Score =48.9; E_value=1.7e-11; Accession=PF02151.9; Description=UvrBuvrC motif
  Pfam module annotation: Pfam domain module=GIY-YIG::GerE::UVR; Domain location=45-127::1-52::232-267
MITRGQKVTEISEQLNLSPKTVNSYRYRMFSKLNISAFLSTVTSQPGVYRMYDATGTVIYVGKAKDLKKRLSSYFRTQVGSRKTEVLVSNIHNIDVTVTHTETEALLLEHNYIKLYQPRYNVLLRDDKSYPYIFLSGDPHPRLAMHRGAKHAKGEYFGPFPNGYAVRETLALLQKVFPIRQCENSVYRNRSRPCLQYQIGRCLGPCVAGLVSEEEYAQQTDYVRLFLAGKDDQVINQLVQRMEQASVGLRFEEAAHLRDQIQAVRRITEKQFVSNQGDDLDVMGVAYDAGMACLHVLFIRQGKVLGSRSYFPKVPADTELTEVVQTFVGQFYLQGSEARTLPADILLDFNLPERELLAASLSELAGRK

SEQ ID NO: 193810 - protein, 117 aa, Glycine max
  Coding DNA Sequence Number=SeqID_77032
  Homolog annotation: Hit_ID=O64438; Match level="QueryCoverage=35%, HitCoverage=17%, E-value=7e-14, Identity=83%"; Hit description=ARG10
MRIFTLALSMFFFFLFPMIVRCFYSTAVGGLRCYENPKNKITAVPAEEEDIWGAFFKNRESVISPNSNIRLMSVETTLGTKGKCEVRDNRIGVHKKPTHTAKISLNGKCSVQNEWLD

SEQ ID NO: 193811 - protein, 229 aa, Glycine max
  Coding DNA Sequence Number=SeqID_77033
MPFGLKNTPSEFQEIMNVSKSKINLFQTRIRFLGHNIYQGIIIPIDRLKKNPPAWSDIHTQTVKDIKLKVQFIKCLYLPIPQAFKIVETDASDIGYGGILKQRVHDHEHKRPCYLRQREPPYGEVEVQVKASNWLYQSQPSKQSSSTSSGSPTQVGSSTQKSKIEGSSTQIVTIKPESSTQESPKPATAKQTKADYVWSVQTLQGLQEMGLAKLPKLNQKDLGRHCLRI

SEQ ID NO: 193812 - protein, 151 aa, Glycine max
  Coding DNA Sequence Number=SeqID_77034
TELERRNLHKCLTNLVDGSIDLALVKEFYANLYSSDGPSPKQARVRGHLVKIDAGSLNAFLETPVVLAEGRGFILNAEGHSGRILRKDLTTLAQVWSVLSYSNLAPTSHTSDLTVDRARLIFGLVSHMDMNIGALISGQMTSISCSDHRPM

SEQ ID NO: 193813 - protein, 285 aa, Glycine max
  Coding DNA Sequence Number=SeqID_77035
  Gene Ontology: Mol. function=DNA-directed DNA polymerase activity; Biological process=DNA replication
  Homolog annotation: Hit_ID=UPI00006B88B6; Match level="QueryCoverage =74%, HitCoverage=55%, E-value=2e-72, Identity=65%"; Hit description =DNA polymerase III subunit beta
  Pfam annotation: Domain name=DNA_pol3_beta; Domain location=74-192; Score=149.5; E_value=8.8e-42; Accession=PF00712.10; Description=DNA polymerase III beta subunit, N-terminal domain
  Pfam annotation: Domain name=DNA_pol3_beta_2; Domain location=200 -285; Score=29.7; E_value=3.9e-08; Accession=PF02767.7; Description =DNA polymerase III beta subunit, central domain
  Pfam module annotation: Pfam domain module=DNA_pol3_beta::DNA_pol3 _beta_2; Domain location=74-192::200-285
  Subcellular localization annotation: CTP_CleavageSite=42; ConfidenceScore=5.13e-01
MGAVVVVRYPLTRGFLRDSTTDKSVVPYSRLISTDLSTVSTAVNTVKELSHSRRDPITRRTDDASPFDDKGAPVRFQVNRDVFSEAVSFVVKLLPQRNPQPILAGVLIEADGAGLTLSAFDYEASARTTIEATVETPGTILVHGRLLSDIASRLPNAPIEIAVEEDGSITVSCGSARFTLAAMPVEEYPSIPEVTGSSGVVPADDFGTAIAQVGFAASRDDVTPVLTGVQLEVSGHNLSLVATDRYRVSLRDVPWDGEAVEATALVPARTLLEVGKTFGHAGTIQ

SEQ ID NO: 193814 - protein, 89 aa, Glycine max
  Coding DNA Sequence Number=SeqID_77036
MDIYHTELDEFKGELERRNFHKHLTNLADSSIDLALVKEFYANLYSLEGPSPKQVRIRGHLIRIDADSLNAFLETPVVLAEGESLPAYS

SEQ ID NO: 193815 - protein, 53 aa, Glycine max
  Coding DNA Sequence Number=SeqID_77037
MVSQGKCRGGKREQTLGEKVAGDGRASKGLVGQRILCVDQAWGRAWFAEAKWL

SEQ ID NO: 193816 - protein, 50 aa, Glycine max
  Coding DNA Sequence Number=SeqID_77038
  Gene Ontology: Mol. function=hydrolase activity, acting on ester bonds; Biological process=lipid metabolic process
  Homolog annotation: Hit_ID=Q1S3U8; Match level="QueryCoverage=98%, HitCoverage=21%, E-value=1e-08, Identity=53%"; Hit description=GDSL -like Lipase/Acylhydrolase
MAEKEMRDGSYPEPLEAKQTPVIKSLDWRLGFKYAGRSSLISNSSTVLLQ

SEQ ID NO: 193817 - protein, 109 aa, Glycine max
  Coding DNA Sequence Number=SeqID_77039
  Gene Ontology: Mol. function=nucleic acid binding; Biological process= DNA integration
MSFEGHSILRPPYFDGKNYTEWKERMIIFIRSIDFKLWLVIKNGPKIPTKLIGNEEVEKSEDEYDEEDMKNLELEAQARNILCRAMNQDAFEKFSKDKTAKQTWDELER

SEQ ID NO: 193818 - protein, 96 aa, Glycine max
  Coding DNA Sequence Number=SeqID_77040
  Subcellular localization annotation: CTP_CleavageSite=32; ConfidenceScore=5.30e-01
MSPPPLETSQSLKISSNAPQDSFLFKLTPVMLAQPGGSSSALSELILAECIIENSSASRIFYVLSHELLRSADGSLSKRIDLASGSKSALPPNFPN

SEQ ID NO: 193819 - protein, 684 aa, Glycine max
  Coding DNA Sequence Number=SeqID_77041
  Gene Ontology: Mol. function=RNA-directed DNA polymerase activity; Cellular component=chromatin; Biological process=chromatin assembly or disassembly
  Pfam module annotation: Pfam domain module=RVT_1::Retrotrans_gag; Domain location=521-682::135-225
MTLDLLFVMDRPVACNIPDQGVEPQYGLLHVDGWATGQEGEAPLPRSLLALGLHVSNVEIEATTLIVGSLGSEKEVRSTKHGHEKEHKGHSSSTLVKDIYLGFPHFDGHTPVLEWIFKAEKFFNYHHTPDSDRVEIAAIHFEKDVIPWFQMPQCMESVNSWSDLTLALESQFRPSPFDCPMSELFKLQQTGIVSDYYLKFMALANRSEGFSNEVVLNCFLSGLNADIHRDVIAQTPMTLIQVVSLAKLYEEKYSPISAHTFNFNSAPSNAVKNTTKASLPPLLPTPNTPPLRNNFVKKISPAEMQLRREKGLCYFCDDKFTFNHKCPNRQMLMLQLEDDEGEAQKSFDVRSEDNNSTAETVIDNPQHLSLNALKGGLGVGTIRFVAHINTLPTRVLVDGGSSDNFLQPRVAKFLKLPIEPAPLFKVMVGNGNYMTVVGMIRELSIQAQEPELALLLHTYEFVFENPTSLPPPRSHDHAIPLLEGSKPVKVKPYLYLLSQKDEIEKLVQGMLEEGIIQPSMSPFSSPIILVKKKDGSWRVCTDYRALNAITVKDTFPIPTIDELIDELFGAKFFSKLDLRSGYHQILLKHEDRYKTAFRTHHGHYEWLVMPFGLTNAPATFQSLMNDIFRGVLRKFVLLHWSLQALDLLHQWSPLRRRRVKRRRHFKEKMSQEETHHHRKPWIRA

SEQ ID NO: 193820 - protein, 396 aa, Glycine max
  Coding DNA Sequence Number=SeqID_77042
  Gene Ontology: Mol. function=transferase activity
  Homolog annotation: Hit_ID=UPI000016344C; Match level="QueryCoverage =78%, HitCoverage=51%, E-value=2e-45, Identity=33%"; Hit description =protein binding
MINPGKFLLSCSEQQTPIMINPDKFLLSLIAEDKLKLVKFVGHESTSVRGMKKHVIFQLVKFLWETILREKTLKEAIKIISEPSQLLFDAAEVGNFGFLSELISAHPSLIWEVDDKKQSIIHTAVSHRHASIFNVVHEIGSIKDIIVEGFVKGNNTLLHLAAKLAPSDRLELVSGAAFQMSHELIWFEEVKKIMPPSFIMLKNSEDKTAQELFTREHEGLRRKAEDWMKRTAEFCILISTVIATAVFSAAINIPGGIDDQTKKPNYLDKTSFLVFAISDGIAFISSATSILIFLSILISRYAEYDFHKSLPFKLICGLVTLFISITCMMVAFGSAFFITYDSGLKVVPDSISILASVPILLYITLQFSLWKDIIYSTIHCRNLFKPSKRMIHISSR

SEQ ID NO: 193821 - protein, 130 aa, Glycine max
  Coding DNA Sequence Number=SeqID_77043
  Homolog annotation: Hit_ID=Q9FFL9; Match level="QueryCoverage=70%, HitCoverage=32%, E-value=1e-12, Identity=42%"; Hit description =Arabidopsis thaliana genomic DNA, chromosome 5, P1 clone:MIK22
MTVVDSPTQQQQPQMGNAASARHNRPNLEFIEATDEEAKDKFLSLCVPLYKFALEGNWPAAKVILQKDVRLKNAAIAVGWATLLHVAVGANHAPFVKELLQELDNQDIKLKDIKGNTAFCFASASGNMEI

SEQ ID NO: 193822 - protein, 79 aa, Glycine max
  Coding DNA Sequence Number=SeqID_77044
MGNARFLEEVKFGKEDNIRKVVFEEEPIIDSAQVLIPIAVQETTSVIENNVQTIVDDIVQEQDNDEVLPQIPIQQPQQP

SEQ ID NO: 193823 - protein, 36 aa, Glycine max
  Coding DNA Sequence Number=SeqID_77045
MHLMSHISNEIHGFFRGLQLDFSPCRGVQQLLELQS

SEQ ID NO: 193824 - protein, 40 aa, Glycine max
  Coding DNA Sequence Number=SeqID_77046
VADHASFMPMIDLLPIAYRDAGSGIALKTLKHVQKAWGQG

SEQ ID NO: 193825 - protein, 139 aa, Glycine max
  Coding DNA Sequence Number=SeqID_77047
MGSRGSYWMSNSESSMEQATIFLTSSGFLKNLLDGVVRLDYHLMTREVRLESLGQGNEWAELTTSSITERYKSKGALGLDRLKDGSVVMVFLKARKACSQLLNFLYVGWAMHLQYDSAFVGVSFNPLFPEDFFLVRHML

SEQ ID NO: 193826 - protein, 120 aa, Glycine max
  Coding DNA Sequence Number=SeqID_77048
  Homolog annotation: Hit_ID=O21999; Match level="QueryCoverage=42%, HitCoverage=33%, E-value=2e-22, Identity=100%"; Hit description=LacZ- alpha
  Subcellular localization annotation: CTP_CleavageSite=4; ConfidenceScore=5.01e-01
MEISSALRRPPTCPTSSTAIDAPSDLFLASPFVKKSPLKSPPPIIRITSSSRYHQNGAHRVGEVRDEGMQAWHWPSFYNVVTGKTLALPNLIALQHIPLSPAGVIAKRPAPIALPNSCAA

SEQ ID NO: 193827 - protein, 184 aa, Glycine max
  Coding DNA Sequence Number=SeqID_77049
MCSGGGSMLFLRINIIGESSNDESFNNHISSNVGSDNESNVPNGDFTTTGGVATSGSIICPNIEEEEVESPLPIPLQNVIDLDLEAIVVHVLVLHPIIHPSTLPPSKPKTTTKEYPPLTLIGYSWVYGKVVSYANSLCSYESIIEFLEGVKFCHVDCSDAMIIKSCLANVCILFELDNPFIFEF

SEQ ID NO: 193828 - protein, 228 aa, Glycine max
  Coding DNA Sequence Number=SeqID_77050
MRGAPLEDELAPIISRGFNKTNVETLQKVCKAWEVLQKKDKELRGSNNGPIGGYRKWLKAHVQGLDWLLSLRTAKREEVEAPEEDEEVQALRMELKQAQTVKERFKSATLKIRKENAELRDINIATTKALEQMTKRARREEHGRNKFRGALWGSNRDQSGVDSLILKDELNVCSRSKRNLSQRLCETETNMLAIISKYQEELNLATAHEHRVADEMPKCTRRRRLEEG

SEQ ID NO: 193829 - protein, 133 aa, Glycine max
  Coding DNA Sequence Number=SeqID_77051
MASHKRKATTLVSQDDYDRSRFISQEAWDRYSDNVLAKNIMPERNGSIDVAIVKEFYTNLYVLEDKSPKQVRVQGHLIKFDANSLNTFLETPMVVEKGESLPSYSRFARLRPDPQELATQLCIPRRGFVLDAE

SEQ ID NO: 193830 - protein, 181 aa, Glycine max
  Coding DNA Sequence Number=SeqID_77052
  Gene Ontology: Mol. function=transition metal ion binding; Cellular component=chromatin; Biological process=RNA-dependent DNA replication
MSKNWVLKKHSKTFLDWFKDTVFSDENAFETLRKLADEPKRNVITWQGYDINKYSFYTKAQDEKSTMQSSGVTLRAESQHFVNVHDDNPYLKKLAYPNNTFIMAEQAKQVFYVQDPCDERWSVVLHRKTIGVNVEDDDSYIDTYVSLFSTQVSPNVVREEEADDVHANRNGHDEGELINII

SEQ ID NO: 193831 - protein, 370 aa, Glycine max
  Coding DNA Sequence Number=SeqID_77053
  Gene Ontology: Mol. function=RNA-directed DNA polymerase activity; Biological process=RNA-dependent DNA replication
MEAAATPSEEPQSSKASSSFPVAGNSLVELFEEPIMAEKPRRVTLEDYSSSTVPRFFTSIAPPEDEVVEKFLKKYFPDSKTVEGKASISSFHQFTNKSLSEALEIFRGLLRKMPTHAGGKIKMKTPEEAMNLIENMVASDDAILRDRAHISTKNSLLELTSQDALLAQNKLLSKQLEALTEKLRCSICGGAHGSGSCIPNEEQMTQEVNYMRNQPRGNFNPGGESTRPQQQMPNLYDRTMKLEETLTQFMQVSMSNQKSTESAIKNLEVQVGQLVKQLVEKSSSSFTANTEKNPKEECKAVMTRSKMEIQAEEGRADQKVEGFKQQLVAQPALDPVDTFVELEEIDEKKKGKSEAAKEKKKEATPMEGKE

SEQ ID NO: 193832 - protein, 119 aa, Glycine max
  Coding DNA Sequence Number=SeqID_77054
  Gene Ontology: Mol. function=protein dimerization activity; Cellular component=cytoplasm; Biological process=proteolysis
  Homolog annotation: Hit_ID=Q9KPT3; Match level="QueryCoverage=99%, HitCoverage=22%, E-value=2e-63, Identity=94%"; Hit description =Aminoacyl-histidine dipeptidase
MDSGRHQVEGMLKSIAELAGAELELSGAYPGWKPDADSEIMHIFRDMYEGIYGHKPNIMVIHAGLECGLFKKPYPNMDMVSFGPTIKFPHSPDEKVKIDTVDLYWQQMVALLANIPAKA

SEQ ID NO: 193833 - protein, 198 aa, Glycine max
  Coding DNA Sequence Number=SeqID_77055
  Pfam annotation: Domain name=Transposase_23; Domain location=5-66; Score=-10.3; E_value=0.015; Accession=PF03017.5; Description =TNP1ENSPM transposase
MGLYLQRQRTTVLVAIGKICEGGSSIHNVTYADDVVRVSVDEFIEGDAEVPFPTSEIQYVKQALQTFIAWPKNLVKKVSHEESHTSPKKLPKTDERGMNDIEHDPLRQLIKSLYYMYDTPIELKWDGSKFGLPNVDALFFLTFSDVNEIVAGYKCLNISILQLWMLFLDEWSSTLGHASVYGFLEPQSIHHAKDRRTE

SEQ ID NO: 193834 - protein, 35 aa, Glycine max
  Coding DNA Sequence Number=SeqID_77056
AFSEELTKRNHRAKRVRPMRMNTHPLARLPVAKRG

SEQ ID NO: 193835 - protein, 337 aa, Glycine max
  Coding DNA Sequence Number=SeqID_77057
  Gene Ontology: Mol. function=nucleic acid binding; Cellular component= chromatin; Biological process=DNA integration
  Homolog annotation: Hit_ID=Q1T010; Match level="QueryCoverage=99%, HitCoverage=24%, E-value=1e-124, Identity=62%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MEDELRSIERNHTWDLVQLPKNKKPISVKWVFKLKLDPEGRIVKHKARLVARGFLQKQGVDYTEIFAPVARHETVRVIVSLASNKGWSLTHLDVKSAFLNGALEETVFVTQPPGFELEGKEEMVYKLNKALYGLKQAPRAWNRRIDAYLAQLGFKRCVVEHGVYVMLKEDNKVLMVCLYVDDLLVTGNHTTEIDNFTSLMMSEFEMTNLGKLSYFLGLEFLWTEYGIVMHQRKYAGEILKRFGMEDCNVAITPAETNQKLEDKPEEEGVDPTGYKQLVGSLRYLCNSRPDICYAVGVLSKFMNRPKKSYFLAAKRVLRYVKGTMQYGVMFPSSVDGC

SEQ ID NO: 193836 - protein, 123 aa, Glycine max
  Coding DNA Sequence Number=SeqID_77058
  Gene Ontology: Mol. function=DNA binding; Cellular component=nucleus; Biological process=regulation of transcription, DNA-dependent
  Homolog annotation: Hit_ID=P93417; Match level="QueryCoverage=65%, HitCoverage=14%, E-value=4e-36, Identity=82%"; Hit description =Transcription factor GAMYB
  Pfam annotation: Domain name=Myb_DNA-bind_2; Domain location=42-95; Score=-6.8; E_value=0.056; Accession=PF08914.1; Description=Rap1 Myb domain
  Pfam annotation: Domain name=Myb_DNA-binding; Domain location=40-87; Score=54.5; E_value=3.6e-13; Accession=PF00249.21; Description=Myb -like DNA-binding domain
  Pfam annotation: Domain name=Myb_DNA-binding; Domain location=93-123; Score=4.2; E_value=2.1; Accession=PF00249.21; Description=Myb-like DNA-binding domain
  Pfam module annotation: Pfam domain module=Myb_DNA-bind_2::Myb_DNA -binding::Myb_DNA-binding; Domain location=42-95::40-87::93-123
MSSMTSGGDTRKISKGRWSSSLDEKVGVGGNVGGEGPLKKGPWTAAEDAILVEYVKKHGQGNWNAVQKHSGLARCGKSCRLRWANHLRPDLKKGAFTAEEENRILELHAKMGNKWARMAAEVC

SEQ ID NO: 193837 - protein, 84 aa, Glycine max
  Coding DNA Sequence Number=SeqID_77059
MSSTLTKVTLLYLMKVERQHVVVGGEAEAAELGDHMRHTERALVVGDHEILRGGKDGEVVVIDEGDEVDKGGDEQVDGVFVGEI

SEQ ID NO: 193838 - protein, 158 aa, Glycine max
  Coding DNA Sequence Number=SeqID_77060
  Homolog annotation: Hit_ID=Q9AVH2; Match level="QueryCoverage=29%, HitCoverage=16%, E-value=3e-20, Identity=97%"; Hit description =Putative senescence-associated protein
MARHKVTRTHTHTHSRRHKGEEGLGRPSARAHTREGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 193839 - protein, 65 aa, Glycine max
  Coding DNA Sequence Number=SeqID_77061
  Subcellular localization annotation: CTP_CleavageSite=17; ConfidenceScore=5.19e-01
MKKKLTGCCTRCKASKRSDVGNDNSRNFTAPRLHFSSSFPLPGQLTQASWFLRLKDLAHPGELVA

SEQ ID NO: 193840 - protein, 92 aa, Glycine max
  Coding DNA Sequence Number=SeqID_77062
MKLLMLFANLPRAYKVFNKRTLNVEEFVHVVCDETNSIVQENSLEEDAGFEEKDSTLEDDIKAEELEQNKEISTTMCKEFPREWRTQKFWIT

SEQ ID NO: 193841 - protein, 81 aa, Glycine max
  Coding DNA Sequence Number=SeqID_77063
  Homolog annotation: Hit_ID=O48543; Match level="QueryCoverage=42%, HitCoverage=8%, E-value=5e-08, Identity=74%"; Hit description=Adenyl cyclase
MITWFIGYFKGFSSRLPILEHLQLPRGLSGQKTHLQLLLLVDKAYAKNHNDTKLLVEVMRLLKKNDLPVQPGTADIVFSED

SEQ ID NO: 193842 - protein, 130 aa, Glycine max
  Coding DNA Sequence Number=SeqID_77064
LIRQIGKSVVFTFSISQFVGLASIPKRDTQWLSARKKLEEDELSGSLSAPLQVIKRTPLAHPLSETSALSQNTVMHPKQFRFELSVSLAFFLEKPLLARESSLGLKLLHVKEVLERERSKFQKVLRDFAV

SEQ ID NO: 193843 - protein, 97 aa, Glycine max
  Coding DNA Sequence Number=SeqID_77065
MEEGASPPKIALDKKLEEDALMEEKKEKRDLIASLRSFHEKTSLRSFFAKISLKSHSLAKHTHLKTKLTSLRSFLEKLELSYTHPSNNYAHLLEKRS

SEQ ID NO: 193844 - protein, 179 aa, Glycine max
  Coding DNA Sequence Number=SeqID_77066
MVITRVSDANNIPAGNRLKVLLISSGINAQVAIGKKSITNNNTILEFGNSSNRGIVLPKVENATTMNASEGTMVWDTTTGSFRYYGGTTPAWNPPAAGGTTGGAPSGSDANGKKMIIGSDISDADGILILEAKQGDKALVLPSISQPSERFSSPPTGLMVYDTATNQVAVFNGTKWTYF

SEQ ID NO: 193845 - protein, 404 aa, Glycine max
  Coding DNA Sequence Number=SeqID_77067
  Gene Ontology: Mol. function=transcription factor activity; Cellular component=chloroplast; Biological process=regulation of transcription, DNA-dependent
  Homolog annotation: Hit_ID=Q7W9G4; Match level="QueryCoverage=82%, HitCoverage=98%, E-value=1e-137, Identity=74%"; Hit description=LysR- family transcriptional regulator
GFWRISCIRGGSAGAEPAVRPAFLVDRTARSRAPVDDNVRVLHAFHVHRRDVHPQTVGGVLLELGTGQLQRVLAQAAHHPVGGRQTGRGTRSLRRRAAVRAPRQEAGADGPGPQAVRAGARDAGPEQPHRAEHGRPGQFRGRGAAGRDRAGRHDLAGAAGQPDQPALSQGAVDARDRRRHHAVRAAGAGPVGPGHHAGPVLELPVRLRPPGRGDQRLDGQPVAGHRFLGKAGAAGPGAVPGDFTADQFGAVASVRCLVRRAGSVGQAGADLQQPGHDGAVDHAGAGYQLLAGGVFRAAGRARGAVPAGCAAGSADDQLLRGAQEEHRQSGGVAGDRYCAGGMRVRGGGGVPAACAAGGTVRLNFNRRHGRLPLCIPKEQAIFLAPAVTQCWPCARSGLDNISAG

SEQ ID NO: 193846 - protein, 254 aa, Glycine max
  Coding DNA Sequence Number=SeqID_77068
MTEDIFVFEICADYRIGRLRMLLDFSQITVGYIRLPPDSWARIKGALLSHGNKSVCADNHRTLTSLGTVQMTTLVSASQRARMPLVDKGAHNPKSRSEDADIPGEGVDDDPEDAYISGKGANYDSPSEDAGIHGEGIANETFSQSRLEDADISGKVLRIANETLWQSRLEEADISRKGAVIRIANETVLQSLPEDADILEKVLRIGNETYSQSRPEDADISGKGAEEADISGKGVGDDSRPEDAYISREGADEN

SEQ ID NO: 193847 - protein, 97 aa, Glycine max
  Coding DNA Sequence Number=SeqID_77069
MPISPGKTWSLTDRNRYISQSRPEDADISSKGVGDDVSHYMLSGIESDGSQMRLFHSLGWNTLTSSGKSPPEDAYISGEGADDDVSHCMLLGFESYG

SEQ ID NO: 193848 - protein, 207 aa, Glycine max
  Coding DNA Sequence Number=SeqID_77070
MAFSLQVLGAPAKMLGAPSSTQNTFSCLDHRPHGKSKLVLLKIDSKVNRTNNKDGDKFLHRVATNTPYGGQYMCNSIKGIKGYRYKEHKESHITTQEKGVMEASKEERCYGSIKRRKDTSSKIGMTMSNTNLDGHIGICNDEFWLKNNKKEVEDVSAVGETLGVSLGGVNKDKIINKIQELESRDRKLKEENCMKKDSMEGLDGKSQ

SEQ ID NO: 193849 - protein, 47 aa, Glycine max
  Coding DNA Sequence Number=SeqID_77071
MASVETSAMARSQILPNVYGTDAFYEYGSPGDCPLLRYNIRAAWCPM

SEQ ID NO: 193850 - protein, 213 aa, Glycine max
  Coding DNA Sequence Number=SeqID_77072
  Gene Ontology: Mol. function=helicase activity; Biological process =viral genome replication
  Homolog annotation: Hit_ID=Q1SN45; Match level="QueryCoverage=99%, HitCoverage=12%, E-value=2e-49, Identity=47%"; Hit description=AAA ATPase
MDRPEYVWKQTWQWMADDIVFNHRRQGIQLTNKEKMHLCLTEIQNLLQANRKSLRDFPSMPYPLGYAANPHQNNLIYNELAYNRDILVAEFDKCYQSLTDEQASIFNKIMHVVATQSGGVYFLYGYGGTGKTFVWKTLSSAIRSTGGIVLTVASSGIASILFPGGRTTHSKFVIPVPATKNSTCNIHQGSDLAELFHITKLIIWDEAPMCHRY

SEQ ID NO: 193851 - protein, 96 aa, Glycine max
  Coding DNA Sequence Number=SeqID_77073
MREELGTQLAFLQKQPPSGGTSWKAQVGLNVTEPHGLRNNASFWFPACCGISRIVQQCFLLTSGTLWNFTYCATMGAKYLEAVKQRLHAIKQWSPG

SEQ ID NO: 193852 - protein, 59 aa, Glycine max
  Coding DNA Sequence Number=SeqID_77074
MFSPPGFLGSVEISEKNRFREENPSQGISVTRPRRFRKQIREDFPPSFVRSSLFFGLQS

SEQ ID NO: 193853 - protein, 123 aa, Glycine max
  Coding DNA Sequence Number=SeqID_77075
MHGANGGGAFRQAVPRGVGVAILAGDLAFSYVALESPFLLAIWPCMGRSGRVRDAVAGSGMQQARGAIGDCDLLSKKFSLINGSPLHCSVTPHISTFILLLQVASLLWFFILLSFIPVASNFL

SEQ ID NO: 193854 - protein, 242 aa, Glycine max
  Coding DNA Sequence Number=SeqID_77076
  Homolog annotation: Hit_ID=Q6JJ76; Match level="QueryCoverage=25%, HitCoverage=8%, E-value=1e-24, Identity=96%"; Hit description=RelA
MATPAAMEWGEAESLSRRNFILFHHPGRAKSVVGNKELLPGYPTLIIADAAYPISHTGQRHGGDALRRVSPGLAVHRKTQAITAALSVSIRMATGCHALSALPAEQAAVDFALTELEVDIRYRAAEIFEFAFLGGLATNGAGDLTKRSKHDFRSFRDRKRPLPCAERITAAFRYLKGIKNASIKGTRDRGDAIQILELRQKLVQLPEIPDFHVQRQLGEVGTDADHVQPANIDVERCDRLRD

SEQ ID NO: 193855 - protein, 69 aa, Glycine max
  Coding DNA Sequence Number=SeqID_77077
MDTIVLSCSNFLLLLALFLLNIYAYKTLTETAIIQFKRKTNTNMNRRKKFPGNSAKNLFGRGKCIGSRK

SEQ ID NO: 193856 - protein, 265 aa, Glycine max
  Coding DNA Sequence Number=SeqID_77078
  Homolog annotation: Hit_ID=Q2NT57; Match level="QueryCoverage=33%, HitCoverage=45%, E-value=4e-11, Identity=42%"; Hit description =Hypothetical phage protein
  Subcellular localization annotation: CTP_CleavageSite=50; ConfidenceScore=5.19e-01
MGSIVVVPAMSVRHPIKPGAAAQVGERRRVVRRFRPRHPQPAGETEVAVLAQQVQAGHQRNAAYQRPAQIVGHVQDPAVAVLQCQPIVVAAQRNREHLRNRRHGYLEVVHAYLLVPVQRPAVGRRHGPGRLHAQVLLVRGLFFFLLARVRGQRGAARLYHHHFAQRHRREHGAEAVFVGLDRELLDQHVAVAPPAGDHGHRLARFLQAEQLRVDGGRVVVGRGLAIGHVLGLRAGQRLIRGVAPRALQGQRQRLLKAWSLIADLP

SEQ ID NO: 193857 - protein, 212 aa, Glycine max
  Coding DNA Sequence Number=SeqID_77079
  Gene Ontology: Mol. function=hydrolase activity
  Homolog annotation: Hit_ID=UPI00005EFF01; Match level="QueryCoverage =72%, HitCoverage=34%, E-value=3e-38, Identity=50%"; Hit description =COG5301: Phage-related tail fibre protein
MASGLILTAVGAEAIEAAYQAGEVVTIPIVAFGDGGGASVTPDPAVTKLVNKFGDVPFTQGESGSGMIAGQAVINAREHPGKVVREFGLMSSAGVLIAYGAYPDTYLPEQNDSIVKELVVNFAMPLVHAESVVLEIDPNISVLTIEEADARYLFRKGDTATGDLGAPMFQANGTNGIPAGAGMYKEQLDNHAPFYSPDYHWSVTPGSTYIPL

SEQ ID NO: 193858 - protein, 87 aa, Glycine max
  Coding DNA Sequence Number=SeqID_77080
MNGVDGATKKRKEEEKKHGENKRCHRQKSSSALAHDNAPTKRVVHVEGIEEGIWWGEHMIPNPVCGFLFHYSSVELHHYYQLVSKVE

SEQ ID NO: 193859 - protein, 75 aa, Glycine max
  Coding DNA Sequence Number=SeqID_77081
MNIGWVRTDYFILACAEDDGGNRPDRPTGAYDLAYIKPGQAQASKIHRRLGSGLSKPGPAWPIPTPIRLPPNFTS

SEQ ID NO: 193860 - protein, 75 aa, Glycine max
  Coding DNA Sequence Number=SeqID_77082
MGGVKLRTYLGIVARDKVDVTYEKVDEGPYCSEGPDLGGYSEFEILEASNSTTKRKLLQTMGERWRQFKSDLTRK

SEQ ID NO: 193861 - protein, 91 aa, Glycine max
  Coding DNA Sequence Number=SeqID_77083
MIRGDTLRLSAPFCHPEAAGPMTSRDQIWSFCTLVSSRGGGPDDTRKYPSGYPYKHSFAICAWHPSLGNLWKSGNDKSWSPATLVNREERN

SEQ ID NO: 193862 - protein, 155 aa, Glycine max
  Coding DNA Sequence Number=SeqID_77084
MAQESRRISSKWELIDDIHDNGWPSITHDLLYLKMGSTFWRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWRCQEDT

SEQ ID NO: 193863 - protein, 70 aa, Glycine max
  Coding DNA Sequence Number=SeqID_77085
MMIWKFYAKLVIHAPMWTLKHQVFCYLNVATCPSRGEAHGCAFQRRKDARSRHQRLFVENVGKTEGNRSK

SEQ ID NO: 193864 - protein, 109 aa, Glycine max
  Coding DNA Sequence Number=SeqID_77086
METISKRFEELDVCGKFTLKNKLREIAYPDQTSMCPPPAKSLIHDFIDNIVDVKVDGNCGYRLVVGLLGMGENSWSMVRNHMLKELDKFSNDSNNHLWTRKTHNFRVYN

SEQ ID NO: 193865 - protein, 88 aa, Glycine max
  Coding DNA Sequence Number=SeqID_77087
MKDKWNVHELHGMLVQEETRLKNQGSHSVHYVISHQGNQGAGKKFMKKHDKGKWSLKNNDDSLQIQRKEIRTFLEGLPKVQVLVQKEK

SEQ ID NO: 193866 - protein, 278 aa, Glycine max
  Coding DNA Sequence Number=SeqID_77088
  Gene Ontology: Mol. function=two-component response regulator activity; Cellular component=membrane; Biological process=two -component signal transduction system (phosphorelay)
  Homolog annotation: Hit_ID=Q5P208; Match level="QueryCoverage=83%, HitCoverage=94%, E-value=8e-67, Identity=57%"; Hit description=DNA -binding response regulator OmpR
MAQALHRGLFQVHRGGQYIAFVAYGLDQPVRATIVAQLVAQAADLQVDRAILCLVVAATAERDQLLARQHLVGMGDEHPQQAELGAGQHHHAIVRVHQVAMLQIEHPPREARTAHRQRLQVGWQRLGPAQHVADARQQLARFERLGKIVVGAHFQAQHAIDRLGACGQHDHRRVRACAQVAAQGQAILTRQVEVEHDQVHVLAVQQLAHGGAVGSRAHLVAGTAELLGQQGADVVVVVDDQQSVHRVFSLHVAIIPCRQLNRIRGNAYQCIHPWAGYL

SEQ ID NO: 193867 - protein, 707 aa, Glycine max
  Coding DNA Sequence Number=SeqID_77089
  Homolog annotation: Hit_ID=Q9ABL0; Match level="QueryCoverage=45%, HitCoverage=46%, E-value=8e-58, Identity=38%"; Hit description =Thio:disulfide interchange protein, putative
  Pfam annotation: Domain name=DsbD; Domain location=1-158; Score= -60.4; E_value=0.011; Accession=PF02683.6; Description=Cytochrome C biogenesis protein transmembrane region
  Pfam annotation: Domain name=Sigma70_ECF; Domain location=342-517; Score=-80.9; E_value=0.024; Accession=PF07638.2; Description=ECF sigma factor
  Pfam annotation: Domain name=Sigma70_r2; Domain location=363-431; Score=54.3; E_value=4.2e-13; Accession=PF04542.4; Description=Sigma -70 region 2
  Pfam annotation: Domain name=Sigma70_r4_2; Domain location=456-500; Score=8.2; E_value=0.094; Accession=PF08281.2; Description=Sigma-70, region 4
  Pfam module annotation: Pfam domain module=DsbD::Sigma70_ECF::Sigma70_ r2::Sigma70_r4_2; Domain location=1-158::342-517::363-431::456-500
MALAGILLAARAGGAAVGWGFQLQSPLVIALLSLVILAAALNLLGVFEVGLTVQRVGAIDIQRGAFLRSALTGALAIIVATPCAAPFMASAIGYALVQPPAVALVIFFALALGFAAPFTLLSLFPPLARFLPRPGVWMDILKRGLAFPMLGAWAWLVWILAQQAGSSALAVVLAASVVLAFAGWLYGMAQQRRFAGKGHKALFSVTAILLIAVIAPLPGLIKPGAAQQGGMQAQVSKQTWTPQAVAAQRGHGKAIFVDFTASWCITCQVNEKTSLSTQAVKTALAKTGTLYMVADSTKFNPDVDDVMSEFGQGGLPMYLVYPADGGPPKVLPQRMHTGDSARENWPGLMERAQAGDQCAYTRLLRALVPVIRAQVRRRLSDEALTEDVIQDVLLTLHRVRHTYDPAYPFLPWLTAIVSARAVDALRRRGRQQHCALDDAQAADPASTAEQQQLDTRQELAGYLSQLPLRQREIVEHVHLHEMSLNEAAAHHNLSVGARSVPGETPAGDRKTRAGLAGAGATGGHRGQFAGAAHSDRLRKAVVAAGPAVAGIERQQSAANGHAAAAARHTAVLCFPAGGESADAAADHPQSAPDAGALSGPQPGHGGPGRRLHGGKPAGVLSSGAPACAGFAAAPGGHREHHRADRIAWPALGNDALRTQSVEQLGEGIQRRAIAGKAGFTALAHIGKRLHRPAQIRIGVPPRRQFID

SEQ ID NO: 193868 - protein, 300 aa, Glycine max
  Coding DNA Sequence Number=SeqID_77090
  Gene Ontology: Mol. function=chitin binding; Cellular component =extracellular region; Biological process=chitin metabolic process
  Homolog annotation: Hit_ID=UPI000044A8F0; Match level="QueryCoverage =88%, HitCoverage=99%, E-value=9e-37, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSPSEDYTSSPLEDCRSSPSEDYKSSTSEEYTPSPSEDYTSSPLEDYKSSASEGCTSSSSEGYRPSPSEGYMLSPSEDYTSSPSEGYTPLPSEDYKSSPSEGYMPSPLEDYTSSPSKGSTPSPSVDYSLHALAFKGLLVLTFRGLHALAFRGLHVLAFRGLHALAFRGLLVLAFRGLHALSFRGLHLLTFRGLHILAIRGLHVLAIRGLYVLIFRGLHALAFSGLHVLTLRGLHARTFRGQHVLTLRWLHAFAFRGLHVLTFRGLQVPRLQRTISPQLQRSTRPHPSEDYTSSPFRGLQ

SEQ ID NO: 193869 - protein, 101 aa, Glycine max
  Coding DNA Sequence Number=SeqID_77091
  Homolog annotation: Hit_ID=Q9FGQ4; Match level="QueryCoverage=49%, HitCoverage=29%, E-value=4e-13, Identity=72%"; Hit description =Arabidopsis thaliana genomic DNA, chromosome 3, TAC clone:K5K13
MQSLLLNPVFPRLNQKILWTDNSNCQKLHNYFEGNAGALRNFEVLDFLRAKGASKDPTRVIAKVAQFEYKVYDYLVDTVASTTKKLVFYDAHSKAVIRKPS

SEQ ID NO: 193870 - protein, 110 aa, Glycine max
  Coding DNA Sequence Number=SeqID_77092
MEGLVDLAAIDAFLAFHHGKESPVVAILAMYDTFDRGCEKSSARIVCCALALYVWLVSHLFSPRRSQELPRLLAKAKAVADTYSAPEEIHGLLSYCQHMIDLMDHMIGNR

SEQ ID NO: 193871 - protein, 71 aa, Glycine max
  Coding DNA Sequence Number=SeqID_77093
  Pfam annotation: Domain name=DUF1471; Domain location=1-71; Score =15.3; E_value=4.5e-05; Accession=PF07338.3; Description=Protein of unknown function (DUF1471)
  Subcellular localization annotation: CTP_CleavageSite=19; ConfidenceScore=5.10e-01
MKTIKAMSIAAVAALSLMSAASFAQSVTVTSSTLDGAEAKIAAQAQEQGAQYKITEANTNNRVHMTAELYN

SEQ ID NO: 193872 - protein, 154 aa, Glycine max
  Coding DNA Sequence Number=SeqID_77094
  Subcellular localization annotation: CTP_CleavageSite=40; ConfidenceScore=5.22e-01
MVIITSIEGAAPSHQTLRNMTMKTIKTLTIAAAAALSLMSAASFAQTVSATSTTLDGAEAKIAAQAQQQGMCQNGSPNGRPFLSCSQARSVSSILAILLNLQRRLSGRRTQYAEQRGYQPAGAGFCRCITHATPCSRSGDSFCPLAAIYRNGAR

SEQ ID NO: 193873 - protein, 116 aa, Glycine max; identical to SEQ ID NO: 154549
  Coding DNA Sequence Number=SeqID_77095

SEQ ID NO: 193874 - protein, 187 aa, Glycine max
  Coding DNA Sequence Number=SeqID_77096
  Gene Ontology: Cellular component=vacuolar membrane
  Homolog annotation: Hit_ID=Q2V9B6; Match level="QueryCoverage=87%, HitCoverage=47%, E-value=5e-64, Identity=67%"; Hit description=Per1 -like family protein
  Pfam annotation: Domain name=Per1; Domain location=3-162; Score=60.1; E_value=5.8e-15; Accession=PF04080.3; Description=Per1-like
MYSNLYYCRAVELTEKLDFSSAVALLGFTLILAILRAFNVRDEATRVMISAPLLAFVTTHIMYLNFYELAYGLNRIVCTGMVVVQLLIWAIWAGASNHPARWKLWAVVVGGGLAMVLETYDFPPYMGYVDAHALWHATSIPLTFFWWGFIRDDAEFRTTALLKKAYFLSEINCNYTPVQNNRSCVDS

SEQ ID NO: 193875 - protein, 409 aa, Glycine max
  Coding DNA Sequence Number=SeqID_77097
  Gene Ontology: Mol. function=two-component response regulator activity; Cellular component=nucleus; Biological process=two -component signal transduction system (phosphorelay)
  Homolog annotation: Hit_ID=Q9ZWJ9; Match level="QueryCoverage=57%, HitCoverage=37%, E-value=2e-41, Identity=39%"; Hit description=Two -component response regulator ARR2
  Pfam annotation: Domain name=Myb_DNA-binding; Domain location=187 -237; Score=33.4; E_value=7.7e-07; Accession=PF00249.21; Description =Myb-like DNA-binding domain
  Pfam annotation: Domain name=Response_reg; Domain location=9-122; Score=82.4; E_value=1.4e-21; Accession=PF00072.14; Description =Response regulator receiver domain
  Pfam module annotation: Pfam domain module=Myb_DNA-binding::Response _reg; Domain location=187-237::9-122
MTHERVDIISVLVVDDDKTSLAIVSNILTSLGYKVLTANSALNALEILREFRGFIDLLITELHISGMNGFEFQKYVENQFHLPVIIMSSDGRNSVISKSLANGAAHYILKPFSADDFKDIWQYARKLTFQNIEGGSIPGDNTSIQDVHSAISSNVSKRKRKCFPRKSTQMNKEGQSGESSTLVKKPKVVWTPYLHNRFLLAIKQIGLEKAVPKTILQVMNVPNLTRENVASHLQKYRIFLRKVADKGLLEGLSNRDLRSRFAYGLSASMIKDIQAKTAKSRVTAQQYMKRIAHQSVYGGIANAVKSYNHVSSVTNTPLGRSHQFPHPYHKGLNMMLHNQHGSSSDQARLRAQSSFGSNVGTNNIQQNTLGSYANQPYYAQSSYNNVGVVFPSDGVTRHGLMTSTNGLRG

SEQ ID NO: 193876 - protein, 114 aa, Glycine max
  Coding DNA Sequence Number=SeqID_77098
MDLLNETEENHNANDFLKSDFSSSNHAVQSLEQSYKALTNYQATTDVIINPTKGTSNLPNETSTSSDKNSNRLMGGDDGYANMEHLNRIGISNLLKPCSVTRKIRENEKDAPES

SEQ ID NO: 193877 - protein, 133 aa, Glycine max
  Coding DNA Sequence Number=SeqID_77099
MAPKKLSTKRSRRDTAVEGSSATLEFDSHRFRSAEHQQRFEAIKGWPFHRERHVQLREDEYTDFQEEIARRRWTSLVTPMAKFDPEIAINVSSARGGTGPTGSTRRPLPNSNPRRNWASRKLSGLVHTFSMNL

SEQ ID NO: 193878 - protein, 98 aa, Glycine max
  Coding DNA Sequence Number=SeqID_77100
MHKNNCSGEATKRSSAGDLVPIDLEINATCRRRNQERIIKILQDLEATAILEEEPQSSEASSSFPIVEHSHLDPSEDYIMAEEPRRVTLEDYSSSNVP

SEQ ID NO: 193879 - protein, 412 aa, Glycine max
  Coding DNA Sequence Number=SeqID_77101
  Gene Ontology: Mol. function=transporter activity; Cellular component= integral to membrane; Biological process=transport
  Homolog annotation: Hit_ID=UPI0000E68CF5; Match level="QueryCoverage =100%, HitCoverage=79%, E-value=1e-116, Identity=48%"; Hit description=multidrug resistance protein B
  Pfam annotation: Domain name=MFS_1; Domain location=1-398; Score =126.7; E_value=6.6e-35; Accession=PF07690.6; Description=Major Facilitator Superfamily
MAILDIQIANSSMKVIQGALSATLNDSSWLMTSYFTAEIVAIPLCGWLCQALGTGRYALWCIAGFLGASLLCSAAWNLSSMIVFRALQGFSGGALIPISFRLIIEILPLKKRPLGMSLFSIIGTFAPAVGPALGGWLTDNFSWHAIFYINAIPALLSWGLIHYALKHPVIDWNIIRRGDFVGIISVMLCLGALEVILEKGGEENWLESNMICVLAVISAVSFLIFMYAQLTHAQPLINIRLFRDYNFSCAILVFAMLGVAIYGTLFLVPYYLTMVHDYNASDIGTVVIWMGFPQLIILPFIPLLIQRYNQKYLICIGFVGLAISAFMDCAMDGDFAGPQMAWSMLIRALGQPFIMVPLSLLATRNIQQKDSASSAVLINIFRSLGGSCGTAILSTFFITRIYTHVDVVKTSL

SEQ ID NO: 193880 - protein, 133 aa, Glycine max
  Coding DNA Sequence Number=SeqID_77102
MGYVGVRELSWRWATGDGGFMRALWMWKTCCAPSPDRHLVPHVMEWYLEICRGGQETLGTSGGVLLPKTKLDQSRPNPGIVGQLENEVRKLGELLVIDYQGDVIDYQALERNWNTVEASGNRLPACVIDYTEE

SEQ ID NO: 193881 - protein, 70 aa, Glycine max
  Coding DNA Sequence Number=SeqID_77103
MAEVNKVQERMKADMEIMNEQIATMMEAMMSMKKIMKVNAAVVATVSTVFGVDPTPPYGLNQINHPTSDM

SEQ ID NO: 193882 - protein, 220 aa, Glycine max
  Coding DNA Sequence Number=SeqID_77104
  Homolog annotation: Hit_ID=Q1SDS1; Match level="QueryCoverage=76%, HitCoverage=33%, E-value=7e-11, Identity=30%"; Hit description=IMP dehydrogenase/GMP reductase
MGWFEYQGNVWKRRREPWQAETNGLHSLMSSIDAFLAFRDCKESSFVAILADLYDTFDRRCEKNTTLYVWLVSHLFRQEERHVCPLEGHRSCVEKKEANWDRLLASKEGASVNWFPQWKEGRTDILVSCGGFPNVSLMGTRGCINYNLVLAIRQLGYPMRGAPSEEGLTPFIARGFNSPNAGVLQGVNKAWEMVPKKDKELRGSSNRAVGGYRRWLKAYA

SEQ ID NO: 193883 - protein, 58 aa, Glycine max
  Coding DNA Sequence Number=SeqID_77105
MAVATAKEKEKAPKQRRDRRGSITGEDKGLRELHTIAHGGIRIMLWLLQLNVVIVVGH

SEQ ID NO: 193884 - protein, 331 aa, Glycine max
  Coding DNA Sequence Number=SeqID_77106
  Gene Ontology: Mol. function=translation elongation factor activity; Cellular component=cytoplasm; Biological process=selenocysteine incorporation
  Homolog annotation: Hit_ID=P14081; Match level="QueryCoverage=99%, HitCoverage=64%, E-value=1e-42, Identity=40%"; Hit description =Selenocysteine-specific elongation factor
  Subcellular localization annotation: CTP_CleavageSite=86; ConfidenceScore=5.61e-01
MSRTHSGWSLNSGSTCCHSVASCGLKRGAKSGRCSQPCFCRSSPCASIWSINPGTSGAGACGSATRRRRSWPMPGSSGCCWWKVLSASRKRCCQALAIVSLIRLTPSRAGFSGSSSASSAGAVVRLAFTALFAVAQQYASAAQRVLRIAVANNYPIVFRQPQRLAEHQFSHIQAQCDDQPLRAGGTWLRQQPVAARNLCLLHVTDDIQRDALARLGARHRLVLRMQRPHAQRQVQAAEPQRVAHPDFTAQRGAGDHQPGAFQRESAVDGEPETAARLKRRCVQAAEVLAQRFNALLRMAAGNKLRCRWPAELLRELRDLLLHLCDACGVNA

SEQ ID NO: 193885 - protein, 605 aa, Glycine max
  Coding DNA Sequence Number=SeqID_77107
  Gene Ontology: Mol. function=pyridoxal phosphate binding; Biological process=metabolic process
  Homolog annotation: Hit_ID=Q9FGL6; Match level="QueryCoverage=97%, HitCoverage=90%, E-value=1e-150, Identity=49%"; Hit description =Arabidopsis thaliana genomic DNA, chromosome 5, P1 clone:MJM18
NSSAEWRHSFAVTTTSSIFPNTQFTNHESLPSLHESFNEFTKVYPQYSETEQVDHVRAKHYFHLSLSNQTCLDYIGIGLFSYSQLEHHETSKSQVPSSSIPQTPQLPPPNYSDIPFFSLSCKTGSLKTLLLHGGQDSEFEAAMRKRIMCFLNISENDYFMVFTANRTSAFKLVADSYQFQTSRRLLTVYDYESEAVEAMISSSKKRGARAISAEFSWPRLRIQTTKLRKMIERKRKKKKRKGLFVLPLSSRVTGARYPYLWMSIAQENGWHVLVDACALGPKDMDCFGLSLFQPDFLICSFYKVFGENPSGFGCLFIKKSAISSLESSSSAGIVNLVPEKQPHQLSDDSSGTDLEIKNKSLPTCLHEEKPFPLSSFSGPMQTKQSETVEEGEPPDSKLKAPQCSEIEEVQQEPVQTPKTSNVQESDIQFRCLDQVDSLGLILITNRSRYLINWLVNSMLKLKHPNTQGVPLVKVYGPKVKFDRGPALAFNIFDWKGERVEPALVQKLADRSNISISYAFLHHIWFADKYAEEKGRVLHTKVVGDQEVVTTTNKKKDSVGISVVTAALGFLANFEDVYKLWAFVARFLDADFVEKERWSHGRIHEV

SEQ ID NO: 193886 - protein, 547 aa, Glycine max
  Coding DNA Sequence Number=SeqID_77108
  Gene Ontology: Mol. function=hydroxymethylglutaryl-CoA synthase activity; Cellular component=soluble fraction; Biological process =acetyl-CoA metabolic process
  Homolog annotation: Hit_ID=Q6QLW8; Match level="QueryCoverage=98%, HitCoverage=96%, E-value=0.0, Identity=82%"; Hit description=HMG-CoA synthase 2
  Pfam annotation: Domain name=ACP_syn_III; Domain location=115-189; Score=-17.2; E_value=0.041; Accession=PF08545.1; Description=3 -Oxoacyl-[acyl-carrier-protein (ACP)
  Pfam annotation: Domain name=ACP_syn_III_C; Domain location=302-372; Score=-33.1; E_value=0.039; Accession=PF08541.1; Description=3 -Oxoacyl-[acyl-carrier-protein (ACP)
  Pfam annotation: Domain name=HMG_CoA_synt_C; Domain location=179-546; Score=441.5; E_value=1.1e-129; Accession=PF08540.1; Description =Hydroxymethylglutaryl-coenzyme A synth
  Pfam annotation: Domain name=HMG_CoA_synt_N; Domain location=5-178; Score=338.3; E_value=1.3e-98; Accession=PF01154.8; Description =Hydroxymethylglutaryl-coenzyme A synth
  Pfam annotation: Domain name=RNA_pol_Rpb2_3; Domain location=435-488; Score=-1.7; E_value=0.031; Accession=PF04565.7; Description=RNA polymerase Rpb2, domain 3
  Pfam module annotation: Pfam domain module=ACP_syn_III::ACP_syn_III _C::HMG_CoA_synt_C::HMG_CoA_synt_N::RNA_pol_Rpb2_3; Domain location =115-189::302-372::179-546::5-178::435-488
MASSRPANVGILAMDIYFPPTCVTQDALEGHDGVSKGKYTIGLGQDCMAFCSEVEDVISMSLTVVTSLLEKFNVDPKQIGHLAVGSETVIDKSKSIKTFLMQVFEASGNTDIEGVDSTNACYGGTAALFNCVNWVESSSWDGRYGLVVCTDTAVYAEGPARPTGGAAAIAMLVGPDAPIAFESKLRGSHMSHAYDFYKPNLASEYPIVDGKLSQTCYLMALDSCYRLYCEKFEKLEGRPFSMSDSDYFVFHSPYNKLVQKSFGRLYFNDFLRNASFVDEVARETLAPYASLSGDESYQSRDLEKANQQAAKHLYDAKVQPSTLIPKQVGNMYTASLYAAFASLLHNKNSSLVGKRVVMFSYGSGLTATMFSFQLQEGQHPFNLSNIVTVMNVSDKLKQRVEPIICRICVFKVVVLETLCISVPKIDMGTDAFWPQVLDQTNPLTQIVHGRKLSYLGPGGLMERTASFQGWLWWIPNSTSSTYESCFHRKKFPIMIPPEKFVETLKIMEHRYGGKDFVTSKDCSYLTPGTFYLTNVDSMYRRFYAKKD

SEQ ID NO: 193887 - protein, 470 aa, Glycine max
  Coding DNA Sequence Number=SeqID_77109
  Gene Ontology: Mol. function=Type I site-specific deoxyribonuclease activity
  Homolog annotation: Hit_ID=Q0VNG8; Match level="QueryCoverage=28%, HitCoverage=11%, E-value=5e-13, Identity=31%"; Hit description=Type I restriction-modification system, R subunit
  Pfam annotation: Domain name=Helicase_C; Domain location=56-131; Score=23.2; E_value=0.0001; Accession=PF00271.21; Description =Helicase conserved C-terminal domain
MTNELIAEKYFEAINFKETKELKKAIVFAASIKHAENLRLAFIRKYNELMGYSPDNAEAEEIFRSIHSAIPNHEELVREFQSPNSRIKVAFTVDLLSTGVDAPDVEVIVMARPTKSRVLYLQMKGRGTRIYKEGNKVKDKFYLIDFVDTWRLENEEDKPITNEDIVKEEEEEEKEISELMGSTEEPQRTTAKKEVKREQKREEMVILDIPVSIVYAEVITPENFKNELKGISEQVVRQVKAYLQAQEEVQIKKTQFETAVRSFDYFYRKNGGKTLNENYLKELEAFLNEQGITEDVLKDTYGEPDATLKDFVEVALGLKTFPTPEERKRNLIKEWYNKKGYPKECERLFMALYDFRKRNPNIDKKAFFNAEVVKQAGGFSKEIYQENIAKELGEDYKSTIPSEYRFFNWACDPRNYARSKGFKTVTEFLDKMFLDLANLPDTGDPKIDEDRSIIKKIFSNKPGECKTIIR

SEQ ID NO: 193888 - protein, 109 aa, Glycine max
  Coding DNA Sequence Number=SeqID_77110
MENMSSWAIGFQRNLWFFQKKNYPLEKASRFLSGGFIKANFKREKVVGNNYLDIVVKDCSSFVNSRFSNSLVFVHRSASRVTDFMAHFSFECKERFWIKDIPHQLEPII

SEQ ID NO: 193889 - protein, 142 aa, Glycine max
  Coding DNA Sequence Number=SeqID_77111
  Gene Ontology: Mol. function=Type I site-specific deoxyribonuclease activity; Biological process=DNA modification
  Homolog annotation: Hit_ID=Q6L2Y9; Match level="QueryCoverage=97%, HitCoverage=24%, E-value=2e-17, Identity=52%"; Hit description=Type I restriction-modification system specificity subunit
MSDYVEIDIGEFPKDWDVRKLKDVIIKAKSGGTPRRNVPEYWNGNIPFAKIQDITKSVLNSSVPILPLEEQKKIVELLQKATDIYYTLKDYIIQIRNSTETITKVIRKELLTKGIGHRDYVETDIGEFPKDWERGKEMRIVK

SEQ ID NO: 193890 - protein, 101 aa, Glycine max
  Coding DNA Sequence Number=SeqID_77112
  Gene Ontology: Mol. function=nucleotidyltransferase activity
  Homolog annotation: Hit_ID=Q9ZUY4; Match level="QueryCoverage=66%, HitCoverage=35%, E-value=6e-16, Identity=55%"; Hit description =Expressed protein
MGGIVSTPPTHKFPLPTMETCDYVRPSKLLLNVTIENSLGAIQVLLSPEDTVADLVNAALLIYEKEKRRPLLKDTDPKCYDLHYSPYTLQSICLAAAGLAM

SEQ ID NO: 193891 - protein, 122 aa, Glycine max
  Coding DNA Sequence Number=SeqID_77113
  Gene Ontology: Biological process=cell wall catabolic process
  Homolog annotation: Hit_ID=Q8H095; Match level="QueryCoverage=75%, HitCoverage=87%, E-value=1e-13, Identity=38%"; Hit description =Expressed protein
  Pfam annotation: Domain name=LysM; Domain location=77-119; Score =27.8; E_value=3.9e-05; Accession=PF01476.10; Description=LysM domain
  Subcellular localization annotation: CTP_CleavageSite=19; ConfidenceScore=5.13e-01
MALKLQLQSLSSKKDFDVKTQAKSTRIKKARMRGLEPVSWFLLIMLALRLIPNMEECSSPAIDVEKHTLEEPCKEFYEVRQGETLYSIAEKCRDPHIWLWNPHVEDPDDVYPGVIVRLKPVR

SEQ ID NO: 193892 - protein, 69 aa, Glycine max
  Coding DNA Sequence Number=SeqID_77114
MRMLKVKMSGLIPVYAGTLELPPRREKVQCGEGYCIWVINPLENVGQFRKSKSDVSFRCQKQLMRMLRV

SEQ ID NO: 193893 - protein, 133 aa, Glycine max
  Coding DNA Sequence Number=SeqID_77115
  Homolog annotation: Hit_ID=Q1SMD1; Match level="QueryCoverage=69%, HitCoverage=18%, E-value=8e-07, Identity=34%"; Hit description =Tetratricopeptide-like helical
MSEDIRANPLLTVMVEKGNHSGIVLHLHVRTEKTVKVDDRRGRSLKKHAVEQGNNMMVIKVIVSLRLRMRMKKTWKHREGGKKPEEGRHCDGPGRKWKECGVGFMAKGGRHTSCIRTAQEKYKHPGYSHRFCY

SEQ ID NO: 193894 - protein, 277 aa, Glycine max
  Coding DNA Sequence Number=SeqID_77116
  Homolog annotation: Hit_ID=Q1RZZ2; Match level="QueryCoverage=44%, HitCoverage=64%, E-value=3e-13, Identity=36%"; Hit description =Ribonuclease H
MVASEYTIICALFDKDENDKAEKMIARGLLLSKPTLICLYIQTSKHIYDTDFAGPFKPWEGIRKQWLNYVETATHSLEHPKQTLEIMIKWQPPSQGWFSINTDDKVQGQDGIVGCGGLIRDANGHVCGFAKTNKLVLDLHCGAYEGLCMAQNRGLTAVGLKMDAQTVSQSLERTQEGCSSRRVVSQSVSKPDSTSSRRSKEDISRKAACMALSQMRKRLPRIKAFHFLPLAHNKALNRLLQTDWQEPCLCQCKYPSGQKTEGSAPLLYSVWGVLITY

SEQ ID NO: 193895 - protein, 344 aa, Glycine max
  Coding DNA Sequence Number=SeqID_77117
  Gene Ontology: Mol. function=calcium ion binding; Cellular component =mitochondrion; Biological process=protein amino acid phosphorylation
  Homolog annotation: Hit_ID=Q1SMD3; Match level="QueryCoverage=97%, HitCoverage=95%, E-value=1e-107, Identity=36%"; Hit description=TonB box, N-terminal; Tetratricopeptide-like helical
  Pfam annotation: Domain name=PPR; Domain location=104-138; Score =25.5; E_value=0.00019; Accession=PF01535.11; Description=PPR repeat
  Pfam annotation: Domain name=PPR; Domain location=139-173; Score =37.9; E_value=3.4e-08; Accession=PF01535.11; Description=PPR repeat
  Pfam annotation: Domain name=PPR; Domain location=174-208; Score =40.0; E_value=8.2e-09; Accession=PF01535.11; Description=PPR repeat
  Pfam annotation: Domain name=PPR; Domain location=209-243; Score =46.3; E_value=1e-10; Accession=PF01535.11; Description=PPR repeat
  Pfam annotation: Domain name=PPR; Domain location=244-278; Score =33.1; E_value=9.7e-07; Accession=PF01535.11; Description=PPR repeat
  Pfam annotation: Domain name=PPR; Domain location=279-313; Score =33.2; E_value=8.9e-07; Accession=PF01535.11; Description=PPR repeat
  Pfam annotation: Domain name=PPR; Domain location=69-103; Score=29.1; E_value=1.6e-05; Accession=PF01535.11; Description=PPR repeat
  Pfam module annotation: Pfam domain module=PPR::PPR::PPR::PPR::PPR::PP R::PPR; Domain location=104-138::139-173::174-208::209-243::244 -278::279-313::69-103
  Subcellular localization annotation: CTP_CleavageSite=40; ConfidenceScore=5.17e-01
MLHSQSHYNNHNDHNDAVALFNRMLLMRPPPPTFQFNNILSSLVKMQRFPTAISLSKHLDFKGITSDLVTLNILINCFCHLGQITLSFSVLATILKRGYHPDVITLTTLIKGLCLRGEVKKALKFHDDVVALEFQLDRISYGTLINGLCKIGETKAAIQLMRNLEERSIKPDVVMYNIIIDSLCKNKLVGEACNLYSEMNAKQIYPNVVTYTTLIYGFCIMGCLIEAVALLNEMKLKNINPDVYTFSILIDALGKEGKMKAAKIVLAVMMKAYVKPDVVTYNSLVDGYFLVNEVKHAKYVFNSMAQSGVTPGVQSYTIMIDGLWRIAYVWDLVDKMRDRSQLAD

SEQ ID NO: 193896 - protein, 447 aa, Glycine max
  Coding DNA Sequence Number=SeqID_77118
  Gene Ontology: Mol. function=nucleic acid binding; Cellular component= cell cortex; Biological process=electron transport
  Homolog annotation: Hit_ID=Q9FNZ2; Match level="QueryCoverage=91%, HitCoverage=95%, E-value=1e-158, Identity=62%"; Hit description =Zfwd1 protein
  Pfam annotation: Domain name=WD40; Domain location=131-169; Score =35.1; E_value=2.4e-07; Accession=PF00400.22; Description=WD domain, G-beta repeat
  Pfam annotation: Domain name=WD40; Domain location=211-247; Score =12.1; E_value=1.4; Accession=PF00400.22; Description=WD domain, G -beta repeat
  Pfam annotation: Domain name=WD40; Domain location=255-291; Score =32.8; E_value=1.2e-06; Accession=PF00400.22; Description=WD domain, G-beta repeat
  Pfam annotation: Domain name=WD40; Domain location=295-331; Score =31.4; E_value=3.1e-06; Accession=PF00400.22; Description=WD domain, G-beta repeat
  Pfam annotation: Domain name=WD40; Domain location=338-378; Score =12.3; E_value=1.3; Accession=PF00400.22; Description=WD domain, G -beta repeat
  Pfam annotation: Domain name=zf-CCCH; Domain location=100-125; Score =27.5; E_value=4.8e-05; Accession=PF00642.15; Description=Zinc finger C-x8-C-x5-C-x3-H type (and similar)
  Pfam annotation: Domain name=zf-CCCH; Domain location=19-43; Score =1.6; E_value=0.82; Accession=PF00642.15; Description=Zinc finger C -x8-C-x5-C-x3-H type (and similar)
  Pfam module annotation: Pfam domain module=WD40::WD40::WD40::WD40::WD4 0::zf-CCCH::zf-CCCH; Domain location=131-169::211-247::255-291::295 -331::338-378::100-125::19-43
MDVDGGNKRVYNRLGGDAKHQKVCFHWQAGKCNRYPCPFLHSELPANSHHANGASSKRAYDNSGFSGPRRSPSFNNTWGRGGSRGGGGAGAGAGRGVVVKAEKVCNYWIQGNCSYGERCKFLHTWSVGDGFSLLTQLEGHQKAVSAIAFPSGSDKLYTGSTDETARIWDCQSGKVCVGVINLGGEVGCMISEGPWVFVGIPNFVKAWNTQNLSELSLNGPVGQVYALVVNNDMLFAGTQDGSILAWKFNVATNCFEPAASLKGHSRGVVSLVVGANRLYSGSMDNTIRVWNLETLQCLQTLTEHTSVVMSVLCWDQFLLSCSLDKTVKVWYATESGNLEVTYTHNEENGILTLCGMHDSQGKPILLCACNDNTVHLYDLPSFAERGKILTKKEVRAIQIGPNGIFFTGDAARREFGLRLGLGRGRKRQKKRGESELWKYPWHKAVLK

SEQ ID NO: 193897 - protein, 243 aa, Glycine max
  Coding DNA Sequence Number=SeqID_77119
  Homolog annotation: Hit_ID=Q9FIS4; Match level="QueryCoverage=76%, HitCoverage=78%, E-value=8e-64, Identity=63%"; Hit description =Arabidopsis thaliana genomic DNA, chromosome 5, P1 clone:MTG10
  Subcellular localization annotation: CTP_CleavageSite=34; ConfidenceScore=5.57e-01
MSCKINSLSSPIPCKFYTNKPKLRRTNTILFSFPSSEKQQKTISTSTSETPTTEAYTVSFKTEKGCKLGISRYPDFEYDAEGGMGTGVGAKVTENNNPANNDLPVSFDLETLYIPPLTSSTTKFLGFPLPPFLKIDIVPEAFHGSINQESGKVDLEFKAKFLFSAGSLYKAPPLMVKTVLTSEETKGTMRSGRGKRLDKEGKCRLVGVATIDPIDDFFMNSFLGLPTECLAELKAVISISSSS

SEQ ID NO: 193898 - protein, 328 aa, Glycine max
  Coding DNA Sequence Number=SeqID_77120
  Gene Ontology: Mol. function=RNA-directed DNA polymerase activity; Cellular component=intracellular; Biological process=RNA-dependent DNA replication
MAEELLQGMMNKGQIEIYSAKKGEGNLFTVKMPTPFPYKNDKALPWKYAAQGSNKRKDVSFVRVKEDLPFTKVTNISGMSGMTHSGRIFAASELPVWSKDKGKVKADIGERDKVGLTSNDEVPIGNITEERDDFDKKVISVEEATKFLRIIQQTRISLLGLLMNSEPHRALLVKILNEPHVAQDISVEGFRGIVSNITTNNYLTFTNEEVPVEGRGHNKALHVSIKFLDHIVTKVFVDNGSSLNVMPKTTLDKFPFNASHIRLSSMVVRTFDDPLGWGGPVNATPEIKVCSGRAAGYSIRGGRHTAMLMWISSDAPTLIGTALMVARV

SEQ ID NO: 193899 - protein, 83 aa, Glycine max
  Coding DNA Sequence Number=SeqID_77121
MEPYTFIECLYDSTTEHIPPSYREDDRSRGCSTPCFEDKVPPEIRIGINFSVYFIDISNLLIYNSVITAFLTNSNNFINIPIY

SEQ ID NO: 193900 - protein, 103 aa, Glycine max
  Coding DNA Sequence Number=SeqID_77122
MTKGAKDDISLCASHDPRVSMTEIVGRPTKARLLLLRILNEELRPTYFWINYETKIVSVFSLLKCEHALVKRQNFQLIRATYAFWMKNNVSTGEGEYADEIFS

SEQ ID NO: 193901 - protein, 120 aa, Glycine max
  Coding DNA Sequence Number=SeqID_77123
  Gene Ontology: Mol. function=transferase activity; Biological process= RNA-dependent DNA replication
MWTLHCMQIMGVWGWECAFEMIEESLFGLERTSRSFYLFPTRLKQWRYWRQLNEFGSIVQQCKPLLNLLPNVRIGIGRRQTNMVAHSLTRISCLHASPKVFSRIPNCIADYILREMNQAF

SEQ ID NO: 193902 - protein, 64 aa, Glycine max
  Coding DNA Sequence Number=SeqID_77124
MNHFFRKTPGKTSSGNFPEEVVHPEEFRKTRTSGRSFKFPEDLSGRTPSSGRFPEEPLLPEMIL

SEQ ID NO: 193903 - protein, 178 aa, Glycine max
  Coding DNA Sequence Number=SeqID_77125
  Gene Ontology: Mol. function=hydrolase activity, hydrolyzing O -glycosyl compounds; Biological process=trehalose biosynthetic process
  Homolog annotation: Hit_ID=Q5PHK1; Match level="QueryCoverage=89%, HitCoverage=26%, E-value=3e-35, Identity=47%"; Hit description =Putative hydrolase
MALLLLSPHIPLLFMGEEFGESNPFLFFTDFRDDLANTIREGRRSEFDGHSGYKSETVPDPNDRTTFETSKLDWSKAQTEAGEDWLTLTGKLLLLRRTKIVPLLRGDNGRAGRVVEAGDGCIAVTWTFSAGALSIAVNLGDETRPLPDQPGDAIFAWPEEQAALPKNSILVRLATEAV

SEQ ID NO: 193904 - protein, 192 aa, Glycine max
  Coding DNA Sequence Number=SeqID_77126
  Gene Ontology: Mol. function=zinc ion binding; Cellular component =integral to membrane; Biological process=ubiquitin cycle
  Homolog annotation: Hit_ID=Q1SN88; Match level="QueryCoverage=88%, HitCoverage=66%, E-value=2e-55, Identity=68%"; Hit description=Zinc finger, RING-type; RINGv
  Pfam annotation: Domain name=zf-C3HC4; Domain location=79-123; Score =30.0; E_value=8.3e-06; Accession=PF00097.15; Description=Zinc finger, C3HC4 type (RING finger)
  Subcellular localization annotation: CTP_CleavageSite=43; ConfidenceScore=5.16e-01
MVLSVLLCALICSLGLNSIIRCALRCSNFVVSDSVATNNNNPPAAARVANTGVKKKALKTFPTVSYSAELNLPSLDSECVICLSEFTSGDKVRILPKCNHRFHVRCIDKWLSSHSSCPKCRQCLIETCQKIVGCSTQQASSSQQQQQQQHVLAVPETIVTIVAPLEPEGLTLSINDITVEVDEWNGMDPSQP

SEQ ID NO: 193905 - protein, 78 aa, Glycine max
  Coding DNA Sequence Number=SeqID_77127
MRKIPKKRGQKGLFLGFLDPSSPRLASGEETNSPRRAQKWRELREERNKMKKEEETRPRRYQIATVIDFYIVLRSSSY

SEQ ID NO: 193906 - protein, 312 aa, Glycine max
  Coding DNA Sequence Number=SeqID_77128
  Gene Ontology: Mol. function=protein serine/threonine kinase activity; Cellular component=cytosol; Biological process=protein amino acid phosphorylation
  Homolog annotation: Hit_ID=Q1S7W7; Match level="QueryCoverage=91%, HitCoverage=88%, E-value=4e-95, Identity=67%"; Hit description =Protein kinase
  Pfam annotation: Domain name=Pkinase; Domain location=41-311; Score =156.9; E_value=5.1e-44; Accession=PF00069.15; Description=Protein kinase domain
  Pfam annotation: Domain name=Pkinase_Tyr; Domain location=41-304; Score=31.6; E_value=2.1e-14; Accession=PF07714.7; Description =Protein tyrosine kinase
  Pfam module annotation: Pfam domain module=Pkinase::Pkinase_Tyr; Domain location=41-311::41-304
MANREENNEGHKFTVKYVGLNGMECEGKLPRRVVGVRNHCYLLKSKIGEGSFSAVWRAEQRPPTGVDVAVKQVFLSKLNPRLKACLDCEINFLSSVNHPNIIRLLHFFQDDGCVYLVLEFCAGGNLASYIQNHGRVQQQIARKFMQQLGSGLKVLHSHDIIHRDLKPEVGILYMFSGHRIEFSKLLKMESFTSLCHRFNANCLIQWHLLKTEEHCFKNILLSSHGVEAVLKIADFGLSRTVCPGEYAETVCGSPLYMAPEVLQFQRYDDKADMWSVGAILFELLNGYPPFNGRNNVQDWILTVLIFVQGYYA

SEQ ID NO: 193907 - protein, 123 aa, Glycine max
  Coding DNA Sequence Number=SeqID_77129
  Subcellular localization annotation: CTP_CleavageSite=40; ConfidenceScore=5.12e-01
MGKRNHRRMTPSGNFVTITTVFVNDRLCGVSKISALGHARLSDRKPHQTASCCPVLCLSPSLARPEFARFVSTDRDIESACRSNSSKNIRPDLLDVEDSGLAAFVRLSNGDMRKALNILQVVC

SEQ ID NO: 193908 - protein, 334 aa, Glycine max
  Coding DNA Sequence Number=SeqID_77130
  Gene Ontology: Mol. function=protein serine/threonine kinase activity; Biological process=protein amino acid phosphorylation
  Homolog annotation: Hit_ID=Q1SQC9; Match level="QueryCoverage=94%, HitCoverage=61%, E-value=4e-45, Identity=59%"; Hit description =Protein kinase
MDLKLHGAKFRLMMYYRHQGIKSVGLSKLKDPEVKSFIEKCLVPASQRLSAKELLMDHFLQVNGSLKNRCLPLPDILLPKYGTFENHCLMSEGPASTRVRSISMDLGDASEPPLTTLLYNSVDSVDDALPSPCVEIRRLKEVNRDSKLAKYKHSSEGSSQIVAEDVGLSTSPGRPAEMENNDNVICDKFMSRANIGLRRETKTNDLYFEKHRSYSSATSDFNDKHFSTVSFMSAKSGFTDFDLPKVSSQSSLTSEFRASSDYRSFPCVESNGTMNFSCHPVSTSSFFEPGDELRIELEMIEQQYQDEIEDLLRRKQQDITETTRRHLQNNASIK

SEQ ID NO: 193909 - protein, 133 aa, Glycine max
  Coding DNA Sequence Number=SeqID_77131
  Gene Ontology: Mol. function=ribonuclease H activity; Biological process=RNA-dependent DNA replication
  Homolog annotation: Hit_ID=Q1SDD8; Match level="QueryCoverage=64%, HitCoverage=16%, E-value=7e-17, Identity=45%"; Hit description =Ribonuclease H; Glutathione S-transferase, C-terminal-like
MCSVEWWLSARSKWLCAARFKGLLLEKTLLLDLFNDGDLNVVHRRNINALLDNTLKPAPKRLRKTTIKEKMCSFNTGFTKAPHEHHYATSTPKIFISGHSIVNNAPKKKGFIRSYSSEPNGLIPKNFKCSGSD

SEQ ID NO: 193910 - protein, 88 aa, Glycine max
  Coding DNA Sequence Number=SeqID_77132
  Gene Ontology: Mol. function=RNA-directed DNA polymerase activity; Biological process=RNA-dependent DNA replication
MVVVLDHTSSKPLDLDSQIDETEWLSQMKKHVLINLVVIIRKSNEKWRMCMNYTNLNKACLKDAYPLPNIDQLVDGVIGDNCFSHLIL

SEQ ID NO: 193911 - protein, 69 aa, Glycine max
  Coding DNA Sequence Number=SeqID_77133
MSKLAIDQGTDVQIEATTKAIQQIPQQLQGAILKKPKQAFIYEECGGSHPTSRPCLHVLPRAKKSTLYC

SEQ ID NO: 193912 - protein, 173 aa, Glycine max
  Coding DNA Sequence Number=SeqID_77134
MLLAKTLDLETMMFLDQQVKWNQSFSLSLIVGLGDGSRTWHRELTPLSAYTTLLSPCSSCGGFQAFDDSLTCSKTHVEEDDEIEEDLEINNVDAELPQGRVGWLVEKSSEEDPDENRIGLVVTTLGLGALDLLHQWSSMVGEWRRKRDDWRCHFKEKMSQAQAHHHRKPWIRA

SEQ ID NO: 193913 - protein, 104 aa, Glycine max
  Coding DNA Sequence Number=SeqID_77135
  Homolog annotation: Hit_ID=Q8H6Q8; Match level="QueryCoverage=98%, HitCoverage=3%, E-value=5e-12, Identity=37%"; Hit description=CTV.20
MMESEYGDKNPFKATAKAFPQGFHYKPTTLNKTRKFYEFILVDTDSVSIKHFKDSKDPNLNTHSTIQILKVMQPQHYGSNLNQPKKFFAPFDPTGYTYWDYIDA

SEQ ID NO: 193914 - protein, 128 aa, Glycine max
  Coding DNA Sequence Number=SeqID_77136
MTFFQGTNGSTFMTKEVQDQPYIKSGHATDNPCTALLASSVKCVIGVSKNSNDQAIFTMVVLSLAHQRAKHASTAKCSFNALSATEESGRASISRLRAKHEISVLSAAGVFSQAQRTTGVKPKPTYSR

SEQ ID NO: 193915 - protein, 163 aa, Glycine max
  Coding DNA Sequence Number=SeqID_77137
  Homolog annotation: Hit_ID=Q1SDS1; Match level="QueryCoverage=63%, HitCoverage=20%, E-value=1e-09, Identity=36%"; Hit description=IMP dehydrogenase/GMP reductase
MVGASINWFPRWKKGRVRVLSSCEGFSNIPLMGTRGCIDYNPVLSIRQLGYPMRGAPSKESITPFIARGFSDPNARIFQRVRKAWSVAQRKDKELRGSNNGIIGGYHKWLKAWMQELDWLPKLRTSSEEEAETPEESEEVQALKAELEKAQAVKEKFKMIAIK

SEQ ID NO: 193916 - protein, 157 aa, Glycine max
  Coding DNA Sequence Number=SeqID_77138
  Homolog annotation: Hit_ID=Q1T254; Match level="QueryCoverage=96%, HitCoverage=40%, E-value=4e-14, Identity=31%"; Hit description =Peptidase aspartic, catalytic
VAGCTICGGAHESGCCIPIEEHPTHEVNYMGNQPRNNFNGQWRNHPRNQFNRDQGGPSTRPQQQGPSLYDHTTKLEETLAQFMQVSISNQKSTESAIKNLEVQVGQLAKQLADRSSSSFIANTEKNHKEECKAVMTRSRMAIQGNDSEAGKKMEEHK

SEQ ID NO: 193917 - protein, 59 aa, Glycine max
  Coding DNA Sequence Number=SeqID_77139
MKSSTSVPAIGLGAQRNSLGAAIRLRLMIWAASNQIMRGFRVLLDAPSIIAGAPSILTK

SEQ ID NO: 193918 - protein, 51 aa, Glycine max
  Coding DNA Sequence Number=SeqID_77140
MAFYGGECSVTASAPDRANSSYWTKLDQNRIKTNIQQLGYRTPIPRDNTIN

SEQ ID NO: 193919 - protein, 218 aa, Glycine max
  Coding DNA Sequence Number=SeqID_77141
  Gene Ontology: Mol. function=structural molecule activity; Cellular component=viral capsid
  Homolog annotation: Hit_ID=Q8W0V9; Match level="QueryCoverage=88%, HitCoverage=88%, E-value=2e-91, Identity=82%"; Hit description=24 kDa protein SC24
  Pfam annotation: Domain name=Alginate_lyase2; Domain location=35-217; Score=191.5; E_value=2e-54; Accession=PF08787.1; Description=Alginate lyase
  Subcellular localization annotation: CTP_CleavageSite=68; ConfidenceScore=5.11e-01
MVPKPILCVTLLSLIISLTTLSLVAADPTYGFTRLPLSNSNFQVQRPYDVPVSQRYSFSNGVHRFLVYSSDKPHMQGSATEPRTEIRITGYDYTSGVWQFEGYFYVPSGTTGTCIQQVFGGVSSATTSQSRVYGGSLTHYQSITLEQNIYNRWIRFNVIHDVGANNVKIYINGGNAPRYNGPGRGASTHYFKFGVYAQPGAASNYMESQWRDIKILRK

SEQ ID NO: 193920 - protein, 75 aa, Glycine max
  Coding DNA Sequence Number=SeqID_77142
  Subcellular localization annotation: CTP_CleavageSite=43; ConfidenceScore=5.31e-01
MKREKYILNDIVQSVQFNSHGSSVSSQSGIGLRVQSTSLGGISSASLQQPPNPVHSPSSQQPLMPDVGNSKIEEQ

SEQ ID NO: 193921 - protein, 131 aa, Glycine max
  Coding DNA Sequence Number=SeqID_77143
  Subcellular localization annotation: CTP_CleavageSite=19; ConfidenceScore=5.01e-01
MPRVDATKPITHAYSPPCRQQQAPHAPRAVLHHQPTRTVVSLNNLLSVVVHYGRTAALHDKLLEHRDMTLFEMGVESYGSAMVARKRQPTVFALWMTTKLGEFCRNRPWNPGITFGNHGLKPQHLEDKYLV

SEQ ID NO: 193922 - protein, 115 aa, Glycine max
  Coding DNA Sequence Number=SeqID_77144
MGQEFTPSWTELWSITCYLLWQWRNHQIHDPHFCRPYCPWCVVGLPGLKEHGSKQLSTNSAFVAQLWGNVVGSSNGSRRALNQSGTMMFEQLPTLLSPLLVRDALDCFLPRLIPV

SEQ ID NO: 193923 - protein, 494 aa, Glycine max
  Coding DNA Sequence Number=SeqID_77145
  Gene Ontology: Mol. function=glucokinase activity; Cellular component= intracellular; Biological process=glycolysis
  Homolog annotation: Hit_ID=Q8P6S9; Match level="QueryCoverage=66%, HitCoverage=98%, E-value=1e-55, Identity=42%"; Hit description =Glucose kinase
MTDGGVAQLALGPACARFHRIQCAAALRQHLPCGLVGRHAEVPGRNHLGPTLRARLHARQSRHACGQCAGLQELPAIHHLPLPVCNARPARCRSCRSVVRGLSCGVPDRCTKYAQLAVLHAPYRHLAQHLGQHALVEEALTEAAIGQEILHMRGNASGQVHRACTDGDRCVAGQAAQPGAEHLQRLHRQHVFTAAGGTDQCFGTGPHRGDAAQLAQARIQVHQATTGQHALVVHVRPALQQLAQHLQFQRVAGAERGVADLAGQHRAPAIGETQRSAQAGARAQHQRRERLCRISVAVQWHQGFRLQVRDGQRHRFEIIDQLQLMQPGLRAGGRQRDRPRQVGIDQYIAIEQAGDGHHRSLHRLAKACGEIGQDRGQAGVLGAGIGAMAAQQRRLAGLGFSQRKAGEGAADIGDHQTARRTAAGGVGGNRGRCCDGHAGLLGSIESPRFSGIGAALPSTPMIQVGLHAFLFGHLHTIHQHAQPLRAEAGKQQRP

SEQ ID NO: 193924 - protein, 158 aa, Glycine max
  Coding DNA Sequence Number=SeqID_77146
MPQGDGVRIMRTSMTTLTQIWMTLLLSMILPSDHNSDLPLLKWTAPTRHPVDSEKSNRALGPGIATTKGGPTCRSKLHDDESKGTSTWVVVTENKRGYISCGSVQVEGFYKVEKKSQEPQVAWGLDVGTGLTGASSKKGKCAESPPTFIQEKCRKNWK

SEQ ID NO: 193925 - protein, 140 aa, Glycine max
  Coding DNA Sequence Number=SeqID_77147
  Homolog annotation: Hit_ID=Q5Z4L5; Match level="QueryCoverage=27%, HitCoverage=7%, E-value=3e-10, Identity=74%"; Hit description =Putative LYST-interacting protein LIP5
MSFLDDSTNIYNHETKTAESVTLAVRIETDEQDSFPAWLSHIMQVGDVHSTVKYHPLPWLGPPPPTRLPTIYVAISRTKKAVTFPFSGATRLMKELEQKQKYAVWKAAEIRKALKEGRKSSAGPPDGDEDLSVPLSSSSE

SEQ ID NO: 193926 - protein, 304 aa, Glycine max
  Coding DNA Sequence Number=SeqID_77148
  Gene Ontology: Mol. function=heat shock protein binding; Cellular component=integral to membrane; Biological process=protein folding
  Homolog annotation: Hit_ID=Q1SQA8; Match level="QueryCoverage=49%, HitCoverage=55%, E-value=1e-38, Identity=56%"; Hit description=Heat shock protein DnaJ, N-terminal
  Pfam annotation: Domain name=DnaJ; Domain location=131-186; Score= -2.4; E_value=0.0075; Accession=PF00226.21; Description=DnaJ domain
MAGELSSPPPANNHRDEKYGYQGRFSNKDQPKSGQPKSGQHSGGKPQKKSKRKIRRESFSEDFDGHTEQIFQATFGNKWYTWSFNNWRSSSSEHSTSGFEWREHSNRTNKWKNESDTEHEDDDSCCEGSSSDRTVLGLPPTGPLKIEDVKNAFRLSALKWHPDKHQGPSQATKERSQDALEKVFGDNQWGVGLVPSCVMQTTLKWKLKAKKNDRGRDHKSVDQDQEAEMQSPIPLKLSEIAPSSGGRWHASSRSGAGLWCSGPGRLFLSSGAGAGCCFRTLPWMEAKLFPCPCPDNNVATFLRP

SEQ ID NO: 193927 - protein, 269 aa, Glycine max
  Coding DNA Sequence Number=SeqID_77149
  Gene Ontology: Mol. function=structural molecule activity; Cellular component=flagellin-based flagellum; Biological process=ciliary or flagellar motility
  Homolog annotation: Hit_ID=P58330; Match level="QueryCoverage=71%, HitCoverage=45%, E-value=1e-65, Identity=72%"; Hit description =Flagellin D
GGGSDCNEAGYRVCGGNRGCRARGETEKLRFGKHLCGIGCCCGDTCGRRCRDLEIAKSAGIGVIGGAVENAVFRRAGGRIEKRGLVIDLDVDGLDGDIACTVTDEGADDLLGDGRQIAGGVADLALQPVFTGEGGGFANALQLVLKLADFFLDLGLVNACFAGGNQLLADFLDDIDGGFHGGIGGINLCGAEAESVLYGGEGAIIRTHGGRDRPVGGIVGCGLDAHAGGNARLGFFHVAADGAKSLEGGHGRNVGQNAGHNDLPLDWLK

SEQ ID NO: 193928 - protein, 79 aa, Glycine max
  Coding DNA Sequence Number=SeqID_77150
MKNVEERSKPSRNSLWKRYGNVSEAPRLRFSSRKQFFQANSKEREVPIFPSKIGEVLAAQLAQASSARPGEPGCFLQKQ

SEQ ID NO: 193929 - protein, 65 aa, Glycine max
  Coding DNA Sequence Number=SeqID_77151
  Subcellular localization annotation: CTP_CleavageSite=46; ConfidenceScore=5.38e-01
MVSVASVKFLKTLENPSQGAFVNDSVEILPRSSSFFTILRSFFVVLQSSTGKFPTLNLSIHSMHP

SEQ ID NO: 193930 - protein, 128 aa, Glycine max
  Coding DNA Sequence Number=SeqID_77152
  Gene Ontology: Mol. function=peptidase activity
MASSNPLFPEGNSIRRPPIFNGEGYHYWKTRMQIFIEAIDLNIWEAIEIGPYIPTVVDVSTSTVEARLHDECDEQKAQRSNNNSRESRTIQEFKNQEEFETQEESLESRIKIQGSRSQESRSRLKNQE

SEQ ID NO: 193931 - protein, 132 aa, Glycine max
  Coding DNA Sequence Number=SeqID_77153
MGEIEEVQERMKANMEAMISMKKIMEVNAAAVVATNIYAFPPYGLPPNYTPPNMVHPPDENVNNSTLILIQSQHTQSYHPHVSQPMGETHEIPHHNLADFKPCLGYATQGQAVGGVPCSNPTSAPDCASSMK

SEQ ID NO: 193932 - protein, 109 aa, Glycine max
  Coding DNA Sequence Number=SeqID_77154
MANLSYYYEGSRYVITVNKFGFMDKVVSRICPLDLMMKYVQFQSLAHQWAKRASTAKHSFSALSATEESRSSSISRPRAIRETSALSVAAIFSQAQHKTGAKPESTYPH

SEQ ID NO: 193933 - protein, 53 aa, Glycine max
  Coding DNA Sequence Number=SeqID_77155
MDALAYPFYLHRPIVGDGHGSENVDVLDNNLMEGVDREVALVPLVTPQWHDEP

SEQ ID NO: 193934 - protein, 115 aa, Glycine max
  Coding DNA Sequence Number=SeqID_77156
  Gene Ontology: Mol. function=DNA binding; Biological process=DNA integration
  Homolog annotation: Hit_ID=Q1SJY5; Match level="QueryCoverage=70%, HitCoverage=8%, E-value=3e-22, Identity=58%"; Hit description =Integrase, catalytic region
MTGDASKFTHISPKKNEHLTYGDNNKGRILGVGKIDIHGHYFLLIKVMHFMHSRYLPKLFIIRKILKLHLSGVIMEENLKTKILNHFVMNMALSIIFLHPELFNKMEFLRGKIDP

SEQ ID NO: 193935 - protein, 421 aa, Glycine max
  Coding DNA Sequence Number=SeqID_77157
  Gene Ontology: Mol. function=strictosidine synthase activity; Cellular component=vacuole; Biological process=biosynthetic process
  Homolog annotation: Hit_ID=Q9LKW1; Match level="QueryCoverage=88%, HitCoverage=91%, E-value=2e-95, Identity=51%"; Hit description =Putative strictosidine synthase
  Pfam annotation: Domain name=SGL; Domain location=52-350; Score= -93.0; E_value=0.0019; Accession=PF08450.2; Description=SMP -30GluconolaconaseLRE-like region
  Pfam annotation: Domain name=Str_synth; Domain location=212-300; Score=162.3; E_value=1.2e-45; Accession=PF03088.7; Description =Strictosidine synthase
  Pfam module annotation: Pfam domain module=SGL::Str_synth; Domain location=52-350::212-300
STVVTFAMNTGLVAGAALLALLAITFSLLNPQTLFSPPHVPGSKDHLHAARLLHVTGAVGPESLVFDADGGGPYTGVADGRILKWEGEERGWTEFAVTSSNSSFELDKELSRDDSIDSLGMGYLYYFLTMKIAFLSYYRDYDSYCIRSDCVRPFAPELEHICGRPLGLRFDKKNGDLYIADAYLGLKVVGSAGGLATEVVTEVEGQPLQFTNDMDISEDEEVIYFTDSTTIFQRRQFMLVLLSGDKTGRLMKYNKSTKEVTVLLRGLAFPNGVALSKDGSFVLVAETTTCRILQLWLRGPKAGHVDTFAVLPGFPDNVRRNSQGHFWVALHAKGSRFAKWVSSNPWAGKALLKIGFNFKQLHSSFAGWKPHAAAVKLSDKGEILEVLEDCDGKTLKFISEVEEKDGKLWIASVLMPFIGIY

SEQ ID NO: 193936 - protein, 123 aa, Glycine max
  Coding DNA Sequence Number=SeqID_77158
MVGYTPSSIADLVFAGERIKVGLEEGKSDHPALMNMKIGANEKDENEGETLAMTAIPTRSNFPSAQQCHYSANNSPSHPIIHKGHPQSSTKPARRTSGAKTPTKKEFYSKKPVGFTPNSGVIC

SEQ ID NO: 193937 - protein, 91 aa, Glycine max
  Coding DNA Sequence Number=SeqID_77159
MTHPCRRPSYCQLAPLLFDGLRQQRLAAQLGDQLPLGASITHASMAIPSGVCGYPAKFHSPCSADICPSDVTRSTSCSEVNPCAAARNPFA

SEQ ID NO: 193938 - protein, 327 aa, Glycine max
  Coding DNA Sequence Number=SeqID_77160
  Gene Ontology: Mol. function=protein transporter activity; Cellular component=type II protein secretion system complex; Biological process=protein secretion by the type II secretion system
  Homolog annotation: Hit_ID=P41441; Match level="QueryCoverage=95%, HitCoverage=78%, E-value=4e-86, Identity=55%"; Hit description =Putative general secretion pathway protein F
  Pfam annotation: Domain name=GSPII_F; Domain location=1-116; Score =58.3; E_value=2.5e-14; Accession=PF00482.13; Description=Bacterial type II secretion system protein F domain
  Pfam annotation: Domain name=GSPII_F; Domain location=196-318; Score =87.7; E_value=3.7e-23; Accession=PF00482.13; Description=Bacterial type II secretion system protein F domain
  Pfam module annotation: Pfam domain module=GSPII_F::GSPII_F; Domain location=1-116::196-318
MAAALPLDEALAAIQQQKENKNLIGVIGSLRQAVLEGQSLSSAMQQHPRVFDTVYCTLVKAGEAVGKAGTVLERLADFNEARQRMHSKLMQALIYPSLLTIVAIVVVVILLTAVVPNVAAQFIHLKHELPLTTRILLAISDFLSVYGPGILGLLFVGGGLFSYWLKREGNRHRFHRLLIHFRATAPLVCAIDSARYLRALSILNVSGVPLLQGMSLSAEGVGNQEIRQRLSDAAERVRQGNSVSQSLEKTAIFPPMMLYMIASGEKSGQLGELMQRAADNQDVRLQNRITLTLAIFEPALIVVMAAIVLFIVVAVMQPILQLNSLMN

SEQ ID NO: 193939 - protein, 101 aa, Glycine max
  Coding DNA Sequence Number=SeqID_77161
  Subcellular localization annotation: CTP_CleavageSite=23; ConfidenceScore=5.06e-01
MEKMNVPITTRGWGPVRAKGHFRAVAARPGKLNLRLEVTSSPKRANFLTMKLFDGPGEPNASLGKLGCRKTQKRPFCPLPWYLSQPTLRREGEAKFTGASS

SEQ ID NO: 193940 - protein, 155 aa, Glycine max
  Coding DNA Sequence Number=SeqID_77162
MLRNFTDYATMLFLTSGMLRNFTDCATIFLFYFQNVAELYGLPNDGGDDKNINMVLLLPAATLHTVDELRKLLSNKDVYQQFLSSLDEVKIQNNFNIIIFFLVVVNSYLRTAIGKSVGDSGGTRIGEDAKAGDESLDYRKGLLLEASDEDDTDKN

SEQ ID NO: 193941 - protein, 102 aa, Glycine max
  Coding DNA Sequence Number=SeqID_77163
MQTIRKNHCIQSQTGIYGSLSMNNSYLYSKLHSSRITTFMTYKNIHDVQEHTRTSTVVCGSKGSLNCKHHEPHDEGSSIKSMLYKLLVNLRSGVFMLQIDGF

SEQ ID NO: 193942 - protein, 36 aa, Glycine max
  Coding DNA Sequence Number=SeqID_77164
MARNMSAPCPYSRDLYGRELTRSLEVSSPSKNILQQ

SEQ ID NO: 193943 - protein, 52 aa, Glycine max
  Coding DNA Sequence Number=SeqID_77165
  Gene Ontology: Mol. function=phosphoglycolate phosphatase activity; Biological process=metabolic process
  Homolog annotation: Hit_ID=Q1T1G8; Match level="QueryCoverage=96%, HitCoverage=18%, E-value=6e-19, Identity=80%"; Hit description =Haloacid dehalogenase/epoxide hydrolase
MEYVNDGRPFWQYIVSYSTGCSDPQYFEELYNYYTTDKAWHLNDTGAEELFV

SEQ ID NO: 193944 - protein, 376 aa, Glycine max
  Coding DNA Sequence Number=SeqID_77166
AYIYLGCYIENKRGYISCGSVQVERTSTWLFKENKGGYIPFGSLLVKDFTRLLEISRTGGCLGTGRRHGKECALRCPYRTHARARVKSEIEEVKEQMKADMEAMKKQMATMMEAMMSMRKMMEVIMATVVVASTATEVDPTHPSGLNQNKHSFPPYGLPPNYTPPNVAHTPNENVNNFAPKPIESQQPQSDYAHVSQPMEETHEASLDHNLADFEPHLGYATEGQAIGVPPAMVERVKFDHIEERMRAIEGGRDYAFVDMADICLVPDIAIPPKFKVLDSDKYKGTTCHRNQLRVYYRKMGAYAKDENLWMHFFQESLTGAAVTWYTNLEPSRVHSWKDLMIAFIRQYQYNSDMAPDRMQLQNMCHTEHESVKEYA

SEQ ID NO: 193945 - protein, 96 aa, Glycine max
  Coding DNA Sequence Number=SeqID_77167
  Homolog annotation: Hit_ID=Q1T1G4; Match level="QueryCoverage=96%, HitCoverage=37%, E-value=2e-07, Identity=43%"; Hit description=Helix- loop-helix DNA-binding
MVALFSPTVFSTKGWLLEEEPLSYDVSSKNSFPYQFYSLQTQIEVEIERSTAPSPDDPAMVKKLSHNASERDRRKKVNNLVSSLRLLLPVEDQTVL

SEQ ID NO: 193946 - protein, 64 aa, Glycine max
  Coding DNA Sequence Number=SeqID_77168
  Subcellular localization annotation: CTP_CleavageSite=40; ConfidenceScore=5.03e-01
MPQPNSATSCHHLWKPNMGEHMSLCSSQSMATSRKVVAVLADAPKEPVVYVPQVVAENDVDILI

SEQ ID NO: 193947 - protein, 61 aa, Glycine max
  Coding DNA Sequence Number=SeqID_77169
MYYNGKWNIPHQGEFLGYSFTGTNPIRFDIPSGCGMEKLKDLIKQVAPIGVPPNGIHGSQL

SEQ ID NO: 193948 - protein, 118 aa, Glycine max
  Coding DNA Sequence Number=SeqID_77170
  Homolog annotation: Hit_ID=Q1S3Q9; Match level="QueryCoverage=90%, HitCoverage=23%, E-value=8e-13, Identity=33%"; Hit description =Cyclin-like F-box; F-box protein interaction domain
MALTELLQSEKNEIKVYDMGDSCWRNLEGFPDLWSLPKVRGVYLGGTLNWVLIKAKIAATFEIVIISVDLQKETCRSLCLPDDLWAVDINIGVFRDSQCVWQDYNNTHIGLLREFGDD

SEQ ID NO: 193949 - protein, 66 aa, Glycine max
  Coding DNA Sequence Number=SeqID_77171
MEKTMKMRYNGGDSSSGMDNSGGADDGGGVGNGDSNGGGIDNNDNGWNSGNDNNNNDGGDILAIYH

SEQ ID NO: 193950 - protein, 88 aa, Glycine max
  Coding DNA Sequence Number=SeqID_77172
MVVMMVGMTVIGWWRNDVGENVVIATTMIVRVAETTVTNNNGGSSGDGSCGKNGGNGGANGDGDTSSGSDCQVEDGDDGSGGKNNGGS

SEQ ID NO: 193951 - protein, 134 aa, Glycine max
  Coding DNA Sequence Number=SeqID_77173
MVLQPTIRQEGNVRAHGCIFQGRKARGVATNVYSRKTLEKPERCGLRTLSVKGSGVVFMHGEGEKREVVADQLAQASWIASTRRHRLLLEHSRRPKWAWLLFAPLFSLNYATMLVSWVSKGANKVQGPTASTPG

SEQ ID NO: 193952 - protein, 65 aa, Glycine max
  Coding DNA Sequence Number=SeqID_77174
MMHAPDLNSQMQCGTYRIQYQGNSPKRVYTTPHLENHAVFVEATQSCTVTPPLGAQPGATRSSLP

SEQ ID NO: 193953 - protein, 54 aa, Glycine max
  Coding DNA Sequence Number=SeqID_77175
  Subcellular localization annotation: CTP_CleavageSite=30; ConfidenceScore=5.05e-01
MASFSQMQSQMQSQGLARPAEPLVGPSGPRVSTKGSCVDPPGNDLETGDSDRCG

SEQ ID NO: 193954 - protein, 82 aa, Glycine max
  Coding DNA Sequence Number=SeqID_77176
MKKQQLRRRRRGERRRHPLENKPLKEKFHHQDSVLDKKLREEASMEDCFTTRDPQSLNPFLEVRREEEISLERDRLNNGALK

SEQ ID NO: 193955 - protein, 146 aa, Glycine max
  Coding DNA Sequence Number=SeqID_77177
MIQQLLLGGPEDQGQGQLRLLSTAIAPHLASTSTAPPPARIAASHSTPSPEDFQCFEAMLRSIHQGQIILLQTWPGTQPPPHRDDKNPATQVPHQPADESSESSTPKPLIRKRRVVVTQEATTTPEKSPKATPEPPAPMADTTSPQ

SEQ ID NO: 193956 - protein, 55 aa, Glycine max
  Coding DNA Sequence Number=SeqID_77178
IKARTLSPVKNKGRTLSPVKDKVRTLSPMKDKVRTLSLVKDKVLTSSPVKQAKRY

SEQ ID NO: 193957 - protein, 85 aa, Glycine max
  Coding DNA Sequence Number=SeqID_77179
MGIKRSFKVVMGPRTRLVLSFKTRKGKQGSKGLSKELIQGKSIWLEAYKNKIASIISKYACELGSINKNQAKAIVQAINWAKHTK

SEQ ID NO: 193958 - protein, 103 aa, Glycine max
  Coding DNA Sequence Number=SeqID_77180
  Homolog annotation: Hit_ID=Q1SWC8; Match level="QueryCoverage=62%, HitCoverage=5%, E-value=3e-10, Identity=45%"; Hit description=RNA -directed DNA polymerase
MFLSETLAHANKVEEIKRTVGFNNCFVVDREDDKYGRVDHPSWLINGFKKVVLECNLVDIPMVGYPFTWLHSKGLGSSSSMEKEEREEMPLHGEDESRRTSPP

SEQ ID NO: 193959 - protein, 249 aa, Glycine max
  Coding DNA Sequence Number=SeqID_77181
  Homolog annotation: Hit_ID=Q2HVB5; Match level="QueryCoverage=28%, HitCoverage=27%, E-value=3e-15, Identity=59%"; Hit description =Ribosomal protein L25
MGIVPLQLQPKHGLGFNKSTYASEVSERASEVPQPLTHSAVVILRALRPEPFTYLDDFPRPDPNHDETILAIPRSASDKNISTKERRARRLWSIVFEQEDGQHSGKKHLIYPPSPFVAKSVAREDGIRECATTVRAANSNVLSGIGFSRPVFHHDGSWLVAYFTDAFDLAGSKGGGGSGNISALLTGVPRDVNKQLLHVTSGMTFSSKTIGGNLNSKVKSAVMKGSTLMKPTASLLAKQNQPHPIVSSR

SEQ ID NO: 193960 - protein, 91 aa, Glycine max
  Coding DNA Sequence Number=SeqID_77182
MEYSICYYHFQDQMMSPTPPPTFCIDADETKWEHNDMLHVDHFFKFLCFHRKPNVPGDRIHIIDFCFSWTQPMSSYFRFTTPVFEVVDHSI

SEQ ID NO: 193961 - protein, 104 aa, Glycine max
  Coding DNA Sequence Number=SeqID_77183
  Homolog annotation: Hit_ID=Q2PET6; Match level="QueryCoverage=26%, HitCoverage=6%, E-value=4e-07, Identity=92%"; Hit description =Putative beta-galactosidase
  Subcellular localization annotation: CTP_CleavageSite=35; ConfidenceScore=5.02e-01
MSQNFMDYATIPFFFLLPKCYGTSRIVQRCLLLISGMSRNFTDCLTMGVKFLEAVKRRLHAIKQWSPDKIRTARGPFYDFVGAGLTSVKIKGLNNGTIDLSSYV

SEQ ID NO: 193962 - protein, 63 aa, Glycine max
  Coding DNA Sequence Number=SeqID_77184
MNCKGCEFHNGSVKKFAILLLIWKTLHLVSVYLMAPKGFGKKEELLLLGNHIEKEVREEKQVP

SEQ ID NO: 193963 - protein, 76 aa, Glycine max
  Coding DNA Sequence Number=SeqID_77185
MALLVEKTTQVVPQDEERLVGVSVLKFDVDSTILACIAFSCPNLAFLEISVSDPAVNRISRVLGRSHEHFTKHQVH

SEQ ID NO: 193964 - protein, 206 aa, Glycine max
  Coding DNA Sequence Number=SeqID_77186
  Gene Ontology: Mol. function=RNA-directed DNA polymerase activity; Cellular component=intracellular; Biological process=RNA-dependent DNA replication
MVEEQNDKTTLTPNEDIPVKDLSEKRDGGGKKEVLLEEAREFLRIIQQSEFKVIEQLNKTPARVSLLELIMSSEPHWALLVKVLNEAHVAQDISVEGFGGLVNNIITNNYLAFAEEEIPVEGRGHIRALHVLVKCMDHVMAKVLIDNGSSLNVMPKSTLEKLPFNASHLKSSSMVVRAFDGTRREVRGEIDLPVQIGSHTCQVTFQ

SEQ ID NO: 193965 - protein, 86 aa, Glycine max
  Coding DNA Sequence Number=SeqID_77187
MDAMILIEVREPLTRRLLFQQQQNEENIRATPSPPHTSLIKTRAPIVVAPRLLKPKDRPWHVCKSVPLRLLYMPPTVSDIYARAHY

SEQ ID NO: 193966 - protein, 96 aa, Glycine max
  Coding DNA Sequence Number=SeqID_77188
MWVQLHASTTSLKTYRVVTGVRSVEKIRNAETIWQLAMKGNCKLCGREEGTSWRMSVRVMKGGSAAFDLFVGPTSGGDTHRLGWRQCLTTSLVVPM

SEQ ID NO: 193967 - protein, 51 aa, Glycine max
  Coding DNA Sequence Number=SeqID_77189
MECRGAHSGELSSPRILGCLAAALSVCPELGKGRRLIGRDPSLYLHPSLST

SEQ ID NO: 193968 - protein, 85 aa, Glycine max
  Coding DNA Sequence Number=SeqID_77190
TVAVFFAAHKSTSFSSIVVLRRIVFKWGIFCGSNDFQDYLDDAKESRVKKVPKNQESKSFKNQVSKNQDSRIIKFQESRFKNNQD

SEQ ID NO: 193969 - protein, 76 aa, Glycine max
  Coding DNA Sequence Number=SeqID_77191
MASFSQMQSQLQSQMQSQGLALPPEHLVGPSGPRVGVEEVKDPDALVPVPTDEVSLVGQAIHTFLACPAHLVKSLS

SEQ ID NO: 193970 - protein, 59 aa, Glycine max
  Coding DNA Sequence Number=SeqID_77192
MKEKDQRTFRPDKFSARSFSTGDIPPHMNKEEKTETPSFLSKNTTLEKILLVRDRAFDL

SEQ ID NO: 193971 - protein, 125 aa, Glycine max
  Coding DNA Sequence Number=SeqID_77193
MEASGNRLPVYVIDYTEEWVIGNRLRDEPVRTLQRTVEWILPTPTPYRLVEPVQVIEVTSSEEDPEEDPEELPPEPAVDALDFLEGDEDPLPEVDSPEEVMSASEADSTEDSGPREMATSGGSSS

SEQ ID NO: 193972 - protein, 152 aa, Glycine max
  Coding DNA Sequence Number=SeqID_77194
MIMGGQDIYSSQDEATTSPSSSKSEEAKWEESSEEIYPQEEGQPLMVKEECKEVSVFSKRFQSSFRAQNFMLFSPSPFIHLLLPPSSHPWPPMVWCLLSLFLSPFHCHSSSKKQRNLLMKKILGLQVPMELTSRSRVEKREVRLRFLHKCQC

SEQ ID NO: 193973 - protein, 95 aa, Glycine max
  Coding DNA Sequence Number=SeqID_77195
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=95%, HitCoverage=18%, E-value=1e-37, Identity=89%"; Hit description=ATP synthase subunit alpha
  Pfam annotation: Domain name=ATP-synt_ab_N; Domain location=2-70; Score=71.6; E_value=2.4e-18; Accession=PF02874.13; Description=ATP synthase alphabeta family, beta-barrel domain
MVTIRAGTVLQVGDDIARIYGLDEVMTGELVEFEEGTIGIALNLESKNVGVVLMGDGLMIQEGSSVKATRRIAQILVSEAYLGRVINALAKPIDG

SEQ ID NO: 193974 - protein, 317 aa, Glycine max
  Coding DNA Sequence Number=SeqID_77196
NVEEQGEGQGIGPSSPQGSSQRSSSEEHFSDEEAIQEAEAGGSDIFPASSTSKLSASIGIAEDTFIQMQDEDPAAALRLLLNTSQANTSSEKNPGASSSSDADITSTVRQDCLLLKLSMEYARADVLKSIEENPSAAFGHLNFLKKLHNPLTSDEILGKVIQIESIIDQFANTVQKKRENGARLDAQKQAHILLLEKARAAQREVERLTKEAKEGSSEIKACDDNISSWEATITNLLSQVDDLRQKIVTEQAKRKELQEKAADSIQKLVAEKGREGLKAFSASQAVADEARAMESADQVLSKEMATLKKLYEDLIMT

SEQ ID NO: 193975 - protein, 35 aa, Glycine max
  Coding DNA Sequence Number=SeqID_77197
MNSTEWKKVSLKEQGHNCYLAKMPTQHNFTPCTHD

SEQ ID NO: 193976 - protein, 119 aa, Glycine max
  Coding DNA Sequence Number=SeqID_77198
MYPFISMKLPFYPELVKALYSNLEIQEDFLISEVYGIKMVIDQSLFFDLTQLSSDGVPFENSLDDELKFDFSVSDAHRLVCTNQADMTGRLLVGSLALESRILHYLIVRILLPRSSNLA

SEQ ID NO: 193977 - protein, 98 aa, Glycine max
  Coding DNA Sequence Number=SeqID_77199
MALAVRVNPLNIHDISYNGLIVVFYCPSIKGKTLGEAMSSNQAREIPEPDSVTAELIAIYQFPEFSSEPRRPGMPSRSLFLSVSVSAKLASASPKPSF

SEQ ID NO: 193978 - protein, 74 aa, Glycine max
  Coding DNA Sequence Number=SeqID_77200
MRSYLMVIRTFREPGENKPVDARRLTLSSAPFVVLTLEVRLPYGYPHLSSTRGKRACLCAETNIVFCTFCRPDP

SEQ ID NO: 193979 - protein, 382 aa, Glycine max
  Coding DNA Sequence Number=SeqID_77201
  Homolog annotation: Hit_ID=Q9M461; Match level="QueryCoverage=18%, HitCoverage=7%, E-value=6e-22, Identity=78%"; Hit description=Plasma membrane H+ ATPase
  Pfam annotation: Domain name=E1-E2_ATPase; Domain location=2-196; Score=-88.1; E_value=0.00022; Accession=PF00122.10; Description=E1 -E2 ATPase
FLEIGRWTEQDAAILVPRDIISIKLRDIIHADARLLEGDALSVDQSSLTGESLPVTKNLSEEVFSGSTVKKVGIIIEPMWLMADGGSWRKVAVLGRLLRSRRRRSRHGSSLLAAVCSGSRAAGSEAGCRGRGWFRGRAVLKLRGLQQRSESPTPTADKKKNSAIFRLPATSAMAAMAMAAAMAPPSLTRHATAIRWRFFRKPLRNSAMAPPWPPFNNTDVVAGTMRGHVLANLKLGTAHDTNSVRSMLHDEVVVCDLGVGIRGREKPEENLSLFNVDVRVHALTPKGVCRLEEWHDMDALMVESTLQVKSIDAFMNNVALRGGRRGRKQWSCLTKNLRYCLHQHHHRFRVEVQGKGRVALNHEGEGKGARVKDIFVHSLFLW

SEQ ID NO: 193980 - protein, 97 aa, Glycine max
  Coding DNA Sequence Number=SeqID_77202
MDFLGLRSEIENENPDLTFQLSKPHSFSTHGTTFSLSNPRRLAKLPIISPKTPYPRKSREKEVHPNLKFRSPTRRDALHDSENALLSRFGAEMGTKG

SEQ ID NO: 193981 - protein, 62 aa, Glycine max
  Coding DNA Sequence Number=SeqID_77203
  Homolog annotation: Hit_ID=Q10PB0; Match level="QueryCoverage=69%, HitCoverage=34%, E-value=2e-12, Identity=72%"; Hit description =Expressed protein
MKYGIGVEILLDIQSSEECNTVCYSMSSLLVYQPHLQVSEGNPESGGSGEENQGPVDSFSHD

SEQ ID NO: 193982 - protein, 301 aa, Glycine max
  Coding DNA Sequence Number=SeqID_77204
NILPEKKVKLYHTEFDVFKTELERHNLHKRLTNLVDGSIDVALVKEFYANLYSSEGPSPKQARFRGHLVKIDADSLNTFLETPVVWHKDPEEGLDDFSPVSHMDMNIRALIYGQMTSIAQNNSSRFGFPALITALCRARGVVSDSLTFERLSPVVAPPGSIPSIEQFLEMVTWPGAQPSLHREYEGPTAQVPQHVEDASSKVTVPEPFIVEEEAGETQVRQEAAATPERSREVTSNPPTLVVDLSSPQHAADPSTPILEIPEDPTTPVLTLNTSPLATPVLHLIDEEDVQTRDTQDQSQEF

SEQ ID NO: 193983 - protein, 182 aa, Glycine max
  Coding DNA Sequence Number=SeqID_77205
  Subcellular localization annotation: CTP_CleavageSite=57; ConfidenceScore=5.66e-01
MIYNRHLLSSATNLYKLTHQFSLLSRAYSFVSPPPFTQKFTFLSPPWRFPSTPRLCNGSNLVGMRIMRCYCHDSGGAKEWTEEIEYLDESGGVIYKGKGVRSVEPGVDDHVMVGEVKKPFVNALAVAKIVEVVKRWKWGPELDTQLDKLQFVPNMTHIAQALKVVGDVDACLSLFRWAKRQA

SEQ ID NO: 193984 - protein, 50 aa, Glycine max
  Coding DNA Sequence Number=SeqID_77206
  Homolog annotation: Hit_ID=Q01G74; Match level="QueryCoverage=75%, HitCoverage=6%, E-value=4e-07, Identity=56%"; Hit description =Homology to unknown gene
GKEAPIISEEDPHSVLCGMSELFRLANGGADEQLQEGQAAWTNHKAPQLH

SEQ ID NO: 193985 - protein, 381 aa, Glycine max
  Coding DNA Sequence Number=SeqID_77207
  Gene Ontology: Mol. function=helicase activity; Cellular component =mitochondrion; Biological process=embryonic development ending in seed dormancy
  Homolog annotation: Hit_ID=Q9FNL2; Match level="QueryCoverage=99%, HitCoverage=80%, E-value=1e-31, Identity=25%"; Hit description=Salt -inducible protein-like
  Pfam annotation: Domain name=PPR; Domain location=102-136; Score =24.2; E_value=0.00047; Accession=PF01535.11; Description=PPR repeat
  Pfam annotation: Domain name=PPR; Domain location=137-171; Score=5.0; E_value=1.9; Accession=PF01535.11; Description=PPR repeat
  Pfam annotation: Domain name=PPR; Domain location=176-210; Score =33.9; E_value=5.4e-07; Accession=PF01535.11; Description=PPR repeat
  Pfam annotation: Domain name=PPR; Domain location=247-281; Score =26.5; E_value=9.4e-05; Accession=PF01535.11; Description=PPR repeat
  Pfam annotation: Domain name=PPR; Domain location=31-64; Score=14.2; E_value=0.15; Accession=PF01535.11; Description=PPR repeat
  Pfam annotation: Domain name=PPR; Domain location=318-352; Score=2.0; E_value=4.3; Accession=PF01535.11; Description=PPR repeat
  Pfam annotation: Domain name=PPR; Domain location=66-100; Score=4.2; E_value=2.4; Accession=PF01535.11; Description=PPR repeat
  Pfam module annotation: Pfam domain module=PPR::PPR::PPR::PPR::PPR::PP R::PPR; Domain location=102-136::137-171::176-210::247-281::31 -64::318-352::66-100
MISILGTSGRLNEMRDVIEQMKEDSCECKDSVFVSVIKTYANAGLVDEAISLYKSIPRFNCVNWTESFNTMLQIMVKENRLEIAHRLFVESSCGWEVRSLVRALNLLMYALCQKSRSDLALQLFQEMDYQSCYPNRDSYAILMKGLCQDRRLHEATHLLYSMFWRISQKGNGEDIVVYRTLLDALCDAGKFEEAEEILGKILRKGLKAPKRCHSRLDLDQLSDGKDIESAKRMIHEALIKGSVPSLASYNAMAVDLYSEGKIDEADKVIIEMQVRGFKPTHSIFEAKVAALCKVSKVDEAIKVIEEDMVKVNCLPTAKVYNILLKNLCNVGNSTAILESLNKMSSKVGCTGDRDTYSILLEMLCGERRYLEASQLLEKNVH

SEQ ID NO: 193986 - protein, 44 aa, Glycine max
  Coding DNA Sequence Number=SeqID_77208
PKSKAPARWIVVKYFNETRPLEPERLKAFRIQWTQYYLRVRAES

SEQ ID NO: 193987 - protein, 275 aa, Glycine max
  Coding DNA Sequence Number=SeqID_77209
MAWSHDYLKEKEKQRTLRALSICKGSAFFIMHILLLALILKGVNKIKSYGVHFRLKLRHTVNNEILIYPGYVPVPGVKYRVFHYGLRFSVGNWSFDKADWRNVDVVNKCWAKFPDPPDSSPVDPANNEDLQRDLLSIECAKMLNEALNLHHQKRCSSDNSLSTSKEEEKKEEGGVSRVSNIDANDDSISNNISTNRLEESTDVRKDEVPSSFRFWVICLWAFSGVGFLVVIFVVYSGHRRRGTRLKHGRRRRSLHTGFMETNGRDRHSRGVEVPL

SEQ ID NO: 193988 - protein, 517 aa, Glycine max
  Coding DNA Sequence Number=SeqID_77210
  Homolog annotation: Hit_ID=Q01G74; Match level="QueryCoverage=98%, HitCoverage=51%, E-value=3e-44, Identity=43%"; Hit description =Homology to unknown gene
METKYPAINKPAGVVHWLKHSKEAKNVDWVVILDADMIIRGPIIPWELGAEKGRPVAAYYGYLIGCDNSLAKLHTKHPELCDKVGGLLAFHIDDLRVFAPLWLSKTEEVREDRAHWATNITGDIYGKGWISEMYGYSFGAAEVGLRHKINDNLMIYPGYVPREGIEPILLHYGLPFSVGNWSFNKLAHHDDGIVYECNQLFPEPPYPKEVRQLELDPNRRRGLFLSLECINIINEGLLLQHAANGCPKPTWSKYLSFLKSKAYAELTQPKYVNPATLQMMEDIKEEHVDDGAGKPHPKIHTIFSTECTTYFDWQTVGLMHSFRRSGQPGNITRLLSCSDEDLQQYKGHDLAPTHYVPSMSRHPLTGDWYPAINKPAAVLHWLNHVNIDAEFIVILDADMILRGPITPWEFKAARGRPVSTPYDYLIGCDNELAKLHTSHPEACDKVGGVIIMHIDDLRKFAMLWLHKTEEVRADRAHYARNITGDIYESGWISEMYGYSFGAAEEELNFMNLGYGLL

SEQ ID NO: 193989 - protein, 92 aa, Glycine max
  Coding DNA Sequence Number=SeqID_77211
  Homolog annotation: Hit_ID=Q1RUA5; Match level="QueryCoverage=43%, HitCoverage=15%, E-value=2e-10, Identity=75%"; Hit description =Annexin, type V
MKLNCLISWKLDRNQDAVAPKQKELLQYVEGATSENSEVMLAGCHYRQAKHLQDMGQMRKRCYWYWDTGMLNKGRKSEKLIGSFTMNRSLII

SEQ ID NO: 193990 - protein, 153 aa, Glycine max
  Coding DNA Sequence Number=SeqID_77212
MSIWPPPKPWNEKPRGPERKNTTETSSKGLYGATIDSLHGEGSMGMGSNTITKRAPRHPYQTRSKSRAMGDVEEVQEQMKAYMLALKDQMASMMEAMLDMKRLIESNMVTTTATEADPVLPSTANLAHQLAPDMVGRGRDTLGNTSSPHLGYN

SEQ ID NO: 193991 - protein, 134 aa, Glycine max
  Coding DNA Sequence Number=SeqID_77213
MGAHSRDEKLLMHFFQDSLAGAAVVWYTNLEASRIPSWKDLITTFIRQYQYNTDMTPDRTRLQNMSKREHESFKEYAQRWRDLAAQVAPPIVEREMITAGFLLLLLFVPLFLRSNIFKGNLVCRKAHRIVNLNY

SEQ ID NO: 193992 - protein, 79 aa, Glycine max
  Coding DNA Sequence Number=SeqID_77214
MWFCIYNYKYKSLAVERGIKERTGITFTVQNQNLNPTGPGLSKAEERVTKVASNCSESCLGAPLSPIPVCLQNLFSKCK

SEQ ID NO: 193993 - protein, 134 aa, Glycine max
  Coding DNA Sequence Number=SeqID_77215
MWMNTDCDQRFEERSKVLLYCEILYTYIQEQVFMRLRSKFDDKASPLYPSSTLVPYSSPCIACQHLNLKTLTTFPFLIQATASNYCLLVILVFRKLPEEVQFYYIPTVLDKLFLFGILELAHEVLYDSYPPTTF

SEQ ID NO: 193994 - protein, 73 aa, Glycine max
  Coding DNA Sequence Number=SeqID_77216
  Gene Ontology: Cellular component=membrane
  Homolog annotation: Hit_ID=Q9FM19; Match level="QueryCoverage=82%, HitCoverage=21%, E-value=5e-23, Identity=88%"; Hit description =Hypersensitive-induced response protein
MNEINAVNVPGTTAKDVMDMVLATQYFDTMKEIGAASKSSPVFIPHGPGAVRDVAGQIREELLQASHLASTPP

SEQ ID NO: 193995 - protein, 219 aa, Glycine max
  Coding DNA Sequence Number=SeqID_77217
  Gene Ontology: Mol. function=voltage-gated ion-selective channel activity; Cellular component=mitochondrial outer membrane; Biological process=anion transport
  Homolog annotation: Hit_ID=Q4PKP6; Match level="QueryCoverage=83%, HitCoverage=64%, E-value=7e-40, Identity=46%"; Hit description =Mitochrondrial voltage-dependent anion-selective channel
  Pfam annotation: Domain name=Porin_3; Domain location=1-200; Score =0.0; E_value=4.7e-08; Accession=PF01459.12; Description=Eukaryotic porin
MSDFSAFAAASITVDELVPGFKSLFKCTIPDSGKVELQHLSNYTGITGCIGLEGNLEKGYDPVLNLSGLVGTNILSLGGNVALDLPTRTISKLNAGLGLNTDFLVASLTMHDSFDIVKASCYHEVNPLTKTAIAAELNHSLSMGETSATVGAQHAFLPQTLVKARFDTFGRAGALIQQGFWERCFVTMAGEVEFNTSDNNLHPKMVAAVLLLFFTSLDT

SEQ ID NO: 193996 - protein, 1024 aa, Glycine max
  Coding DNA Sequence Number=SeqID_77218
  Gene Ontology: Mol. function=transferase activity; Biological process= response to oxidative stress
  Homolog annotation: Hit_ID=Q9FJG3; Match level="QueryCoverage=98%, HitCoverage=99%, E-value=0.0, Identity=46%"; Hit description =Phosphoribosylanthranilate transferase-like protein
  Pfam annotation: Domain name=C2; Domain location=15-104; Score=103.6; E_value=5.8e-28; Accession=PF00168.20; Description=C2 domain
  Pfam annotation: Domain name=C2; Domain location=296-378; Score=22.1; E_value=0.0021; Accession=PF00168.20; Description=C2 domain
  Pfam annotation: Domain name=C2; Domain location=458-544; Score=21.8; E_value=0.0025; Accession=PF00168.20; Description=C2 domain
  Pfam annotation: Domain name=C2; Domain location=613-705; Score=81.8; E_value=2.1e-21; Accession=PF00168.20; Description=C2 domain
  Pfam annotation: Domain name=PRT_C; Domain location=869-1024; Score =372.8; E_value=5.4e-109; Accession=PF08372.1; Description=Plant phosphoribosyltransferase C-terminal
  Pfam module annotation: Pfam domain module=C2::C2::C2::C2::PRT_C; Domain location=15-104::296-378::458-544::613-705::869-1024
MTTPFQQPPQTVRRLVVEVVDARNLLPKDGQGSSSPYVVADFDGQRKRTTTRFKELNPVWNEPLEFIVSDPENMEFEELEVEVYNDKKFGNGSGRKNHFLGRVKLYGTQFSRRGEEALVYYTLEKRSVFSWIRGEIGLRIYYYDEMLMEEEKPPPPPQQQQEEQGERTEQDRNKPPPGVVVVEEGRVFEAPGAMEQCVPLPSGPPHSPRVVVVAESPPPVVHVSQDPPLAEMCEPPASEMQFHPEVRKMQANRGNRVKILKRPNGDYLPKDISGKKTGNESERVHPFDLVEPMQYLFVKIWKARGLAPPSEGPIVRVRMSSQSRRSNPASYRPSEPPDSPEWNQTFALSYNNTNDANSATLEISVWDSPTENFLGGVCFDLSDVPVRDPPDSPLAPQWYRLEGGTADQNPGRVSGDIQLSVWIGTQSDDAFPEAWISDAPYVAHTRSKVYQSPKLWYLRVTVVEAQDLNIAPNLPPLTAPEVRVKVELGFQSQRTRRGSMNHRSLSFHWNEDLLFVAGEPLEDSVIVLLEDRTTKEPALLGHIVIPLSSIEQRIDERHVAAKWFTLEGGPYCGRVQMRLCLEGGYHVLDEAAHVCSDFRPTAKQLWKPAVGILELGILGARGLLPMKSKGGGKGSTDAYCVAKYGKKWVRTRTVTDTFDPRWNEQYTWQVYDPCTVLTVGVFDNWRMFADVSEDHRPDCRIGKVRIRVSTLESNRIYTNSYPLLVLTRTGLKKMGEIELAVRFACPSLLPDTCAVYAQPLLPRMHYLRPLGVAQQEALRGASTKMVAQWLARSEPPLGHEVVRYMLDADSHVWSMRKSKANWFRIVAVLAWAVGLAKWLDDIRRWKNPVTTVLLHILYLVLVWYPDLIVPTAFLYVVLIGIWYYRFRPKIPAGMDTRLSQAEAVDPDELDEEFDTMPSSKPPDVIRMRYDRLRMLAARVQTVLGDFATQGERLQALVSWRDPRATKLFIGVCLTITVALYAMPPKMVAVALGFYYLRHPMFRNPMPSATLNFFRRLPSLSDRLM

SEQ ID NO: 193997 - protein, 117 aa, Glycine max
  Coding DNA Sequence Number=SeqID_77219
  Homolog annotation: Hit_ID=Q1SAI8; Match level="QueryCoverage=31%, HitCoverage=2%, E-value=3e-10, Identity=78%"; Hit description =Integrase, catalytic region
MATTTPPTQIDIEAVMHILRLNPSNANWYMDTGATSHMTSEQADGDNGDDNNGDSGSGNNVNGDGNVGGDSGDDSSANDRDDNDSVSGIDSDSNVGDNNGGVVVIVIVIANYDGDNK

SEQ ID NO: 193998 - protein, 556 aa, Glycine max
  Coding DNA Sequence Number=SeqID_77220
  Gene Ontology: Mol. function=transporter activity; Cellular component= membrane; Biological process=oligopeptide transport
  Homolog annotation: Hit_ID=Q9CAR8; Match level="QueryCoverage=96%, HitCoverage=90%, E-value=1e-177, Identity=58%"; Hit description =Nitrate transporter (NTL1); 53025-56402
  Pfam annotation: Domain name=MFS_1; Domain location=10-494; Score =0.8; E_value=0.00029; Accession=PF07690.6; Description=Major Facilitator Superfamily
  Pfam annotation: Domain name=PTR2; Domain location=69-482; Score =382.3; E_value=7.4e-112; Accession=PF00854.12; Description=POT family
  Pfam module annotation: Pfam domain module=MFS_1::PTR2; Domain location=10-494::69-482
MKGSKKDRAAEVLENLAFLANASNLVLYLSKFMHFSPSTSANIVTNFMGTAFLLAILGGFLADAFITTYSLYLISAGIEFMGLLMLTIQAHKPSLKPPNCVIGNTDSPCDKIHGADAVMLFAGLYLVALGVGGIKGSLPPHGAEQFDENTPEGRKQRSAFFNYFVFSLSCGALIAVTFVVWIEDNKGWKWGLVVSTASILLSIPVFILGSHKYRTKIPAGSPITSMFKVLVAAICNNCKAKNSTNAVRSMTTSPSHATEREDGEEESKTTKEVVQGQTLTENLKFLNKAVMEPAVHPMLECTVKEVEEVKIVTRILPIFMSTIMLNCCLAQLSTFSVQQSATMSTMLGSFKVPPASLPVFPVLFVMILAPLYNHIIVPFARKATKTEMGITHLQRIGTGLFLSIVAMAVAALVETKRKKTAFKFGLLDSAKPLPITFLWVALQYIFLGSADLFTLAGMMEFFFTEAPWSMRSLATALSWASLAMGYFLSTVLVSTINKVTGAFGHTPWLLGANLNHYHLERFYWLMCVLSGLNFVHFLFWANSYKYRCSTKPGYTS

SEQ ID NO: 193999 - protein, 178 aa, Glycine max
  Coding DNA Sequence Number=SeqID_77221
  Homolog annotation: Hit_ID=Q7X7K9; Match level="QueryCoverage=61%, HitCoverage=22%, E-value=4e-08, Identity=37%"; Hit description=WRKY transcription factor 33
  Pfam annotation: Domain name=WRKY; Domain location=128-174; Score =6.3; E_value=0.00012; Accession=PF03106.6; Description=WRKY DNA -binding domain
MEGCQPLAEQMQSSNDVAKTVKLPLPFDLNTIPKEDEEARPATSDETWLPDSESDDNFRPLQQPSSTPDAPVDIDDVEDRASIVEGGSDSGNRKRKRSLEESDKGTAGRSFHGETELTVRIGSKKEIDDDGYRWRKYGQKIMKGCLYPRYTVQLSLHSLHVQVCLYIFLYNMDDMMHM

SEQ ID NO: 194000 - protein, 399 aa, Glycine max
  Coding DNA Sequence Number=SeqID_77222
MTLLEVIKDASVNSKPLDSPLDYPIVLNPGGILPNLKPEVEDESSSSLIKPLIGWQISQTDAEIIDVSKKFFTQLKAKLKNTNNLDKGEFISSLNSYLENIRDKLGVVIGVDSSCSGYTRILIEKLGVFIGKDVAGLVLDGSVSLEIWEVVKALIVNGITEHSCYSDLVTKLVVKKRSDLLCLCIKHGFDLGSSEILTILRYFLSPSKDSYDSMVTVKKEWECQALLAIEKASDSNLKKKYLLIAKEASILLMMAYDGFSASEICLHYLFSSSNINDVMLSPSFSKLNSKELINLIRYLAKWLKKYERFPQAGPCPKASSVSVLGLNVCDWVPKLEDVIKCLGLVLDENFSSLVLHPQFHEELRSIEGVVSCLTVEAKFCHLMTDVVDKIKIEVKGENN

SEQ ID NO: 194001 - protein, 155 aa, Glycine max
  Coding DNA Sequence Number=SeqID_77223
  Homolog annotation: Hit_ID=Q1T4K9; Match level="QueryCoverage=84%, HitCoverage=55%, E-value=4e-38, Identity=58%"; Hit description=Heat shock protein Hsp20
  Pfam annotation: Domain name=HSP20; Domain location=29-122; Score =15.0; E_value=1.8e-05; Accession=PF00011.11; Description=Hsp20alpha crystallin family
MASARGTTRVGVRTRARTPVVEEIVPNSGWTEDSAGHYLLVDLPDFRKEEMKLQVNSYGRIVVSGERNLNEWKHVHFRLTFPAPLNSDMDKIAGKFDGGILYVTVPKQVTQQNKESETAKVGNGKVERAEEKDSHQHGNGEVERAAENDSHAPKC

SEQ ID NO: 194002 - protein, 235 aa, Glycine max
  Coding DNA Sequence Number=SeqID_77224
  Homolog annotation: Hit_ID=Q9LT22; Match level="QueryCoverage=96%, HitCoverage=20%, E-value=9e-63, Identity=58%"; Hit description =Genomic DNA, chromosome 3, P1 clone: MPN9
MLGKDKTATSLEEVDALPAIYATVLKFSSSAPYVSIPSYRIPFLLGEPYNKDSASQDASLSIVPVDVGNDSQEEEKYRAIVEIDLEPREPTPGIVDVHIETNAENSQIIQGQLQGITVGIEDMFLKAIVPTDIPEDEIPRYNFDLFNTLWEACGSSSSTGRETFQLKGGKGIAAISGTQSVKLLDVPATSLIQATERHLAHFVVGVHSVLLTMMKSMRRGLLAIVEKETWVVFLF

SEQ ID NO: 194003 - protein, 110 aa, Glycine max
  Coding DNA Sequence Number=SeqID_77225
  Homolog annotation: Hit_ID=Q1T4K8; Match level="QueryCoverage=56%, HitCoverage=14%, E-value=8e-08, Identity=59%"; Hit description =Pectate lyase, N-terminal; Pectolytic enzyme, Pectin lyase fold
MVSNLLYVVTGNKLKPSLFREKSGITHLSLWRTWDWRSEGDLMMNGTFFTESGKEAVIFSRQTSLQSLGHLHQGSLWLCWYSKMCSKQAMQDKQIQLTGHWKRDRFNSEQ

SEQ ID NO: 194004 - protein, 171 aa, Glycine max
  Coding DNA Sequence Number=SeqID_77226
MESKAWLKKAWVGHLQNLATFNRLEEELIWDGEEEIRPKYLGGDMKWSSEMHTSFRLVWIMCWCIPIHALDMESIKKIAESVGEVVEVDEEVEDLQRVDRARVLVKTPWSLLINHLVMTNINGEEFVVKIVEETCYSFRKYTCGKLNFLDSLEKISSRESEIGPDAAFVCS

SEQ ID NO: 194005 - protein, 502 aa, Glycine max
  Coding DNA Sequence Number=SeqID_77227
  Gene Ontology: Mol. function=molecular_function; Cellular component =nucleus; Biological process=biological_process
  Homolog annotation: Hit_ID=Q1T4K6; Match level="QueryCoverage=60%, HitCoverage=53%, E-value=1e-112, Identity=71%"; Hit description =Unnamed protein product; contains similarity to nuclear protein ZAP gene_id:MQB2.8-related
  Subcellular localization annotation: CTP_CleavageSite=36; ConfidenceScore=5.14e-01
MDRQWRPPPPPPPPNVCPACFHSHFPFCPPPSPFPYANPNFKRPRIDDNPISFSDDERRLKLIRDHGSHTYAPHPNHNGFPPPHNAQFRSSPHPSQRVPDGFHHIGAMQPQPPHQGNQHNFNGRVVHYPYPYPAPNDNNMEAPWFFKGQPQPPLPSSPPPPLPMEPSMNQLKTYFSPPKKPPSLFPVPEPHPMPQPYYPTAFPSEREPSKQQYLGDSQSFAINQLAAERPKVIDASRLFRHPHRASRPDHFVIILRGLPGSGKSYLAKMLRDLEVENGGDAPRIHSMDDYFMTEVEKVEDSEASKSSSSGRSKKLVTKKVMEYFYEPEMEEAYRSSMLKAFKKTVEEGVFTFIIVDDRNLRVADFSQFWATAKRGQSVTGQGHRSKMWRRSGYEVYILEATYKDPVGCAARNVHGFTQEDIEKMSKQWEEAPSLYLQLDVKSLFHGDDLKESRIQEREKRRGTTKVDMDMEDDLGDALLPVQGKEADKVVDPPFGEDASRML

SEQ ID NO: 194006 - protein, 84 aa, Glycine max
  Coding DNA Sequence Number=SeqID_77228
MGLVRCFLPGKQVQGTSTRFLKHKQEQDDNKMFGEQANAFYTFSVIVILLSTSFVKVTIVDSYLVFEFVVLVIRMYESNYGMRK

SEQ ID NO: 194007 - protein, 108 aa, Glycine max
  Coding DNA Sequence Number=SeqID_77229
MNAEGSSSSSIYKSPRSCEAMMEAASTWELAKNIGTSFGNEENELLSRMVVLDGRDKSEFKKLGRRRLKVWNREQFGDIQQKLKWVKEKLNELEKKGEDKDLTEVEIN

SEQ ID NO: 194008 - protein, 153 aa, Glycine max
  Coding DNA Sequence Number=SeqID_77230
  Gene Ontology: Mol. function=RNA-directed DNA polymerase activity; Biological process=RNA-dependent DNA replication
  Homolog annotation: Hit_ID=Q1S7B8; Match level="QueryCoverage=74%, HitCoverage=14%, E-value=4e-16, Identity=36%"; Hit description=RNA -directed DNA polymerase
EGQKKLAWVKWETICLPKEKGGLGVRDFASFNQALLDKWRWNLLHHIGDLWAKVLMLKYRGWKNLDEARRNHKELIWWRDLCFVCGSEGKGGWLNEGVKWKIGCRSQMGFEVGELWEWNFVWRRMMPEREMELVASFMEDIKELGVQPNQQDK

SEQ ID NO: 194009 - protein, 150 aa, Glycine max
  Coding DNA Sequence Number=SeqID_77231
  Gene Ontology: Mol. function=oxidoreductase activity; Cellular component=mitochondrion; Biological process=metabolic process
  Homolog annotation: Hit_ID=Q1T4K0; Match level="QueryCoverage=92%, HitCoverage=20%, E-value=3e-52, Identity=73%"; Hit description =Aldehyde dehydrogenase; Carbamoyl-phosphate synthase L chain, ATP- binding
MAITLNVLSSLSVQGKWAGSSNWNTVVDPLNGDSFIKVAEVDETGIQPFVESLSSCPKHGVHNPFKAPERTLGDFQMISLLGVNGTEVLILFGYLMFGEISAKAAHMLSLPKVSDFFTRLIQRVSPKSYQQAFGEVYVTQKFLENFCGDQ

SEQ ID NO: 194010 - protein, 65 aa, Glycine max
  Coding DNA Sequence Number=SeqID_77232
MEEEQLRQLAKEEDQTVKSTKTDELFIHSERAEERERAAYWELKGFFFSSSWLEVAIFDKNMCRK

SEQ ID NO: 194011 - protein, 61 aa, Glycine max
  Coding DNA Sequence Number=SeqID_77233
MKKILGNMHVGWVAGSVHQGSGGARDSQRMHGLRRELHRWHGGGWTVVEGVTCKFGVESNA

SEQ ID NO: 194012 - protein, 49 aa, Glycine max
  Coding DNA Sequence Number=SeqID_77234
MVKVFVDIRHFSCSEKLWGGGAEAPLLEKTGFYDDPLKPSMMVFNRLRK

SEQ ID NO: 194013 - protein, 322 aa, Glycine max
  Coding DNA Sequence Number=SeqID_77235
  Gene Ontology: Mol. function=nucleic acid binding; Cellular component= nucleus
  Homolog annotation: Hit_ID=Q9SWF9; Match level="QueryCoverage=90%, HitCoverage=82%, E-value=1e-148, Identity=68%"; Hit description=Zinc finger CCCH domain-containing protein ZFN-like
  Pfam annotation: Domain name=zf-CCCH; Domain location=124-150; Score =45.5; E_value=1.8e-10; Accession=PF00642.15; Description=Zinc finger C-x8-C-x5-C-x3-H type (and similar)
  Pfam annotation: Domain name=zf-CCCH; Domain location=276-302; Score =46.6; E_value=8.3e-11; Accession=PF00642.15; Description=Zinc finger C-x8-C-x5-C-x3-H type (and similar)
  Pfam annotation: Domain name=zf-CCCH; Domain location=54-80; Score =48.3; E_value=2.7e-11; Accession=PF00642.15; Description=Zinc finger C-x8-C-x5-C-x3-H type (and similar)
  Pfam annotation: Domain name=zf-CCCH; Domain location=85-104; Score =23.6; E_value=0.00069; Accession=PF00642.15; Description=Zinc finger C-x8-C-x5-C-x3-H type (and similar)
  Pfam module annotation: Pfam domain module=zf-CCCH::zf-CCCH::zf -CCCH::zf-CCCH; Domain location=124-150::276-302::54-80::85-104
MARVGEKEKTRVVVRFVGRRSFSFEEWGGGEDSLWMMNLRTGETMDSGSYPERPGEPDCSYYMRTGLCRFGATCRFNHPPNRKLYYLKTGTCKFGATCKFHHPKDQAGIAGRVALNILGYPLRPNEPECTYYLRTGQCKFGNTCKFHHPQPSNMMLSLRGSPVYPTVHSPTTPGQQSYAGGTYIPSPRWQGPSSYAPLILPQGVVSVPGWSAYSGQMGSISTSDSPQQAMRNGQTYGTSRQGELAGSQGAYSQFRSGTVPVGFYTLQRENIFPERPGQPECQFYMKTGDCKFGAVCRFHHPQERLVPAPNCVLSPIGLPLRP

SEQ ID NO: 194014 - protein, 79 aa, Glycine max
  Coding DNA Sequence Number=SeqID_77236
MRGPTRSKPTQPHLIWGRGQGSFQLTLLGLLLVDLNEGYFRSTSAKIIFSWPRSRLFSTSLVHDYFQATSIKTFLANLG

SEQ ID NO: 194015 - protein, 121 aa, Glycine max
  Coding DNA Sequence Number=SeqID_77237
MVMEYWRPWFWGHTDKYYVVKLSQLRLEFGATLGAANDKIIAIQITGTATKKGKVSSSFSSSTRTQKLGSIHTTFPQRFINSKAPTIVWDARDFCGFHLLLKHRSLSGTCHMALHVLHLSV

SEQ ID NO: 194016 - protein, 320 aa, Glycine max
  Coding DNA Sequence Number=SeqID_77238
  Homolog annotation: Hit_ID=Q5JLN0; Match level="QueryCoverage=93%, HitCoverage=72%, E-value=7e-89, Identity=49%"; Hit description =Lysine ketoglutarate reductase trans-splicing related 1-like
  Pfam annotation: Domain name=DUF707; Domain location=19-319; Score =398.3; E_value=1.1e-116; Accession=PF05212.3; Description=Protein of unknown function (DUF707)
MDTAVDADQNVIVDTVIDKCKNQCRPNGSEALPAGIVSTTSSLELRPLWNPPVTKKGHHKIELKVNASTNLFAMAVGIKQKDLVSKMVKKFIDSNFVVMLFHYDGIVDEWKDLEWSSLVIHVSAIDQSKWWFAKRFLHPDIVTEYDYIFLWDEDLGVEHFHPDKYVSIIKREGLEISQPALDPKKSEVHHQITARGRRSSVHRRTYKASNDGKGCDKSSTAPPCTGWIEMMAPVFSRAAWRCVWYMIQGDRTKNVGVVDAEYIVHYNRPTLGGIDNTMVSSQEKDHRVDVRRLSYQELDVFRKRWEKAVEEDKCWVDPFQ

SEQ ID NO: 194017 - protein, 98 aa, Glycine max
  Coding DNA Sequence Number=SeqID_77239
  Homolog annotation: Hit_ID=Q2R4R8; Match level="QueryCoverage=37%, HitCoverage=29%, E-value=8e-16, Identity=81%"; Hit description =Expressed protein
MAFKAITGFRGEGTKAKRSIGNVAIDGIATWRGQADPFGSTTAAMSMSMSRRGHLDKCFFLDSLELLEPEEGQGQVFPLKSESMKSDPSCLYSMLPTL

SEQ ID NO: 194018 - protein, 414 aa, Glycine max
  Coding DNA Sequence Number=SeqID_77240
  Gene Ontology: Mol. function=glutamyl-tRNA reductase activity; Biological process=tetrapyrrole biosynthetic process
  Homolog annotation: Hit_ID=Q2QM36; Match level="QueryCoverage=72%, HitCoverage=86%, E-value=1e-67, Identity=46%"; Hit description =Expressed protein
  Pfam annotation: Domain name=DUF266; Domain location=172-287; Score =175.0; E_value=1.9e-49; Accession=PF03267.4; Description=Arabidopsis protein of unknown function, DUF266
MLLSPNPLSLLCALLLCLPLAIVFTTNTTHTTTTTTPIILDIPMPLPKNITIHENLNKTSSLLSPSLNIQDDELHKVITREKRRPIGPNKKSLLTSLSVPLSSPSPSMWQENRHDALFKAAMRVNAKPTRPKKVAFMFLTNKPLPFAPLWESYFNQTTTSKNLFNIYVHADPTFPYHAPFSGVFFNRVIRSQPTRRFSPTLTAAARRLLAHALLDDTSNSLFVLLSPSCIPLHSLNFTYHALLRRGKSFVEILANEAVAYDRWAARGPHVMLPEVRLEEFRVGSQFWALTRRHARLVVSDRVLWPKFNVPCVRFDTCYPEENYFPTLLSMWDPQGCVPATLTHVNWTGRVDGHPRTYEAWEVGPELIRRMREDRPRYGDGNGDGRRDPFLFARKFAADALEPLMRISNGVIFRD

SEQ ID NO: 194019 - protein, 433 aa, Glycine max
  Coding DNA Sequence Number=SeqID_77241
  Gene Ontology: Cellular component=mitochondrion
  Homolog annotation: Hit_ID=Q2QM21; Match level="QueryCoverage=63%, HitCoverage=40%, E-value=6e-78, Identity=49%"; Hit description =Expressed protein
VSLSLLKLRNFHDDLPRAFVDKVTCLGEKNNGKVDDQVEQWSSYESDELSVCDSDDSSDESTTTTTSSSSSSSTSTAIHCNGSSVTRSERFVDSDTETFLDTMQRSWSMLPWNRSFEGWTFKRTSSSKREPLTSHSTHSMGPYFDHNKCTASGWENRELWSRDGKTKLKTNVFFASFDQRSKKACGESACTALAVCIAHWLHSNHNMPTRAQFDSLIKKGSSKWRKLSHSDHYLKLFPDKHFDLETILEANIRPLVVIPQNSYTGFFSPEKFKCLEGAMSFDDIWDEITRNDGVVDHEPRIYIVSWNDHFFVLKVEVDACYVIDTLGERLFEGCKKAFMLKFDGSSLMHAKGSKKGRGEIVCKGKECCKEFIKRFLAAIPLRQLEEEEQNKGTVYNPYFHRKLQIDFHYSLLSSLSSVSSIGEPLQPNYIARH

SEQ ID NO: 194020 - protein, 158 aa, Glycine max
  Coding DNA Sequence Number=SeqID_77242
  Gene Ontology: Mol. function=RNA-directed DNA polymerase activity; Biological process=RNA-dependent DNA replication
MKNEREVKEEFPDEQVLEVAERPWFANIANYKTTCCEGPLPSSYGNVYILVAVDYVSKWVEVIATPKNDARTTNGQAEVSNGKLKRILEKTVASSRKDWAVKLDDALWAYRTAYKTSIGLSPFQMVYGKAFHLRVELEHKAYWALRLLDFDESLSGEK

SEQ ID NO: 194021 - protein, 124 aa, Glycine max
  Coding DNA Sequence Number=SeqID_77243
  Gene Ontology: Mol. function=2-C-methyl-D-erythritol 2,4 -cyclodiphosphate synthase activity; Cellular component=chloroplast; Biological process=isoprenoid biosynthetic process
  Homolog annotation: Hit_ID=P62617; Match level="QueryCoverage=96%, HitCoverage=75%, E-value=3e-49, Identity=80%"; Hit description=2-C -methyl-D-erythritol 2,4-cyclodiphosphate synthase
MRLFLDQQGNRFAGDALTAPGEAELLGGGGLHVDVIHMALQIFRQENAHLRDVRRHFRRLGDNGDIEVTEAISFGADAFPGFAQQLAAVGAFERRIGIGEQFADIAQRRRAQQGVGRGVQRDVA

SEQ ID NO: 194022 - protein, 164 aa, Glycine max
  Coding DNA Sequence Number=SeqID_77244
  Homolog annotation: Hit_ID=Q9SU58; Match level="QueryCoverage=43%, HitCoverage=7%, E-value=2e-19, Identity=62%"; Hit description=ATPase 4, plasma membrane-type
  Pfam annotation: Domain name=Cation_ATPase_N; Domain location=1-74; Score=89.6; E_value=9.8e-24; Accession=PF00690.16; Description =Cation transporterATPase, N-terminus
MEENIPLEEVFQTLRCDSDGLTTKFAQERLVIFGHNKLEEKKESKVLKFLGFMWNPLSWVMEAATIMAIALANGRSIISGSSKHTIIGASKRSLLLEIMLKSVQFQRISIAKRGFSTLSVKKEFGRAPESKHHAKREISLLSELSIYCQAQCNIGTKPKSTYSR

SEQ ID NO: 194023 - protein, 108 aa, Glycine max
  Coding DNA Sequence Number=SeqID_77245
MTLLVSATGITGVLTSESDSPAPYQSPPQGILDIHFLHPPSTCVQNTKGKQGGKHAVTTEDNLHYIHINSMLGVAVRKLRSAIKMKHSECERDGNLEAEENRKNSRNF

SEQ ID NO: 194024 - protein, 717 aa, Glycine max
  Coding DNA Sequence Number=SeqID_77246
  Gene Ontology: Mol. function=chitin binding; Cellular component =integral to membrane; Biological process=viral reproduction
  Homolog annotation: Hit_ID=Q1T3Y0; Match level="QueryCoverage=11%, HitCoverage=11%, E-value=7e-22, Identity=64%"; Hit description =Targeting for Xklp2
  Pfam annotation: Domain name=TPX2; Domain location=559-619; Score =11.5; E_value=0.039; Accession=PF06886.2; Description=Targeting protein for Xklp2 (TPX2)
MGDSTCLMQQPFCYASGISNEASENNPIHALEQSISFGRFMSESLAWEKWSSFSHNRYVEEAERYSRPGSVAQKKAFFEAHYKKLAAQKAAALLEQANNEAQNNSTGQEDEGVIDNDNDTHNLQISPNSEMVVKEEQDAKVLSVTSDEHDVLVRLTASEHDSNSSVEASVTPESNKVEGAEAVMEEVAVVGSSMKVELQSHLEDVGAQKEESEKLSAIVTPPILTPIVKVSKSDQEVLASVGKKKPPVSSFKLSKANGTSYLTSTPVKSTAAISFKRDNIATPMSNKPANETSKFTTTPVKSTAAISFKRDNIVTPMSNTPANGTSVFTTTPVKSTAAITFKRDNIVTPMSNKPANGTSKFTTTPVKSTAAISFKRDNIVTPMSNKPANGTSKFTTTPVKSTAAISFKRDNIVTPMSNKPANGTSKFTTTPVKSTAAISFKRNNIVTPMSNKPATLSTADKKRSTPRSVNFTPIRELNRLTASVMRKFESTRAGAGSSKASKDNSTTLRTPTMASKEMQNQSSLTPLTEKKRNKTPLDLSSAPGNHTGGSKWRLLSGDIEAGKKASLRAQIQKLEEKFNANEAQKEQLHTKLKVGDQEKTETEIIRKLRQSFCFKARPLPDFYKERKTSTNETKKDPLTHFGTPKDGRKSTPSMAESKTSFPPNRPVLKNSGTKHFLGKSGRTLSHPLTSTSMIIPTHENTSPNIQNGYQTGRNLKY

SEQ ID NO: 194025 - protein, 707 aa, Glycine max
  Coding DNA Sequence Number=SeqID_77247
  Gene Ontology: Mol. function=RNA-directed DNA polymerase activity; Cellular component=chromatin; Biological process=chromatin assembly or disassembly
  Pfam annotation: Domain name=Chromo; Domain location=651-699; Score =21.4; E_value=0.0029; Accession=PF00385.14; Description='chromo' (CHRromatin Organisation MOdifier
  Pfam annotation: Domain name=rve; Domain location=382-538; Score =92.0; E_value=1.8e-24; Accession=PF00665.16; Description=Integrase core domain
  Pfam annotation: Domain name=zf-H2C2; Domain location=323-364; Score =9.9; E_value=0.017; Accession=PF09337.1; Description=His(2)-Cys(2) zinc finger
  Pfam module annotation: Pfam domain module=Chromo::rve::zf-H2C2; Domain location=651-699::382-538::323-364
MAFRTHHGHYEYLIMPFGLCNAPSTFQAIPGSNESPPCSVLTTEFYLKRTKCLFAQRELEYLGHVVSIKGVTPEPSKIKAIAQWPTPATAKELRAFLGLTGFYRKFMCQYATIASPLTSLLCKNVFEWSLESQEAFDKLKSAMINTPILALPNFHEPFLIEMDVSGTAMGVVLSQQGHPLAFFSKNFNPRLLNASTYVRELHAITSTVIQTPEQHYYLSKLLGFDYTIQYKTGATNIVADALSCRPPEPGQLLVLLVPQFDFLRDIQQALVSDPDFQALLTHVQENPSAYPQYRVHNGFLLFNNRIWLNKTNPYITSLLSKFHATPLGGHFEVAKTLHRIEASFFWQGLKQDVQKYLRECKVCQQNKTSTRRPEGLLQPLPAPVRVWEDISMDFITHLPPSNSFTVIMVVVDRYSKGVHLGALPIGFSAFKVAMLFVEIVCKHHGFLKSIVSDRDPVFLSAFWRELFRLSGTHLRLSTAYHPQTDGQTEVVNRVLEQYLRCFVNSQPSSWFRYLSLTEWCYNTSLHSSFGMTPFEVIYGKPPPTIPQYIPGLTRNEVVETLVQSRQDIHTQLQKRLKKVQDSMKKYADAGRDDVTFIVDQWVGEVAYRLDLSAEARIHPVFHFSLLRHHHGPPPSSTEPWTLEIIGQKPMQRPLCILDTKLDTSTSPPMQLVLVQWVGQPPEDTSWEPWLELRDAYHLEDKVVFEDR

SEQ ID NO: 194026 - protein, 136 aa, Glycine max
  Coding DNA Sequence Number=SeqID_77248
MEASSSPQSTTPPLILEEPVVFIHPPIFEEPQTVKKEPPRVTLGDYSSSTMPQFTSIKRPNDEVEEKFLKNYFPGSKTTKGKTDISSFHQFLDEFLSEALDCFHGLLRKTPTHGFSEPVQVNMFVDRPMKYSFHVL

SEQ ID NO: 194027 - protein, 219 aa, Glycine max
  Coding DNA Sequence Number=SeqID_77249
MAYDMSISFFQNLNLFFPHEYFYIRTQLSFPAKVFFCQAKSGIDGSLNLEVVSPTLLAAEKEEAKAVLTLFLKKQGLSNSVAARTINKSDLFIDHLVSKLHSKHKSWYLAGRELTTLEIRDSLIPYLESLFEEHGDLLVDVVENYPNPPVKDKSDVPVPPSSPVLDSKKLKAVSRVSAMDPDGGNLRPHIVYLMELGMDIEQIRSITRRFPSFAYYSLE

SEQ ID NO: 194028 - protein, 90 aa, Glycine max
  Coding DNA Sequence Number=SeqID_77250
MWKMTTFTGDTQTASGTGEFGVLEGTANTIGDIGIHGNRQSNWEVATAIGELRASCNSHWRVRAEGIVIPDGDLGPLYTRKLFQCYCVFT

SEQ ID NO: 194029 - protein, 153 aa, Glycine max
  Coding DNA Sequence Number=SeqID_77251
MGKGSLRRRLPEDPLRVLSELPEEVVPEKFRKKCSSERNQRSSGRTLLPEHLFHKVSGRSSSSGRIPEEGFFRMTFEIFGSRIIGRDRQDDHDDVPERRRPTALARRQQVHQMTQDIPDMTEDVPDMAEDAPEMTADVQGHDGAEGSHADGFP

SEQ ID NO: 194030 - protein, 81 aa, Glycine max
  Coding DNA Sequence Number=SeqID_77252
CFVRVARSLLYPLGGGALFMVVPRQMTVVTVVGLTINSGVLDAILPRKGPVTRAMSKRLQEDWARAAEEGPRVLMNLKVDF

SEQ ID NO: 194031 - protein, 94 aa, Glycine max
  Coding DNA Sequence Number=SeqID_77253
  Subcellular localization annotation: CTP_CleavageSite=70; ConfidenceScore=5.05e-01
MRVMSLACFFVLLLVLLLLQLQSFSTAATTNESAKFQNFESGSMPKPSSFQEAKQGFRQNSGEGGSEAVLGEEKRKIYTGSSGAVHKNVAFSYK

SEQ ID NO: 194032 - protein, 178 aa, Glycine max
  Coding DNA Sequence Number=SeqID_77254
  Homolog annotation: Hit_ID=Q6K5F5; Match level="QueryCoverage=94%, HitCoverage=62%, E-value=1e-51, Identity=56%"; Hit description =Mitochondrial transcription termination factor-like protein
  Pfam annotation: Domain name=mTERF; Domain location=1-166; Score= -77.9; E_value=0.0048; Accession=PF02536.5; Description=mTERF
MESIDFLHEFGLSEESIGKILTRCPNIVSYSVEDNLRPTANYFCSLGVDVGILLFRCPQNFGLSIEANLKPITTFFLERGYTLEEIGTMISRYGALYTFSLTENLIPKWDFFLTSGYQKSDLVKFPQYFGYSLEERIKPRFVIMKKSGVKLLLNQVLSLSSSNFEEALKKKMKKMQNG

SEQ ID NO: 194033 - protein, 70 aa, Glycine max
  Coding DNA Sequence Number=SeqID_77255
  Gene Ontology: Mol. function=oxidoreductase activity; Cellular component=cytoplasm; Biological process=alcohol metabolic process
  Homolog annotation: Hit_ID=Q8LJR2; Match level="QueryCoverage=88%, HitCoverage=17%, E-value=4e-30, Identity=98%"; Hit description =Alcohol dehydrogenase 1
  Pfam annotation: Domain name=ADH_N; Domain location=26-70; Score= -21.9; E_value=0.071; Accession=PF08240.2; Description=Alcohol dehydrogenase GroES-like domain
MRAAAVAWEAGKPLSIETIEVAPPQKGEVRLRILFNSLCRSDVYWWDAKDQTPLFPRILGHEASGYVTFG

SEQ ID NO: 194034 - protein, 151 aa, Glycine max
  Coding DNA Sequence Number=SeqID_77256
  Gene Ontology: Cellular component=integral to membrane; Biological process=transport
  Homolog annotation: Hit_ID=P57758; Match level="QueryCoverage=50%, HitCoverage=28%, E-value=2e-12, Identity=49%"; Hit description =Cystinosin homolog
MVSWNSFPLEVIYQMIPVAANDVAFSIHSVILNLIILSQISMFERGNQKFSNYAIAIVVVVWFSVAVCFFIALHSQSWLWLISIFNLISIVSFSMNHMSLRFPNLFQRDEMLIMCGKQLYCSTIQAVMILIKYFPQHVWYGVLDMLFHVYS

SEQ ID NO: 194035 - protein, 82 aa, Glycine max
  Coding DNA Sequence Number=SeqID_77257
MSNPSCTTFNFGFAFSPELQFLGKGNSSGYSHGACNGMKQRHQEDCYYCEWRMSENEGGALQLQDNKEETWEGKENSVTLTP

SEQ ID NO: 194036 - protein, 120 aa, Glycine max
  Coding DNA Sequence Number=SeqID_77258
  Gene Ontology: Mol. function=hydrolase activity; Biological process =aromatic compound metabolic process
  Homolog annotation: Hit_ID=Q9FX41; Match level="QueryCoverage=92%, HitCoverage=29%, E-value=8e-37, Identity=69%"; Hit description =Lysophospholipase homolog, putative
MDFHVSAMDTQQALLDPKVVASIVGATFTSPAVGVEPSHPILVALAPIVSFLLPTYQCNSAYKKGLPVSRDPDALIAKYSDPLVCTGSLRVRTGYEILRTTSYLQQNLRKLRVSISSSPC

SEQ ID NO: 194037 - protein, 388 aa, Glycine max
  Coding DNA Sequence Number=SeqID_77259
  Gene Ontology: Mol. function=L-cystine transporter activity; Cellular component=integral to membrane; Biological process=transport
  Homolog annotation: Hit_ID=P57758; Match level="QueryCoverage=94%, HitCoverage=98%, E-value=2e-56, Identity=63%"; Hit description =Cystinosin homolog
  Pfam annotation: Domain name=PQ-loop; Domain location=253-316; Score =39.2; E_value=1.5e-08; Accession=PF04193.5; Description=PQ loop repeat
  Pfam annotation: Domain name=PQ-loop; Domain location=9-75; Score =70.6; E_value=5.1e-18; Accession=PF04193.5; Description=PQ loop repeat
  Pfam module annotation: Pfam domain module=PQ-loop::PQ-loop; Domain location=253-316::9-75
MVPWNSFPLEVIYQVLGWLAFLSWSVAGYPQLILNFRRKSVVGLSLDYEILNLTKHFSYLIYNASLFFVPAVQKQYFEKYGHGQMIPVAANDVAFSTHSVIVHLIILSQIAMFERGSQKFSKYAIAIVVVVWFSAAICFFIALPSQSWLWLISIFKKSLITCLNSWGEVYISVRQLHLVLIGLKLKSNMKSEPIAHLILAYSSRLPYSAFSLFMIHIRCMSVGVSKMTPDLENLINGQAQSLKLGLKRLCRTMKLRLGIIQVVMTLIKYFPQAFMNFLRKSTDGFSIGTILLDFSGGIFNYSQMVVQSIDQGSWVNFYGNIGKVLISLVTIFYDSILMCQHYVLYPENKKGLTSKNSEEIKQPLISASPIDQQIKGSLKSSHQSPAEL

SEQ ID NO: 194038 - protein, 579 aa, Glycine max
  Coding DNA Sequence Number=SeqID_77260
  Gene Ontology: Mol. function=sequence-specific DNA binding; Cellular component=nucleus; Biological process=regulation of transcription
  Homolog annotation: Hit_ID=Q1T4J9; Match level="QueryCoverage=91%, HitCoverage=89%, E-value=1e-142, Identity=54%"; Hit description=DNA -binding WRKY
  Pfam annotation: Domain name=WRKY; Domain location=221-281; Score =132.1; E_value=1.6e-36; Accession=PF03106.6; Description=WRKY DNA -binding domain
MHVPEKKINDIQHMIIHPAREPPVTNTESSILEAPPSTSPNKKEEVVNQLETAKAEMGVAREENQLLKTCLNKIMNEYRTLEMQFQDILKQQGTKKNADKGNDDKHEEILEEADLVSLCLGRVPRSDEKIKVSNKPLKDDEGLTLGLECKFETSKSGSTNEALPNNPSPENSCEVVPKEEGGESKEALKTMRSDTEDEVAQQNPTKKPRVCVRARCDTPTMNDGCQWRKYGQKISKGNPCPRAYYRCTIAPSCPVRKQVQRCVDDMSILFTTYEGTHNHTLPPSATAMASTTSAAASMLLSGSSTSNSASIPSTATTNLQGLNFYLSDGSKPRQLYLSNPALSSSLSHPTITLDLTTSHPSASSSSSSPFVRFNSNYNNNHQPRYPSSSSSLSFSTSNSSEIANAISWSNGFLNNNRNILSSVNFGRQQMENMNQSYMQKNNNNTSLLPQADTISAATKVITADPAFQSALAAALTSFIGGGGVGNTRGSQGGNVVGESLSLGQKMKWGEVFPASNNSNSSISNNKVNGCASSFLNKTPAANTQTKNLMFLPPSSLPFSSTPKSASASPAADNSDTTTN

SEQ ID NO: 194039 - protein, 176 aa, Glycine max
  Coding DNA Sequence Number=SeqID_77261
MVQSKGEEKGSGCDLKGVVSGGVPVQLLQNQVFPVSLIFIPKHTEKTLTRSRAKSRLGKLSRWWNEMDGGDGSAWREVWEPRWQDSVVDCVECATKRNMEDVGDGSVVQLLTPPYYSPVFVPQTLEDWQVSKPKRGTIVAQLTDVVVVKWKAPQDGIAKCSIDVAFHKHIMCVCGF

SEQ ID NO: 194040 - protein, 47 aa, Glycine max
  Coding DNA Sequence Number=SeqID_77262
  Gene Ontology: Mol. function=small conjugating protein ligase activity; Cellular component=nucleus; Biological process=protein modification process
  Homolog annotation: Hit_ID=P25865; Match level="QueryCoverage=87%, HitCoverage=27%, E-value=4e-16, Identity=90%"; Hit description =Ubiquitin-conjugating enzyme E2-17 kDa 1
MGIELSLLCDPNPNSPANSEAARMFSENKREYNRRVREIVEQSWTAD

SEQ ID NO: 194041 - protein, 193 aa, Glycine max
  Coding DNA Sequence Number=SeqID_77263
  Homolog annotation: Hit_ID=Q1T4I1; Match level="QueryCoverage=58%, HitCoverage=19%, E-value=4e-43, Identity=79%"; Hit description=IQ calmodulin-binding region
  Subcellular localization annotation: CTP_CleavageSite=54; ConfidenceScore=5.16e-01
MVKIQTASSHCIRRNGRFEVKTFHIGQNSTGRSRSRRSSRDRTKAIYSETNSILMEEKAVVRFHIKVLPKGKKSPDLTMGKSPGKWIKTVLFGKKSSKSNISKGREKLVNQKGVVVTSKVPETGLALEPTSDTIARHEEDPELENKEAENVLPGNQEIDTVGSINEDAALDPEKMRLEEAATKAQAAFRGYLF

SEQ ID NO: 194042 - protein, 345 aa, Glycine max
  Coding DNA Sequence Number=SeqID_77264
  Homolog annotation: Hit_ID=Q9FJJ1; Match level="QueryCoverage=90%, HitCoverage=64%, E-value=9e-42, Identity=37%"; Hit description =Arabidopsis thaliana genomic DNA, chromosome 5, TAC clone:K19B1
  Subcellular localization annotation: CTP_CleavageSite=27; ConfidenceScore=5.05e-01
MEEPVKEQQPLSAGNSARPKLQRYALRSSSKSKENKPDAPDRSISSESKRGLSTPRLSRSVCGLDFSGNKDKSTSAKPPRRLSNPVKASPTPNLKLVGNITPISESRTMRSGNVQGSQSRSQTPASEISRTSSRMKFNLLSSSSYWLNQIKLSESADKHSVSLGFFKLASEARCEPFQKMKDELKSYVQRHQLAELGEVKELLQSYDIAENIEQPQVSESITQVPEEGTGSSDDEEVHCSSSSTMDTAKLKPEPLDTESTEPAPVKIESTKKETSQKNNHPGSRLRENLKNSANSRPASDSGSSRLVKKSEKPTTQQTNKEKSEVKKQGKKSDVIKGKNAANFQF

SEQ ID NO: 194043 - protein, 452 aa, Glycine max
  Coding DNA Sequence Number=SeqID_77265
  Gene Ontology: Mol. function=nucleoside-triphosphatase activity; Cellular component=integral to membrane; Biological process=transport
  Homolog annotation: Hit_ID=Q1SCG9; Match level="QueryCoverage=99%, HitCoverage=49%, E-value=0.0, Identity=77%"; Hit description =Probable ABC-type transport protein T23J7.110-Arabidopsis thaliana
  Pfam annotation: Domain name=ABC_tran; Domain location=161-343; Score= 167.1; E_value=4.6e-47; Accession=PF00005.17; Description=ABC transporter
MELYPGFALYRGLYELAQFSFEGSSSETGGMKWQNLSESTNGMKEVLIIMFVEWIMMLFAAFYVDQVLSSGSRKGPLFFLKGFQKRPPFQKLDAQMPVSKVFSQMEKPDVIQEKEKVEQLLLEPTINHAIVCDDLKKVYPGRDGNPDKYAVRGLFLSVPQGECFGMLGPNGAGKTSFINMMIGLTKPTSGMAFVQGLDIRTQMDGIYTTMGVCPQHDLLWESLTGREHLFFYGRLKNLKGSVLTQEVEESLESLNLFHGGVADKQVGKYSGGMKRRLSVAISLIGDPRVVYMDEPSSGLDPASRKNLWNVVKHAKQNRAIILTTHSMEEAEALCDRLGIFVNGNLQCVGNAKELKARYGGTYVFTMTTSSDHEKDVENMVQKLTPNANKIYHLSGTQKFELPKGDVRITDVFQAVDAAKRNFTVSAWGLVDTTLEDVFIKVAREAQAFDTLS

SEQ ID NO: 194044 - protein, 286 aa, Glycine max
  Coding DNA Sequence Number=SeqID_77266
  Gene Ontology: Mol. function=protein kinase activity; Cellular component=cytoplasm; Biological process=protein amino acid phosphorylation
  Homolog annotation: Hit_ID=Q6L429; Match level="QueryCoverage=99%, HitCoverage=71%, E-value=1e-118, Identity=71%"; Hit description =Protein kinase APK1B, chloroplast, putative
  Pfam annotation: Domain name=Pkinase; Domain location=2-251; Score =96.9; E_value=6e-26; Accession=PF00069.15; Description=Protein kinase domain
  Pfam annotation: Domain name=Pkinase_Tyr; Domain location=3-251; Score=52.0; E_value=1.2e-15; Accession=PF07714.7; Description =Protein tyrosine kinase
  Pfam module annotation: Pfam domain module=Pkinase::Pkinase_Tyr; Domain location=2-251::3-251
MPKSGTVVAVKKLKPEGFQGHKEWLAINYLGQLRHPNLVKLIGYCLEGDNRLLVYEYMPNRSLEDHIFRKGTQPLPWATRVKIAIGAAQGLSFLHDSKQQIIYRDFKASNILLDSEFNAKLSDFGLAKAGPTGDRSYVSTQVLGTHGYAAPEYIATGRLTSRCDVYSFGVVLLELLSGRHAIDNTKSGVEHNLVEWSRPYLGDRRKLFRIMDTKLEGQYPQKAAYTIAIIALQCISEAKTRPQMFEVLAALEHLRAIRHSASPSGEEKSMPSPMLKSPLGHNHPEL

SEQ ID NO: 194045 - protein, 326 aa, Glycine max
  Coding DNA Sequence Number=SeqID_77267
  Gene Ontology: Mol. function=isomerase activity; Cellular component =periplasmic space; Biological process=carbohydrate metabolic process
  Homolog annotation: Hit_ID=Q75M64; Match level="QueryCoverage=95%, HitCoverage=88%, E-value=3e-78, Identity=55%"; Hit description =Putative aldose 1-epimerase
  Pfam annotation: Domain name=Aldose_epim; Domain location=15-322; Score=200.3; E_value=4.5e-57; Accession=PF01263.10; Description =Aldose 1-epimerase
MSLIIRAHEHHRKIEFYELKRGYLRLNLTNYGATIISVITPDKHGNLGDIVLGYGPLILIRMIQFTSVPLLDVWQVGSEELNSLWKAKPTNCPLMITGTHFTVAQEASVMSYGQWNPTRNTVMLSWKTKVSVTYMLIGTHEFGVKMIAKQVDKATPVNLAQHTYWNLRGHNSGDILSHTVQIFGSHITPVDKLLIPTGEIISVKGTPYDFLEPKKVGSQIQEGLYDMNYVLDKSFQKHLSKAAVVIDPVSGRKLELWSNQLGLQFYTSGQLNATKGKDEALYGKHAGIALETKGFPDSVNYPYFPSQIVKPGEIYEHTMLYKFTAN

SEQ ID NO: 194046 - protein, 312 aa, Glycine max
  Coding DNA Sequence Number=SeqID_77268
  Gene Ontology: Mol. function=N-acetyltransferase activity; Biological process=metabolic process
  Homolog annotation: Hit_ID=UPI00006AB9E5; Match level="QueryCoverage =45%, HitCoverage=94%, E-value=5e-29, Identity=46%"; Hit description =acetyltransferase, GNAT family protein
  Pfam annotation: Domain name=3-dmu-9_3-mt; Domain location=180-305; Score=78.4; E_value=2.3e-20; Accession=PF06983.3; Description=3 -demethylubiquinone-9 3-methyltransfera
  Pfam annotation: Domain name=Glyoxalase; Domain location=181-304; Score=7.3; E_value=0.03; Accession=PF00903.15; Description =GlyoxalaseBleomycin resistance proteinDioxygenase superfamily
  Pfam module annotation: Pfam domain module=3-dmu-9_3-mt::Glyoxalase; Domain location=180-305::181-304
PLSALGPSDDKSPLAIAVETRLEIKLVRAGALLPRQQHHLVTALAPGQLQRVFDHRERHAVAAIGLRRHHVFDDAERLRLMRQPRDQRQHAGGYRLFLLRRYHQTDRRIVQQALQGTARVVAAQRRILWAQLAIQSQQAVEIVRLRQAMNDAHGCSFRRFKGNPLSSINTTTITEGDVMSQVSTFVMFQGEAQQAIDLYSQVFARFRLMQVQHYDPTPDGRRLIKHATIDFDRQNLVFIDSPISHDFSFTPAVSLFINLPNEEALERAFHRLAEGGKVLMPLDDYGFSARFGWLNDRFGLSWQLNVPAGDLP

SEQ ID NO: 194047 - protein, 210 aa, Glycine max
  Coding DNA Sequence Number=SeqID_77269
  Homolog annotation: Hit_ID=Q1Z978; Match level="QueryCoverage=73%, HitCoverage=51%, E-value=7e-15, Identity=30%"; Hit description =Hypothetical Lysophospholipase
RGEIQADRPRLPKPSPTAERIGHKRPLPHLGKTGRRRQIAGHPGKWPQLGCQQDQAVRLLFTRIAGQVVEQHPGAAGMAKQDDIDIAPNTLRPLNRPPLSRGIAMPANIDQAHRERWLGGQLARKNVIPGGAVNPAAVINHDHVFALGSLSIQAVAQSLNATGQRAHLCPRPLTVRLRLLNIAVKINQIAPFHDVVGIPHGRVPAPAISI

SEQ ID NO: 194048 - protein, 143 aa, Glycine max
  Coding DNA Sequence Number=SeqID_77270
  Gene Ontology: Mol. function=cobyrinic acid a,c-diamide synthase activity; Cellular component=chloroplast; Biological process =selection of site for barrier septum formation
  Homolog annotation: Hit_ID=Q45RR8; Match level="QueryCoverage=71%, HitCoverage=34%, E-value=1e-28, Identity=58%"; Hit description =Plastid division regulator MinD
MRRILPPTLHTHVVVSDQSSVPIEDLNHGVVDMVLEAKEEVEVMETNIGINGDDREVNASEGEVDVGMSGGSAYATLAGGDDSDMGGGAEKLRLAVPLEDGEVFGFGFFKGEGGERALGRGEKEREEKKKKKMNDEEEEAQWS

SEQ ID NO: 194049 - protein, 910 aa, Glycine max
  Coding DNA Sequence Number=SeqID_77271
  Gene Ontology: Mol. function=protein binding; Cellular component =membrane; Biological process=defense response
  Homolog annotation: Hit_ID=Q1SW19; Match level="QueryCoverage=100%, HitCoverage=95%, E-value=0.0, Identity=47%"; Hit description=Disease resistance protein
  Pfam annotation: Domain name=LRR_1; Domain location=616-636; Score =6.3; E_value=19; Accession=PF00560.23; Description=Leucine Rich Repeat
  Pfam annotation: Domain name=LRR_1; Domain location=638-659; Score =15.6; E_value=0.18; Accession=PF00560.23; Description=Leucine Rich Repeat
  Pfam annotation: Domain name=LRR_1; Domain location=784-806; Score =8.3; E_value=8.1; Accession=PF00560.23; Description=Leucine Rich Repeat
  Pfam annotation: Domain name=LRR_1; Domain location=832-857; Score =6.6; E_value=17; Accession=PF00560.23; Description=Leucine Rich Repeat
  Pfam annotation: Domain name=LRR_1; Domain location=880-896; Score =1.1; E_value=1.8e+02; Accession=PF00560.23; Description=Leucine Rich Repeat
  Pfam annotation: Domain name=NB-ARC; Domain location=162-474; Score =302.5; E_value=7.6e-88; Accession=PF00931.13; Description=NB-ARC domain
  Pfam module annotation: Pfam domain module=LRR_1::LRR_1::LRR_1::LRR _1::LRR_1::NB-ARC; Domain location=616-636::638-659::784-806::832 -857::880-896::162-474
MAEIAVSSALDKLLPLIADEANLLRGISKEFADIKKELEYIQAFLKDADRKAAAEGDNTDDRIKIWVKELREASFSIEDVIDEYMILVEQQPRDPGCATSLCKVIHFIKTLMPRRQIASKIKQAKSSVHGIKQRGVDYHFLIHSSLQLGPSRYRGSHNNVQWHDPRMHSRYLDEAEVVGLEDTRDELIGWLVEGPAERTVISVVGMGGLGKTTLAGRVFNNQKVISHFDYHAWITVSQSYTVEGLMRNLLKNLCKEKMGDLLEGISEMDRDSLIDEVRNHLKQKRYVVIFDDVWSVELWGQIENAMFDNNNGSRILVTTRMEGVVNSCKKSPSDQVHKLEPLTKQESMELFCKMAFRCHNNGRCPEELKKISTDFVEKCKGLPLAIVAIASLLSGKEKTPFEWEKIRRSLSSEMDKNPHLIGIAKILGFSYDDLPHYLKSCLLYFGVYPENYEVKSKRLFRQWIAEGFVKDEEGKTLEDVAEQYLTELIGTNLVQVSSFTTDGKAKSCRVHDLIHDMILRKFKDLSFCQHISKKDESMSSGMVRRLSIETISNDLMGSSKSLHARSLLIFADENEAWNTNFVQRIPTKYKLLKVFDFEDGPSHYISIHENWGNLAHLKYLNLRNSNMPSLKFIGKLQNLETLDIRNTSIKKLPKEIRKLRKLRHLLGDDMKLFQLKNCLGGLTSLQTLRHVKLTMENDDGVELIRELGKLKQLRNFCLTGVREEQGSALCSSISEMTNLEKLRIESYGVQVIDLPFISSLPMLRKLSLFGKLKKLPEWVPQLQNLVKLSLEYSELTNDPLKSLQNMPYLLFLGMYKAYKGESLYFEDGGFQQLRELSLGGLRNLESIIIDKGALHSLKKLKFWGIRKLKKVPPGIQHLKKLEVLDIRNMPYEFNECIAPDGGPEHPIIQH

SEQ ID NO: 194050 - protein, 85 aa, Glycine max
  Coding DNA Sequence Number=SeqID_77272
MGREFLAMFRGGHEDEVIRHQCGALFLSGMIFLSLLVISMIIFSCGVDDSHRHRRKRNRGLTGLGGNDGGGGSNDSGGGGGGGGG

SEQ ID NO: 194051 - protein, 453 aa, Glycine max
  Coding DNA Sequence Number=SeqID_77273
  Pfam annotation: Domain name=DUF688; Domain location=1-426; Score= -120.2; E_value=1.2e-07; Accession=PF05097.3; Description=Protein of unknown function (DUF688)
MGSSVSDDGDEAYEDARDLLSRTESFFMSCSVQPFGSFSSDHQQGRYFMIDRFLLAAKAMTSEASQYASKKARIGQEHQKQKKNEVNTEISCPINQLRPKASPHYTHDIKREESEDESDGYSEYENYTTTTCGLFPRFCLLNPMPGLRMVDKVQRHAAHGMQAKSAASHIASSKEQGRTPYGKNLIDSQSGFKEEKEILDILVKSKHGIDPHQRGCIQHGSSYESHVHEKTLYVDSVHKVNSQTNDIGGDFETFRRDSGIYNNPSTDSSLKVIGCKKINSESQVYSRDKHSTILTQNSELDLKRQLAAKWVDEECTLASSKVRYNGKIDLESQCLTKLGHQEITGASCFGLPIVLPSLKAPSESWLKRTLPTICKRNMTSQSNHTANIYARSKTPKTTSSLRPMWETMVKSSNAYHGHLQLPEEIRKHKVLQYFRIYKHLPFQRLELYGEKCL

SEQ ID NO: 194052 - protein, 62 aa, Glycine max
  Coding DNA Sequence Number=SeqID_77274
MSLRHFTEHLVGACLGMNSKGMGAIWILGCHPAALSVCLELGKGRRSIGRDSSLYLCPSLST

SEQ ID NO: 194053 - protein, 165 aa, Glycine max
  Coding DNA Sequence Number=SeqID_77275
  Homolog annotation: Hit_ID=Q9FH08; Match level="QueryCoverage=27%, HitCoverage=22%, E-value=2e-09, Identity=60%"; Hit description =Similarity to tetracycline transporter protein
MARVSHRVRKLLADSRIGKLIIGTHKTSFFLCMLSYYISNIVYQYHACSESQRGDPNLEANVGNQFADLMVISGIAGTVSQLLLMPILAPILGKTRLLSVGLFFHCVHMFLYSMAWSSLDSISPLSMLDNENQSEIIISLDHIHDYGHMHAKLGVICDFQILSMR

SEQ ID NO: 194054 - protein, 132 aa, Glycine max
  Coding DNA Sequence Number=SeqID_77276
  Homolog annotation: Hit_ID=Q9LRZ8; Match level="QueryCoverage=85%, HitCoverage=79%, E-value=2e-41, Identity=65%"; Hit description =Genomic DNA, chromosome 3, TAC clone:K13N2
MAIRLNDADDESVPRKLSQFGSVMTNGAPIVGVIGGSACIVSLLWALFGRMDANFGGIADRWDYLVGYLGSERLAYAFIWDICLYIIFQPWLIGDNLQNVQENKMDKASIIKDVIDYIQHLHEQEKIIQVER

SEQ ID NO: 194055 - protein, 481 aa, Glycine max
  Coding DNA Sequence Number=SeqID_77277
  Gene Ontology: Mol. function=protein serine/threonine kinase activity; Cellular component=membrane; Biological process=protein amino acid phosphorylation
  Homolog annotation: Hit_ID=Q9LXT2; Match level="QueryCoverage=74%, HitCoverage=92%, E-value=1e-154, Identity=78%"; Hit description =Serine/threonine-specific protein kinase-like protein
  Pfam annotation: Domain name=Pkinase; Domain location=175-451; Score =143.1; E_value=7.7e-40; Accession=PF00069.15; Description=Protein kinase domain
  Pfam annotation: Domain name=Pkinase_Tyr; Domain location=175-451; Score=125.5; E_value=1.5e-34; Accession=PF07714.7; Description =Protein tyrosine kinase
  Pfam module annotation: Pfam domain module=Pkinase::Pkinase_Tyr; Domain location=175-451::175-451
MEEDYGYRRTAKIALVAIMVLASVAVFALLVVFAYYCYILNKVSNRRKSLKKGLQLTYMMFNFFTSTQCGTSPHTCIPAWIRLVPDHVYCKMENLVDERRAFVCLIYAATVFVCSFYCLYVLFSCLKFGEVWVSNRTFEDANLNEKSDFANLQVVAEKGLQVFTFKQLHSATGGFSKSNVIGHGGFGLVYRGVLNDGRKVAIKFMDQAGKQGEEEFKVEVELLTRLHSPYLLALLGYCSDSNHKLLVYEFMANGGLQEHLYPVSNSIITPVKLDWETRLRIALEAAKGLEYLHEHVSPPVIHRDFKSSNILLGKKFHAKVSDFGLAKLGPDRAGGHVSTRVLGTQGYVAPEYALTGHLTTKSDVYSYGVVLLELLTGRVPVDMKRPPGEGVLVSWALPLLTDREKVVKIMDPSLEGQYSMKEVVQVAAIAAMCVQPEADYRPLMADVVQSLVPLVKTQRSPSKVGSCSSFNSPKLSPGPTF

SEQ ID NO: 194056 - protein, 79 aa, Glycine max
  Coding DNA Sequence Number=SeqID_77278
MGKKAKQSVDGSCGERSGPEKAMEKKKVLVWGVGRRIKVWEKILKIKGHEKEGAKVMGSGGKKSEDVEEQDGLDEGVVG

SEQ ID NO: 194057 - protein, 167 aa, Glycine max
  Coding DNA Sequence Number=SeqID_77279
  Homolog annotation: Hit_ID=Q9SJI9; Match level="QueryCoverage=96%, HitCoverage=55%, E-value=1e-43, Identity=55%"; Hit description =Expressed protein
  Pfam annotation: Domain name=DUF1637; Domain location=4-167; Score =70.5; E_value=5.5e-18; Accession=PF07847.3; Description=Protein of unknown function (DUF1637)
MPYYIQRLYRLCKASFSPNGPVSEEAVAKVCEKLDNSILCPDVRKLQAFSLSPLFLFRVCPSEGEKIKPSDVGLEQEAQVVRNWSGQMPECNGNHQQPPPIKYLHLYEDDSFSIGIFCMPPSSIIPLHNHPGMTVLSKLLYGSVYVKSYDWIDFPGPTDPSEDLLAL

SEQ ID NO: 194058 - protein, 82 aa, Glycine max
  Coding DNA Sequence Number=SeqID_77280
MKLPMKEKDDKQDRKHFDSTRTPKSEKLSSTVRSGAPNRWLWWKWWCNQNVIWWTFEKVPLKPVQPKYDLDQSDLGILSARK

SEQ ID NO: 194059 - protein, 108 aa, Glycine max
  Coding DNA Sequence Number=SeqID_77281
MDFALGTSRFAATLFTMVHQQVVVVSVVGLVINGRVYMNDLNEDEGGVNEEHVDYSDAFNISQVFATCDDVLSGQYRAKKKDSVRTCTGVRKYEYLFKLREKPIMEGK

SEQ ID NO: 194060 - protein, 273 aa, Glycine max
  Coding DNA Sequence Number=SeqID_77282
  Gene Ontology: Mol. function=DNA binding; Cellular component=nucleus; Biological process=regulation of transcription, DNA-dependent
  Homolog annotation: Hit_ID=Q9LY95; Match level="QueryCoverage=98%, HitCoverage=99%, E-value=9e-63, Identity=50%"; Hit description=MYB40- putative transcription factor
  Pfam annotation: Domain name=Myb_DNA-binding; Domain location=14-61; Score=37.4; E_value=4.8e-08; Accession=PF00249.21; Description=Myb -like DNA-binding domain
  Pfam annotation: Domain name=Myb_DNA-binding; Domain location=67-112; Score=45.5; E_value=1.8e-10; Accession=PF00249.21; Description=Myb -like DNA-binding domain
  Pfam module annotation: Pfam domain module=Myb_DNA-binding::Myb_DNA -binding; Domain location=14-61::67-112
MGRQPCCDKVGLKRGPWTIEEDHKLMNFILNNGIHCWRTVPKLAGLLRCGKSCRLRWINYLRPDLKRGGFTEMEEDQIIQLHSCLGNRWSKIASHFPGRTDNEIKNHWNTKIKKRLKLLGLDPLTLKPSEQKEKSVDDKKNIELQPNTSKGSEQGVENKSLDMHSTREVPKTEGKIEENKVTWDDTTGFFNNYEMLCSQLDLGSWMSQETKTSTSSYCSSSFSLDDSSNLSVGESSYLQENSLQQWVDGLDSILSWDSFNPLEKDFLFLDNRQ

SEQ ID NO: 194061 - protein, 52 aa, Glycine max
  Coding DNA Sequence Number=SeqID_77283
MGSVGGNSESRAITSSQNTTRSEVEKNNRKQLESARNNLEVQEATACEMIVK

SEQ ID NO: 194062 - protein, 89 aa, Glycine max
  Coding DNA Sequence Number=SeqID_77284
MQYRHSEDRKTPHVPPFGRLASNIHPMLLATHLLASSENPNNIGADANTKCGPLTKMVQRLTYCKRHNYATKSNQHRVIKTLVIKSLPH

SEQ ID NO: 194063 - protein, 252 aa, Glycine max
  Coding DNA Sequence Number=SeqID_77285
  Gene Ontology: Mol. function=oxidoreductase activity, acting on the aldehyde or oxo group of donors, NAD or NADP as acceptor; Cellular component=cytoplasm; Biological process=amino acid metabolic process
  Homolog annotation: Hit_ID=UPI00005F93E4; Match level="QueryCoverage =76%, HitCoverage=91%, E-value=6e-63, Identity=62%"; Hit description =COG0702: Predicted nucleoside-diphosphate-sugar epimerases
  Pfam annotation: Domain name=Epimerase; Domain location=4-190; Score=- 59.4; E_value=0.029; Accession=PF01370.11; Description=NAD dependent epimerasedehydratase family
  Pfam annotation: Domain name=NAD_binding_4; Domain location=6-186; Score=-77.8; E_value=0.0014; Accession=PF07993.2; Description=Male sterility protein
  Pfam annotation: Domain name=Semialdhyde_dh; Domain location=3-95; Score=-4.8; E_value=0.0017; Accession=PF01118.15; Description =Semialdehyde dehydrogenase, NAD binding domain
  Pfam module annotation: Pfam domain module=Epimerase::NAD_binding _4::Semialdhyde_dh; Domain location=4-190::6-186::3-95
MARALLVGATGLVGRELLQLLQSDPQITAIVAPTRAPLPPHGKLTNPVGDALFELLSSLQQPVDLVFCCLGTTRRAAGSADAFRYVDYQLVVESALTGRRLGAQHCLVVSALGANADSTFLYNRTKGEMEQALREQHWPRLTLVRPSMLVGDRPAPRLMERLTLPLFRLLPGKWRAVSAKDVAQTLLQQAFTPGEGADAEVVERQLQPGGQFVVQQPQIEMMADAAIEHQQIQRHVLQIVGGGRRQADGVGQ

SEQ ID NO: 194064 - protein, 303 aa, Glycine max
  Coding DNA Sequence Number=SeqID_77286
  Gene Ontology: Mol. function=protein serine/threonine kinase activity; Cellular component=beta-catenin destruction complex; Biological process=protein amino acid phosphorylation
  Homolog annotation: Hit_ID=Q1SPP5; Match level="QueryCoverage=92%, HitCoverage=87%, E-value=1e-124, Identity=91%"; Hit description =Protein kinase
  Pfam annotation: Domain name=Pkinase; Domain location=15-243; Score =133.5; E_value=5.8e-37; Accession=PF00069.15; Description=Protein kinase domain
  Pfam annotation: Domain name=Pkinase_Tyr; Domain location=6-208; Score=-146.2; E_value=0.0017; Accession=PF07714.7; Description =Protein tyrosine kinase
  Pfam module annotation: Pfam domain module=Pkinase::Pkinase_Tyr; Domain location=15-243::6-208
MSISDFAKSFIGRAYEMSAPVADGNDALTGHIISTTIGGKNGEPKQTISYMAERVVGTGSFGIVFQIFRGLAYIHTVPGICHRDVKPQNLLVDPLTHQVKLCDFGSAKVLVEGESNISYICSRYYRAPELIFGATEYTTSVDIWSAGCVLAELLLGQPLFPGENQVDQLVEIIKILGTPTREEIRCMNPNYTDFRFPHIKAHPWHKVFHKRMPPEAIDLASRLLQYSPKLRYSAVEAMAHPFFEELREPNARLPNGRSLPPLFNFKKELDGAPPELLPKLIPEHVRRQTGLGFLYSAETQTQM

SEQ ID NO: 194065 - protein, 89 aa, Glycine max
  Coding DNA Sequence Number=SeqID_77287
MGEAPLVLAMELVVAAPSSSQHRHCIADVASGRVATLSSWIREATAVHHIKVEHGVLSISNMSQKNESNSVAEVSMACSMLLLRARRLL

SEQ ID NO: 194066 - protein, 227 aa, Glycine max
  Coding DNA Sequence Number=SeqID_77288
MPCSNVFVNGVMQLANHKSLLKGNYGQVEFGHELASIGEAFEGFNDACRDRLYPSFLLVSTGFNPRVSCEGSAYYRFKAPDQRSNTSSVFSDFPSPNSVLTPQKLRPILSGKEVEDFPEEEDLEFKKLKGFMDLGFVFSEEDKDSRSVSLIPGLQRLGKEDDGRNSEQNIDETVICRPYLSETWDVLDQRKVVNPLLNLRVPVVGNEIGMKDNLRFWAHTVASIVKH

SEQ ID NO: 194067 - protein, 52 aa, Glycine max
  Coding DNA Sequence Number=SeqID_77289
METSEMLTGDASHVVCMNFMRKTLGDKIMLHREGEDAMKGGAILFDLYWLMM

SEQ ID NO: 194068 - protein, 613 aa, Glycine max
  Coding DNA Sequence Number=SeqID_77290
  Gene Ontology: Mol. function=binding; Cellular component =mitochondrion; Biological process=metabolic process
  Homolog annotation: Hit_ID=Q2QLK4; Match level="QueryCoverage=92%, HitCoverage=62%, E-value=1e-42, Identity=26%"; Hit description =Pentatricopeptide, putative, expressed
  Pfam annotation: Domain name=PPR; Domain location=126-160; Score =25.8; E_value=0.00015; Accession=PF01535.11; Description=PPR repeat
  Pfam annotation: Domain name=PPR; Domain location=161-195; Score =37.6; E_value=4.4e-08; Accession=PF01535.11; Description=PPR repeat
  Pfam annotation: Domain name=PPR; Domain location=196-230; Score =26.1; E_value=0.00013; Accession=PF01535.11; Description=PPR repeat
  Pfam annotation: Domain name=PPR; Domain location=21-55; Score=16.1; E_value=0.092; Accession=PF01535.11; Description=PPR repeat
  Pfam annotation: Domain name=PPR; Domain location=231-265; Score =20.3; E_value=0.0068; Accession=PF01535.11; Description=PPR repeat
  Pfam annotation: Domain name=PPR; Domain location=266-300; Score =25.5; E_value=0.00019; Accession=PF01535.11; Description=PPR repeat
  Pfam annotation: Domain name=PPR; Domain location=301-334; Score=2.1; E_value=4.2; Accession=PF01535.11; Description=PPR repeat
  Pfam annotation: Domain name=PPR; Domain location=56-90; Score=34.8; E_value=2.9e-07; Accession=PF01535.11; Description=PPR repeat
  Pfam annotation: Domain name=PPR; Domain location=91-125; Score=33.4; E_value=8.1e-07; Accession=PF01535.11; Description=PPR repeat
  Pfam module annotation: Pfam domain module=PPR::PPR::PPR::PPR::PPR::PP R::PPR::PPR::PPR; Domain location=126-160::161-195::196-230::21 -55::231-265::266-300::301-334::56-90::91-125
GIQLLFDEMVGDSADGVSLFAACNRVIRYLAKAEKLEVSFCCFKKILNAGCKVDTETYNSLITLFLNKGLPYKAFEMYESMEKAGCSLDGSTYELMIPNLAKSGRLDAAFKLFQEMKVRGFRPGLNVFASLVDSMGKAGRLDSAMKVYMEMRGYGYKPPPTIYVSLIESYVKSGKLETALRLWDEMRMAGFRPNFGLYTLIIESHAKSGKLEIAMSTFLDMEKAGFLPTPSTYACLLEMHAASGQIDPAMKLYNSMTNAGLRPGLSTYTVLLTLLANKKLVDVAAKILLEMKAMGYSVDVTASDILMVYIKEGSVDLALRWLRFMGSSGIRTNNFIIRQLFESCMKSGLFESAKPLLETYVNSAAKVDLILYTSILAHLVRCQEEKNERHLMSILSATKHKAHSFMCGLFTGPEHRGQPVLTFVREFFQGIDYELEEGAAKYFVNVLLNYLVLMGQINRARCVWKVAYENKLFPKAIVFDQHIAWSLDVRNLSVGAALIAVVHTLHRFRKRMLYYGIVPRRIKLVTGATLKIVIAQMLSSVESPFEVSKVVLRASGDSVMEWFKKPIVQQFLLNEIPSRSDILMHKLNILFPSSAPELRSLSPPKPLIASRAM

SEQ ID NO: 194069 - protein, 413 aa, Glycine max
  Coding DNA Sequence Number=SeqID_77291
  Gene Ontology: Mol. function=ATPase activity, coupled to transmembrane movement of substances; Cellular component=integral to membrane; Biological process=transport
  Homolog annotation: Hit_ID=Q8PIU8; Match level="QueryCoverage=100%, HitCoverage=67%, E-value=0.0, Identity=80%"; Hit description=ABC transporter ATP-binding protein
  Pfam annotation: Domain name=ABC_tran; Domain location=229-412; Score= 183.8; E_value=4.2e-52; Accession=PF00005.17; Description=ABC transporter
  Pfam annotation: Domain name=MMR_HSR1; Domain location=230-335; Score= -21.5; E_value=0.093; Accession=PF01926.13; Description=GTPase of unknown function
  Pfam module annotation: Pfam domain module=ABC_tran::MMR_HSR1; Domain location=229-412::230-335
MVDSLWYIVVYTGTALYLFAQADWRLMVPLILWLLAYVVIMVYFVPRAKERAWIASEARSKAMGRIVDGYTNIPTLKLFAHGGREQAYVAESIQELAVKHRAQTRVTTGMDLTIAIVNGFLIAGTCGLALWLWNGGHITVGAITLATGLVIRIHNMSGWIMWTINGIFEDIGTVQDGITTIAQPLTVQDREDAVPLQVTRGGVHFQDIHFHYGKKGGVIAGLDLVVKPGEKIGLVGPSGAGKSTLVNVLLRLYDLESGRILIDDQDIAYVTQESLRQQIGVVTQDTSLLHRSIRDNLLYGRPDATDEQLRAAVAKARAEAFIDTLVDGQGRRGYDAHVGERGVKLSGGQRQRIAIARVLLKDAPILVLDEATSALDSEVEAAIQDSLDQLMGGKTVIAIAHRLSTIARMDRLV

SEQ ID NO: 194070 - protein, 42 aa, Glycine max
  Coding DNA Sequence Number=SeqID_77292
MAWTYCMQGSARPFHPVATVALGPVQRLVGARQHVIHAITCL

SEQ ID NO: 194071 - protein, 383 aa, Glycine max
  Coding DNA Sequence Number=SeqID_77293
  Gene Ontology: Mol. function=ATP binding; Cellular component =chromosome; Biological process=DNA metabolic process
  Homolog annotation: Hit_ID=Q2SEV8; Match level="QueryCoverage=88%, HitCoverage=100%, E-value=7e-91, Identity=61%"; Hit description =Predicted ATPase
MLQTLAIAHYRSLHGLVLPLQQLNVVTGDNGSGKSSLYRALRLLAETAQGGVAAVLAREGGLGSALWAGPESIDRRVAAGEIPLQGGPRQASVGLKLGFTTDEFGYAIDLGYPPPSHSAFALDPQIKVEAIWAGPFLRSANLLVDRRGAMVRQRHARGWDLVDDRLSLFDSLFTQVGDPQRMPETIALREYIRRWRFYDHFRSDADAPARQPAMATRTPVLHHDGRDLAAAWVTILEIGDPVALARSVDDAFPGATVGFEELDAGDQPASGPAAGAGAADHRGQCAQPGVGGVTRQPVDRSTGASARLSFAAPAQGTGPHAAERAGPAGCAGMALAAALIRPSTPCVDALNRRCCVPRPCQGFPDAAPACGGSAADAGTPRRR

SEQ ID NO: 194072 - protein, 110 aa, Glycine max
  Coding DNA Sequence Number=SeqID_77294
MPLELEMLATLRGCAKRTTVLIAFVVISKKTEELPWAVTELIFSKTLYLYPPLLHCFMLKCFDIASFSSSYSALHIQFRSPLGAMWLKGVKTPVCVSGNCDERAKHAYYA

SEQ ID NO: 194073 - protein, 104 aa, Glycine max
  Coding DNA Sequence Number=SeqID_77295
  Homolog annotation: Hit_ID=Q1SS44; Match level="QueryCoverage=79%, HitCoverage=33%, E-value=9e-09, Identity=43%"; Hit description =Cyclin-like F-box
MTLPLILLTLIPCKVWIIQVPPPKTLEVEPLARCFTFSVGCDGAVLREGVEKVRIAWNMVLRGWKGVFMMMERIGKVGSRLTTSGGSHRSCQCQGVALVWWWQI

SEQ ID NO: 194074 - protein, 198 aa, Glycine max
  Coding DNA Sequence Number=SeqID_77296
MDSSKLPSMHYYNVVLVYIGVSLLHGCGVHAIDGVVKVTILRLGLPRHTLLEPSPHLKTLLVALNMFSSRSRFANLWSHASMNVEHGVATVEEGENRYANKLVGESYELDVASISSLPSRMYKIGLLRRIVIPLCCQEMENNFYTREGFMRQGEKTRKEEKKEGRKGKRKERKKEEKVGGCQYWRKGRKGIWMFCMCW

SEQ ID NO: 194075 - protein, 128 aa, Glycine max
  Coding DNA Sequence Number=SeqID_77297
  Subcellular localization annotation: CTP_CleavageSite=49; ConfidenceScore=5.22e-01
MFAHSIKGCRPLGRACGVLIPSPSRLFRFFRRFPQINVGGDSARIPFVEHASRESRVALPPKESKEGQLGCCSGSWYLLVKDASMQLELTIKRAAKTVYQVVTLGIFIVTSLDKLAKSIILIAFKVPL

SEQ ID NO: 194076 - protein, 88 aa, Glycine max
  Coding DNA Sequence Number=SeqID_77298
MSEIEDVQEHMNADIEVVKDRMAAMMEAMLSMKKIMKVNTTAVATTNAATKVDPTHLSGLNQVNPPVSNIVGQGGEALGSTGGTYFVQ

SEQ ID NO: 194077 - protein, 131 aa, Glycine max
  Coding DNA Sequence Number=SeqID_77299
GYLGIRSSRMPEYLKKSKDCHIGVSKPRVFGYLTRLNTYDLVPSRPRPRTPSVDEPCPFLEPTSNNPPSQIRRKIQKEIPKRNQLEDPVKVLLIKGEKVHCIVPDAIEGTMDATKERHVEVSDVSSTQTWV

SEQ ID NO: 194078 - protein, 127 aa, Glycine max
  Coding DNA Sequence Number=SeqID_77300
  Homolog annotation: Hit_ID=O80607; Match level="QueryCoverage=76%, HitCoverage=31%, E-value=2e-41, Identity=78%"; Hit description =Predicted by genscan
MPDGWETISKNQEGNVWEMSQREEDILLQEFERRIAYSKFQIASFIKTHIFSRRRPIDGWKYMIELVGPNAKRGKGSVSRVPSLSDPSTQPFKEEKNSVDKTYVPRERRGRLIQKPCMKDKASDNMT

SEQ ID NO: 194079 - protein, 489 aa, Glycine max
  Coding DNA Sequence Number=SeqID_77301
  Homolog annotation: Hit_ID=Q9LK80; Match level="QueryCoverage=97%, HitCoverage=94%, E-value=1e-108, Identity=45%"; Hit description =Arabidopsis thaliana genomic DNA, chromosome 5, TAC clone:K23F3
MIELFLSEPNWNDVVNDDDSTRSRISILNDLETVIWSTVGRSEARLWLCNTVAGLNCVTSLDQRDLFRNLLRTSGVKRDLASQLLHLMFDTAPHKPGSVLARRSHVLNKFFQGNPKRVLQWFSCSSSGGGLEQGKGFRALSQFAFKNRDICWEELEWKGKHGQSPAVVATKPHYFLDLDVLQTVENFLENVPEFWSSEEFAESVKDGDIFFVDRSFFVRYFINLMYKEEFRDVWDVVNEFLMQQAFSSLCGRLLITLEDQDLCHFVESLCKSLGPKLELKHFNDVSNLFVIVLFKCGSYGSIDQLLLFNAVMTQGRQLLRLLRDEEAWETQEKINEIVSKMSAIPNNPNSLTPIFKSKYKMKIIEVIKYLGLLSWLLYYRLSKECQTPESWESVFMNNQIGFRNSNKHALSDEDGPSEEDCSVRVKGRRKKKARKKRRTYDRHDDGDDELLDYDSASQKLVFPSNTRSWLLSTDGYSSAWSSVSSISLN

SEQ ID NO: 194080 - protein, 403 aa, Glycine max
  Coding DNA Sequence Number=SeqID_77302
  Gene Ontology: Cellular component=membrane
  Homolog annotation: Hit_ID=Q69NN6; Match level="QueryCoverage=69%, HitCoverage=37%, E-value=1e-60, Identity=45%"; Hit description =Mechanosensitive ion channel domain-containing protein-like
MEKTRSSDQVVVFLDQHNPKPPSMESENHQDKPKHPLKVRALNRLSFSKPKSRILEYNYNVPRNKVAEESDIIQPTYKFSSNDDDDDDDDNDLDLEWDEDETEEDGSEHGPKLHQKRKFKIKWRLMMEWILFLNILACLVCSLTISSITNMHLLGLEIWRWCVMAMVTFSGRLVSGWVVGLTVFILERNFMLREKVLYFIYGLRNSIRNCMWLGLVLLSYWSMVFNDVQKKNHKFLNKVFQALVAVLVGATIWLVKIVLVKMLASSFHVTTYFDRMKESVFHHYILETLSGPPMEDAEEVLRQHHLAGSKSMPARWNAKNLYKSKRFGSRKIDMEKLRKLSMESTATAWSVKRLVNYVRSSGLSTISRTVDDFGNAESEISSEWEARNCAQRIFKNVAKPGAK

SEQ ID NO: 194081 - protein, 256 aa, Glycine max
  Coding DNA Sequence Number=SeqID_77303
  Gene Ontology: Mol. function=calcium ion binding; Cellular component =membrane; Biological process=superoxide metabolic process
  Homolog annotation: Hit_ID=Q69NN6; Match level="QueryCoverage=94%, HitCoverage=32%, E-value=7e-75, Identity=55%"; Hit description =Mechanosensitive ion channel domain-containing protein-like
  Pfam annotation: Domain name=MS_channel; Domain location=26-234; Score=30.6; E_value=9.2e-08; Accession=PF00924.9; Description =Mechanosensitive ion channel
MIRAYYERKALAQSLNDTKTAVQQLHKIASAVVSVIIIIVMLLLMEMATIKIILFCITQFVLIGVAFQGTCKTVLEAIIFVFVMHPFDIGDRCVIDGVHMIVEEMNILTTVFLRYDNEKIYYPNAVLLSKPISNFYRSPEMWDSIDFTIDVSTSMETILALKKSIQMYIESKPKYWNPKHSMIAKGIENMDKLKLCLSVQHTINHQNYGERNIRITELLLELKRIFEIHGVKYHLLPQEIQITHMNIEHSKVLFQS

SEQ ID NO: 194082 - protein, 53 aa, Glycine max
  Coding DNA Sequence Number=SeqID_77304
MCHTARELYMTCFSVHPLFLSQSTQPWLLSPTATTLPSSRCPPSISYAPLFSP

SEQ ID NO: 194083 - protein, 54 aa, Glycine max
  Coding DNA Sequence Number=SeqID_77305
MVIICPKDNVVIWFCSLHNRSDNNLKGIINSALKGFDDSQHCKSKAAARWIVVK

SEQ ID NO: 194084 - protein, 407 aa, Glycine max
  Coding DNA Sequence Number=SeqID_77306
  Homolog annotation: Hit_ID=Q1SCI1; Match level="QueryCoverage=96%, HitCoverage=99%, E-value=1e-113, Identity=54%"; Hit description =Kelch motif, putative
  Pfam annotation: Domain name=Kelch_1; Domain location=149-191; Score =1.2; E_value=2.8; Accession=PF01344.15; Description=Kelch motif
  Pfam annotation: Domain name=Kelch_1; Domain location=193-239; Score =41.9; E_value=2.2e-09; Accession=PF01344.15; Description=Kelch motif
  Pfam annotation: Domain name=Kelch_1; Domain location=241-287; Score =40.2; E_value=7.1e-09; Accession=PF01344.15; Description=Kelch motif
  Pfam annotation: Domain name=Kelch_2; Domain location=193-239; Score =10.3; E_value=1.7; Accession=PF07646.5; Description=Kelch motif
  Pfam annotation: Domain name=Kelch_2; Domain location=241-287; Score =11.5; E_value=1.2; Accession=PF07646.5; Description=Kelch motif
  Pfam annotation: Domain name=Kelch_2; Domain location=298-338; Score =3.1; E_value=15; Accession=PF07646.5; Description=Kelch motif
  Pfam module annotation: Pfam domain module=Kelch_1::Kelch_1::Kelch _1::Kelch_2::Kelch_2::Kelch_2; Domain location=149-191::193-239::241 -287::193-239::241-287::298-338
MGTLQCFSVEGDEKPRKLSKLSDDPQEEEEGMQIDMVSLFPSQHQSNDQNHAPMAIEERDPRWLINQDVSIGVVLRLSRSEYGSIVSLNQSFRSLIQTGELYRLRRKMGIVEYWVYFSFNLLEWEVFDPMNGYWMKLPRMPSNQYDCFTFSDKESLAVGTELLVFGKAIEAPVVYGYSLLTHTWSHGTQMSVPRCLFASASRGEIAIVAGGCNPLGKILSVAEMYNSDTKTWEALPNMNKARKMSAGVFMDGKFYALGGMGEDGNKLTCGEEYDLETKEWRVIPNMLPPRTSERQDTTEAPPLVAVVNNVLYAADYAQRVLRRYEKERNKWVYIGSLPEITSSMNGWGLAFRACGDRIVVIAGESAHGGRVVEINSWIPDGGAPLWNLLARRHIGGSFVYNCAVMGC

SEQ ID NO: 194085 - protein, 169 aa, Glycine max
  Coding DNA Sequence Number=SeqID_77307
  Gene Ontology: Mol. function=protein binding
  Homolog annotation: Hit_ID=Q6DXT5; Match level="QueryCoverage=87%, HitCoverage=34%, E-value=1e-51, Identity=68%"; Hit description =Putative leucine-rich repeat family protein
MKMCAGFSVSLTTLRIVRTGNVAFEAVVGEINVSEVGVEVVGEGSSEVGVGDGEGFELGHAGEDDEGAGGLDVDIEDDEVGEVLEVGEPDTGEFAEAIDAGEGGEGEGEVGGEADGGNRAVEEGEELEGGEGLEGGEGEGEVRGAVGQAEGDEVAEGLVAVAEGGIMEG

SEQ ID NO: 194086 - protein, 430 aa, Glycine max
  Coding DNA Sequence Number=SeqID_77308
  Gene Ontology: Mol. function=protein binding; Cellular component =nucleus; Biological process=multicellular organismal development
  Homolog annotation: Hit_ID=Q1SXD6; Match level="QueryCoverage=99%, HitCoverage=98%, E-value=0.0, Identity=84%"; Hit description=WD40 -like
  Pfam annotation: Domain name=NLE; Domain location=9-74; Score=110.4; E_value=5.3e-30; Accession=PF08154.2; Description=NLE (NUC135) domain
  Pfam annotation: Domain name=WD40; Domain location=135-180; Score =40.6; E_value=5.6e-09; Accession=PF00400.22; Description=WD domain, G-beta repeat
  Pfam annotation: Domain name=WD40; Domain location=193-231; Score =32.9; E_value=1.1e-06; Accession=PF00400.22; Description=WD domain, G-beta repeat
  Pfam annotation: Domain name=WD40; Domain location=259-296; Score =33.9; E_value=5.6e-07; Accession=PF00400.22; Description=WD domain, G-beta repeat
  Pfam annotation: Domain name=WD40; Domain location=300-338; Score =12.5; E_value=1.3; Accession=PF00400.22; Description=WD domain, G -beta repeat
  Pfam annotation: Domain name=WD40; Domain location=345-384; Score =35.2; E_value=2.3e-07; Accession=PF00400.22; Description=WD domain, G-beta repeat
  Pfam annotation: Domain name=WD40; Domain location=388-425; Score =7.3; E_value=5.1; Accession=PF00400.22; Description=WD domain, G -beta repeat
  Pfam annotation: Domain name=WD40; Domain location=95-132; Score =17.6; E_value=0.044; Accession=PF00400.22; Description=WD domain, G -beta repeat
  Pfam module annotation: Pfam domain module=NLE::WD40::WD40::WD40::WD40 ::WD40::WD40::WD40; Domain location=9-74::135-180::193-231::259 -296::300-338::345-384::388-425::95-132
MEEEGSARRIQVRFVTKLSEPYKIPTTAIAIPADLTRFGLSSLVNALLESNDAPEPFDFLIDGEFIRMSLEQFLLAKGISAERILEVEYTRAVAPRKEEDPSLHDDWVSAVDGSSSRFFLTGCYDGLGRVWKGAGLCTHILDGHSDAVTSVSIINPKGDSGAETVTVATASKDRTLRLWKLNTEDPVNHPMRVRAYKILRGHKSSVQSVAVQTSGEMVCSGSWDCTINLWQTNDFNAEDDQVSKKRKVGGQVEESQLEGEAFTTLVGHTQCVSSVVWPQRELIYSASWDHSIRKWDVEIGKNLTDIFCGKVLNCLDIGGEGSALIAAGGSDPVLRIWDPRKPGTSAPVFQFASHTSWVSACKWHDQSWFHLLSASYDGKVMLWDLRTAWPLSVIESHSDKVLSADWWKSDSVISGGADSKLCISSEIPVQ

SEQ ID NO: 194087 - protein, 244 aa, Glycine max
  Coding DNA Sequence Number=SeqID_77309
  Gene Ontology: Mol. function=structural constituent of ribosome; Cellular component=ribonucleoprotein complex; Biological process =translation
  Homolog annotation: Hit_ID=Q9FLF0; Match level="QueryCoverage=69%, HitCoverage=86%, E-value=9e-87, Identity=93%"; Hit description=40S ribosomal protein S9-2
  Pfam annotation: Domain name=Ribosomal_S4; Domain location=54-155; Score=125.0; E_value=2.1e-34; Accession=PF00163.9; Description =Ribosomal protein S4S9 N-terminal domain
  Pfam annotation: Domain name=S4; Domain location=156-203; Score=53.1; E_value=9e-13; Accession=PF01479.15; Description=S4 domain
  Pfam module annotation: Pfam domain module=Ribosomal_S4::S4; Domain location=54-155::156-203
MGLVKSPAFPELGFWDLLKGRKKHVLKFSCENLVHRKGCEAGREEPWCTFLSTETVNGKTFKKPRRPYEKERLDAELKLVGEYGLRCKRELWRVQYALSRIRNNARNLLTLDEKNPRRIFEGEALLRRMFRYGLLDETQNKLDYVLALTVENFLERRLQTLVFKSGMAKSIHHARVLIRQRHIRVGRQVVNIPSFMVRVDSQKHIDFSLTSPLGGGRPGRVKRKNQRAAAKKAAGGDGDEEDED

SEQ ID NO: 194088 - protein, 222 aa, Glycine max
  Coding DNA Sequence Number=SeqID_77310
  Gene Ontology: Mol. function=transcription regulator activity; Cellular component=nucleus; Biological process=regulation of transcription
  Homolog annotation: Hit_ID=Q8W397; Match level="QueryCoverage=87%, HitCoverage=85%, E-value=1e-30, Identity=40%"; Hit description =Putative amelogenin
  Pfam annotation: Domain name=HLH; Domain location=29-78; Score=7.3; E_ value=0.024; Accession=PF00010.16; Description=Helix-loop-helix DNA -binding domain
MGSESVAPMVETSKNRSSSGKMNQGKVPRKIHKAEREKMKREHLNERFVDLASALDLNENNGKASILCETARLLKDLLSQIESLKKENVTLLSESHYMTMEKNELKEENCSLETQIEKLQGEIQARLAQSKPDLNVPPHEPPEQTNFPGQNLQLHTIEPNLQQGSTVLVVPFHPNLQASFPAPNVTEVTPKSMSVVSKPHARYPTPADSWPSQLLGEQPTSS

SEQ ID NO: 194089 - protein, 253 aa, Glycine max
  Coding DNA Sequence Number=SeqID_77311
MKILVRTFDAHRGAEAKFPLVTRVYGSNLEFDVKVNYHGESSVMQQFREQFKALQMKNIEEMGLSKFLEGTHTNMVASTSSSEVDFFDTLVEYFVRIQDLELRVALHSMITTPKSGALAESLCKKRSANMDKLRHRVVGFIQIEELSEFCDKEVFNAETRPTAPNNANSIGTMVIYIEECIVLKDKIEELAHKGCLNDFVRGNNYNPDGCRSGDKGGRRGSFKGGYVRGWGNNNQQSTRQSEQRQHENPLGAV

SEQ ID NO: 194090 - protein, 133 aa, Glycine max
  Coding DNA Sequence Number=SeqID_77312
MDGEVSQNSLLASWVWEDATSFGSANLQDNECWSMIVAFKGGGYRDEGLLVSKMMGKEPLDDCKKGGMEVTTQEKSATDFSDIGAPKRDFACEIEEEIRGVTLCLKSTGIPEALLNKVVDNNYFDLTQPNMTL

SEQ ID NO: 194091 - protein, 195 aa, Glycine max
  Coding DNA Sequence Number=SeqID_77313
MRVKVTSLWRVECKVFGSKFECVWMENEDDNNGVQVGLKNEALAIGPPSPSKGSLPLFLALSSSGCNMTRGSYAQVVKENDNHVKKVWQKKRSKETGKIMDGETIPSGRDKHKMVAQVNDWKILLWRDIQLSLRYLGDNVGFLSGKQEDNLMDIFEGEEDWLTTCLYQLHHGSPQSLMEASWCGCVALVSLTVVE

SEQ ID NO: 194092 - protein, 324 aa, Glycine max
  Coding DNA Sequence Number=SeqID_77314
MSCTEALSECQLAKRMPASSRLSEKTGAKPKATYRWRRHSHYLYFFSLSFSLFIVVKEASLLWRAKSSVGSSYGVLDFSIRMNIKAILQFPYSSDIEGFLESIMKGFNLRKIKASMAKSQNMSLRLVLTDLVKPKKRKRVAKEIDQFGDKTDQPQSKTMKVVVNEHISPKKEKEVYKKENLGTIDEEKPTTENKDVNVTQSCPLCKVDHVTVTRDLPSLRNADIKGSEFITNDKLLIKIKSKASLEENRKLANSLSEKNSLMIKKIEIIDGIQQEIADHEKMVSMKTVENEKLVKAIESLNKNFNTAIMELAKTKNVVKALNNQ

SEQ ID NO: 194093 - protein, 252 aa, Glycine max
  Coding DNA Sequence Number=SeqID_77315
  Homolog annotation: Hit_ID=Q9LK89; Match level="QueryCoverage=93%, HitCoverage=95%, E-value=1e-10, Identity=26%"; Hit description =Arabidopsis thaliana genomic DNA, chromosome 3, TAC clone: K16N12
  Pfam annotation: Domain name=DUF1645; Domain location=48-232; Score =58.2; E_value=2.7e-14; Accession=PF07816.2; Description=Protein of unknown function (DUF1645)
MQKEQDKEYLDSLTCPSFNCYSTDQLAGIAQNRTQNDDPDFEFAAFRDEAFSGDDAIFPLFNSEVARDRRNRVSGGRDSGAAVLRFPITGEELRRSEHDPLPAPSSESSSEADELERVPAGTYCVWRPNSPQASPGKCKKSNSTGSSSSKKWKLLDLLYRSNSEGKESFVFLTPAPAPEKKRANQRWSIEVAEKSKGKGFSGKKKAPVSVHEALYLRNRELRMVDKKKSFLPYKPGLVGFCTSRLGKAFPSF

SEQ ID NO: 194094 - protein, 72 aa, Glycine max
  Coding DNA Sequence Number=SeqID_77316
MALTPEEISRPFIKFWNSSSLERGREEVNSKNDYDSSLMSNISFSSMDFWQTTEDPSLLEPEEDILRVKENE

SEQ ID NO: 194095 - protein, 94 aa, Glycine max
  Coding DNA Sequence Number=SeqID_77317
MGESPYSLQVTEKQHHCLEQRRQLVRNESDAYLPNVPAKCYRAIFTKRKHVSNCVMTLHEFLGVPPSKMELGFKGKQMTKKKKMGKRMFRKETC

SEQ ID NO: 194096 - protein, 544 aa, Glycine max
  Coding DNA Sequence Number=SeqID_77318
  Gene Ontology: Mol. function=protein serine/threonine phosphatase activity; Cellular component=protein serine/threonine phosphatase complex; Biological process=protein amino acid dephosphorylation
  Homolog annotation: Hit_ID=O81709; Match level="QueryCoverage=99%, HitCoverage=100%, E-value=1e-111, Identity=43%"; Hit description =Protein phosphatase 2C
  Pfam annotation: Domain name=PP2C; Domain location=248-527; Score =198.5; E_value=1.6e-56; Accession=PF00481.12; Description=Protein phosphatase 2C
ILMEEMSTTVTVPLRVGNSVCDKPTIATHMDVSRIKLMSDAGLLSNSITKVSNETFIGSDEDHDGGRHEDEVGITAVTAPEQQREGEIPMSDTISQNISSLVVGDEVLTPEIEEDDLISLEGDPIIDSSSLSVASENSSFCGDEFISSEVSSDLGTTSSIEIGKSVSTVKIAARATDLGASNVEVDVAVSLEETGVRSGQTPTTGVFHQLTLERSVSGTAGRSVFELDCTPLWGFTSVCGKRPEMEDAVATVPRFLKIPIEMLTGDRLPDGINKCFSQQIIHFFGVYDGHGGSQVAKYCRERMHLALAEEIESVKEGLLVENTKVDCRDLWKKAFTNCFLKVDSEVGGGVNCEPVAPETVGSTSVVAIICSSHIIVSNCGDSRAVLCRAKEPMALSVDHKPNRDDEYARIEAAGGKVIQWNGHRVFGVLAMSRSIANPDDMYRAIQMNSVFSYPIDLIASDRYLKPWIIPDPEVTFLPRAKDDECLILASDGLWDVMTNEEGIDPAAQAAADYLSNRALQKGSKDNITVIVVDLKAQRKFKSKT

SEQ ID NO: 194097 - protein, 233 aa, Glycine max
  Coding DNA Sequence Number=SeqID_77319
  Gene Ontology: Mol. function=nucleotide binding; Cellular component =membrane; Biological process=small GTPase mediated signal transduction
  Homolog annotation: Hit_ID=Q40194; Match level="QueryCoverage=90%, HitCoverage=96%, E-value=1e-108, Identity=92%"; Hit description=Ras -related protein Rab11D
  Pfam annotation: Domain name=Arf; Domain location=17-189; Score= -73.1; E_value=0.00039; Accession=PF00025.11; Description=ADP -ribosylation factor family
  Pfam annotation: Domain name=MMR_HSR1; Domain location=29-144; Score =2.3; E_value=0.00062; Accession=PF01926.13; Description=GTPase of unknown function
  Pfam annotation: Domain name=Miro; Domain location=30-144; Score =73.1; E_value=9e-19; Accession=PF08477.3; Description=Miro-like protein
  Pfam annotation: Domain name=Ras; Domain location=30-191; Score =334.2; E_value=2.2e-97; Accession=PF00071.12; Description=Ras family
  Pfam module annotation: Pfam domain module=Arf::MMR_HSR1::Miro::Ras; Domain location=17-189::29-144::30-144::30-191
VGGEKEKARKSKRGKARGYKGDDEYDYLFKLVLIGDSGVGKSNLLSRFTRNEFNLESKSTIGVEFATKSLDIDAKVIKAQIWDTAGQERYRAITSAYYRGAVGALLVYDVTRRATFENAARWLKELRDHTDPNIVVMLIGNKSDLRHLVAVPTEDGKSFAEKESLYFMETSALEATNVENAFTEVLSQIYRIVSKRAVEAGNNASSSAVPSKGQTINVKDDSSVLKKIGCCSN

SEQ ID NO: 194098 - protein, 74 aa, Glycine max
  Coding DNA Sequence Number=SeqID_77320
  Homolog annotation: Hit_ID=P35493; Match level="QueryCoverage=80%, HitCoverage=10%, E-value=5e-08, Identity=46%"; Hit description=2,3 -bisphosphoglycerate-independent phosphoglycerate mutase
MVLRGWKGVFMMMERIGKVGSRLTTSGGSHRSCQCQGVALNDWNVMKQGWDAQVLGEASYKFTNALEAVRKLMA

SEQ ID NO: 194099 - protein, 120 aa, Glycine max
  Coding DNA Sequence Number=SeqID_77321
MAGCRNVPFAGERGRGSRVCFPKEERCAESPPTFICGKRRKNRRKPVKMKILSSGVVFTLEEGINTSHVDKSGAFAPTDPPLERKSDLRSSFLGVNQAILFYLKGDHFKALDLKNDPFYL

SEQ ID NO: 194100 - protein, 196 aa, Glycine max
  Coding DNA Sequence Number=SeqID_77322
  Homolog annotation: Hit_ID=Q5QIT3; Match level="QueryCoverage=26%, HitCoverage=9%, E-value=8e-09, Identity=55%"; Hit description =Protein phosphatase 2A beta
MDVCQGLNPWEKRPSQISLPGISPLAKKRGAGPGKIPVKIPVLAPVFSLTHLHTFLTRCCTDTRAASHFRGVTPLSRLGRTAFCSAWSCRVDLWEDSVSFTENEGIPDDFKPVLRELLATHPGLEFLQSTPELQERYGLSSILDFLSFATKGINNQIEQAILRADKIGVKVISLAPLLKEKCLDVFLENALEASDP

SEQ ID NO: 194101 - protein, 82 aa, Glycine max
  Coding DNA Sequence Number=SeqID_77323
MWCEEWSENHHEGWRAADGTTGARSNGMRPPQGQRQYGDRKKKKKRKKTKGKTGSNATGKGPKGEWWQRQRQRNCLAGIGKR

SEQ ID NO: 194102 - protein, 104 aa, Glycine max
  Coding DNA Sequence Number=SeqID_77324
MSTKALTNNMAIIFYMALILSGITWIACMKEDTHYSNTYLLHPRQLLQESSSVADPKIPIIPIIGIAIIGGIIVLAIVYYLVRRFCFPPSSSNPSQPNSPPPSP

SEQ ID NO: 194103 - protein, 73 aa, Glycine max
  Coding DNA Sequence Number=SeqID_77325
MLRDIQNVFKEPRSGLAGLAKKLLGAILNKTRRNNNWEQRPLTPNQVSCTENAKKFKKCVPKVVDTDMETSKH

SEQ ID NO: 194104 - protein, 157 aa, Glycine max
  Coding DNA Sequence Number=SeqID_77326
MSTISKASSSKNMTSECDSSEESGWTKYFEDFFVDNHNIDDDQNYCSMSFSGVDSYSTSFVFDAAIKKITDSTLDKEYGNQSSLKKRKKIKTALVDDALEDTASSPIKGSKEKRNTLGERDERKELSFNEKDNDDHTELKKKGRCLVPFSMIVKYLG

SEQ ID NO: 194105 - protein, 97 aa, Glycine max
  Coding DNA Sequence Number=SeqID_77327
MSKQSSIALEPLLPLDNIWYSASLFSVEWLSYSFLHDATAYLAFALTVLSFFLLLSTRDIVALVEHSSPFLFCDANNFLRKMKTFLSNDDINGAIVW

SEQ ID NO: 194106 - protein, 86 aa, Glycine max
  Coding DNA Sequence Number=SeqID_77328
MGEVVLRKWMRDKDTLRCSGRRGSKNLGELANGDYPKFGALIWRSWKMRGRCMMYPYVAITPDCHPHDFVRPSRPGRIGGSDWAQW

SEQ ID NO: 194107 - protein, 114 aa, Glycine max
  Coding DNA Sequence Number=SeqID_77329
  Gene Ontology: Mol. function=protein serine/threonine kinase activity; Cellular component=nucleus; Biological process=protein amino acid phosphorylation
  Homolog annotation: Hit_ID=Q8GVD7; Match level="QueryCoverage=59%, HitCoverage=22%, E-value=2e-23, Identity=72%"; Hit description =Cyclin-dependent kinase
MNRAKENLRGSVPESNNLMSVALERDAQGVTEAEINDLKNTLVLVKENVMRLNISVKDIMDMAVNNTLSVLGDFLWRHLHRPQLIATRRWRVRNERAEGEIKIKNTKFQGIKTI

SEQ ID NO: 194108 - protein, 141 aa, Glycine max
  Coding DNA Sequence Number=SeqID_77330
  Homolog annotation: Hit_ID=Q5N755; Match level="QueryCoverage=75%, HitCoverage=9%, E-value=2e-08, Identity=40%"; Hit description =Putative ZnF_RBZ domain protein
MPQSGSPATKFSSSDEIVSFPLEDRECEWKGVNRLVVSTRKTPLERRLANAQYKKNLTNNDILEIEVSNAGEPIKSHDNLDDMLGRSAGLPQFDNKNFVDEQNANGDNQPSFASNTSHFNNVKGSYTSTVPPIPLSIVKQL

SEQ ID NO: 194109 - protein, 144 aa, Glycine max
  Coding DNA Sequence Number=SeqID_77331
MVQYPATVSWTLTHRIVFDEGIIHQGLFTPLWFDNDDVLVAKEYVSVGYFTNKYHGTWEATPTWGLLLWERHLLLYSYVNITSPMQYRLGGYCYGDYLTLDILGQIHVKYADICKETGTYEVTDVGYETQIIDDLWHNYPAKGL

SEQ ID NO: 194110 - protein, 84 aa, Glycine max
  Coding DNA Sequence Number=SeqID_77332
  Homolog annotation: Hit_ID=Q9FV81; Match level="QueryCoverage=58%, HitCoverage=9%, E-value=7e-12, Identity=66%"; Hit description=Glu -tRNA(Gln) amidotransferase subunit B
  Pfam annotation: Domain name=GatB; Domain location=37-83; Score=19.6; E_value=5.7e-05; Accession=PF01162.10; Description=PET112 family, C terminal region
MELKDMSNSACVIFHHHLGDITDLVATNMVICLWQRTIATRKKERLGDYQYFAEPDLPTIILSQEYVDGIKNSLPELLEIKQRR

SEQ ID NO: 194111 - protein, 840 aa, Glycine max
  Coding DNA Sequence Number=SeqID_77333
  Gene Ontology: Mol. function=protein binding; Cellular component =membrane; Biological process=defense response
  Homolog annotation: Hit_ID=Q1SW19; Match level="QueryCoverage=99%, HitCoverage=96%, E-value=1e-158, Identity=38%"; Hit description =Disease resistance protein
  Pfam annotation: Domain name=LRR_1; Domain location=533-556; Score =3.7; E_value=59; Accession=PF00560.23; Description=Leucine Rich Repeat
  Pfam annotation: Domain name=LRR_1; Domain location=558-579; Score =14.5; E_value=0.39; Accession=PF00560.23; Description=Leucine Rich Repeat
  Pfam annotation: Domain name=LRR_1; Domain location=706-728; Score =11.3; E_value=2.2; Accession=PF00560.23; Description=Leucine Rich Repeat
  Pfam annotation: Domain name=LRR_1; Domain location=755-780; Score =5.5; E_value=27; Accession=PF00560.23; Description=Leucine Rich Repeat
  Pfam annotation: Domain name=NACHT; Domain location=201-360; Score= -34.9; E_value=0.03; Accession=PF05729.3; Description=NACHT domain
  Pfam annotation: Domain name=NB-ARC; Domain location=164-452; Score =126.2; E_value=9.4e-35; Accession=PF00931.13; Description=NB-ARC domain
  Pfam module annotation: Pfam domain module=LRR_1::LRR_1::LRR_1::LRR _1::NACHT::NB-ARC; Domain location=533-556::558-579::706-728::755 -780::201-360::164-452
MAEMAVSFARDKLLPLLSDEAKLLWNIPKEFEDIQNELEYIQGSLEKADRMAAEEGDNANKGIKKWVKDLREASFRIEDVIDEHIIYVEHQPHDALGCAALLFECNITHFIESLRRRHQIASEIQQIKSFVQGIKQRGIDYDYLIKPSLEHGSSSYRGSQSVQWHDPRLASRYLDEAEVVGLEDPKDELITWLVEGPAERTIIFVVGMGGLGKTTVAGRVFNNQKVIAHFDCHAWITVSQSYTVEGLLRDLLKKLCKEKKVDPPHDISEMNRDSLIDEVRSHLQRKRYVVIFDDVWSVELWGQIENAMLDTKNGCRILITTRMDGVVDSCMKYPSDKVHKLKPLTQEESMQLFCKKAFRYHNNGHCPEDLKKISSDFVEKSEGFVKEEEGKTLEDTAQQYLSELISRGLVQVSSFTFDGKAKSCRVHDLLRDMILRKSKDLSFCKHISKEDESMPSGMIRRLSVETFSNGLTGSTKSLHTRSLHVFAQKEEELTNNFVQEIPTKYRLLKILDFEGDLTLPGIFVPENWENLAHLKYLNIRHLAMKTEQLPKYICNLRNLETLDIRETNVSKLPKEFCKLKKLRHLLGDNLDLFQLKNGLGGLTSLQTLCDVSIPVDDNDNGVELIRKLGKLKQLRNLSLNGVKEEQGSILCFSLNEMTNLEKLNIWSEDEDEIIDLPTISSLPMLRKLCLVGKLRKIPEWVPQLQNLVKLTLENCKLTDDPFKSLQNMPHLLFLDVYYGAYEGESLNFEDGGFQQLRKLSLRGMLNLKSIIIDKGALHSLENLLFWNIPQLKTVPPGIQHLEKLQLLEIYNMADEFYECIAPDGGPLHPIVQHPSLVKIL

SEQ ID NO: 194112 - protein, 371 aa, Glycine max
  Coding DNA Sequence Number=SeqID_77334
  Gene Ontology: Mol. function=oxidoreductase activity; Cellular component=mitochondrial outer membrane translocase complex; Biological process=electron transport
  Homolog annotation: Hit_ID=O49312; Match level="QueryCoverage=97%, HitCoverage=80%, E-value=1e-161, Identity=76%"; Hit description =Putative flavin-containing monooxygenase
  Pfam annotation: Domain name=FMO-like; Domain location=33-370; Score=- 418.1; E_value=0.00018; Accession=PF00743.9; Description=Flavin -binding monooxygenase-like
MHDICLNMPPMVQTFDPEDLFKRRCIWVNGPVIVGAGPSGLAVAACLKEQGVPFLILERANCIASLWQNRTYDRLKLHLPKQFCQLPNFPFPEDFPEYPTKFQFISYLESYAKHFNISPQFNETVQSAKYDETFGLWRVKTIRKIKKLGEASSGCCGAVECEVEYICRWLVVATGENSEKVVPEFEGLGEFGGHVMHACDYKSGEGYGGQKVLVVGCGNSGMEVSLDLCNHNANPSMVVRSSVHVLPREAFGKSTFELAVMLMKRFPLWMVDKILLVLARLILGNVEKYGLKRPSVGPLELKHTAGKTPVLDIGALEKIRSGKIKVVPGIRRFFPGKVELVDGQVLQIDSVVLATGYHSNVPSWLKVRLSL

SEQ ID NO: 194113 - protein, 223 aa, Glycine max
  Coding DNA Sequence Number=SeqID_77335
  Gene Ontology: Mol. function=isomerase activity; Cellular component =endoplasmic reticulum; Biological process=cell redox homeostasis
  Homolog annotation: Hit_ID=Q1SC51; Match level="QueryCoverage=99%, HitCoverage=46%, E-value=1e-101, Identity=79%"; Hit description =Thioredoxin, putative
  Pfam annotation: Domain name=DUF1692; Domain location=9-220; Score =292.8; E_value=6.4e-85; Accession=PF07970.2; Description=Protein of unknown function (DUF1692)
MENLVASLPSESQKLPLEDKSDVAKNTERPAPSTGGCRIDGYVRVKKVPGNLIFSARSNAHSFDASQMNMSHVINHLSFGRKVSPRVMSDVKRLIPYVGSSHDRLNGRSFINTHDLGANVTMEHYLQIVKTEVITRKDYKLVEEYEYTAHSSVAQSLHIPVAKFHLELSPMQVLITENQKSFSHFITNVCAIVGGIFTVAGIMDAILHNTIRLMKKVELGKNF

SEQ ID NO: 194114 - protein, 242 aa, Glycine max
  Coding DNA Sequence Number=SeqID_77336
  Gene Ontology: Mol. function=isomerase activity; Biological process =cell redox homeostasis
  Homolog annotation: Hit_ID=Q1SC51; Match level="QueryCoverage=91%, HitCoverage=42%, E-value=8e-86, Identity=70%"; Hit description =Thioredoxin, putative
MCLPVSSVYRKIPRDLTEASLSGAGLSIVAALAMIFLFGMELNSYLSVTTSTQVIVDKSSDGDYLRIDFNISFPALSCEFAAVDVSDVLGTNRLNLTKTVRKFSIDSNLRPTGAEFHSEPAANSIKHDNEVNEESVEGSVVLKTQNFDKYAHQFPITVVNFYAPWCYWSQRLKVFCLMFEGFYVTLPSLSFQKPSWEKAAKIIKERYDPEMDGRIILGRVDCTEDGDLCRRFPFFKNSVSYL

SEQ ID NO: 194115 - protein, 79 aa, Glycine max
  Coding DNA Sequence Number=SeqID_77337
MTWHQYQDKVHLYNILAERNLELSMGMLDKFYGELQWRRWHRVLTKLPEKKIDIALVKEFYSNICGPKDGAPKYCRVRE

SEQ ID NO: 194116 - protein, 50 aa, Glycine max
  Coding DNA Sequence Number=SeqID_77338
  Homolog annotation: Hit_ID=Q1SDP2; Match level="QueryCoverage=68%, HitCoverage=2%, E-value=2e-09, Identity=82%"; Hit description=RNA -binding region RNP-1 (RNA recognition motif); Aldehyde dehydrogenase
MDLTYQQLKPCKCGYEQREYFAQYGKVLKVSMSRTAASVIQQLPNDTCSV

SEQ ID NO: 194117 - protein, 120 aa, Glycine max
  Coding DNA Sequence Number=SeqID_77339
  Homolog annotation: Hit_ID=Q2HW32; Match level="QueryCoverage=34%, HitCoverage=3%, E-value=4e-10, Identity=71%"; Hit description =Lissencephaly type-1-like homology motif; CTLH, C-terminal to LisH motif; Nitrous oxide ...
  Homolog annotation: Hit description=reductase, N-terminal; WD40-like; Quinonprotein alcohol dehydrogenase-like
MEVQMETLLGWAWLVRGLKKFENLRKLENFRHKVFNMGSANGEISLSELGLRDRLVSKSFKIWDISACSLPFQENICLICGDKGDLKSLIYCDQCKACAEHRYLYCELSSLLLNIDNTLI

SEQ ID NO: 194118 - protein, 103 aa, Glycine max
  Coding DNA Sequence Number=SeqID_77340
MTIGDVEIRGGGFIVAARCTVWLEMPRPSSVEMTMLCGCLCSADTVVVRLKEREEKDAEGVVIRGEGKDVNLRMSSLEGVTADGVAVNGVDIASVFLEGAYGV

SEQ ID NO: 194119 - protein, 49 aa, Glycine max
  Coding DNA Sequence Number=SeqID_77341
MGFTWLISSCLFFSSLLEFLFPSFIRGYLLDRLLQLYARSGFQLRGGKN

SEQ ID NO: 194120 - protein, 509 aa, Glycine max
  Coding DNA Sequence Number=SeqID_77342
  Gene Ontology: Mol. function=protein serine/threonine kinase activity; Cellular component=phragmoplast; Biological process =protein amino acid phosphorylation
  Homolog annotation: Hit_ID=Q5SNF8; Match level="QueryCoverage=84%, HitCoverage=79%, E-value=0.0, Identity=82%"; Hit description =Putative serine/threonine kinase 38
  Pfam annotation: Domain name=Pkinase; Domain location=93-396; Score =267.0; E_value=3.7e-77; Accession=PF00069.15; Description=Protein kinase domain
  Pfam annotation: Domain name=Pkinase_Tyr; Domain location=93-382; Score=22.9; E_value=7.1e-14; Accession=PF07714.7; Description =Protein tyrosine kinase
  Pfam module annotation: Pfam domain module=Pkinase::Pkinase_Tyr; Domain location=93-396::93-382
MEDLEEEENGAEEVLGSSLTMEKVAAAKKFIENHYRAQMKNIQERKERRWVLERKLASSDVPNEERINLIKDLERKETEYMRLKRHKICVNDFELLTIIGRGAFGEVRLCREKKSGNIYAMKKLKKSEMLRRGQVEHVRAERNLLAEVASHCIVKLYYSFQDAEYLYLIMEYLPGGDIMTLLMREDTLSENVARFYIAQSVLAIESIHKHNYIHRDIKPDNLLLDKNGHMKLSDFGLCKPLDCNALSTLHENQTIDDETLAEPMDVDDADNRSSWRSPREQLQHWQMNRRKLAFSTVGTPDYIAPEVLLKKGYGMECDWWSLGAIMYEMLVGYPPFFSDDPITTCRKIVHWRNHLRFPDEAQLTLEAKDLIYRLLCDVDHRLGTRGANEIKAHPWFKGVEWDKLYEMEAAFKPQVNGELDTQNFMKFDEVDPPTAARTGSGSSRKGDNEQLIQTMLLVLSFICAKLLVQELLICYFSLNWGKKQQFIWKLTGHYPIGLQQKFTVEEKEG

SEQ ID NO: 194121 - protein, 162 aa, Glycine max
  Coding DNA Sequence Number=SeqID_77343
MADPYYSYGAPAAADGASIARSSFAGYIPSEPSNSTTELRSIGSDYLQRDIGLFYSADDTFGSRVHSEPVKGYSPLADPDPSKKRDTTPLSITHGVPDVNSERPASKSSYDGLPISAADSNILFVGGLPNDCTRREVGRILFSFISLHVGSYVFVCCLLFLA

SEQ ID NO: 194122 - protein, 69 aa, Glycine max
  Coding DNA Sequence Number=SeqID_77344
MVPQEMADHHEWSHDINVEGGIFVRSKNPDNDTDINVVGSHKLFQLISKKVSGVIFPHPNKMFASIIVK

SEQ ID NO: 194123 - protein, 253 aa, Glycine max
  Coding DNA Sequence Number=SeqID_77345
  Gene Ontology: Mol. function=methyltransferase activity; Cellular component=nucleolus; Biological process=regulation of transcription, DNA-dependent
  Homolog annotation: Hit_ID=Q6Z6L6; Match level="QueryCoverage=76%, HitCoverage=47%, E-value=5e-65, Identity=58%"; Hit description =Putative Williams Beuren syndrome critical region 20A isoform 1
  Pfam annotation: Domain name=Nol1_Nop2_Fmu; Domain location=1-213; Score=-45.3; E_value=5.1e-05; Accession=PF01189.8; Description =NOL1NOP2sun family
MAILIACFPFLGIFFLTLRQTYVKGKASSMAAPALSPEPGWEVLDACAAPGNKTVHLAALMKRKGKIIACELQRERIKRLKDTIKLSDIQVLNDDFLNQNPKDPSYSKVKAILLDPSCSGSGTAASRLDHLLPSKAAVPAVERIVYSTCSINQIENEDVIKSVLPIAESNGFQLAKPFPEWQCRGLPVFEGSECLVRTDPAKHGEGFFIALFTRKDANFSGGSNKNETRISHSTPEIKNARRKKKRVPDRGGG

SEQ ID NO: 194124 - protein, 508 aa, Glycine max
  Coding DNA Sequence Number=SeqID_77346
  Gene Ontology: Mol. function=methyltransferase activity; Biological process=metabolic process
  Homolog annotation: Hit_ID=Q5Z7K6; Match level="QueryCoverage=68%, HitCoverage=98%, E-value=1e-141, Identity=68%"; Hit description =Putative coclaurine N-methyltransferase
  Pfam annotation: Domain name=CMAS; Domain location=222-507; Score= -15.8; E_value=1.2e-14; Accession=PF02353.10; Description =Cyclopropane-fatty-acyl-phospholipid synthase
  Pfam annotation: Domain name=Methyltransf_11; Domain location=287 -384; Score=60.0; E_value=7.6e-15; Accession=PF08241.2; Description =Methyltransferase domain
  Pfam annotation: Domain name=Methyltransf_12; Domain location=287 -382; Score=41.5; E_value=3e-09; Accession=PF08242.2; Description =Methyltransferase domain
  Pfam annotation: Domain name=Methyltransf_4; Domain location=266-486; Score=-77.0; E_value=0.09; Accession=PF02390.8; Description=Putative methyltransferase
  Pfam annotation: Domain name=WRKY; Domain location=100-156; Score =68.9; E_value=1.7e-17; Accession=PF03106.6; Description=WRKY DNA -binding domain
  Pfam module annotation: Pfam domain module=CMAS::Methyltransf _11::Methyltransf_12::Methyltransf_4::WRKY; Domain location=222 -507::287-384::287-382::266-486::100-156
MTDKNPRPADSADNYVTNQWPLELSEHLNFDDDQWLDDDPDSFVSGHAFSHNNQANEVGGFGGSGTHFEESSSRDVGNEREKKEVRDRVAFKTKSEVEILDDGSKWRKYGKKMVKNSPNPRNYYRCSVDGWQVKKRVERDKDDPSESSIGRGLMEGMKQLAYNTAVKLILAALEHNLLPDFVTRRYGRFMAANILRSGYKSSSELQLSDLLHFAHSLQQMPIAIDTDETNSQLYELPTAFFKLVLGNKLNFSCCYFPSASMTLDDAEEAMLKLCCERSNLKDGHTVLDLGCGWGSLVLYIAKKYTNCRVTGISYSTTQKTYIEEKCRDLQLQNLNIIVADIGTFEMEASYDRIFSIEMFEHMKNYKDLLKKISKWMKEDSLLFVHIMCHKAFAYHFEDKNEDDWITRYFFAGATMPSANLLLYFQDDVTVINHWLVNGKHSAQTSEEWLKRMDQKMTYIKPIMESTYGKDSATKWTAYWRAFFIVGAETFAYNNGEEWMIAHFLFKKK

SEQ ID NO: 194125 - protein, 99 aa, Glycine max
  Coding DNA Sequence Number=SeqID_77347
MTLDDAEEAMLKLYCKRSNLKDGYTVLDVGCVKNGPKNDLHQANYAIKFFLSQSLTLAPNAMLQAPKSKVQTHDLLPSLDTLQLYLAVQTIWCIGGEKS

SEQ ID NO: 194126 - protein, 217 aa, Glycine max
  Coding DNA Sequence Number=SeqID_77348
  Gene Ontology: Mol. function=binding; Cellular component =mitochondrial inner membrane; Biological process=transport
  Homolog annotation: Hit_ID=Q8L9F8; Match level="QueryCoverage=100%, HitCoverage=65%, E-value=2e-70, Identity=62%"; Hit description =Mitochondrial carrier-like protein
  Pfam annotation: Domain name=Mito_carr; Domain location=124-217; Score=64.9; E_value=2.6e-16; Accession=PF00153.17; Description =Mitochondrial carrier protein
  Pfam annotation: Domain name=Mito_carr; Domain location=31-113; Score= 41.5; E_value=2.9e-09; Accession=PF00153.17; Description =Mitochondrial carrier protein
  Pfam module annotation: Pfam domain module=Mito_carr::Mito_carr; Domain location=124-217::31-113
MSLGTAEDESGSEIHIPAEIDWHMLDKSKFFFLGAALFSGVSCALYPMVVLKTRQQVSSSRFSCLNISCAILRHEGLRGFYKGFGTSLMGTIPARALYMASLEITKSNVATAFLQFGFSETTAVAVANAAAGVTSAMAAQLVWTPIDVVSQRLMVQGSGGSKTTVLANLNSENYRNGFDAFRKIMCADGAIGFYRGFGISILTYAPSNAVWWTSYSM

SEQ ID NO: 194127 - protein, 186 aa, Glycine max
  Coding DNA Sequence Number=SeqID_77349
  Pfam annotation: Domain name=RWP-RK; Domain location=79-130; Score =30.4; E_value=2.2e-06; Accession=PF02042.6; Description=RWP-RK domain
IILSFTNGTPAEVKGFLEDYIAQKDKLGYIIVEEAFSAFYEALCTKLDWIGKPNLEEEEPEAEPEKRRHKRSRKDQSDRINNMTLNDLSGVFHITMKAAKDVLEMSVTVIKAICRKYRLYKWPQRQLQPLARRLKVLKRALESSQDPVIIQTTNMEVRRIKQEMTQLCGGVTPTGIEIPEVEENSV

SEQ ID NO: 194128 - protein, 36 aa, Glycine max
  Coding DNA Sequence Number=SeqID_77350
MEERNEDAWLRDEGQKEQPSQEGDVAGGTPRGWVEE

SEQ ID NO: 194129 - protein, 372 aa, Glycine max
  Coding DNA Sequence Number=SeqID_77351
  Homolog annotation: Hit_ID=Q287W0; Match level="QueryCoverage=95%, HitCoverage=97%, E-value=2e-11, Identity=23%"; Hit description =Expressed protein
MYTTKREQQRFRFQNDSKTPSFSSTLLDKVYRSIDQSNDMKLYNETMGKKQSRVVVEEEEITAASIRRACLLEKWNRSEKVGTQWKTQTRWHHHRHHEHDQDVMFFSSTSSSSDSSSGLLSSSDTESLYGLRSKSRFSCFAPPRPKPVMTSASNEEGLRKSKSRALKIYNNLKKVKQPISPGGGSVKKTKTYDDTKAPKSGQDSTCSSASSFSRSCLSKATPSSSKDKLRDGVKRTVRFYPVSVILNEDSRPCGHKCLYEEDTRVMAWKIGRKKNEDEELRVVDNSRRVEEAAREFLKEYRRSQKKSDFINLRDFTNLDNDDDDDDAASCSSSDLFELDHLAVMGNNRYREDLPVYETTYVSTNRAIANGLI

SEQ ID NO: 194130 - protein, 359 aa, Glycine max
  Coding DNA Sequence Number=SeqID_77352
  Gene Ontology: Mol. function=hydrolase activity, acting on carbon -nitrogen (but not peptide) bonds; Cellular component=mitochondrion; Biological process=nitrogen compound metabolic process
  Homolog annotation: Hit_ID=Q10R10; Match level="QueryCoverage=92%, HitCoverage=91%, E-value=1e-108, Identity=61%"; Hit description =Hydrolase, carbon-nitrogen family protein, expressed
  Pfam annotation: Domain name=CN_hydrolase; Domain location=28-226; Score=148.4; E_value=1.9e-41; Accession=PF00795.12; Description =Carbon-nitrogen hydrolase
MSATSVNSERARAPPAIPLPPPPLSNFKIGLCQLSVSPDKDSNIAHARTAIQDAASKGAQLVLLPEIWNSPYSNDSFPVYAEDIDAGASPSTAMLSELSRLLKITIVGGSIPERSGGLLYNTCCVFGTDGNLLAKHRKIHLFDIDIPGKITFIESKTLTAGETPTIVDTGLNIFKFQADANVGRLQRCMVTKGNEKVGRIGIGICYDIRFPELAMIYAARGCNPEGSLEINYPVLWQTYGISQFLTSGAHLLCYPGAFNMTTGPLHWELLQRARATDNQLYVATCSPARDTGSGYVAWGHSTLVGPFGEVLATTEHEEAIIIAEIDYSILEQRRTNLPVTKQRRGDLYQLVDFQRLNSQ

SEQ ID NO: 194131 - protein, 304 aa, Glycine max
  Coding DNA Sequence Number=SeqID_77353
  Gene Ontology: Mol. function=protein binding; Biological process =defense response
  Homolog annotation: Hit_ID=Q109S4; Match level="QueryCoverage=60%, HitCoverage=15%, E-value=1e-12, Identity=23%"; Hit description=NB -ARC domain containing protein, expressed
MATSDQTLVCVKQVKQEVADEWDESMPLPGDIIEGFSERDADDDSFLPVKASSEFSSQLGKINPRGELIWIQVRRGDSLMKLQVRIVQQKGSILQSEYRIDTTTTRCMAWFSAAISSGVPLVFVNIQTEQIPSTEETHFLKREIATSKQKINNANQIMHGIRLWFLPGLAEISVVLIPQPVEARFGMEIKRTKESFVYIYSVMRGSPADRAGVREMYEESSANGFLLVISRLQCKSIMPTSACSAGLVHCCDQSEMKDILTSAIDQYETIQLHVMAWPNQTRPSPIPDVGGFAALLHPKRDSSL

SEQ ID NO: 194132 - protein, 55 aa, Glycine max
  Coding DNA Sequence Number=SeqID_77354
MVVVGGPVEEVKGMVGNVLVLDNVDNQVWGVVTRERFGIGGVDEEEGLAMAFLNG

SEQ ID NO: 194133 - protein, 1313 aa, Glycine max
  Coding DNA Sequence Number=SeqID_77355
  Gene Ontology: Mol. function=DNA binding; Cellular component=beta -galactosidase complex; Biological process=DNA integration
  Homolog annotation: Hit_ID=Q1SDN3; Match level="QueryCoverage=98%, HitCoverage=96%, E-value=0.0, Identity=50%"; Hit description =Polynucleotidyl transferase, Ribonuclease H fold
  Pfam annotation: Domain name=rve; Domain location=451-597; Score =79.1; E_value=1.4e-20; Accession=PF00665.16; Description=Integrase core domain
  Pfam annotation: Domain name=zf-CCHC; Domain location=266-283; Score =10.1; E_value=0.022; Accession=PF00098.13; Description=Zinc knuckle
  Pfam module annotation: Pfam domain module=RVT_2::Retrotrans _gag::rve::zf-CCHC; Domain location=825-1080::86-201::451-597::266-283
  Subcellular localization annotation: CTP_CleavageSite=51; ConfidenceScore=5.45e-01
MPPRIAPPPPADPSTDPTSPFFVHPSDGPSSVKVTPLLDGSNYHSWARSLRRALGAKLKFEFLDGTIPMPVDAFDPSFRAWNRCNMLIHSWILNSVEPSISRSIVFMDNASDVWLDLKERFSQGDLVRVSEIQQEIYALTQGTRSVTTFYSDLKALWEELEIYMPIPNCTCHHRCSCDAMRLARRHHHTLHVMRFLTGLNDEFNAVKSQILLIEPLPSITKIFSMVIQFERQNCVPNLDDSKALVNASTSKSQGSANGRSNSGSKRYCTYCHKTNHFVENCFQKHGVPPHMMKNHSGSAHHSAVDGGERVESSTASQNTTSVTMTPSLTQEQLDKLLQLIQPPSVNHCNASTSKQVCSFNTAGPSSADTKGTVVFSSSFSITNVLYVPTFTVNLISVSQLCHHTPYTLNFTDTICSIQEQKSLKMIGLGESRDGLYYLTQTNKECASSNYNISSIFSSANNVHIPENAIWHFRYTWITLMKNKSEARLHVQNFIHFIKTQYNHSVKSIRTDNGPEFLMPDFYASKGILHQTSCVDSPQQNGRVERKHQQILNIGRALLVQSNLPKSFWCYAVSHAVYIMNRVPAPNLQNKSPYTLLYNTAPDFDTLKVFGSLVFASTLQSHRTKLDLRARKCVFLGYKSGVKGVVLLDLLNNSIFLSRDVTHHEHIFPYQSSSPKTPWEYHSISPTPNDSDITLDSDISLDINAEQSPSPPHSSLSPNISNDTVISDTSTSTPPPKDHNDSPLLHSKPIRQRRAPLHLSDYVCHNTSPTSHESLTSGTKSKYPLSSFHSLTLLSPSHKAFSMSITHCTEPQSYEEASKHEHWVTAMKEELNALAKNCTWKIVELPPHTKPIGCKWVYKVKHKANGQIERYKARLVAKGYNQVEGIDYFETFSPVAKITTVRTLLAVAAIKNWHLHQLDVNNAFLHGDLQEDVYMKIPDGVTCAKPNSVCKLQKSLYGLKQASRKWYEKLTNLLLKEGYIQSISDYSLFTLTKGNTFTALLVYVDDIILAGDSIDEFDRIKNVLDLAFKIKNLGKLKYFLGLEVAHSRLGITISQRKYCLDLLKDSGLLGCKPASTPLDTSIKLHSAAGTPYADISGYRRIVGKLLYLNTTRPDIAFATQQLSQFMQAPTNVHFNAACRVLRYLKNNPGQGIFFSRTSEMQLIGYSDADWAGCMDSRKSISGYCFFIGKSLVSWRAKKQATVSRSSSEAEYRALSSAAYLRVQLTRTPTLYCDNQSAVHIASNPVFHERTKHLEIDCHLVREKLLKGTLKLLPVSTSDQVADFLTKALAPPKFHDFVSKLSMINIYHDKLEGGC

SEQ ID NO: 194134 - protein, 453 aa, Glycine max
  Coding DNA Sequence Number=SeqID_77356
  Gene Ontology: Mol. function=triacylglycerol lipase activity; Biological process=lipid metabolic process
  Homolog annotation: Hit_ID=Q1SDA9; Match level="QueryCoverage=70%, HitCoverage=51%, E-value=1e-126, Identity=72%"; Hit description =Lipase, class 3
  Pfam annotation: Domain name=Lipase_3; Domain location=135-272; Score= 98.6; E_value=1.8e-26; Accession=PF01764.16; Description=Lipase (class 3)
PGKLFKHYGLRFVTSSIEKKKLAVAAEKNQTTFAATQKEETNEENGGETKEEKNNGGYMISASAAYEIAASAASYLHAQTRSILPFKSSDAVEGEGSHEASNERFNGEKMANTEEANLKATTDSVTAVVAANEQVKQGSESFASWQANLLFEPVQFEGLDVHVHRGIYEAAKGTYQQMLPEIRGHLKSHGSRATFRFTGHSLGGSLALLVNLMLLIRKEAPFSSLLPVITFGAPSIMCGGDTLLDMLGLPRSHVQAITLHRDIVTRVFCCQYPNHLAELLKAVNSNFRNHPCLNNQKLLYAPMGELLILQPDENFSPSHHLLPSGSGLYLLSGSLSESSDTLKQIHAAQLVFLNTPHPLEILSDRSAYGSGGTIQRDHDMNSYLKCVRTVICQELNQIRKARREQRRKAWWPLVLPHGRNTDIVGGSMIQDRPSFSGIIQIGKESLKRFSRLV

SEQ ID NO: 194135 - protein, 321 aa, Glycine max
  Coding DNA Sequence Number=SeqID_77357
  Gene Ontology: Mol. function=protein serine/threonine kinase activity; Cellular component=integral to membrane; Biological process=protein amino acid phosphorylation
  Homolog annotation: Hit_ID=Q67UT0; Match level="QueryCoverage=78%, HitCoverage=68%, E-value=2e-53, Identity=45%"; Hit description =Putative serine/threonine protein kinase
  Pfam annotation: Domain name=Pkinase; Domain location=166-321; Score=- 50.6; E_value=1.5e-05; Accession=PF00069.15; Description=Protein kinase domain
  Pfam annotation: Domain name=Pkinase_Tyr; Domain location=166-321; Score=-90.4; E_value=6.4e-07; Accession=PF07714.7; Description =Protein tyrosine kinase
  Pfam module annotation: Pfam domain module=Pkinase::Pkinase_Tyr; Domain location=166-321::166-321
  Subcellular localization annotation: CTP_CleavageSite=25; ConfidenceScore=5.50e-01
MNLRESPRTQQKLSRQSSKSNRGVKQEAAASPLSSGCCRGLSSVRTVSSTAPTSQQHDQLQQRYEKLEAKVAGLEKEVQRQTELRVMYRKRMERTQDYLKYCLQIAQENGILDLIVHSKVELSQSPLSLYTANSTPPIPTPSHHPNLTAIIDQAKINGWYINPSEIELVEKIGQGTTADIHKGTWRGFDVAVKCMSTAFFRTNENGVVFFAQELETLSRQRHRFVLHLMGACLEPPHHAWIVTEYLNTTLKEWLHGPAKRPKNRSVPLPPFKDRLIRALETAQAMQYLHDQKPKVVHRDLKPSNIFLDDALHVRVADFGHA

SEQ ID NO: 194136 - protein, 82 aa, Glycine max
  Coding DNA Sequence Number=SeqID_77358
  Homolog annotation: Hit_ID=Q8FKG5; Match level="QueryCoverage=34%, HitCoverage=32%, E-value=8e-08, Identity=100%"; Hit description=LacI protein
AQYANRLSPRVGRFINAAGTTGFPTGKRAVDGIDGLDVDHEMDTIRCKDKVIDNLEHDPLKSCGFKRDNVAYSCDIKEQGLT

SEQ ID NO: 194137 - protein, 767 aa, Glycine max
  Coding DNA Sequence Number=SeqID_77359
  Gene Ontology: Mol. function=calcium ion binding; Cellular component =membrane; Biological process=superoxide metabolic process
  Homolog annotation: Hit_ID=Q69NN6; Match level="QueryCoverage=95%, HitCoverage=95%, E-value=1e-163, Identity=46%"; Hit description =Mechanosensitive ion channel domain-containing protein-like
  Pfam annotation: Domain name=MS_channel; Domain location=539-747; Score=50.8; E_value=4.7e-12; Accession=PF00924.9; Description =Mechanosensitive ion channel
MDVINKQQGGLKCGEVTMAEKKREVMVAIPNEQQHSRVNSPHRILNDNEVAGAKSPPLNCASPEIRFMPSPNKPPKVFTSNANLTRRKSLTRSVYSKPKSRFGEQPYPIDGTLLEDNANSTLQENLTVGSPYKASPNNNNKAGTVNRTFSILSVITPKTPLMASPGPAGEDFDEIIYKKVELSKNKRSRRLTAKMLFEWFVFVCIASSLVASLAVGKLKRTEIWGLGFWRLCVLVMVTFCGMLVTRWFMHIVVFLIETNFLLRKKVLYFVYGLKKCVQFFIWLGLVLLTWVLLINRGVHRTELASKILNGVTWTLVSLLIGAFLWFVKTLLLKILASNFHVKSFFDRIQESLFHQYILQTLSGPPLVEEAEKVGASYSVGHFSFRSTDGKGGTKKETIDIAKLHQMKQEKVSAWTMKVLVDAMTTSGLSTISSALDESFDEGENEQTDKEITNEMEATAAAYYIFRNVAAPGCTYIDEDELRRFMIKEEVRMVYPLLAEAETGQITRKSLTDWLLKVYQERRALAHALSDTKTAVKQLNKLVTVLLVVVNIIVWLLLMEIATTKVLVFLSSQLVLAAFMFGNTCKNIFEAIIFVFVMHPFDVGDRCVIDGVELLVEEMNILTTVFLKLNNEKVYYPNSVLATKPISNYYRSPDMGDRVDFSIDFMTPAEKIGALKEKIKRYVERNPQYWHSNHGLVVKEIEDVNKIKMALNVTHTMNFQEFGEKTKRRTELVMEVKKMFEELNIRYNLLPQGIHLRHIEPNSSVLNT

SEQ ID NO: 194138 - protein, 44 aa, Glycine max
  Coding DNA Sequence Number=SeqID_77360
  Homolog annotation: Hit_ID=Q1SC52; Match level="QueryCoverage=81%, HitCoverage=13%, E-value=5e-08, Identity=75%"; Hit description =Plastocyanin-like domain, putative
MPVATLMDSKKFSGGHTVIKLNQSGPHNFISGNKNSCLKNEKLV

SEQ ID NO: 194139 - protein, 76 aa, Glycine max
  Coding DNA Sequence Number=SeqID_77361
  Gene Ontology: Mol. function=Rab GTPase activator activity; Cellular component=intracellular; Biological process=regulation of Rab GTPase activity
  Homolog annotation: Hit_ID=Q1SC55; Match level="QueryCoverage=84%, HitCoverage=14%, E-value=5e-25, Identity=83%"; Hit description=TBC domain, putative
MWRDPGVSADSFYEIRPECTDVPVTRFKIKAGKTLSARKWHAAFTPEGYLDIGKTLSRIYRGSVQQGTLACLKNIR

SEQ ID NO: 194140 - protein, 191 aa, Glycine max
  Coding DNA Sequence Number=SeqID_77362
  Gene Ontology: Mol. function=electron carrier activity; Biological process=electron transport
  Homolog annotation: Hit_ID=UPI0000E804E7; Match level="QueryCoverage =81%, HitCoverage=59%, E-value=5e-18, Identity=35%"; Hit description =PREDICTED: similar to Chromosome 20 open reading frame 116
NLNSDIAVECVIQDNTPSPPIQGVAEEVARESRLAKQDRYSEMRRLKDEEREAQERKLEEEARAQKAKEEEAAALEFEKWKGEFSVDDEGTLEEVQGSTEDLLGNFVEYIKECINRITSLESMGRLSGVMDDRGKFIYISQEEMKAVADYIKRQGRVSISHLASKSNQFIDLEPKAQYSEDINIAEEITVN

SEQ ID NO: 194141 - protein, 666 aa, Glycine max
  Coding DNA Sequence Number=SeqID_77363
  Gene Ontology: Mol. function=GPI anchor binding; Cellular component =anchored to membrane; Biological process=root hair cell differentiation
  Homolog annotation: Hit_ID=Q1SC56; Match level="QueryCoverage=98%, HitCoverage=98%, E-value=0.0, Identity=68%"; Hit description=Cobra -like protein 10
  Pfam annotation: Domain name=Phytochel_synth; Domain location=245 -426; Score=341.4; E_value=1.5e-99; Accession=PF04833.5; Description =Phytochelatin synthetase-like conserv
MKTALLKQVTSSYSTKIITACLFLFLNCHVGYGQNDFEKFSSLSSPPPPLMTELDACNGVFLTYALLGRVKEYPHVKNTSKQAWAFKAEASLTNVGDEEVQGWKMYVGFQHREILVSADGAVLTDAGDFPAEVGNGTTMMGSTATDLKTAIDTAGDIDQMSVRIQMKGTQFGLGAGATPMPKTIHLENDGFKCPAPSRRATRMFVCCRKDPKVKAKQAKKTKYPPRRKGDITIAYDVLQAFQNNYYAQVTIDNNHPLGRLDHWNLTWEWQKGEFIYSMKGAFARRRDPSECLYGLAGKFYKDMDFTNVATCQKKPTISDLPSERKEDEKVGKLPWCCRNGTVLPPIMDKNKARSMFQMQVFKIAPDTDNRTALTPPSKWNIDGVINPKYKCSAPVRVDPQVFPDPSGLSAISTAVASWQIVCNITKPKPQENRCCVSFSAFYNESAIPCNTCACGCDDTRKCSSRASPMLLPPDVLLVPFANRSVKARAWARLKHLHVPSKLPCGDNCPVSINWHVSSDHRDGWTARITLFNWEDYSFDDWFTAVQLRRTFEDFEDVYSFNGTRIPGLKTVFFEGLKGLNYLAGETNGTHANDPRVPGKQQSVISFSKKHIKDFDVTHDGFPTKVFFNGMECSLPPIRPAKSSGRKSSSISVIALVFTAFVTFLMI

SEQ ID NO: 194142 - protein, 191 aa, Glycine max
  Coding DNA Sequence Number=SeqID_77364
  Gene Ontology: Mol. function=Rab GTPase activator activity; Cellular component=intracellular; Biological process=regulation of Rab GTPase activity
  Homolog annotation: Hit_ID=Q1SC55; Match level="QueryCoverage=82%, HitCoverage=39%, E-value=2e-49, Identity=61%"; Hit description=TBC domain, putative
  Subcellular localization annotation: CTP_CleavageSite=70; ConfidenceScore=5.34e-01
MGCKSCSKPILEPSPISLNFLRGNFRCTESSVGVAAQLSNLASVTQFSVNVCETESANVLSLNFGAQNILVEMMWALEYDPELFLMYEMPLSASEKAEGSKGKTKSIRQCGKYEREIVKSGAKNAEAPLPMSIFLVASVLKDKSAKLLQEARGLDDVVKILNDTTGNIDAKKACSGAMKLHKKYLKKAKKP

SEQ ID NO: 194143 - protein, 224 aa, Glycine max
  Coding DNA Sequence Number=SeqID_77365
  Gene Ontology: Mol. function=nutrient reservoir activity
  Homolog annotation: Hit_ID=P19594; Match level="QueryCoverage=70%, HitCoverage=100%, E-value=6e-60, Identity=75%"; Hit description=2S albumin precursor (GM2S-1) [Contains: 2S albumin small chain (Aspartic acid-rich ...
  Homolog annotation: Hit description=peptide); 2S albumin large chain (8 kDa methionine-rich protein) (8 kDa MRP)]
MNSDSYGRVIVSLLYERVKDIFALSPTLLGAQQKCRTCTAAWNWIVVVVRIRQSYIKMYEKVIGGQVALDHGSKPAHSSQVNELLLHFLLLLLLQFLALVLHYLLQRFALAFGASQLAHLCAALLHVSFFFFVFVFSFVPPYVVDSSPHGPENVIVVVIIIIVIAAALDLLHDVLLAGREVHPLELLAAAILLVLPFGGAASVGDAEEKRDEEDCELGHFAIDG

SEQ ID NO: 194144 - protein, 59 aa, Glycine max
  Coding DNA Sequence Number=SeqID_77366
MENQSEELEEKQKKKMEKELINLATMCRSSLVNGDRVRTLLSRQWKHLECALCMALPLF

SEQ ID NO: 194145 - protein, 144 aa, Glycine max
  Coding DNA Sequence Number=SeqID_77367
MEELFVAVLSMLLVAALIPLYLWKRRQDSQPPPPHRDEAPQAPRRETVARAAATRRMRRRPAASGASTSADPPATQEGSVWLNFSISIYRRTGEGSGGESDDEAAGGGYYEAKASKKKEIKRQEREERRQLVAFYTNLPKNHAV

SEQ ID NO: 194146 - protein, 118 aa, Glycine max
  Coding DNA Sequence Number=SeqID_77368
  Gene Ontology: Mol. function=protein serine/threonine kinase activity; Biological process=protein amino acid phosphorylation
  Homolog annotation: Hit_ID=Q96294; Match level="QueryCoverage=60%, HitCoverage=15%, E-value=4e-17, Identity=58%"; Hit description =Calcium-dependent protein kinase
  Subcellular localization annotation: CTP_CleavageSite=70; ConfidenceScore=5.79e-01
MAFHRKRYVNSSHMSRSMQRYVKLNSSCPSSRSTRYRSSMFSFDTSTANVIGAFCFAMKALGKLDFTSLRATMAGDLQQLPIGEEITAEKESVGGEKGSREMCVGSSGLEIKKKKGLN

SEQ ID NO: 194147 - protein, 147 aa, Glycine max
  Coding DNA Sequence Number=SeqID_77369
MGVRAKNQRNVFQKGKRMGVATNVYSRKMLEKPKRRYANIEKKGSSVVYAWGRVLPLLLCILRCDEAKGHFGAVAARPGKLKLNPEAWHLKSPFFLLHSTVIDLQESNDAIDEEDPSLTSSTWSYITLSIQIFLQRLRLGGLDNPPS

SEQ ID NO: 194148 - protein, 91 aa, Glycine max
  Coding DNA Sequence Number=SeqID_77370
  Gene Ontology: Mol. function=ATP binding; Biological process=defense response
MEDVKPMKSPMYVSNPLSKDESGHEAIGVKWVFKIKKNVKGEVERYKTRLVAKGYKIFQLYVKLAFLNGYLEKDVYAEQITGFAIKREEKK

SEQ ID NO: 194149 - protein, 109 aa, Glycine max
  Coding DNA Sequence Number=SeqID_77371
  Homolog annotation: Hit_ID=Q5VR67; Match level="QueryCoverage=54%, HitCoverage=14%, E-value=8e-19, Identity=68%"; Hit description=F-box family protein-like
MYRCRTPIHIQEVSEFFFYKNNGYNLDTTRTRLRLGDMAQAVVRYGSYTVVLEFNHYTPGSRWRLTTVSRKDHREEGNEADGFYGGIRKITSEAEIATWKCLWPSEVLD

SEQ ID NO: 194150 - protein, 120 aa, Glycine max
  Coding DNA Sequence Number=SeqID_77372
MEAIEQEDDLAGRHLKSIFLEEDEFKLVVYPATPPIVLPGLRRVMARTTPNAPQPSPSGIPPPTTSSTVGKPFSSSSQQQHLVQMMQSLHHGHRLAIQNMHQLSIHLSMEPPLVTPKAFL

SEQ ID NO: 194151 - protein, 163 aa, Glycine max
  Coding DNA Sequence Number=SeqID_77373
  Subcellular localization annotation: CTP_CleavageSite=41; ConfidenceScore=5.07e-01
MIDTSAASRSFYSCCCSRFVVVAVTPTPPPFPVVPIQEATPAAEVDALVASAEYGLRHQEALRKVASLEAKVAKWRITARTIWKVKCPKVASAIVAFSEAVKSNHQLSSKGEKKDLVGKVKGIVTEKDELIKVVVVLEARLKESESRLEEFELWLARERKANK

SEQ ID NO: 194152 - protein, 127 aa, Glycine max
  Coding DNA Sequence Number=SeqID_77374
  Gene Ontology: Mol. function=pyruvate kinase activity; Cellular component=mitochondrion; Biological process=glycolysis
  Homolog annotation: Hit_ID=Q2QXR8; Match level="QueryCoverage=87%, HitCoverage=21%, E-value=4e-43, Identity=77%"; Hit description =Pyruvate kinase family protein, expressed
  Pfam annotation: Domain name=PK; Domain location=2-127; Score=-212.0; E_value=0.00011; Accession=PF00224.11; Description=Pyruvate kinase, barrel domain
MTKIVGTLGLKSRSVDTISRCLDAGMSVARFDFSWGDPEYHQETLENLRVAIKSTKKLCAVMLDTVGPELQIENKTDHPITLEADTLVVLTPDQTKEAGSNLLPVNFNGLSKLFSCCIFVLRPACTR

SEQ ID NO: 194153 - protein, 141 aa, Glycine max
  Coding DNA Sequence Number=SeqID_77375
MTIYSNNRILEITCRLRAQLLRARRSCSCARADMEGCLVSKEIVSCRGRLSHVRGSSLDRCENCRSVKLVKLPNLDKCCSGCFCQVVQGGHTFGFISKACAVHAQYSCIRVTLGVGTYWRRGAWVSGIVSWCKKLDHFSSR

SEQ ID NO: 194154 - protein, 104 aa, Glycine max
  Coding DNA Sequence Number=SeqID_77376
MASLHLRNVVLEFLESISIRHGSRRGLEPSKGVSYLRPDRVLTMGEKEREKDFGVCYTAAVRVDVAKVSSWTLHVRLRVAFDRRTREETCKTKDSNAQVCVRLK

SEQ ID NO: 194155 - protein, 148 aa, Glycine max
  Coding DNA Sequence Number=SeqID_77377
MGMHDNTDDWVALWAITFYWLWGWRNKHVHDEHSMRPHNPIVFDSEEKSDRGRNSSGCRRSCLQEYFGRKGGKCWLRLVQAIKNKLMEIGQYYIKHIYREANGCADAIANATHNSQGDVVMFEQSPNILSTLLFADVVGVSTPRLISL

SEQ ID NO: 194156 - protein, 271 aa, Glycine max
  Coding DNA Sequence Number=SeqID_77378
  Gene Ontology: Mol. function=sequence-specific DNA binding; Cellular component=nucleus; Biological process=regulation of transcription, DNA-dependent
  Homolog annotation: Hit_ID=Q1ST32; Match level="QueryCoverage=94%, HitCoverage=99%, E-value=1e-106, Identity=75%"; Hit description =HSF/ETS, DNA-binding
  Pfam annotation: Domain name=HSF_DNA-bind; Domain location=23-215; Score=170.6; E_value=3.8e-48; Accession=PF00447.8; Description=HSF -type DNA-binding
MAFTLDRFEENMVFTLESQKSVPAPFLTKTYQLVDDPHTDHIVSWGEDETTFVVWRPPEFARDLLPNYFKHNNFSSFVRQLNTYGFKKVVADRWEFANEYFRKGAKHLLCEIHRRKAPQQHHQLFHDQSPSQIFQQDENLCWLDTPLPSPKPNTDILTALSEDNQRLRRKNFMLLSELSHMKSLYNDIIYFIQNHVKPPPFEQRSSSVIPNLVELDSLHESPNDMGVRRSAKSCVVDKSLITSTEESNSSVKLFGFPLSGRKRLHPDNTNC

SEQ ID NO: 194157 - protein, 51 aa, Glycine max
  Coding DNA Sequence Number=SeqID_77379
MRKLIKERMENKVVNFVGLNKVVSGIKWMNGMKYRNGNNGSYRAPNEVIPK

SEQ ID NO: 194158 - protein, 191 aa, Glycine max
  Coding DNA Sequence Number=SeqID_77380
  Subcellular localization annotation: CTP_CleavageSite=43; ConfidenceScore=5.91e-01
MGSPPASTTPPPPPPPPSSSSPPPPPPTSDASASTSAVKRTRKASRLRSLSTRPPGVERPVVHVDPATGKADGPHKKKLRTYLGIVARDKVDITYENWKEVPTTQKDLIWEDIQAEFDFPEASDSRTKRKLLQTVGERWRQGLNQTSRGNGPLQPIRTVSRTLSVTNTASARKSGPSFARLAKTLLGRMCA

SEQ ID NO: 194159 - protein, 165 aa, Glycine max
  Coding DNA Sequence Number=SeqID_77381
  Gene Ontology: Mol. function=RNA-directed DNA polymerase activity; Cellular component=intracellular; Biological process=RNA-dependent DNA replication
MVEEQNDKTTLTPNEDIPVKGLSEKRDGCGKKEVSLEEASEFLHIIQQSEFKVLKKAHVAQDISVEGFGGLVNNIIANNYLAFAEEESLSRGEGITGLCMYQSNAWTTSWPSQVPWWSVPSTAPAESRSLYTPPKTEVRSRGTFGYYVWGGRHLGKLLVLYAICG

SEQ ID NO: 194160 - protein, 130 aa, Glycine max
  Coding DNA Sequence Number=SeqID_77382
MATNKKLIAPRAFGNGISISIPDTVKDHGELKLSRFVRGCAWNICEFLASSTPFCEVEGFGLKCQPIVVGMHYLCCQGASLGVEVADSIMCLECLLDDGIEVSNFLSASKLGEQVYILKQSKSSMRVFTV

SEQ ID NO: 194161 - protein, 113 aa, Glycine max
  Coding DNA Sequence Number=SeqID_77383
  Gene Ontology: Mol. function=sodium:hydrogen antiporter activity; Cellular component=integral to membrane; Biological process=sodium ion transport
  Homolog annotation: Hit_ID=Q4VT46; Match level="QueryCoverage=57%, HitCoverage=12%, E-value=6e-16, Identity=67%"; Hit description=Nhx1 antiporter
MQTWNNSFFPPISTCVFNQDETPLLYSLVFGEGVVNDATSVVLFKAIQNFDLFHIDLTTALQLLANFLYLLIVSTVLGIFVRKPYTITKQRERWTNEEHKKFLEALKLYGKAW

SEQ ID NO: 194162 - protein, 1220 aa, Glycine max
  Coding DNA Sequence Number=SeqID_77384
MLSIVEIGNLDKQGLMCHVGEASAMHMQYSCIYVTCGVDTYWRCGTSHLRGKAQPSGTSPVGEPISVTMILPPSISWGARKSGGGDIMASPCVRCSHYARLPLSLLRLLALNGTEDSYKLAVQPFESDDFPFLRVVLGSPPFFFMYKCLFEVLGLMKLIGKIGWVSLISVSKKLFEFDWNVFRRFKDRFFKVLATNVVADELPLMFNRDGEPCFLFYWQSDLTRFKSFDEDLLTLVERVDKVSTKTNTCRVVVQFIGIMSDFAWRPFVKQGQPAIEVGPTTDVVERDDGTEVLGRKKLRAPFSLRALRQVVGFMLGSGCPAGLQDLPSTPLAVQVYAPAAVVVSTFATPPPPTVSIQEVILAAEVSAPVTLADLVVPPSSTLLSANHIYTARDFDSLWGLAILEENGQRHQKALNKVASLEPEVAKWRVTACTVWRVGHTKMLFTRLDGDELFKRCKGLQRESNELANKVESTTTKKGELAKEASKELEEELIMYKKEAMEQHEKSFHKAIRQTRFFNKDLDLGLFYPFKDVKDGVLLDKKDIAIEEEVGEEQDAEEQGDGLVDQSGGSLLCLVESGTFMLVVVPKERAYREQILGLMSFGPGMHSSWALEKQDSPRIDLGFDEPLEKRDLPRVDLGFDEPLEMRNSPRADLGFDEPLEMRDSLRVHLGFDEPLEKSETHRGRTLDLTSLADLWLDKPLEKPDSPRADLGFDEPETHQGVDLGFNEPLELGCACPEFCQDLARTNLGLLIGGSLTSMVIMASVPYVSWKGVLLGLKDNSVGYLYLTVGLGMFDRSYQSIATSKYLTAPRAFGSGPSMSIPHMAKVEGICLERWPIVAGAHHFGSKGASPCMKVANPFMKFFHDIVYLLAVQAFEQGVHGGSLERLLDDSLEVLGLFGVGQLGEQVYSGVALPGTASLVWYLLALDNLRVSVAFDIVRAFEDDSCPTSLHIGHIVNVEAPPVLGGLVVSSKFCQKVCHELSSWGRGVRTGDQTLKVLLAMLPPSLLMGSWCFPSSCMRVELTTSSTIERYKRKGTPGPGRLKTGGMTMVFLKAKNACLRNDFTFSMSLGRNLDMDARVGFYSPMCDDKAQELASADPENFSEYLFQVCHMLGYATGFDNHVVNVDLDISSDMLLKIRSINLWTHPVKVGVVSAYSHLQLAFLTMMMLANQHVRWLPSKQVRVPVYDISYASLLMAGEVSAELHALPEFGSELQLDKFFNRL

SEQ ID NO: 194163 - protein, 163 aa, Glycine max
  Coding DNA Sequence Number=SeqID_77385
MGMGGSDFEDSIWQPLVDCEVVPINDFSSEETRCEAFDGGSSSFERLVDLHCVGEGTSHPCRRVVHTAEEKEDLAAIVAESAKVIVDLQARLRESMLIVSDLQYRLKESELEVEKEKEANKELEEELLMFKNEDMKEDKLLDEEEVVVAEEDAGKEQDNGANV

SEQ ID NO: 194164 - protein, 413 aa, Glycine max
  Coding DNA Sequence Number=SeqID_77386
  Gene Ontology: Mol. function=RNA-directed DNA polymerase activity; Biological process=RNA-dependent DNA replication
MTDIDTLKQLQNQITEMERLHEEELRKLKANHDRLQSHLRCPQGRTTRRHPFVNRIMEVDIPLGWKPPNLEQYNGTTDPDEHMDAFLTKVNLWTNDDAILCRVFPTSLKGVALTWYDGLPPRSIDSFNTLVALHSMFLSLWPGKSGNSLCKKILVEWTNCKNEPKATFKWKKCPGPETRSENPDKSATREKKEQDLEDIKRITTETMIPTEEETKQKIEEDRDTTSKDASKNLCKNKKMNHAANKSQSSKRHLYAIWDIDINYVDLPSPQSLPPITFTDRDFKGSNPINQDDPMVVSIIIANFMIKTRGYVDLMTTFSQGQLSKIFSIRYLIIDANTFYFALIGKKELNELRDIISTLHQKMQFPTLRGEIVTVKTDQKQARQCYAESLKVAPYPHTSELAKPHPQRVATLKS

SEQ ID NO: 194165 - protein, 143 aa, Glycine max
  Coding DNA Sequence Number=SeqID_77387
EPLLPESSSGILKVLPEERVFRNSSGRTLLPESFRKRFSGSLPEEVFFRKNTSSENFPENVLPELPEEPLTGLPEDSAVSLLRHFFRRTLVFYPKVTILRFHCYANNAAYYKQRVGREINLFAEKKKKTLGAPRGEEASSRRR

SEQ ID NO: 194166 - protein, 71 aa, Glycine max
  Coding DNA Sequence Number=SeqID_77388
MAKASFTMNNDQSKDDYCVQLLEYLNECNSEGSIVILLTHARIKESQGSCNSLKASKLLINQPMPKIEEFK

SEQ ID NO: 194167 - protein, 60 aa, Glycine max
  Coding DNA Sequence Number=SeqID_77389
MPDDREGGISTRNFHPTPQAVFPEPPGSGVGVILEGPDSVTLEQTIKFNFKELMKHWAWT

SEQ ID NO: 194168 - protein, 213 aa, Glycine max
  Coding DNA Sequence Number=SeqID_77390
DFLHRIFEEDSEDSAPIKVFLLVWGSNGKQRRLAMATGGRIYNLQISLRKTVALRRSPLLALSTPLGAQHNFLSVEIGLSAPLGAQRNFLSVGIGLSTLLGAQRNFLSVGIAISVPFALRERPKVVIVKIPTMGIVDAMLDIVSSGTTLIENNLKEIKGGDVTANMRGSSAEEVAERILSQPSLMGLQASYAKNKTKQQHCPVDTEQQVANVP

SEQ ID NO: 194169 - protein, 352 aa, Glycine max
  Coding DNA Sequence Number=SeqID_77391
  Gene Ontology: Mol. function=RNA-directed DNA polymerase activity; Biological process=RNA-dependent DNA replication
  Homolog annotation: Hit_ID=Q1S4N5; Match level="QueryCoverage=92%, HitCoverage=79%, E-value=3e-47, Identity=32%"; Hit description =Peptidase M, neutral zinc metallopeptidases, zinc-binding site
MNVACGEESKARYSLCFVSQANVVEVASDMDLNIRGAVEKSTLRHVDHLVKKFHPPLCLLYETHAPFVRVAGKWDSWGYKPSFIQEVGYGICKHVGWHRSFGFPYFGNTVYVEENVVDGGHVRKRLDRCLAHVDWGMAFPHAIVEILAPHNFDHNLLLLSCSKFKTNSVRSFQFRAHPDFNELISECGQGLMGMLFQSWPRDTKFFLVQVVIRRWRNRVISLQIDGIWVDYDEVFKKEANSFSKKLLQSTVACTPQSLILWRRWFSNFFISKVSDVIAQEVWELVAYAHETGNINPALAETIIVPIPKVDGPTNLKEFQPISLCNVLFKLILKVLVERIRPRLSSIIGPFQN

SEQ ID NO: 194170 - protein, 98 aa, Glycine max
  Coding DNA Sequence Number=SeqID_77392
  Homolog annotation: Hit_ID=Q7XHQ1; Match level="QueryCoverage=60%, HitCoverage=18%, E-value=9e-07, Identity=43%"; Hit description =Calcineurin-like phosphoesterase-like
  Pfam annotation: Domain name=DUF1723; Domain location=2-34; Score =10.6; E_value=0.029; Accession=PF08330.1; Description=Protein of unknown function (DUF1723)
MSHTFYLPIGECTITLEDIALQWGLHIDGRPINGPRSYDWEQMCAKYIAPNIEIEQYPPQQSPPVVANMHDEGLQPHAQSYEFTPQHHHHQEDYGYNP

SEQ ID NO: 194171 - protein, 59 aa, Glycine max
  Coding DNA Sequence Number=SeqID_77393
METTNAEVIKLRETKLYPQLIKLVKGIRAYIGSKPDVHLTCNNNNVTPLAHNLHSNIVP

SEQ ID NO: 194172 - protein, 98 aa, Glycine max
  Coding DNA Sequence Number=SeqID_77394
MGSSQVPWLKKRFYQVKIKSLGVASLKELGQLMGQLQQQALRKAYGKIWDLTMAEVSTEAIASLAQYYDQPLRCFTFGDFQLTPTMEEFEEILGCLLG

SEQ ID NO: 194173 - protein, 87 aa, Glycine max
  Coding DNA Sequence Number=SeqID_77395
MEAEAKNKYVKKEENNNDNNNNKSNSKIGNSSEGLSKPKCQMKTLFQLETLEKAYAAIEGQEGVAGKEAAKGSSVAGFSGGGAQVGA

SEQ ID NO: 194174 - protein, 104 aa, Glycine max
  Coding DNA Sequence Number=SeqID_77396
MVEKSIWAGEAHPSELELAQASQLLSSEGISSPRRAGYLRLKIFHGLGEPDASLGELWSRKFHKMTIFPISLWFSFLDLAINLSDGSTLHCNRCQTIKAFPGRN

SEQ ID NO: 194175 - protein, 269 aa, Glycine max
  Coding DNA Sequence Number=SeqID_77397
  Gene Ontology: Mol. function=nucleoside-triphosphatase activity; Cellular component=membrane; Biological process=cobalt ion transport
  Homolog annotation: Hit_ID=Q2P430; Match level="QueryCoverage=99%, HitCoverage=92%, E-value=1e-111, Identity=76%"; Hit description=ABC transporter ATP-binding protein
PLHDGDEQIGQARAAGLAKGGELGARHAIEQHHGLAERQAALVDRLHGAGGVQLVGIDQQLGVAPADVVHFRVEHDAAVADEHHVAEDVLDLLHLVGGDDDGLLFVEVVFQQALVELLAVQDVQAQGRFVQHQDAGIDGHHQRQVQLHDHALGQLAHALLRLQLGIGQEALATGAVEARVHAGDEVDRLADLQPARQYGDVGDEADVVHQFVAVQSRVAAEHAQFTLHRGQAQKGLQRGGLAGAIGPDQADDTPAWNAETGIVEGDRGL

SEQ ID NO: 194176 - protein, 74 aa, Glycine max
  Coding DNA Sequence Number=SeqID_77398
MKMKANKTRNELKVSDSNTYWLKNKERTKNAGKSSQIYSWKRLGSVTEALQLDSSSRKWKREVLDAKRLLEENF

SEQ ID NO: 194177 - protein, 240 aa, Glycine max
  Coding DNA Sequence Number=SeqID_77399
  Gene Ontology: Mol. function=transferase activity
  Homolog annotation: Hit_ID=Q7N2Q8; Match level="QueryCoverage=97%, HitCoverage=73%, E-value=4e-30, Identity=32%"; Hit description =Similar to putative galactosyl transferase or beta- glucosyltransfera se
  Pfam annotation: Domain name=Glycos_transf_2; Domain location=9-184; Score=95.4; E_value=1.7e-25; Accession=PF00535.16; Description =Glycosyl transferase
MMVPDYLISVLLTAHNSEKFLPDTLASLEKACHGVEQYIEFILINDASVDNTAALLDDFSRRHPQAKVFNIDYRNIGRVRNFGVQQCSGEYITMLDGDDQLLADALADIVRYLKSHRPDALFTALNEVYESRPEHITWQGLQAETLSRHQAIEKFLIHRDLQAHFIGQFIKRTMLLAHPFPDYTCYEDAWLFPEILVSSDAIAYSRQSPYLYFKRGNSLSSQLDKHKISLLVSATQHMDE

SEQ ID NO: 194178 - protein, 63 aa, Glycine max
  Coding DNA Sequence Number=SeqID_77400
MHFKYAPTTMEASDGHCERGATRSKQHRQHGGGQQAMKQWKVGSEVATTQGIEAQAHGFERRF

SEQ ID NO: 194179 - protein, 100 aa, Glycine max
  Coding DNA Sequence Number=SeqID_77401
MKKRTEDEEDFSLFVKKFKNLSRREELRGMLQMRPTWSIKANCPSNEEWPEKNDKKKYEERRTKKVYIAWDDNDSFDGSEKEINLLTRDYESDENISQED

SEQ ID NO: 194180 - protein, 294 aa, Glycine max
  Coding DNA Sequence Number=SeqID_77402
  Gene Ontology: Mol. function=hydrolase activity, hydrolyzing O -glycosyl compounds; Biological process=tricarboxylic acid cycle intermediate metabolic process
  Homolog annotation: Hit_ID=Q989F8; Match level="QueryCoverage=94%, HitCoverage=57%, E-value=1e-147, Identity=88%"; Hit description =Alpha-galactosidase
  Pfam annotation: Domain name=Glyco_hydro_4; Domain location=1-255; Score=-167.7; E_value=0.0069; Accession=PF02056.6; Description =Family 4 glycosyl hydrolase
MARLIRSVSATAFSTGAEQIAEILGAKSRAELEYICSGINHQTWFIDLRLNGRKIGKEELVAAFEAHPVFSQQEKLRIDVLKRFGVYSTESNGHLSEYLPWYRKRPEEIARWIDMSDWIHGETGGYLRHSTETRNWFETEFPQFLASADKPIDPAKRSNEHASHILEALETGRVYRGHFNVKNNGVISNLPADAIIESPGFVDRFGINMVSGITLPEACAATCMASINVQRMSVHAAVTGDIDLLKLAVLHDPLVGAVATPEEVWQMVDEMVVAQARWLPQYADAVPAAKERLA

SEQ ID NO: 194181 - protein, 57 aa, Glycine max
  Coding DNA Sequence Number=SeqID_77403
  Subcellular localization annotation: CTP_CleavageSite=49; ConfidenceScore=5.44e-01
QVFSLSLRVKGGVLSKFTLAQRLFTAYPSSRFLCALSRRMVRLADGSPSAWHGSAGS

SEQ ID NO: 194182 - protein, 118 aa, Glycine max
  Coding DNA Sequence Number=SeqID_77404
MLTSLERAQTTTLVSACPSNLGSPNDKVQITIRRLRMLPDSRSRLEDANISGKGADDHIGLFVSIGLGDSKMCARITIGCLRVPQDSQVTIAKGGVVDKSGAFALMYPQFVMRNSDLR

SEQ ID NO: 194183 - protein, 302 aa, Glycine max
  Coding DNA Sequence Number=SeqID_77405
  Gene Ontology: Mol. function=nucleic acid binding; Biological process= DNA integration
  Homolog annotation: Hit_ID=Q1SG63; Match level="QueryCoverage=53%, HitCoverage=16%, E-value=9e-38, Identity=43%"; Hit description =Integrase, catalytic region; Zinc finger, CCHC-type
MEIYVSDRLGKSVCVCFLISEVVIIKKGEIVEAKLHDESRLIQICFDDNKDDDKKLKGQSKNEFKMFKIESRTLQDIRGKLISRIKRSLNQDKYEKYRVHLLGLLTENKRGYISCGSVLVEGTSTRFKENKGGYIPCGSLLVKGFLQDEIIFSATLEKACNEFFELMKDEFEMSMMSELKFFLGLQIIQKDDGIFIHQEKFTKDLLKRFKIDEARSMATLLHPSTVIDKDKKGNYTPEKEYRGFEIDLVHYCDADFVGDKVEWKSTSGACQFLEKSLVSWSSKKQSTIALKSFGSSNKFWIV

SEQ ID NO: 194184 - protein, 156 aa, Glycine max
  Coding DNA Sequence Number=SeqID_77406
  Homolog annotation: Hit_ID=Q1SXA8; Match level="QueryCoverage=74%, HitCoverage=7%, E-value=3e-07, Identity=34%"; Hit description=Zinc finger, CCHC-type; Polynucleotidyl transferase, Ribonuclease H fold
EQGRVHLLWLFACKGFYKVIGNLKNRGLLGDWMPLDPTIAITEAKNLKTLGMDELIGSLKVDEKKSMNEMQIPKGEIIALKAYQKTKTKHQCKALSSIVVFDVENNYDEFSEEDEEELSFLTKRVQRFLRRRKGPRRNFSNRDFQQGESFRDIRCF

SEQ ID NO: 194185 - protein, 232 aa, Glycine max
  Coding DNA Sequence Number=SeqID_77407
  Subcellular localization annotation: CTP_CleavageSite=62; ConfidenceScore=5.21e-01
MAIKNPSNSSTSNSETSHSPSPKNQDKGKGKAIHISFGPNFEATMTITPLCAKVIVIGSPKRRSLVKDEKYGRKRQRPELVKVFFLGAEVDYNNFIMNTTIKGIEIMILEHILADILKVLRDNSRLYDECLEVQGHRRTKKVPLSLPHLIINHLIKATKPIKSTSNVPYGMLMTLVLRHFGFSLHGKLIDDDVLSLGAKNVATLKLSPQPDMEKACIFYEEEDQNKEKHKEK

SEQ ID NO: 194186 - protein, 71 aa, Glycine max
  Coding DNA Sequence Number=SeqID_77408
MPTVALVVVVDMVVGVAVGVNAGERQSKRLRGENANGDENGESKKDLDRDRERYHDREQSSGRYRSERERN

SEQ ID NO: 194187 - protein, 108 aa, Glycine max
  Coding DNA Sequence Number=SeqID_77409
MGSDADLGAGLGGLGAGHGIKVGRGRGVSIGASVGGGCTEEENGERWLDIMSSKSMGAWVAAKLVMATSRRSSLAAEGLASAIEERQRRGRSDQIVTNRVYTTKLNYK

SEQ ID NO: 194188 - protein, 107 aa, Glycine max
  Coding DNA Sequence Number=SeqID_77410
MTKARQKGVPKGKEGEACHPARPGELGCFLQKAPPSGGTSWKAQVGLVAICTPSCYGTSRIVQQCSLLTSGTLWNITYCATMGAKYLEAVKQRLHAIKQWSPDEISV

SEQ ID NO: 194189 - protein, 80 aa, Glycine max
  Coding DNA Sequence Number=SeqID_77411
MFRFRIGSKIPLAILHFGCGSKILGCIRNTRMCTYAIFDSQSALSMHVCKFSKGNACDVGNGLEEACLKEVQEGQGSRRN

SEQ ID NO: 194190 - protein, 69 aa, Glycine max
  Coding DNA Sequence Number=SeqID_77412
MLENGGKIKVEGIGSMRMKLYNGAIQTFSNMTSQGYKYVGSKWACKVYRGRHLVLRGKKNKGNLCCLDE

SEQ ID NO: 194191 - protein, 188 aa, Glycine max
  Coding DNA Sequence Number=SeqID_77413
MTFLGETNSQTIVNSRLGFIFPNGSIIHNDSGVYFQTSTPVPIRVPNSCDFATLKTRIHITLNLTYEVFLDEIHYRQPVKETCNYFLFQCMQLKNDDDVNTMLMCNDQFSCVGPIELLCTIGRTLDEILNLLECTMTHTHDALLYYNGRWNMPRQNNFLGYAFTGKNPKKFEILSGCTIDELKDLIKQ

SEQ ID NO: 194192 - protein, 38 aa, Glycine max
  Coding DNA Sequence Number=SeqID_77414
CGNTFWLSAPRHSETPSSIDKQRPMWSSAPFPDMSASP

SEQ ID NO: 194193 - protein, 84 aa, Glycine max
  Coding DNA Sequence Number=SeqID_77415
MASQGDWVPFMDVLALLIFGVVLFPNIDGLVDLAAIDAFLAYHHSKESPVVAVLVDLFDTFDRSKTRGIHVRSRAIARVLKKEE

SEQ ID NO: 194194 - protein, 71 aa, Glycine max
  Coding DNA Sequence Number=SeqID_77416
MVASFGYHKEHDGMMALGFDRLQTYVGERFDSLERQVDTRFEEMDSRITKVEGDVTFIRDCFDLPPPPPSV

SEQ ID NO: 194195 - protein, 463 aa, Glycine max
  Coding DNA Sequence Number=SeqID_77417
  Gene Ontology: Mol. function=protein binding; Cellular component =integral to membrane; Biological process=protein amino acid phosphorylation
  Homolog annotation: Hit_ID=Q1ST34; Match level="QueryCoverage=85%, HitCoverage=100%, E-value=2e-68, Identity=37%"; Hit description =Leucine-rich repeat
  Pfam annotation: Domain name=LRR_1; Domain location=123-145; Score =7.5; E_value=11; Accession=PF00560.23; Description=Leucine Rich Repeat
  Pfam annotation: Domain name=LRR_1; Domain location=153-174; Score =19.0; E_value=0.017; Accession=PF00560.23; Description=Leucine Rich Repeat
  Pfam annotation: Domain name=LRR_1; Domain location=176-198; Score =8.5; E_value=7.3; Accession=PF00560.23; Description=Leucine Rich Repeat
  Pfam annotation: Domain name=LRR_1; Domain location=19-46; Score=6.1; E_value=21; Accession=PF00560.23; Description=Leucine Rich Repeat
  Pfam annotation: Domain name=LRR_1; Domain location=200-222; Score =15.3; E_value=0.22; Accession=PF00560.23; Description=Leucine Rich Repeat
  Pfam annotation: Domain name=LRR_1; Domain location=224-246; Score =11.4; E_value=2.1; Accession=PF00560.23; Description=Leucine Rich Repeat
  Pfam annotation: Domain name=LRR_1; Domain location=253-274; Score =12.0; E_value=1.6; Accession=PF00560.23; Description=Leucine Rich Repeat
  Pfam annotation: Domain name=LRR_1; Domain location=276-297; Score =12.8; E_value=1.2; Accession=PF00560.23; Description=Leucine Rich Repeat
  Pfam annotation: Domain name=LRR_1; Domain location=300-322; Score =11.3; E_value=2.2; Accession=PF00560.23; Description=Leucine Rich Repeat
  Pfam annotation: Domain name=LRR_1; Domain location=324-346; Score =11.1; E_value=2.4; Accession=PF00560.23; Description=Leucine Rich Repeat
  Pfam annotation: Domain name=LRR_1; Domain location=353-374; Score =8.5; E_value=7.5; Accession=PF00560.23; Description=Leucine Rich Repeat
  Pfam annotation: Domain name=LRR_1; Domain location=376-398; Score =12.5; E_value=1.3; Accession=PF00560.23; Description=Leucine Rich Repeat
  Pfam annotation: Domain name=LRR_1; Domain location=400-423; Score =9.4; E_value=5.1; Accession=PF00560.23; Description=Leucine Rich Repeat
  Pfam annotation: Domain name=LRR_1; Domain location=425-445; Score =8.5; E_value=7.2; Accession=PF00560.23; Description=Leucine Rich Repeat
  Pfam annotation: Domain name=LRR_1; Domain location=48-71; Score=9.8; E_value=4.1; Accession=PF00560.23; Description=Leucine Rich Repeat
  Pfam annotation: Domain name=LRR_1; Domain location=74-96; Score =12.3; E_value=1.4; Accession=PF00560.23; Description=Leucine Rich Repeat
  Pfam annotation: Domain name=LRR_1; Domain location=99-121; Score =9.4; E_value=4.9; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1; Domain location=123-145::153-174::176- 198::19-46::200-222:...
  Pfam module annotation: Domain location=:224-246::253-274::276 -297::300-322::324-346::353-374::376-398::400-423::425-445::48-71::74- 96::99-121
  Subcellular localization annotation: CTP_CleavageSite=60; ConfidenceScore=5.06e-01
MPNLNTSHSFLQMIAKLPKLRELSLSECSLPDQFILPLRPSKFNFSSSLSVLDLSFNSLTSSMILQWLSNVTSNLVELDLSYNLLEGSTSNHFGRVMNSLEHLDLSYNIFKADDFKSFANICTLHSLYMPANHLTEDLPSILHNLSSGCVKHSLQDLDLSDNQITGSLPDLSVFSSLKSLFLDQNQLRGKIPEGIRLPFHLESLSIQSNSLEGGIPKSFGNSCALRSLDMSGNNLNKELSVIIHQLSGCARFSLQELNIRGNQINGTLSDLSIFSALKTLDLSRNQLNGKIPESTKLPSLLESLSIGSNSLEGGIPKSFGNACALRSLDMSNNSLSEEFPMIIHHLSGCARYSLEKLDLGMNQINGTLPDLSIFSSLKKLYLDGNKLNGEIPKDYKFPPQLEQLDMQSNSLKGVLTDYHFANMSKLNYLELSDNSLVTLAFSQNWVPPFQLTYIGLRSCKLGP

SEQ ID NO: 194196 - protein, 61 aa, Glycine max
  Coding DNA Sequence Number=SeqID_77418
MSMKNLIGRVGVHDKTDHTLGYQSGSLCFERTLQPYGSVFTPKAYTPKSPSGLLPPNSGPT

SEQ ID NO: 194197 - protein, 83 aa, Glycine max
  Coding DNA Sequence Number=SeqID_77419
MFGVASTMFSDEQPWLQRGDIPGSMIIDDERYWCERKGFGEKLRKENKAMGRKDLKHLKKGKREWLGGRGGGSRDITVACGPL

SEQ ID NO: 194198 - protein, 92 aa, Glycine max
  Coding DNA Sequence Number=SeqID_77420
  Homolog annotation: Hit_ID=Q6K5Y4; Match level="QueryCoverage=69%, HitCoverage=17%, E-value=2e-16, Identity=72%"; Hit description =Putative UDP-N-acetylglucosamine transporter
  Subcellular localization annotation: CTP_CleavageSite=54; ConfidenceScore=5.15e-01
MSLKPSNSSENLMLPVSDPPKSHDADDKLFKGSAMTKRGAFAAVSYMSCAVLLVMFNKAALSSYNFPSANVITLLQFFICYISTIVLQIIGL

SEQ ID NO: 194199 - protein, 118 aa, Glycine max
  Coding DNA Sequence Number=SeqID_77421
MSISPCGRIAPTKTPNELGEVQQGPGVSSSGDGPLLVLQGARSPQQGIVPARHPVDPKKSNRVLELLALITGLSFIKKYCALRQAQGETPQQSGDGRQRATDAPPPPLEFTSAHPQKG

SEQ ID NO: 194200 - protein, 131 aa, Glycine max
  Coding DNA Sequence Number=SeqID_77422
  Homolog annotation: Hit_ID=Q6K5Y4; Match level="QueryCoverage=26%, HitCoverage=10%, E-value=6e-08, Identity=74%"; Hit description =Putative UDP-N-acetylglucosamine transporter
MSSQELYAAKENFLLTVDYMGISNTMLRNMGEPKLERKRRLTNITIILTISTNPTIPNNDMNIKNIKSEYIKAIKECTLDSMALSGKGKTTSKAYIPSDYHKLSVSQLNLVLCSEKYSNSRRMPARRKKAK

SEQ ID NO: 194201 - protein, 125 aa, Glycine max
  Coding DNA Sequence Number=SeqID_77423
MMVTCRLNGADTYDLMDGVVDVEYSISTLNFNFNTLPFLLSSIIQPIVTCVHGVAIFVAAAASKISAANTQPDENLKQKFSNQLLKRGCHVDEDATGVDGGEGAEEGVEDVGGVADDRENDIRAG

SEQ ID NO: 194202 - protein, 125 aa, Glycine max
  Coding DNA Sequence Number=SeqID_77424
MDHLLNWSIVDKHLKPLDATKGRTTEGVGGSSLCQRWHDGRRELTELAHNREGHHKPVLVEFVSSTKIVIAMMMTRGNQGWWWWWSPESCSTWGNGLGEEERGKRKQSSTINSLWQLTAQIQKGT

SEQ ID NO: 194203 - protein, 39 aa, Glycine max
  Coding DNA Sequence Number=SeqID_77425
SSIFDAKAGIALSASFGKLLSCNRVLDLIEHMALVGAQN

SEQ ID NO: 194204 - protein, 85 aa, Glycine max
  Coding DNA Sequence Number=SeqID_77426
  Subcellular localization annotation: CTP_CleavageSite=51; ConfidenceScore=5.04e-01
LVTSLYQSYRVLVPPGKVMPSRHRDHTRRTPSGPKEVQQGPGVSSSDYGPLSATGKKCIAATSRAPQLIHKRRPSPKPKDAPSCS

SEQ ID NO: 194205 - protein, 102 aa, Glycine max
  Coding DNA Sequence Number=SeqID_77427
MPVIYILQSLYHQLLATEGQAVGGIPLENTSEGPQYHPQLHLLHSTTSKNPHAMAEMGKLDHLEERLRAIEGGEDYAFANLEELFLVPNIITPLKFKVLDFD

SEQ ID NO: 194206 - protein, 95 aa, Glycine max
  Coding DNA Sequence Number=SeqID_77428
MDTSSTGSRNDSIEGGNLVVIHDVEGTARSGIEGEWVIMFVQKGSNWERLENEMMMTNLIVEGKEVEKGLDAKFLAFEHLNIIIVVNFKLREGPF

SEQ ID NO: 194207 - protein, 92 aa, Glycine max
  Coding DNA Sequence Number=SeqID_77429
MSKQRVEVWLAWDPFGIHDGGVTSWWTALSGMTNRVRTWFEDGVGDDIVGRIKRWGKGGKNNDRVEGKDAERRVHLWGRRVGVWHQKRKRQS

SEQ ID NO: 194208 - protein, 431 aa, Glycine max
  Coding DNA Sequence Number=SeqID_77430
  Gene Ontology: Mol. function=oligopeptide transporter activity; Cellular component=integral to membrane; Biological process =oligopeptide transport
  Homolog annotation: Hit_ID=P0AFH6; Match level="QueryCoverage=61%, HitCoverage=89%, E-value=1e-107, Identity=77%"; Hit description =Oligopeptide transport system permease protein oppC
  Pfam annotation: Domain name=ABC_tran; Domain location=317-424; Score= -47.4; E_value=0.0027; Accession=PF00005.17; Description=ABC transporter
QRSSGTLQREAGSGRTQPVARRAPALYAQPRGGQQPVHSGVDHAVCGAGADAVAICLRRYRLGDDVRRAKRGIGALFRHRLLRARSAGARGDRRAHLADGRRGGGAGGGDRRHPVRRDVRLSGRQGRLGDDAPAGDPQLLPVHVLRDPAGDLFRPEHPAYLRGDRHGVVAGYGAYRARPNPRSQAGAGVRRLHAQYRAAAYRAERARRGGGVCLAAGAEHDPVRILPQLPGAGHAGAAQQLGRIAQRRRQLNGSFTVVAAVPGGSAIMSTIEHPQLQTGAGVKTSPLLDVKDLRVTFSTPDGDVTAVNDLNFDLRAGETLGIVGESGSGKSQTAFALMGLLASNGRIGGSAKFNGREILNLPENQLNKLRAEEISMIFQDPMTSLNPYMRVGEQLMEVLMLHKKMSKSEAFEESVRMLDAVKCRKRASACA

SEQ ID NO: 194209 - protein, 43 aa, Glycine max
  Coding DNA Sequence Number=SeqID_77431
MKFLYYDDVTPANYDPPFFKGCTNEEATMTCLHVGFSTPLDQI

SEQ ID NO: 194210 - protein, 84 aa, Glycine max
  Coding DNA Sequence Number=SeqID_77432
  Homolog annotation: Hit_ID=Q6RJZ5; Match level="QueryCoverage=41%, HitCoverage=39%, E-value=8e-10, Identity=85%"; Hit description =Induced stolon tip protein
MRFKRFMDSSKSATSHDSGALKSSTELSMEKLQREERDLWRHRYSDCRDCSYDYKAARREAIARENPVVKAAKIVKEIPSKDMP

SEQ ID NO: 194211 - protein, 139 aa, Glycine max
  Coding DNA Sequence Number=SeqID_77433
MKEVSGIRIIPNGEIALRKMSMIISSIIQQMSGLTTVWENKDGENSRLQDSHEVWQEDGGFQEAVENWLGGPSDHESAPVGRICGFYFPEDDNVYSVELRELLNRQGHANINWELQETTLSSASVEQDLEQHSRDQIVG

SEQ ID NO: 194212 - protein, 71 aa, Glycine max
  Coding DNA Sequence Number=SeqID_77434
MKSPPGEEKAKTIAANEEKSTLSSDTSDAVLLNVVLPSDKPSEEVSHVNGDIAVEENPQLSLAKEPIMAAH

SEQ ID NO: 194213 - protein, 67 aa, Glycine max
  Coding DNA Sequence Number=SeqID_77435
MARIQDTSLHSPTINTLPELSQQNLPCQEYRCTNSSKCKINVTSSNFEIDELSNQCWISQDLNKALD

SEQ ID NO: 194214 - protein, 150 aa, Glycine max
  Coding DNA Sequence Number=SeqID_77436
  Homolog annotation: Hit_ID=Q6CQE3; Match level="QueryCoverage=39%, HitCoverage=73%, E-value=5e-12, Identity=47%"; Hit description =Kluyveromyces lactis strain NRRL Y-1140 chromosome D of strain NRRL Y- 1140 of Kluyveromyces lactis
MKFQRLPGPVGQGYRLVEYISVARVRPRTSKGITDLLRSRSLTELTRQIAPPTKNGHAPPPIESRKSSQSVNPYYVWTCTEARPGQLRTGAHRRQKGRADPCTPEADRSTQPKDWVICAPAAFLGCGSPFLRLPSPGIEPLILRHPSPPW

SEQ ID NO: 194215 - protein, 59 aa, Glycine max
  Coding DNA Sequence Number=SeqID_77437
LIRQVCEVLIFTFSLSQDVGLASHPLSATLLGLGRGRIWKKDELCICVKRGVIQRSAPL

SEQ ID NO: 194216 - protein, 164 aa, Glycine max
  Coding DNA Sequence Number=SeqID_77438
MGSSQKPSLKKRFYQVKIKSLEVTSLRELGRLMGQLQRQAFRKAYGLVDLAVIDAFLAFQHGKESPVVAILAMYDTFDRGCEKSGARIVCCALALYVWLVSHPFLQEGRPVYPLQGHRSCVEKGKANWDQLLANMEGRLLIGSLARRKEESGFYLHAKDVQMFP

SEQ ID NO: 194217 - protein, 181 aa, Glycine max
  Coding DNA Sequence Number=SeqID_77439
  Gene Ontology: Mol. function=electron carrier activity; Cellular component=extracellular region; Biological process=response to biotic stimulus
  Homolog annotation: Hit_ID=Q41495; Match level="QueryCoverage=81%, HitCoverage=69%, E-value=6e-50, Identity=61%"; Hit description=STS14 protein precursor
MSKHKMINDKCLVWAFSNVVPRRIIEANGQASLFLHTRRSSAPELKRLSPHNLRVDAAPVVGDARVVGVVVELLLLHPLLNRHARRHRRAPCQELVRAVLAGAQVRELAPQFVPLVPRQLARHVRQLLAPPQRFHPHRRPRLVVRLQNSLASAESSGARGGASASDDTWNVATAASKNNAP

SEQ ID NO: 194218 - protein, 107 aa, Glycine max
  Coding DNA Sequence Number=SeqID_77440
  Subcellular localization annotation: CTP_CleavageSite=40; ConfidenceScore=5.11e-01
MSPPPLETSQSLKISSKALQNGFLVKLSYLSVFPQREMARLARISGFWLSAHLLAQLEDAGGALSELALAQSACTAHPSSRVFHVLSQQMSRLANWSFSARNDFADQ

SEQ ID NO: 194219 - protein, 306 aa, Glycine max
  Coding DNA Sequence Number=SeqID_77441
  Gene Ontology: Mol. function=nucleic acid binding; Biological process= DNA integration
  Homolog annotation: Hit_ID=Q1RWN2; Match level="QueryCoverage=99%, HitCoverage=23%, E-value=1e-105, Identity=64%"; Hit description =Peptidase S8 and S53, subtilisin, kexin, sedolisin; Integrase, catalytic region; Zinc finger, CCHC-type
  Pfam annotation: Domain name=zf-CCHC; Domain location=242-259; Score =27.2; E_value=3.2e-05; Accession=PF00098.13; Description=Zinc knuckle
MAESSFLQPSIPKFDGHYDHWSMLMENLLRSKEYWSIIEDGIVVAPANSTAEQSKAADDSKLKDLKAKNYLFQAIDRTILETILNKETARDIWTSMRQKFQGSTKVKRAQLQALRREFEILSMKDNETVNEYFSRTLAIANKMTAHGESMGQTKVVEKVLRSMTSKFNYVVCSIEESNDVTALTIDELQSSLLVHEQRMQYTLEKDEEQALKVSSAGRGGNRGRGRNGGRGRGRGRQSKELVECYRCHKLGHYQNECPTWEEGANYAEFNEKEEVLLMAQESSKEEVYDESNVEMWFLDSGCSNHM

SEQ ID NO: 194220 - protein, 113 aa, Glycine max
  Coding DNA Sequence Number=SeqID_77442
MAPALGMILRKSTKVLAISWATRQVLLENRVLELSESHPLSETSARLACKRNLEGNLPCKLMLSVSSARSTSHLSLLELSVPSLLSQSSLTRAKRENGAKRAFEDRKPFLKPE

SEQ ID NO: 194221 - protein, 293 aa, Glycine max
  Coding DNA Sequence Number=SeqID_77443
  Gene Ontology: Mol. function=RNA-directed DNA polymerase activity; Biological process=RNA-dependent DNA replication
MDLTLWRVKDFREVSLLLGKRIMLTLEVAQTHFQFLHVKIILQGGATSMNDSWMIGGDFNDIVCNAKKKGGALVFLRKCQIFRDRINRAKLIDLNSVGPAYTWRGPKFNGLQRVFEWSERALSNDSWRLMDIYLRPFKFECARTTHHSLEDVHDVFGEIKVKKRMLMTRIASIQKNTRYYYHRRRKNRIHMLRNHVGILVKDEQEVKVKVGLPQNLISLLMSCITTVETNVKLNGKSSYMFAPHRGLRQGNPLSPYPFVMGMDKLSLLISKAVDDGLWKSFHMGRHSPLISHL

SEQ ID NO: 194222 - protein, 198 aa, Glycine max
  Coding DNA Sequence Number=SeqID_77444
  Gene Ontology: Mol. function=oxidoreductase activity; Cellular component=mitochondrion; Biological process=metabolic process
  Homolog annotation: Hit_ID=Q9LRE9; Match level="QueryCoverage=86%, HitCoverage=41%, E-value=1e-64, Identity=63%"; Hit description =Cytosolic aldehyde dehydrogenase
  Pfam annotation: Domain name=Aldedh; Domain location=1-198; Score= -46.4; E_value=1.1e-13; Accession=PF00171.12; Description=Aldehyde dehydrogenase family
MMKWADLIDQHVEEIAALDAIDAGKLYHLLKAIEVPATANTIHYYAGAADKIHGEVSPSLAAGCTMVLKPAEQTPLSALFYAHLAKLAGIPDGVLNVVPGFGATAGAAICSHMDIDKVSFIGSTEVGREVMRAAANSNLKPVSLELGGKSPFIIFYDADLDKAVELALVAVVYNKVDKKQFKKILSYIEHEKEKGPPF

SEQ ID NO: 194223 - protein, 136 aa, Glycine max
  Coding DNA Sequence Number=SeqID_77445
  Homolog annotation: Hit_ID=Q9SMV7; Match level="QueryCoverage=35%, HitCoverage=4%, E-value=2e-11, Identity=69%"; Hit description=DNA mismatch repair protein MSH6-2
MEGARQGEVETVSPMGGARQADVMVPPVLVAIHGEGRKYYRYFHRISGDRPPTTPPVQQPNGNVTAAVNQRPPADDVRGTDTPPEKVPRRVLPANFAPNEKESGPSLFESIMHKFVKVDDNERVTQRYASLFSFSD

SEQ ID NO: 194224 - protein, 127 aa, Glycine max
  Coding DNA Sequence Number=SeqID_77446
  Homolog annotation: Hit_ID=Q1RTB4; Match level="QueryCoverage=80%, HitCoverage=23%, E-value=5e-07, Identity=34%"; Hit description=IMP dehydrogenase/GMP reductase
MGTRGCINYNPMLAIRQLGYPMRGAPSEKVITPFITGGFNEANAKILQKISKAWNRVGRKDKELRGSSNDVINGYHKWLKSRTQGITWLPKLKSLSRKEAEIPEESEKVQALKAELEGEREVEDGSH

SEQ ID NO: 194225 - protein, 198 aa, Glycine max
  Coding DNA Sequence Number=SeqID_77447
  Gene Ontology: Mol. function=RNA-directed DNA polymerase activity; Biological process=RNA-dependent DNA replication
MGSYVKDEKLLMHFFQESLDGATIIWYTNLKPSRVCSWKDLMDAFIRQYQYNFEMAPDKVQLQNMCKRDNESFKEYTQRWKDLAAQVVPPMVEREMTTMIMDTWPVFYYEKMVGYMSSSFANLLFVGERIEVGLRKGKFNYVTSMNPSNRGPGMSGERKKEGESHVVAVVPTWPKIPQALYSPIYRYPPDMPLFSPIS

SEQ ID NO: 194226 - protein, 75 aa, Glycine max
  Coding DNA Sequence Number=SeqID_77448
MVKILAEIDDIDDNDDATKVLHDVDDYAMNETFIEWKTQHGNSSLNDSTLSTIVQTCFFPSPSPSHQSVIKSLKK

SEQ ID NO: 194227 - protein, 186 aa, Glycine max
  Coding DNA Sequence Number=SeqID_77449
  Pfam annotation: Domain name=GRP; Domain location=35-157; Score=-4.9; E_value=0.00022; Accession=PF07172.2; Description=Glycine rich protein family
MNANGNVTLLACGRAGLLLREKHIHTVVKDYKIVMKRKFISVVVLGVCLVLGISQYVDARNLEEKSKEEVKKPENCLDGGSIGGVGGIGDVGGGGGGLGGGYGGGAGGDSGLGGGYGGGAGSGGVGGLGGGSGLGGGIGGGIYKGIGIGGGIYKGIGFGGVGGGVGAIGGIGGVIGGFKHVEANKP

SEQ ID NO: 194228 - protein, 143 aa, Glycine max
  Coding DNA Sequence Number=SeqID_77450
  Gene Ontology: Mol. function=ARF guanyl-nucleotide exchange factor activity; Cellular component=intracellular; Biological process =regulation of ARF protein signal transduction
  Homolog annotation: Hit_ID=Q42510; Match level="QueryCoverage=93%, HitCoverage=9%, E-value=2e-09, Identity=32%"; Hit description =Pattern formation protein EMB30
MSSNRINYFNFVIFAMVDELHEKMLEYSRRENAERESRSTEETLKLAMELLSDMYLQSLRQITESSGFRTFWSGILRRKDTCMKADLGQYGPSTLGEIIPDLLRKIITQMKEEGILEPRYVGDYIYLDTVDICPHLKDELFPL

SEQ ID NO: 194229 - protein, 89 aa, Glycine max
  Coding DNA Sequence Number=SeqID_77451
  Subcellular localization annotation: CTP_CleavageSite=58; ConfidenceScore=5.16e-01
MGVQIATRPTWAFQDVPPEGGCFWRKQPSSPGRAGWQASPSFSYKKGKEGRIKRFNPRENRSRGTSVTFPWVISRRFSTVLRSFFDLQP

SEQ ID NO: 194230 - protein, 132 aa, Glycine max
  Coding DNA Sequence Number=SeqID_77452
MQRRLLVPFLYIGVTNGDICCNEAQKARLGGAPGANPQLTLTLSSYHVNNLEKVLVCSDLVRDANGKRLRVKAPVRIYLICNPSRRLVTHVIYTSLPRSPFVVKVVGSLRKTTGAVVQASLHRAIVYGPEPG

SEQ ID NO: 194231 - protein, 87 aa, Glycine max
  Coding DNA Sequence Number=SeqID_77453
MGEGLGQHAIGNSGKNGKRLVVDGVERVQSEAGELTLGMGERKTWWVRHARVQTIMGHGKWRFHNRRFCNGSCMVTLAVAGGGCLDN

SEQ ID NO: 194232 - protein, 185 aa, Glycine max
  Coding DNA Sequence Number=SeqID_77454
  Gene Ontology: Mol. function=translation initiation factor activity; Cellular component=eukaryotic translation initiation factor 3 complex; Biological process=translational initiation
  Homolog annotation: Hit_ID=Q1SQK2; Match level="QueryCoverage=96%, HitCoverage=27%, E-value=4e-60, Identity=68%"; Hit description =Translation initiation factor eIF-3b
  Subcellular localization annotation: CTP_CleavageSite=42; ConfidenceScore=5.37e-01
MLRSRTWHCVSASISPLSISTSFASLPAKIAASFWSLKRNLRVAVVYQEENLEFESRFGNIIVVDNLLVVPREKFEKLEGVVRKIYSQIGVIKEDGLWMPEVELAKEKTHGYKLDRAHIFVVSMFDDFDRFMKVPNEWAPPETKPYAPGLTNAKAGDQFVIRAGSDTKVLWNDARHLKPDVVSAS

SEQ ID NO: 194233 - protein, 70 aa, Glycine max
  Coding DNA Sequence Number=SeqID_77455
MSDKRTETNYAPFIIQEQRVEWNNKLGGKRVETDSVPFIIQEQQAEWMNAHRQILCPLSFRSSESSGKRA

SEQ ID NO: 194234 - protein, 383 aa, Glycine max
  Coding DNA Sequence Number=SeqID_77456
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=1e-62, Identity=31%"; Hit description= UPI00006A17C9 related cluster
GLHVLAFRGLHILAFRGLQTLTFRGQHVVAFRGLHVLAFRGLHVLPSRGLQVLTFRGLHVLAFRGLHALTFRGLHVLAFRGLYVLTFKGLHVLPSRGLHVLSFRGLHVLAFRGLHALTFRGLHVLAFRGLYILTFKGLHVLAFRGLQVLTFRGLHALTFRGLHVLAFGGLHVLAFRGLHVLTFRGLHVLAFKGLHTLTFRGLHVHAFRGLHALTLRGLHVLAIRGLRVLAFKGLQALTFKGLNFLAFRGLHALAFKGLHILTFRGLHDLAFRGLHVLAFRGLHALTLRGLHALNFRELHVLAFRGLHVLAFRGLHILAFRGLQTLTFRGQHVVAFRGLHVLAFRGLHVLPSRGLQVLTFRGLHVLAFRGLHALTFRGTTRPRL

SEQ ID NO: 194235 - protein, 48 aa, Glycine max
  Coding DNA Sequence Number=SeqID_77457
MTNGVRLEQVLGGALKEITYLELSDKGESLNKSVLCVEPMVEEGECEG

SEQ ID NO: 194236 - protein, 242 aa, Glycine max
  Coding DNA Sequence Number=SeqID_77458
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=7e-44, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MHVLTFRGMHALAFRGLHVLAIRRLHTLTIGGLHVFAIRGMHALTFRGLHVLACRGLHALTFRGLHVVAFRVLHALTFRGLHVHAFRGLHALTFRGLHVLAFRGLHALTFRGLHVLTITALHALTFRGLHVLAFRGLHTLTFRGLHVLAFRGMHALNFRGLHVLAFRGLHALTFRGLHVLTITALHALTFRGLHVLACRGLHALTFRGLHVVAFRVLHALTFRGLHVLAFRGLHALSFRGLH

SEQ ID NO: 194237 - protein, 335 aa, Glycine max
  Coding DNA Sequence Number=SeqID_77459
  Gene Ontology: Mol. function=RNA-directed DNA polymerase activity; Biological process=RNA-dependent DNA replication
MAPDRTQLQNMVKKESESFKKYAQRWRDLAAQVASPMVEREMITMMVDTLSVFYNGKLVGYMPSSFADMVFVGEIIEVGLKTGKFDYVSSTCTNARRIGATGAKRKEGDTHAITSAPAWIKPPRISHGTHQYAQHHPSFSARAGDFSNSAPVQTRAPVPIQREAPQALAPIPTHLAGNAHFGAGSNAIRNFPSRPTFTLIPMAYEDLLPSLVANQMAMISPGRIYQPPFPKWYNPEEEIPTEGRGHNRALHVSVKCIDHVVAQVDPLGGSRSLYTPPKIEVRSGGAFGHCIGGGRRLALPVRYGNDGGPGDVGVRLRARNGFRQEQRQQNQLGKH

SEQ ID NO: 194238 - protein, 114 aa, Glycine max
  Coding DNA Sequence Number=SeqID_77460
  Subcellular localization annotation: CTP_CleavageSite=53; ConfidenceScore=5.54e-01
MRGSGEFVPFLDTTSRGSKMPQRTFLRRRHGPSVGLFTVGIKTEPSPVESPTVATYPSVGGRRVTRGMRVPRKEYARSRHQRLFEENVGKTGKDAIYDLLSERFGSRIYARGRY

SEQ ID NO: 194239 - protein, 175 aa, Glycine max
  Coding DNA Sequence Number=SeqID_77461
MACTKKIGQMTFEATKEIANMIGLALPLEVEVGLFATLISTKESCVDHLGQDPETRDLNKCGLYVDDNPPQLVTVKRVYEGSTTVRNIPLGNDQLKDKKIVEGPMKPVDMPDLDVDLMYLMTLIILQLFLRPLQMSWDASVFGVYNDNFPLYIKHEDLSKIAYSGQCLSIFVIQL

SEQ ID NO: 194240 - protein, 196 aa, Glycine max
  Coding DNA Sequence Number=SeqID_77462
MEEKKKKHLEEAVISGSTDTVIDPPSPIKRQVKWKMARTNKIGQMTSGAAKEIDDKIDSLEEQASQGSFVAHGCKDVLTIAIGRPEYPGRVRAAGVGVTIKQYFGPALRTSRTSLSMAPKDLEQLTQKIRPQLEESITEKMQSHGLTLPPELEVGPSAAHVSTKESCVDHSGNDPGTGDSEKCELYVEENPPCLVA

SEQ ID NO: 194241 - protein, 50 aa, Glycine max
  Coding DNA Sequence Number=SeqID_77463
MAWDQVMDSWASVMNCPTKFDYEDRVTNFKVVSGPRLVEYVNGLSRLIGA

SEQ ID NO: 194242 - protein, 62 aa, Glycine max
  Coding DNA Sequence Number=SeqID_77464
MEGLGILRKLGSAGSSHGRAESKGLQYNGGANIMGKKHLGIEIMEIYLGRGLLNGELYDHFS

SEQ ID NO: 194243 - protein, 94 aa, Glycine max
  Coding DNA Sequence Number=SeqID_77465
IVIAAQLIHDRVVMECLEVEPVQVIEVSSSEEDLEEDPEELPPESDMDALDLPEDDEDPLPDVDSPEDIMSASEADSTQESGPGGTTNSDDSSS

SEQ ID NO: 194244 - protein, 107 aa, Glycine max
  Coding DNA Sequence Number=SeqID_77466
  Subcellular localization annotation: CTP_CleavageSite=58; ConfidenceScore=5.01e-01
MTAMDLSLRDPLYQKSSWYVVSSSLKWWLVVHRCLLSSNLPNNWYQSQVRLGDRLRQRASAKRNTPGLSARKNPEEDELYRFAKRTASVHPLSERRCTKPKISGPPI

SEQ ID NO: 194245 - protein, 138 aa, Glycine max
  Coding DNA Sequence Number=SeqID_77467
MTPLIHLIALQNSYHRQAFWLTLLLSKQVSLLLQSPLTPPSSTVGHHCKWKRGWWCWRRNTVQGTDRDDARLGIVVVVHVAEVVDEVRLREKLEEDVVVKDVGEGGLGEMVVNNKVGVMDNKNGEGGAVQEIRDEGRG

SEQ ID NO: 194246 - protein, 93 aa, Glycine max
  Coding DNA Sequence Number=SeqID_77468
  Gene Ontology: Mol. function=cadmium ion binding
  Homolog annotation: Hit_ID=P42735; Match level="QueryCoverage=88%, HitCoverage=48%, E-value=2e-21, Identity=56%"; Hit description =Cadmium-induced protein AS8
MVLMIIKGLFGRYERWNPVHPTHGAFWGMGVGVGCGVGWGPGFGPEVIGYVGAGCGIGFNVGITFAGVGVGLPANFIFEGPYNGKWQSLSESH

SEQ ID NO: 194247 - protein, 148 aa, Glycine max
  Coding DNA Sequence Number=SeqID_77469
MEEHQQEQHQASSSLSTQVFTLSDNKQTRKQGWRNAGKQLKAINQIINEEQPKTPMASATSAGANRQWELHKVPTTVACPWAEIASSAGASVQPSTRVRHARSHQQYWCVPPPFDTCPPCTKSPAVLAHPMLGTCKNSTPWEILCKEP

SEQ ID NO: 194248 - protein, 129 aa, Glycine max
  Coding DNA Sequence Number=SeqID_77470
MPKVPELSMPELPKVSELPKSKLSKVPEIPKVPKLSKPELPKVPELPKLPTVFEFSKPKLPKVLKLHKVPELPKLSYLKYLRGQSYLRVIVAVYKHWHCHDISWHTLQGFPFPFPCNKLTRPRLMLTHL

SEQ ID NO: 194249 - protein, 483 aa, Glycine max
  Coding DNA Sequence Number=SeqID_77471
  Gene Ontology: Mol. function=transcription regulator activity; Cellular component=nucleus; Biological process=regulation of transcription
  Homolog annotation: Hit_ID=Q0WL61; Match level="QueryCoverage=99%, HitCoverage=96%, E-value=2e-53, Identity=37%"; Hit description=BHLH transcription factor like protein
  Pfam annotation: Domain name=HLH; Domain location=317-365; Score =19.8; E_value=0.0011; Accession=PF00010.16; Description=Helix-loop -helix DNA-binding domain
  Subcellular localization annotation: CTP_CleavageSite=62; ConfidenceScore=5.52e-01
MGGFQHGNESILTCPPTSGLSGPNVNVSEMAISSVSMAKPSNVVANPFLASSTWDPLVSLSQAQTFGGSSMVSHNEFVNANSSYPLVLDNQGGISNTSHLVQYMSDSNLGGIVPKVHSYASGGFSEMVGSGSFCQHGSGDMADTGYPTHYNPIKEAPIINGEQSQVEDSIPEEEAPGSAPSGNRRKRGLDHNSTFSPNKYISGQNLDAIGVVFQIKLKFCLGNMCGTIYITKNAEGDAVKDSPGKASDGSKEHEKRPKVEQNNGADVRGKQSVKQAKDNNNSQSGEAPKENFIHVRARRGQATNSHSLAERVPSLSHHDICYEKVRREKISERMRLLQELVPGCNKITGKAVMLDEIINYVQSLQQQVESTYQRDILQFLSMKLATVNPELNFDVDRILSKDILQSRIGHGIGAYGPGINSSHTFPNGSFHGTLAGMSSTSSQFPPLPQNVLDHEFQSFYGIGYDSNTALDNLGPNGRLKTEL

SEQ ID NO: 194250 - protein, 60 aa, Glycine max
  Coding DNA Sequence Number=SeqID_77472
MAPSLAPVVSPTLLRRHCEPTQGLSPPSSFFTGAATSLILGLYALHKGLSRLPIIHNNTS

SEQ ID NO: 194251 - protein, 121 aa, Glycine max
  Coding DNA Sequence Number=SeqID_77473
MKQQKQAQPMARVGEKENEETEEEAPQEEEDSLTSKAINKTKPPQQDALAPTRRKATTSNHGQPTTTCEKEGRVTGTFAISPRVLGAPAKMLGAPSNTLLSSSLLINEAQSSTVSTLQEAT

SEQ ID NO: 194252 - protein, 126 aa, Glycine max
  Coding DNA Sequence Number=SeqID_77474
  Gene Ontology: Mol. function=phosphoprotein phosphatase activity; Cellular component=nucleus
  Homolog annotation: Hit_ID=Q8L7U5; Match level="QueryCoverage=91%, HitCoverage=13%, E-value=6e-18, Identity=41%"; Hit description =Serine/threonine-protein phosphatase BSL1
MGSKSWLYLVPTYQTIETFWVTDENAPSPHCGHTFTVVATTKTQGPHVILFGGAIAIEGGSSSAPTFVTPPSLTHSLSAFFFCCLNFIAFTLQEFPSPQAAHVAAAIGTMVVLQLGWDRSRGAFYR

SEQ ID NO: 194253 - protein, 38 aa, Glycine max
  Coding DNA Sequence Number=SeqID_77475
MAGKRVVFDTWAFDTAQKPYVWQKLNPRRSQTFSAKID

SEQ ID NO: 194254 - protein, 210 aa, Glycine max
  Coding DNA Sequence Number=SeqID_77476
GDEFVEPPSMDECCLMSVVSVKLSMMDMSLACQSGHVLELRFMRDLGSFVVLLSIKMSSFLSDCAIGLGGSDSGGSIEQPIMDRDVILIGGSSFKDTCLGASDSESSSSERIRASHQTGGGISRPRGRGRPSAVVREPILVTMILPPSAFGGVRRGICGGYVRMSPCVRRSQSVGSLPSTLAVASYEWVKEDILKYKYSLTSAANVATLQ

SEQ ID NO: 194255 - protein, 302 aa, Glycine max
  Coding DNA Sequence Number=SeqID_77477
  Homolog annotation: Hit_ID=Q47522; Match level="QueryCoverage=14%, HitCoverage=53%, E-value=9e-19, Identity=100%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDRPAANASRSSHSSAQASRASSLTSGQGSPNTRWARARRRHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 194256 - protein, 118 aa, Glycine max
  Coding DNA Sequence Number=SeqID_77478
MTKGKGKDPLEGLGGPMTRASARKAKEALQQVLSILFEHKPKFQGEKSKGPIGNLGINLLGDQMVADLLAVGGPKWALLAAPGLMEEEEEPGHLQCGPVAFPWPCRPKPSQPSRFEPS

SEQ ID NO: 194257 - protein, 126 aa, Glycine max
  Coding DNA Sequence Number=SeqID_77479
MPHLSEKRKQQEEDFSSQPLAKASKSQRLQMQHKYANDTYKFFKKYIESRYYASLKREVYVERKVNLKEGEFTVIQEIFEDKGWTKLMEIVIYNEPLVREFYANVIFLDGFKERKSWVRGIIVKYD

SEQ ID NO: 194258 - protein, 107 aa, Glycine max
  Coding DNA Sequence Number=SeqID_77480
MGVGCCCWRFALLMRVQMMILPTFTMVSDDINDQESSIPLGSVIPLVDGVGPLVTNLATLASGTVVVKGGPHLNIEVPSFPKKDEVESPLPIPSYNVIDLDSEATIL

SEQ ID NO: 194259 - protein, 137 aa, Glycine max
  Coding DNA Sequence Number=SeqID_77481
MQKLDKIKGLEEKIERIGKSVSAQDEPSAHSRSAHDTRLVQKRPTKKPKGAFSAKSPKARGRLKIKLKKRRCEMLLKNSLSETPWLSEPHSLSEATSSLSKCKTLEDDQPESSALSTHLACPVRTLSLLVLSASRLA

SEQ ID NO: 194260 - protein, 745 aa, Glycine max
  Coding DNA Sequence Number=SeqID_77482
  Homolog annotation: Hit_ID=Q1S909; Match level="QueryCoverage=98%, HitCoverage=64%, E-value=0.0, Identity=57%"; Hit description=MATH domain, putative
MTSHSEGCKSNKIEVSYQEAVALKRQEELIREEEAAWLAECEQKAKRGNEREKKSKKKQAKQKRNNRKGKDKGREERPIVAVYDKQQHNPADEKKDSNMEEVQALDEKLDALEVVSDVSDSVDGVGEALQLDSEDRDVSLVNWDTDASEVHPPTEASSNGIGSLSSVQNGMAEKRSSSAMDDSSSTCSTDSLPSMVMNDHYKGNSFLNYKVQKSPNRGKNQVKASCNVGSWTTEMDSQPSGSAADAVDVNESGSSKLGGSEPEGAVLCLQDRLKWLDHQEEDLPSLQKKQSIKDQVSIERTVDNESLPKENKSAVPSSSSSPPRNLPVQMKSENQTRVTGDPVHARKTSFGTSQSTDKEVSSSSTSVSQVTVGPKTEIQKASTPRLTERSMAQVAMLSRPSSAPLVPGVPRPTAAVVSMVQTAPLLARSVSATARLGPDPSPATHSYVPQSYRNAIMGNPVVSTAASLPHSSSSSGVNPSPGYSQPPMVSSPLFISRSSDKMDSNTSLSDVPFGMITRDVLQNGPNWIDSSQREAGRSMPYEPPSRLNDAQNLDLFRPIDSRSLGNITSEFPACTSKHQNQGGLVDEFPHLDIINDLLDEPREHGIGKASRASSVFYSLNDGPQLLNRQFTFPGDLGTDDDLGSSTSSCRFERSRSYHDAGFQQGYSTSGRHYDSLQDYVPQASTLSYGNGKVDGMIPNQWQVAGSDLSYLGMRNTENSYSYYQDYSNMACGVNGYTVFRPSNGP

SEQ ID NO: 194261 - protein, 144 aa, Glycine max
  Coding DNA Sequence Number=SeqID_77483
MHGGIKQHLFAIKKLSGVNMVSIPACHAGDPGSIPGNGVLYFLCRVDISTYNSPYISVTHPRSAGHGLPVLSEESTLVFPDTDKEIWVSDSSAYEANENFTTCMQNTATIIKISEKQMRDLGCQNKKGTWDSWGDSSTSAREEA

SEQ ID NO: 194262 - protein, 60 aa, Glycine max
  Coding DNA Sequence Number=SeqID_77484
MEKERAEWEEGWRVREREIHDREAIVKARERDLASKRDSSIVSNLEKITVLQQWASFLVR

SEQ ID NO: 194263 - protein, 597 aa, Glycine max
  Coding DNA Sequence Number=SeqID_77485
  Gene Ontology: Mol. function=hydrolase activity, acting on acid anhydrides, catalyzing transmembrane movement of substances; Cellular component=integral to membrane; Biological process=metal ion transport
  Homolog annotation: Hit_ID=Q7Y051; Match level="QueryCoverage=81%, HitCoverage=50%, E-value=1e-142, Identity=56%"; Hit description=Paa2 P-type ATPase
  Pfam annotation: Domain name=E1-E2_ATPase; Domain location=312-560; Score=89.5; E_value=1e-23; Accession=PF00122.10; Description=E1-E2 ATPase
  Pfam annotation: Domain name=HMA; Domain location=82-146; Score=21.4; E_value=0.0033; Accession=PF00403.16; Description=Heavy-metal -associated domain
  Pfam module annotation: Pfam domain module=E1-E2_ATPase::HMA; Domain location=312-560::82-146
  Subcellular localization annotation: CTP_CleavageSite=73; ConfidenceScore=5.45e-01
MATHLFRLPLFSQPKLSFNHTPNHALHFISPLPAKRHRTRNRHRRRILRPPFSVSNSFGTEIGSPEFSLLQSRREAKDSPVLLDVTGMMCGACVSRVKNILSADDRVDSVVVNMLTETAAVKLRRIEEEPASVAESLALRLSDCGFPTKRRASSSGVTENVRKWKELVKKKEELVVKSRSRVAFAWTLVALCCGSHASHIFHSLGIHIAHGNARNLESNLRSSLFSIQLQIRVNVIMEINQAKSSLAFLFVGPLMEILHSSYLKGGLALGSLLGPGRELLFDGLNAFKKGSPNMNSLVGFGSVAAFIISSVMLLGFVLLGRSLEEKARIQASSDMNELLSLISTQSRLVITSTEGSPSTDTVLCSDAICVEVPTDDIRVGDSVLVLPGETIPIDLTRKIHEQGTVISGRSVIDESMLTGESLPVFKEKGLTVSAGTINWDGPLRIEASSTGSNTMISKIVRMVGIPFSVMACWCQMLYNVEDAQSREAPVQRLADSIAGPFVYSVMTLSAATFAFWYFVGSHIFPDVLLNDIAGPEGDPLLLSLKLSVDVLVRMKHPLFTGFQLLLLVRTCLTKPCMCFFSDESSKLQTAFDLDSSH

SEQ ID NO: 194264 - protein, 111 aa, Glycine max
  Coding DNA Sequence Number=SeqID_77486
MEFRGCRRGSRFSSYERLAAIGLAILAVASPLYIDRKAECELEDEEQPINVDVLLPFLLFLLTLGIALSASMDRSFAGFDRYWIHRVIGSSGGILAILTVLFLILKFKSSL

SEQ ID NO: 194265 - protein, 893 aa, Glycine max
  Coding DNA Sequence Number=SeqID_77487
  Gene Ontology: Mol. function=protein binding; Cellular component =cytoplasm; Biological process=ubiquitin cycle
  Homolog annotation: Hit_ID=Q338L7; Match level="QueryCoverage=91%, HitCoverage=86%, E-value=0.0, Identity=57%"; Hit description=F-box family protein, putative, expressed
  Pfam annotation: Domain name=F-box; Domain location=96-143; Score =38.7; E_value=2e-08; Accession=PF00646.23; Description=F-box domain
  Pfam annotation: Domain name=LRR_1; Domain location=186-208; Score =1.1; E_value=1.8e+02; Accession=PF00560.23; Description=Leucine Rich Repeat
  Pfam annotation: Domain name=LRR_1; Domain location=224-246; Score =1.1; E_value=1.7e+02; Accession=PF00560.23; Description=Leucine Rich Repeat
  Pfam annotation: Domain name=LRR_1; Domain location=274-298; Score =2.6; E_value=93; Accession=PF00560.23; Description=Leucine Rich Repeat
  Pfam annotation: Domain name=LRR_1; Domain location=300-323; Score =4.7; E_value=38; Accession=PF00560.23; Description=Leucine Rich Repeat
  Pfam annotation: Domain name=LRR_1; Domain location=326-351; Score =8.5; E_value=7.3; Accession=PF00560.23; Description=Leucine Rich Repeat
  Pfam annotation: Domain name=LRR_1; Domain location=372-394; Score =9.3; E_value=5.1; Accession=PF00560.23; Description=Leucine Rich Repeat
  Pfam annotation: Domain name=LRR_1; Domain location=414-439; Score =0.9; E_value=1.9e+02; Accession=PF00560.23; Description=Leucine Rich Repeat
  Pfam annotation: Domain name=LRR_1; Domain location=446-468; Score =3.1; E_value=74; Accession=PF00560.23; Description=Leucine Rich Repeat
  Pfam annotation: Domain name=LRR_1; Domain location=484-503; Score =0.5; E_value=2.3e+02; Accession=PF00560.23; Description=Leucine Rich Repeat
  Pfam annotation: Domain name=LRR_1; Domain location=505-527; Score =9.0; E_value=5.9; Accession=PF00560.23; Description=Leucine Rich Repeat
  Pfam annotation: Domain name=LRR_1; Domain location=547-569; Score =2.2; E_value=1.1e+02; Accession=PF00560.23; Description=Leucine Rich Repeat
  Pfam annotation: Domain name=LRR_1; Domain location=589-614; Score =1.0; E_value=1.9e+02; Accession=PF00560.23; Description=Leucine Rich Repeat
  Pfam annotation: Domain name=LRR_1; Domain location=640-661; Score =10.2; E_value=3.5; Accession=PF00560.23; Description=Leucine Rich Repeat
  Pfam annotation: Domain name=LRR_1; Domain location=663-695; Score =3.6; E_value=61; Accession=PF00560.23; Description=Leucine Rich Repeat
  Pfam annotation: Domain name=LRR_1; Domain location=768-795; Score =0.1; E_value=2.7e+02; Accession=PF00560.23; Description=Leucine Rich Repeat
  Pfam annotation: Domain name=LRR_1; Domain location=814-831; Score =3.2; E_value=73; Accession=PF00560.23; Description=Leucine Rich Repeat
  Pfam annotation: Domain name=LRR_1; Domain location=835-858; Score =5.1; E_value=32; Accession=PF00560.23; Description=Leucine Rich Repeat
  Pfam annotation: Domain name=LRR_1; Domain location=860-883; Score =3.0; E_value=79; Accession=PF00560.23; Description=Leucine Rich Repeat
  Pfam module annotation: Pfam domain module=F-box::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1; Domain location=96 -143::186-208::224-246::...
  Pfam module annotation: Domain location=274-298::300-323::326 -351::372-394::414-439::446-468::484-503::505-527::547-569::589 -614::640-661::663-695::768-795::814-831::835-858::860-883
MDRVSPNRRRSDGESSSASAGDTRQKRARVYFDFDGTHCIVKCSNAGNSSASVEEFVDYDNFQGSSLLRSNDDDAGEESNFDEGDGNDISKVDDLEVKMDLTDDLLHMVFSFLDHPNLCRAARVCKQWRTASAHEDFWKSLNFEDRNISVEQFEDICRRYPNITAIRMSGPASNQLVMKAISSLRNLEALTLGKTHIMDNFFHALADCSMLRRLSINDAILGSGLQEISVNHDRLCHLQLTKCRVMRMTVRCPQLEIMSLKRSNMAQTVLNCPLLQELDIGSCHKLPDSAIRSAVTSCPQLVSLDMSNCSSVSDETLREISQNCANLSFLDASYCPNISLETVRLPMLTVLKLHSCEGITSASMTAISHSYMLEVLELDNCSLLTSVSLDLPRLQNIRLVHCRKFADLNLMTLMLSSILVSNCPVLHRINITSNSLQKLTIPKQDSLTTLALQCQSLQEVDLSECESLNNSVCNVFNDGGGCPMLKSLVLDNCESLTSVQFISTSLISLSLGGCRAITNLELTCPNLEKVILDGCDHLERASFCPVGLLSLNLGICPKLNTLSIEAPFMVSLELKGCGVLSEAFINCPLLTSLDASFCSQLTDGCLSATTVSCPLIESLILMSCSSIGSDGLRSLYCLPNLIVLDLSYTFLVNLQPIFDSCLQLKVLKLQACKYLTDTSLEPLYKGGALPALQELDLSYGTLCQSAIDELLAYCTNLTHVSLTGCVNMHDLNWGSSCGQSDNFPAVNTPSRASSNENIPESSEQSTRLLQNLNCVGCPNIRKVVIPLRANCFHLLFLNLSLSANLKEVDVTCLNLCFLNLSNCSSLEILKLECPKLTSLFLQSCNIDEEAVEAAISKCSILETLDVRFCPKISSMSMGRLRTICSSLKRIFSS

SEQ ID NO: 194266 - protein, 192 aa, Glycine max
  Coding DNA Sequence Number=SeqID_77488
  Gene Ontology: Mol. function=protein serine/threonine kinase activity; Cellular component=integral to membrane; Biological process=protein amino acid phosphorylation
  Homolog annotation: Hit_ID=Q42371; Match level="QueryCoverage=81%, HitCoverage=50%, E-value=8e-64, Identity=47%"; Hit description=ERECTA
  Pfam annotation: Domain name=LRRNT_2; Domain location=23-64; Score =32.2; E_value=1.8e-06; Accession=PF08263.3; Description=Leucine rich repeat N-terminal domain
  Pfam annotation: Domain name=LRR_1; Domain location=117-139; Score =12.0; E_value=1.6; Accession=PF00560.23; Description=Leucine Rich Repeat
  Pfam annotation: Domain name=LRR_1; Domain location=141-163; Score =10.0; E_value=3.8; Accession=PF00560.23; Description=Leucine Rich Repeat
  Pfam annotation: Domain name=LRR_1; Domain location=69-91; Score=8.6; E_value=7; Accession=PF00560.23; Description=Leucine Rich Repeat
  Pfam annotation: Domain name=LRR_1; Domain location=93-115; Score =10.3; E_value=3.3; Accession=PF00560.23; Description=Leucine Rich Repeat
  Pfam module annotation: Pfam domain module=LRRNT_2::LRR_1::LRR_1::LRR_ 1::LRR_1; Domain location=23-64::117-139::141-163::69-91::93-115
MAFRFGLLLLVSLLCLDSISSVNSHVGETLLEIKKWFRDVDNVLYDWTDSTSSDYCVWRGVTCDNVTFNVVALNLSGLNLEGEISPAIGRLNSLISIDFKENRLSGQIPDELGDCSSLKSIDLSFNEIRGDIPFSVSKMKQLENLILKNNQLIGPIPSTLSQVPNLKILLYDVFLLSIFVCVFPFPMLVACE

SEQ ID NO: 194267 - protein, 69 aa, Glycine max
  Coding DNA Sequence Number=SeqID_77489
MVFIGLANSSCTVRVAKDEVAGAGNIVVLAEVKRRDELCVVAVGEGELEDEVDIGLRVGLTMGIITIKS

SEQ ID NO: 194268 - protein, 965 aa, Glycine max
  Coding DNA Sequence Number=SeqID_77490
  Gene Ontology: Mol. function=nucleoside-triphosphatase activity; Cellular component=myosin complex; Biological process=regulation of transcription
  Homolog annotation: Hit_ID=Q0WPU1; Match level="QueryCoverage=98%, HitCoverage=64%, E-value=0.0, Identity=70%"; Hit description=Myosin -like protein
  Pfam annotation: Domain name=IQ; Domain location=710-730; Score=19.0; E_value=0.018; Accession=PF00612.17; Description=IQ calmodulin -binding motif
  Pfam annotation: Domain name=IQ; Domain location=733-753; Score=18.3; E_value=0.028; Accession=PF00612.17; Description=IQ calmodulin -binding motif
  Pfam annotation: Domain name=IQ; Domain location=758-778; Score=22.4; E_value=0.0016; Accession=PF00612.17; Description=IQ calmodulin -binding motif
  Pfam annotation: Domain name=IQ; Domain location=781-801; Score=18.0; E_value=0.034; Accession=PF00612.17; Description=IQ calmodulin -binding motif
  Pfam annotation: Domain name=IQ; Domain location=806-826; Score=22.3; E_value=0.0018; Accession=PF00612.17; Description=IQ calmodulin -binding motif
  Pfam annotation: Domain name=IQ; Domain location=829-849; Score=19.3; E_value=0.014; Accession=PF00612.17; Description=IQ calmodulin -binding motif
  Pfam annotation: Domain name=Myosin_N; Domain location=11-52; Score =38.6; E_value=2.1e-08; Accession=PF02736.9; Description=Myosin N -terminal SH3-like domain
  Pfam annotation: Domain name=Myosin_head; Domain location=66-694; Score=917.9; E_value=4.4e-273; Accession=PF00063.11; Description =Myosin head (motor domain)
  Pfam module annotation: Pfam domain module=IQ::IQ::IQ::IQ::IQ::IQ::Myo sin_N::Myosin_head; Domain location=710-730::733-753::758-778::781 -801::806-826::829-849::11-52::66-694
MPEPTTNMRHGTKVWVHDRDSAWIPAELLESSGNKVTVATASGKKVVALPENVFPRDADEEEHGGVEDMTRLAYLNEPGVLYNLRRRYSLNDIYTYTGSILIAVNPFTKLPHLYDIHMMEQYKGAPFGELSPHVFAVADASYRSMMNGGQSQSILVSGESGAGKTETTKLIMQYLTFVGGRAAGDDRTVEQQVLESNPLLEAFGNARTVWNDNSSRFGKFVEIQFDSNGRISGAAIRTYLLERSRVVQITDPERNYHCFYQLCASERDVEKYKLGKPSHFHYLNQSKVYELDGVSSAEEYMKTRRAMDIVGISHEDQEAIFSTLAAILHLGNVEFSPGKEHDSSVIKDEKSRFHLQMAANLFRQSFQLLLGIDFAKVVLSLQNWLVDKINGSVGQDINSQKQIGVLDIYGFECFKDNSFEQFCINFANEKLQQHFNQHVFKMEQEEYNKEEINWSYIEFIDNQDVLDLIEKKPIGIIALLDEACMFPKSTHETFSTKLFKHFLSHPRLEKEKFSETDFTLSHYAGKVTYHTNTFLEKNRDYVVVEHCNLLSSSKCPFVSALFPLLAEESSRSSYKFSSVASRFKQQLQSLMETLNTTEPHYIRCVKPNSLNRPQKFENTSVIHQLRCGGVLEAVRISLAGYPTRRIYSEFVDRFGLIAPEFMDGSYDDKAVTLKILQKLKLENFQLGRTKVFLRAGQICILDSRRAEVLDNAAKCIQRRLRTFIARRDFISIQAAALSIQACCRGCIGRKIYASKRETAAAISIQKYIRMCLMRHAYVKLYYSAIIVQSNVRGFTTRQRFLHRKEHKAATSIQVYWRMCKARSAFLKHQNSIVAIQCLWRCKQAKRELRRLKQEANEAGALRLAKNKLEKQLEELTWRLHLEKKIRVSNEEAKHVEIFKLQKMVDALNLELDAAKLATINECNKNAVLQNQLQLSVKEKSALERELVAMDEVRKENSLLKVLDVE

SEQ ID NO: 194269 - protein, 184 aa, Glycine max
  Coding DNA Sequence Number=SeqID_77491
  Homolog annotation: Hit_ID=Q1SQM7; Match level="QueryCoverage=78%, HitCoverage=70%, E-value=2e-41, Identity=62%"; Hit description=MTD1
MGGFGVWMEASPSFEVEDDNEHCSTSATSSIGNDSDVLSETECGENDNEAHSTYKCHQPLDTMDSLQQVLPIRRGISKFYDGKSKSFTSLADAGSTPSVKDIAKPENAYTRRRRNLMWEKSRNYPLRSNNGGISKRTTISSSRSTVTLAFAINYDSNSSCASEDSFSSSNPRSPPPLPPLHPQN

SEQ ID NO: 194270 - protein, 474 aa, Glycine max
  Coding DNA Sequence Number=SeqID_77492
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1SQM5; Match level="QueryCoverage=96%, HitCoverage=92%, E-value=0.0, Identity=76%"; Hit description =Glycoside transferase, six-hairpin, subgroup
  Pfam annotation: Domain name=Glyco_hydro_9; Domain location=8-470; Score=664.0; E_value=1.2e-196; Accession=PF00759.9; Description =Glycosyl hydrolase family 9
MLVKGDFNYKEALTKSLIFLEAQRSGKLPSNNRVPWRGDSALDDGKLVNVDLAGGYYDAGDNVKYGLPMAFTVTTLAWGAIFYKPEFEAANELGNVHDAIRWGTDYFLKASSRHKRLYVEVGDPEDDHHCWAPPENMKTKRSVKMITSDIPGTEIAAETAAAMAASSIVFRPKDRKYARRLLNRAKLLFQMANSNKGTYDGECPFYCSYSGYNCKLTYVNGVGEMQDEMMWAATWLYMATRKSVYMKYITEECMSASVAEFSWDLKYAGAQILLSQLHFEGQKNLETFKSHAESFICSVLPDSPYHQIKLSPGGFIHLRDGANTQYATGTSFLFTVYSDLLAKHNQKVTCGDKQFSSSHLLAFAKKQMDYILGNNPEGRSYMVGFGKNPPTQAHHRGASVSILKKGEEVVCALSFTQWFQKDEPNPNELTGAILGGPDINDKFNDKRWDSPKTEPCTYINSLAAGALAKLASLG

SEQ ID NO: 194271 - protein, 461 aa, Glycine max
  Coding DNA Sequence Number=SeqID_77493
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1SQM5; Match level="QueryCoverage=96%, HitCoverage=92%, E-value=0.0, Identity=79%"; Hit description =Glycoside transferase, six-hairpin, subgroup
  Pfam annotation: Domain name=Glyco_hydro_9; Domain location=8-457; Score=705.1; E_value=4.9e-209; Accession=PF00759.9; Description =Glycosyl hydrolase family 9
MLVKGDFNYKEALTKSLIFLEAQRSGKLPSNNRVPWRGDSALDDGKLANVDLAGGYYDAGDNVKYGLPMAFTVTTLAWGAIFYKSEFKAANELDNIQDAIRWGTDYFLKASSRHKRLYVEVGDPEDDHHCWAPPENMKTKRSVKMITSDTPGTEIAAETAAAMAASSIVFRPKDRKYARRLLNRAKLLFQMAKSHKGTFDGECPFYCSYSGYNDEMMWAATWLYMATRKSVYMKYITEECMSASVAEFSWDLKYAGAQILLSQLHFEGQKNLETFKSHAESFICSVLPDSPYHQIKLSPGGFIHLRDGANTQYATGTAFLFTVYSDLLDKHNQKVTCGDKHFSSSHLLAFAKKQMDYILGKNPERRSYMVGFGKNPPTQAHHRGASVPKLKKDEEVVCATSFSKWFQKDAPNPHELTGAILGGPDFNDKFNDKRWDSPKTEPCTYINSLAAGALAKLASLS

SEQ ID NO: 194272 - protein, 225 aa, Glycine max
  Coding DNA Sequence Number=SeqID_77494
  Homolog annotation: Hit_ID=Q1SN44; Match level="QueryCoverage=62%, HitCoverage=24%, E-value=3e-13, Identity=26%"; Hit description =Nucleic acid-binding, OB-fold
MSRSRASSSCWTSVNEELEHIVAHMPKLTIEEQGQWKELAYKLQHVAAPPEGFFQTIFGEVGKVYAAKWKDILGSIWHLVDKDGNYHNVMYNQDVDQPAIVAGWTTLRDFYQRTGDHLISLHHYGKSTFFLTICKTPLLPRAFPRWHSLYHQVPGFVIFKVYLTEQNVFCSSLGVPSSMYYFLKDKGWTHLHFGDVAECQLVFNHWRKLLKIGAGLKVTGESGSG

SEQ ID NO: 194273 - protein, 52 aa, Glycine max
  Coding DNA Sequence Number=SeqID_77495
MHIIEGDGDLSCKVNGRVEFAHWTLKRLLQNSLGDLFSVWDAMSNMITLQHS

SEQ ID NO: 194274 - protein, 69 aa, Glycine max
  Coding DNA Sequence Number=SeqID_77496
  Subcellular localization annotation: CTP_CleavageSite=31; ConfidenceScore=5.09e-01
MANNIKNQAAKTRKQRLGLLGKGWVWPKSTKAAARQNRVLTLFRATAAIGVILSTKHRLERCQNPLCPV

SEQ ID NO: 194275 - protein, 102 aa, Glycine max
  Coding DNA Sequence Number=SeqID_77497
  Homolog annotation: Hit_ID=Q1RWU1; Match level="QueryCoverage=40%, HitCoverage=11%, E-value=3e-08, Identity=50%"; Hit description =Resistance-like protein HAAS-2-related
MDLLVDFLEVNSQEPRDETLQCCTLFANKNAHTCMCQTGSYAWGAAALVHMYENLNDASKRSTRQLVGYITLLQCWIYEHFPIFASFIVAEDYHERKPRAYH

SEQ ID NO: 194276 - protein, 404 aa, Glycine max
  Coding DNA Sequence Number=SeqID_77498
  Gene Ontology: Mol. function=nucleoside-triphosphatase activity; Cellular component=membrane; Biological process=DNA strand elongation during DNA replication
  Homolog annotation: Hit_ID=Q8VXX4; Match level="QueryCoverage=95%, HitCoverage=100%, E-value=1e-160, Identity=73%"; Hit description =Putative replication factor C
  Pfam annotation: Domain name=AAA; Domain location=55-276; Score= -13.0; E_value=0.002; Accession=PF00004.19; Description=ATPase family associated with various cellular activities (AAA)
HSAAITVEDTENKQERQLKMLWVDKYRPKTLDQVMVHTDIAHNLKKLVTEQDSPHLLFYGPSGSGKKTLIMALLRQMFGPGAEKVKVENRTWKIDLLVFCFEVLENWFQAGSRSLDLELTTLSSANHIEMSPSDAGFQDRYIVQEVIKEMAKNRPIDTKGKKGFKVLVLNDVDKLSREAQHSLRRTMEKYSAYCRLILCCNSSSRVTEAIRSRCLNVRINAPSEEQFYFLFLVALKGIPMASKIVQVLEFIGKKEGLQLPPGFAARIAEKSNRNLRRAILSFETCRVLQYPFTNKQAIPPMDWEEYISEIASDIMKEQSPKRLFQVRGKLYELLINCIPPEIILKRLLYELLRKLDAELKHEVCHWAAYYEYRMRLGQKAIFHIEAFVAKFMSIYKSFLIATFG

SEQ ID NO: 194277 - protein, 105 aa, Glycine max
  Coding DNA Sequence Number=SeqID_77499
MSQHLIGEEQNSGASIEFIEHRTRPPPRYLEQMQTNTKFKTLQKKIMENTAELQKFKWNPRFAASEINAKITQTSYQLHKNIAKVDIKGRSYLASFQVSISYKAY

SEQ ID NO: 194278 - protein, 183 aa, Glycine max
  Coding DNA Sequence Number=SeqID_77500
MSDLHKFLLFNLMENLPFDLPQTIYINILRNLKGLGGLDDIYYVALISKLLWDQGVHHVFNKMEDDSKHTLVAKGIGEKKWAVSFTGNKEVLALSFSDSESTDDTSISLLHKSQVPSTQPHPPPSPINLEKFKRAIQQKEPLTNAQRFPLAFVIGNPISESSFHESISIESLQKETIIVQAST

SEQ ID NO: 194279 - protein, 260 aa, Glycine max
  Coding DNA Sequence Number=SeqID_77501
MDTLKASTSGYDGSDNIVHHDVIHVLRLVRKYYFDDACQKKKKAEEEEETLVVVVVKDKDVFVQVEVSTKVVDDTIVHEVIIDLINPIIMDKTPKLSNATITDKVVHHFLEPMSKQSTTSNEVTSRDKSEPNVIIVYSTSLGHAPLKCAQPAVVTRDQVQDMIRMAIESFVERQRQENEQFRLFMQNAITTQFSNLGVILLQNIQQAQMSMFGAVVAPVIVPALAPQPLEPSPHTFAPNTSTSSSSPPPTQPPPPFPTQK

SEQ ID NO: 194280 - protein, 141 aa, Glycine max
  Coding DNA Sequence Number=SeqID_77502
  Gene Ontology: Mol. function=transcriptional repressor activity; Biological process=regulation of nitrogen utilization
  Homolog annotation: Hit_ID=Q05JX9; Match level="QueryCoverage=77%, HitCoverage=35%, E-value=5e-46, Identity=85%"; Hit description =Pinoresinol-lariciresinol reductase homolog
  Pfam annotation: Domain name=NmrA; Domain location=6-141; Score=-3.0; E_value=6.1e-08; Accession=PF05368.3; Description=NmrA-like family
MGKSKVLVVGGTGYIGRRIVRASLALGHETYVVQRPELSLQIEKLQRLLSFKKQGAHLIEASFNDHKSLVDAVKQVDVVISAISGVHIRSHSITLQLKLVEAIKEAGNVKSLKIYSCHLKNRQALMVDFAFKYTAALRLDQ

SEQ ID NO: 194281 - protein, 125 aa, Glycine max
  Coding DNA Sequence Number=SeqID_77503
MQLTQVFNHLEIEKKQGDDLDHEHKKNIEKHVNKSMIEHTSNMPFSSIIRPSNGLGAIACYDSFENKLGVGISPSSIPNAHYLTFRRALLCAHSLSHLLWSRCIVTVVLWQMVVVVVVGVAVNGK

SEQ ID NO: 194282 - protein, 574 aa, Glycine max
  Coding DNA Sequence Number=SeqID_77504
  Gene Ontology: Mol. function=enzyme inhibitor activity; Cellular component=cell wall; Biological process=cell wall modification
  Homolog annotation: Hit_ID=Q1SEQ0; Match level="QueryCoverage=93%, HitCoverage=94%, E-value=0.0, Identity=76%"; Hit description =Pectinesterase; Pectinesterase inhibitor
  Pfam annotation: Domain name=PMEI; Domain location=38-198; Score =102.8; E_value=9.9e-28; Accession=PF04043.6; Description=Plant invertasepectin methylesterase inhibitor
  Pfam annotation: Domain name=Pectinesterase; Domain location=254-551; Score=626.8; E_value=1.9e-185; Accession=PF01095.10; Description =Pectinesterase
  Pfam module annotation: Pfam domain module=PMEI::Pectinesterase; Domain location=38-198::254-551
MVNGKILASGVSLILVVGVAIGVVVVVNRKGTSNPEVEAQQKSVKAMCEGTDDPKLCHDTLITVNSTNSSDPKAYIAAGVEATVKSVIQALNMSDRLKVEHGDKDPGIKMALDDCKDLIEFALDSIESSANLVNNHNIQALHDQSPDFRNWLSAIISYQQSCMDGFNNETNGEQEIKEQLHTGSLDQMGKLTGIVLDIVTNLSKILQSFDLKLDLNPASRRLLELDAEGYPTWFSAADRRLLAKMNQGGAPPPNAVVALDGSGQFKSVKQAIDSYPKNFKGRFIIYVKAGIYNEYITIPKKSENILIYGDGPTKSIITGNKNFIDGVKTMQTATFANTAPGFIAKSIAFENTAGAKKHQAVAFRNQGDMSAMFDCAMHGYQDTLYTQANRQFYRNCEISGTIDFIFGAAPTLIQNSRIIVRKPEANQFNTVTADGTKQKNMATGIVLQNCEILPEQALFPTRFQTKSYLGRPWKDFARTVVMESNIGDFIQPEGWTPWSGNLFLDTLYYAEYANVGPGSNVQGRVKWKGYHPNINKNEAEQFTAGQFLRGGPSGNADDWLKATGVPYTIGFTKP

SEQ ID NO: 194283 - protein, 134 aa, Glycine max
  Coding DNA Sequence Number=SeqID_77505
  Gene Ontology: Mol. function=transcriptional repressor activity; Biological process=regulation of nitrogen utilization
  Homolog annotation: Hit_ID=Q05JX9; Match level="QueryCoverage=90%, HitCoverage=39%, E-value=3e-58, Identity=85%"; Hit description =Pinoresinol-lariciresinol reductase homolog
  Pfam annotation: Domain name=NmrA; Domain location=1-125; Score= -46.2; E_value=1.8e-05; Accession=PF05368.3; Description=NmrA-like family
MVSHYGISVMIAAIFLDEDDVATYTIKAIDDPRTLNKTLYLRPPENIISQAELIGIWEKLIGKELEKTYIPPEGFLTTLKGLDYKLQVGIGHFYHIFYEGCLANFEIGEEGEEASKLYPEVNYTRMDEYLKIYV

SEQ ID NO: 194284 - protein, 165 aa, Glycine max
  Coding DNA Sequence Number=SeqID_77506
  Homolog annotation: Hit_ID=Q1S909; Match level="QueryCoverage=39%, HitCoverage=5%, E-value=3e-21, Identity=76%"; Hit description=MATH domain, putative
  Subcellular localization annotation: CTP_CleavageSite=53; ConfidenceScore=5.35e-01
MPLLSSFLLLLTSSSSFSLFAFLSLKSQSCCCYLLLRFQKWGKESTLCHVIVLMAFNWSIIVIGIRSIFFSSTHCASVSTLPRIHNLCYKRSVSEIVLDQGMAGISSEESGVGKSAEGTFSGQRCQSGEALAEWRSSEQVENETPSTSPPYWDTDDDDDGEFVII

SEQ ID NO: 194285 - protein, 792 aa, Glycine max
  Coding DNA Sequence Number=SeqID_77507
  Gene Ontology: Mol. function=DNA binding; Cellular component=nucleus; Biological process=regulation of transcription, DNA-dependent
  Homolog annotation: Hit_ID=Q1SEQ4; Match level="QueryCoverage=95%, HitCoverage=74%, E-value=0.0, Identity=75%"; Hit description=SBP
  Pfam annotation: Domain name=Ank; Domain location=561-592; Score=5.9; E_value=4.3; Accession=PF00023.20; Description=Ankyrin repeat
  Pfam annotation: Domain name=Ank; Domain location=618-657; Score =10.5; E_value=0.95; Accession=PF00023.20; Description=Ankyrin repeat
  Pfam module annotation: Pfam domain module=Ank::Ank; Domain location =561-592::618-657
MIGLSKGKIQGSLIIFVLLHWRISIFLQLVCNKFLGDADRSDQTTDQDLLTHILRSLASQNGEQGSKNIANLLREPENLLREDGSSRKSEMMSTLFSNGSQGSPTDTRQHETVSIAKMQQQVMHAHDARAADQQITSSIKPSMSNSPPAYSEARDSTAGQIKMNNFDLNDIYIDSDDGMEDLERLPVSTNLVTSSLDYPWAQQDSHQSSPPQTSGNSDSASAQSPSSFSGEAQSRTDRIVFKLFGKEPNDFPLVLRAQILDWLSHSPTDMESYIRPGCIVLTIYLRQAEALWEEMILFGETDGFTSGCSIRWPSFLMVSCHVFVVFVIVVVRGQDNRSQVVIDTSLPFRSNNYSKILTVSPIAAPASKRAQFSVKGVNLIRPATRLMCALEGKYLVCEDAHMSMDQSSKEPDELQCVQFSCSVPVMNGRGFIEIEDQGLSSSFFPFIVVEEDVCSEICTLEPLLELSETDPDIEGTGKIKAKNQAMDFIHEMGWLLHRSQLKLRMVQLNSSEDLFPLKRFKWLIEFSMDHDWCAAVRKLLNLLLDGTVNTGDHPSLYLALSEMGLLHKAVRRNSKQLVECLLRYVPENISDKLGPEDKALVDGENQTFLFRPDVVGPAGLTPLHIAAGKDGSEDVLDALTNDPCMVGIEAWKNARDSTGSTPEDYARLRGHYAYIHLVQKKINKRQGAAHVVVEIPSNTTESNTNEKQNELSTTFEIGKAEVIRGQGHCKLCDKRISCRTAVGRSLVYRPAMLSMVAIAAVCVCVALLFKSSPEVICMFRPFRWENLDFGTS

SEQ ID NO: 194286 - protein, 96 aa, Glycine max
  Coding DNA Sequence Number=SeqID_77508
  Homolog annotation: Hit_ID=Q1SSV9; Match level="QueryCoverage=37%, HitCoverage=19%, E-value=8e-10, Identity=77%"; Hit description =Streptomyces cyclase/dehydrase
MEIDVPISVAYTCYSDREAIPNWMPFISSVKILPDKPDLSRWSLNPFQIRKFTGDLWKVFQTVQHRVKIFEMYDSKEKFRYHILEPDLKLVGIYVI

SEQ ID NO: 194287 - protein, 324 aa, Glycine max
  Coding DNA Sequence Number=SeqID_77509
  Gene Ontology: Mol. function=peroxidase activity; Cellular component =vacuole; Biological process=response to oxidative stress
  Homolog annotation: Hit_ID=Q1RUM5; Match level="QueryCoverage=91%, HitCoverage=90%, E-value=1e-121, Identity=72%"; Hit description=Haem peroxidase, plant/fungal/bacterial
  Pfam annotation: Domain name=peroxidase; Domain location=44-288; Score=459.5; E_value=4.3e-135; Accession=PF00141.13; Description =Peroxidase
MARFLHMLIMLSSLALIISVLPLASASLKVDFYKTTCPSAEAIVKRAVNKAVSLNPGIAAGLIRMHFHDCFVRGCDGSVLLESTQGNPSEREHPANNPSLRGFEVIDEAKAEIEAECPHTVSCADILAFAARDSSNKVGGINYVVPAGRRDGRVSNRDEASQLPRPTFNTQQLISNFEQKGLSADEMVTLSGAHSIGVSHCSSFSDRLYSFNATFPQDPSMDTKFATSLKSKCPPRSDNTVELDASSPNRLDNNYYTMLNNHRGLLTSDQTLLTSPSTRPMVLTNAKHGSTWARKFAKAMVHMGSIEVLTGSQGEIRTRCSVVN

SEQ ID NO: 194288 - protein, 131 aa, Glycine max
  Coding DNA Sequence Number=SeqID_77510
MEKWNYAPTIRGHSLRLNKQHHEHGIGIRVVRFCVFWHCWFGLPGCHMGALDARRGLPKQIGNLGREPSGGSTRQYWSGRECGSERQSHRSGEEHPPVMDQLLARTAPFVPLDHAFPFLCGHGRFATIGCS

SEQ ID NO: 194289 - protein, 81 aa, Glycine max
  Coding DNA Sequence Number=SeqID_77511
MTGEKRLKPWKVEKRRLEESGVAGKLVEVELAPNVLLLVRDDGNKGVKAAVVEIEPTTVVEDMFQFFQNSDTVPLSLSLSS

SEQ ID NO: 194290 - protein, 257 aa, Glycine max
  Coding DNA Sequence Number=SeqID_77512
  Gene Ontology: Mol. function=2-C-methyl-D-erythritol 2,4 -cyclodiphosphate synthase activity; Biological process=terpenoid biosynthetic process
  Homolog annotation: Hit_ID=Q681X6; Match level="QueryCoverage=91%, HitCoverage=71%, E-value=7e-24, Identity=29%"; Hit description=MRNA, complete cds, clone: RAFL21-92-C23
MSGGEDTEGYKYWFRWQVPVCALILIVSIITASMQIVKAKAQPFYHNHLWLPCWRKLSPVWLFFSRAFAFLCLAHLHFDIIALDGAFSFYFYTQWTFTLVMIYFALGTIISAHGCWQYINKPPLQNGEMAEFLRRDLEESTNSIAYREKETKSSIRLQSQYIQEEFNQRVGFWGYLMQITYQLRLTNEEFPMSMHLLGPLYTSAGAIILTDIVFWCVIVPFLSISHFKLNMVSATLLYNLTVIVHDFHFYSCGFGAY

SEQ ID NO: 194291 - protein, 494 aa, Glycine max
  Coding DNA Sequence Number=SeqID_77513
  Homolog annotation: Hit_ID=Q7XA46; Match level="QueryCoverage=40%, HitCoverage=61%, E-value=4e-77, Identity=59%"; Hit description =Dopamine-responsive protein, putative
  Pfam annotation: Domain name=MobB; Domain location=22-149; Score= -20.3; E_value=0.0011; Accession=PF03205.4; Description=Molybdopterin guanine dinucleotide synthesis protein B
  Pfam annotation: Domain name=cobW; Domain location=22-192; Score =247.2; E_value=3.5e-71; Accession=PF02492.9; Description=Cobalamin synthesis proteinP47K
  Pfam module annotation: Pfam domain module=MobB::cobW; Domain location=22-149::22-192
MVSAPNPNFDEAASLALDNRVPATVITGFLGSGKTTLLNHILTSQHGKRIAVIENEFGEVDIDGSLVASHSSASEEIIMVNNGCLCCTVRGDLVKMLLELVRKKRDKFDHIVIETTGLAKPAPVIETFCSDELVSQHVKLDGVVTLVDCKHAMKHLNEVKPRFVVNEAVEQVAYADRIILNKHINGMAQIKQAKFGSVDMDFVLGVGGYDLESENKGLEVARESVWVERNERERVRCRSRVTSETERREEKGRIKLVRTPMASLNNSFSSSSTFPNSIAEKLDHSNFLMWWQQVQPVFKSHHLQWFVENPIIPPRFLSDEDCAIGCENAAYEDWEQQDQGAAHMVAVTLSKSILSRTELQSPVLADKPMREFLLKMKAISDSLASVGGLILPQEHIDAILKGLPQDYHSVIFVIESKFEPFLIEEHAFSDSLSINYKQANSNFSSAYGSNGYNVPNKTSQPKSENFSFGSRGGFGCRGNFNHGGHCGGGRGCGG

SEQ ID NO: 194292 - protein, 108 aa, Glycine max
  Coding DNA Sequence Number=SeqID_77514
MLPSTYHSTPRFNLFNSTRFFFLFYVQLHQHFLHLAMIRFHEGGRKSIVFSDEIVQGKPIPESNLCFGMTILLRQRPLTNGEGWVVKVLCRFHNHDVAETLVGHPYVG

SEQ ID NO: 194293 - protein, 325 aa, Glycine max
  Coding DNA Sequence Number=SeqID_77515
  Gene Ontology: Mol. function=amino acid transporter activity; Cellular component=membrane; Biological process=amino acid transport
  Homolog annotation: Hit_ID=Q1SQ57; Match level="QueryCoverage=96%, HitCoverage=51%, E-value=1e-138, Identity=75%"; Hit description =Amino acid permease-associated region
  Pfam annotation: Domain name=AA_permease; Domain location=48-325; Score=-116.8; E_value=0.013; Accession=PF00324.11; Description=Amino acid permease
MGIWCDSEEGGEYGGQCSWSFLTRRKRVDSSDKSNSQGQLAKELTVPHLMAIGVGATIGAGVYVLVGTVAREHSGAALPLSFLVAGFAAALSALCYAELASRCPSAGSAYHYSYICVGEGVAWLIGWALILEYTIGGAAVARGMTPNLAALIGGGENLPSFLSRHSIPGIDVVVDPCSAIMIFIITGLLCVGIKESTMVQSIITSINICALIFVILAGGYLGFKSGWVGYELPAGYFPFGVDGMLAGSATVFFAYIGFDAVASTAEEVKNPQRDLPLGIGGSLFLCCGLYMLVSIVIVGLVPYYAINPDTPISSAFADNGMQWAA

SEQ ID NO: 194294 - protein, 259 aa, Glycine max
  Coding DNA Sequence Number=SeqID_77516
  Subcellular localization annotation: CTP_CleavageSite=33; ConfidenceScore=5.08e-01
MASSSSSVLSQLLHNRKLPKNSTPPFRNPPDTLAQPKGEDGALSELVFAQHLYTAQPSSKIVHALSHQIGRLANDALSQKISGLTRLDKLATLLLVKAITLDTSQSPSTPDNLFRQQVGSKLVGLMYCLGSTKWLLHYRNNPYKQGPEAPTSLYKYQVLSHHFHISFSSNSEQVDELRHWQRPQCHGGDDIVVVLVVIVGVAVVGESMTLTPSCVSTTTISPSATPTSSCPLCWLVQIVAHGGGGGVGGGATQRRWVRW

SEQ ID NO: 194295 - protein, 348 aa, Glycine max
  Coding DNA Sequence Number=SeqID_77517
  Gene Ontology: Mol. function=transferase activity, transferring phosphorus-containing groups; Cellular component=outer membrane -bounded periplasmic space; Biological process=two-component signal transduction system (phosphorelay)
  Homolog annotation: Hit_ID=Q9HX70; Match level="QueryCoverage=94%, HitCoverage=28%, E-value=3e-52, Identity=35%"; Hit description =Probable two-component sensor
RIQLLFQQEKPFADDLLIFSALAGALDLPAQIIDLAGVNDLRRSAQPVQRRGQRRPVLRIKMIPALLHIVAALLADFLQHLRHHRIVVIHHGAQRFERQQRIQRRHFGGRLVAAQQLSQLVNFQRLKQAGVHARFKTAHAHVRLRIRRQTKNFHRVAAAAQGLRQFDAAHARHIAVGNNQIERLMRQQRQRLFAAAGFADLLAQLAELASQQQAVGRMIVDHQNIQLWQRTAARHAGFLQQLARPACRHHYIKLNQRAASRLAVEVHGALHLLQQLGADHQAKAGAGLLASLFGLGKRLKQFGLIGSADAHAAVFDLNFQLQRTVFPLMADHPHFHAAFVGKLDGVID

SEQ ID NO: 194296 - protein, 62 aa, Glycine max
  Coding DNA Sequence Number=SeqID_77518
MYRYSMFLAYMPRRETVLAKQSHWRFKGRAWMGGEGENGMMQREKKYKMKQARRPIAWSLEL

SEQ ID NO: 194297 - protein, 96 aa, Glycine max
  Coding DNA Sequence Number=SeqID_77519
MYALFNKCLPLATIMVQPSPNALIFMHSCIQKCKLGFLGPRHIWGNYPTPCETAYTLKDDNHMYTNSSHGLYPTKSCANAIEAFHRALGGRMFRHE

SEQ ID NO: 194298 - protein, 40 aa, Glycine max
  Coding DNA Sequence Number=SeqID_77520
MGAGPAGTSGGGDEAQEDEDMADLFDFLGGGRAVHYNFHL

SEQ ID NO: 194299 - protein, 212 aa, Glycine max
  Coding DNA Sequence Number=SeqID_77521
MASRKFPAKRSMKDTTGEGFSVAPQADMDFDRHRFWSMEHQQCFETIRGWHWAPLVTPMAKFDPEIVMEFYANAWPTKGEVQDIRPQSVPRPPADLGRGLAVETGADHAHQHDHPYADMDDFVGTAPMRHPVDPKKSNRALGFPALITGLYQFYRVPVAPSKVICPPNNRVFIEKYCTPRQAQGKVPQQPGDGQQQAADAPPPPPESTSDHL

SEQ ID NO: 194300 - protein, 656 aa, Glycine max
  Coding DNA Sequence Number=SeqID_77522
  Pfam annotation: Domain name=Autotransporter; Domain location=391 -640; Score=0.3; E_value=0.064; Accession=PF03797.9; Description =Autotransporter beta-domain
PDQGLQLAVPAGVMQYRGSVSTDLRGNVTQLKARGANLGLDSGWRWQSGAHALTPVAGVNAQWLDINDFTDSDGAQVSYRNPLQWQLSGGVKYDFRLNEKLKLGAETHYVQRISQRDRVAIGDGQQAAHFATGRGGNSLQYSGYAGWQVLDNLELNTQLQGQQRLTQEGISDWNLQAGLRFSLFSSMEENMKLTPLTLVISAFCYSLPAFADERYPAFSTSQNNNVNAANIPHPPGPFHGPSTQEIPELPLLAQVSRQTGEGIKQLGKIIARGSWFDEINPATSGLVRSNVLAGNNSHHLWYYRLQTMVLTGEKDEGLPNINNPGIVAPIPDPGKGEAVILPPPPPPEPEPPQLTPAPQIPTYLALPNMLYALNDAMQTRFHFAAQQMSMDDHHNLFVYGYSGGERYRSAQGDSDATSRYQGWMLGARWTPEAEQSPLAFSAGVHKGVATMLSNTAAGRSQLRMQTQGINALIGIQPPEGWQLEIPLGLTHYRGTLRHETQGEVARISAVSGNIGAEAGWRWLQDAHSLMPLAAAGVQWLHVADFTEQQGAQVNYQLAPQFSLAGGVKYDYQPLSSVKLGLEARYVWHSGRQNTLDAGDMRGLPIERARHSAQLGGYVSWQLHENVEIGTQLQVQQRLDRPGVSDWNVLSGVKVAF

SEQ ID NO: 194301 - protein, 202 aa, Glycine max
  Coding DNA Sequence Number=SeqID_77523
  Gene Ontology: Mol. function=DNA (cytosine-5-)-methyltransferase activity; Cellular component=chromatin; Biological process =regulation of transcription, DNA-dependent
  Homolog annotation: Hit_ID=Q94F87; Match level="QueryCoverage=61%, HitCoverage=10%, E-value=1e-47, Identity=71%"; Hit description=DNA (cytosine-5)-methyltransferase CMT2
MLFPTVRFSAKHNQRIYTCSDYYSMLSQVPEYCFTFEHGKSKRPFARLWWDENLPTALTFPSCHNQVVLHPEQDRVLTIREFARLQGFPDYYRFYGTVKERYCQIGNAVAVPVSRALGYALGLACRKLNGNEPLVTLPSKFSHSNYLQLSKCVFGNTSNEVNSRQFRALDAEVTPGSIGQDSRVEDSTQLQTCYNNQPGNTD

SEQ ID NO: 194302 - protein, 58 aa, Glycine max
  Coding DNA Sequence Number=SeqID_77524
MVLVKLEGEGYQVFGQAKFLILLGIPGIRPGQIPDVTRATKYSPRPNSSCYGRCPILD

SEQ ID NO: 194303 - protein, 176 aa, Glycine max
  Coding DNA Sequence Number=SeqID_77525
  Gene Ontology: Mol. function=DNA binding; Biological process=DNA integration
  Homolog annotation: Hit_ID=Q1RZ71; Match level="QueryCoverage=68%, HitCoverage=13%, E-value=3e-30, Identity=42%"; Hit description =Peptidase aspartic, catalytic; Polynucleotidyl transferase, Ribonuclease H fold
  Pfam annotation: Domain name=rve; Domain location=15-157; Score=-2.3; E_value=0.0093; Accession=PF00665.16; Description=Integrase core domain
MDVSSNPKIRPNFSLLIGKNSICQWKEIYGLVVVDDYLRWTWVTFLAHKNESFEVFFKFCKRVQNENGVCITSIKRDHGEEFENESFHLFCEENGIFHNLTASRTPQQKDNLGKFDYKSDNGTLLGYLETSKAYRVYNSRTSAVEEAIHWLSIAVWVVVVADIHSTNPFLQTFDNF

SEQ ID NO: 194304 - protein, 53 aa, Glycine max
  Coding DNA Sequence Number=SeqID_77526
MWQLVLVDVHVYAMVKYSESGPPVKQVILPIMGGKLHKKSEQALGVLSELTVV

SEQ ID NO: 194305 - protein, 165 aa, Glycine max
  Coding DNA Sequence Number=SeqID_77527
  Homolog annotation: Hit_ID=Q1SQL2; Match level="QueryCoverage=69%, HitCoverage=83%, E-value=2e-40, Identity=70%"; Hit description=4Fe -4S ferredoxin, iron-sulfur binding
  Pfam annotation: Domain name=DUF1677; Domain location=12-146; Score =120.6; E_value=4.6e-33; Accession=PF07911.4; Description=Protein of unknown function (DUF1677)
MAATAVTETEAVWSVKCYCCGLTEECTPRYIDGVRERYQGRWICGLCAEAVKEEGLKLKDDDVDVDVDVSTDEALKRHMKFRSSTSSPPNKPTLDLILAMKHLLVRSLDSPRKEPLTFSPLTTSRTCFSPGSSKGEPQEARKVVTMSGDLGRYDLTHGKWGPCAQ

SEQ ID NO: 194306 - protein, 498 aa, Glycine max
  Coding DNA Sequence Number=SeqID_77528
  Gene Ontology: Mol. function=protein-tyrosine kinase activity; Cellular component=membrane; Biological process=protein amino acid phosphorylation
  Homolog annotation: Hit_ID=Q1SQL4; Match level="QueryCoverage=74%, HitCoverage=98%, E-value=0.0, Identity=86%"; Hit description=Protein kinase
  Pfam annotation: Domain name=Pkinase; Domain location=77-355; Score =123.4; E_value=6.5e-34; Accession=PF00069.15; Description=Protein kinase domain
  Pfam annotation: Domain name=Pkinase_Tyr; Domain location=77-355; Score=131.6; E_value=2.2e-36; Accession=PF07714.7; Description =Protein tyrosine kinase
  Pfam module annotation: Pfam domain module=Pkinase::Pkinase_Tyr; Domain location=77-355::77-355
MSSKKITWKSIVLILSCNKTSEKQVLKQGSFQRLCLSDISIPSSPQAIEDLSISISLVGPKLHTFTLDELREATHNFSWSNFLGEGGFGPVYKGFVDDKLRPGLKAQPLAVKQLDLDGLQGHREWLAEIIFLGQLRHPHLVKLIGYCCEDEHRLLVYEYMARGSLENQLHRRYSAALPWSTRMKIALGAAKGLAFLHEADKPVIYRDFKTSNILLDSDYTAKLSDLGLAKDGPEGEATHVTTTCIMGTRGYAAPEYIMSGHLSTKSDVYSYGVVLLELLTGRRVVDKCGSNREQSLVEWARPLLRDQRKLHHIIDPRLEGQFPMKGALKVAALTYKCLSRHPNPRPSMSDVVKILESLQDFDDVIIGPFVYVAGTGTRSINNKGIFALVPEEEVTNSETHDDGHKHPSVEGHHRQHQQVPDRGAQPEEKRSGDLHAHLDAVSGELPPQKRGLDLRREGLSGADELEADAAILEELVEGGDDEAREQSEEIVRPIVGLP

SEQ ID NO: 194307 - protein, 173 aa, Glycine max
  Coding DNA Sequence Number=SeqID_77529
MSNPSDEKEQCQKKRKSTICEASNFKTSRRRFFSNKNEEDMNKGVSTTLKLYDDPWKIKKTLTDSDLGILSRLSLAADLVKKQILPMLGADHARAAETEEGTPVRVWDMDTKSMHQLVLKRWSSSKSYVLIGKWNQDFVRRRDLKKGDEIGFHWDPYNCVFNFCVLKRAMPEN

SEQ ID NO: 194308 - protein, 69 aa, Glycine max
  Coding DNA Sequence Number=SeqID_77530
MEFSSQKVSSPTGRRVREEVVVLVIGEEASVVALEKKFSSGVSTLASKVGEGAMVVENMGDDEGVEAME

SEQ ID NO: 194309 - protein, 438 aa, Glycine max
  Coding DNA Sequence Number=SeqID_77531
  Gene Ontology: Mol. function=hydrolase activity; Biological process =aromatic compound metabolic process
  Homolog annotation: Hit_ID=Q1SQL8; Match level="QueryCoverage=100%, HitCoverage=80%, E-value=4e-85, Identity=62%"; Hit description =Alpha/beta hydrolase fold
  Pfam annotation: Domain name=Abhydrolase_1; Domain location=78-311; Score=13.4; E_value=0.00071; Accession=PF00561.10; Description =alphabeta hydrolase fold
MLPSFLSPVSVYSLYLRRCFTGSGLSSQTLSVDDETTLHFWAPTNPTAQKPSVVLIHGFGPESIWQWRKQVQFLAPDFNVYVLDLIFFGGSSTKSSERSETFQAASLGKLLDKLEVEKFHVVGTSYGGLVAYNLAKMLGEERVQKVVIASSGVNMMKSSNVALVQRAQLEKIEDLMLPPTPQHLRILMSLSIHKPPQLLPDFLLRDFLDKLYGENKKEKMELLKGLTIGRDDTSRISPLQQQVHPTMFYERWALVAGPERGQGRRNHDALLGPEKSRSGPEALPGSDPRVWARGHVAMASPGEVPGPTLQPIRPRPRILRRVAHEVGGKKRNVSGSVGGVQKVVIASSGVNMTMSSNTALVQSSEMESIDDLMLPTKPHQLRKLMSLSIYNPPPLVPDFMLKAFIDELYGENKKEKLELLKGITIGRNDTSNVSPLQQ

SEQ ID NO: 194310 - protein, 81 aa, Glycine max
  Coding DNA Sequence Number=SeqID_77532
MVASKQINKVFLGENSQLLKYYHAFQQLREEFDEVQFLGRWRKGVHKGILHGIVLYQRLSGDGVVDTNWCSVLARKAEDIH

SEQ ID NO: 194311 - protein, 224 aa, Glycine max
  Coding DNA Sequence Number=SeqID_77533
  Subcellular localization annotation: CTP_CleavageSite=58; ConfidenceScore=5.30e-01
MESLQYLTFQALTSFIGLKLATPFQISVVYSALKKTKTIYSAFFFFYSPSRAQFPLCLAPNPSSLANPLVFIDLFDGKQEKEKREKKRKEGRRRGVKVTSGGSDGRFGGFEAHATMVGSSEAYPFFFVLLSSLVLGFLFSSQHRTLDSETSMDEVYQNTGSEHEAKWHNISNCAGMLFSTRTPAVSMRPKGKTGYCLENGLVEAVGILISKMPHMFDLFLTYIL

SEQ ID NO: 194312 - protein, 317 aa, Glycine max
  Coding DNA Sequence Number=SeqID_77534
  Gene Ontology: Mol. function=binding; Cellular component =intracellular; Biological process=metabolic process
  Homolog annotation: Hit_ID=Q1SQK8; Match level="QueryCoverage=91%, HitCoverage=71%, E-value=1e-101, Identity=35%"; Hit description =Tetratricopeptide-like helical
  Pfam annotation: Domain name=PPR; Domain location=193-227; Score =30.4; E_value=6.5e-06; Accession=PF01535.11; Description=PPR repeat
  Pfam annotation: Domain name=PPR; Domain location=271-305; Score =13.0; E_value=0.21; Accession=PF01535.11; Description=PPR repeat
  Pfam module annotation: Pfam domain module=PPR::PPR; Domain location =193-227::271-305
MHLRLRAATSTANPFIPPAHLIHSIPQWFSILRHAIAASDLPLGKRAHARILTSGHHPDRFLTNNLITMYSKCGSLSSARKLFDTTPDTSRDLVTWNAILSAHADKARDGFHLFRLLRRSFVSATRHTLAPVFKMCLLSASPSAAESLHGYAVKIGLQWDVFVAGALVNIYAKFGRIREARVLFDGMGLRDVVLWNVMMKAYVDTGLEYEALLLFSEFNRTGLRPDDVTLCTLARVVKSKQNVLEWQLKQLKAYGTKLFMYDDDDDGSDVIAWNKTLSWFLQRGETWEAVDCFVDMINSRVACDGLTFVVMLSVVAG

SEQ ID NO: 194313 - protein, 600 aa, Glycine max
  Coding DNA Sequence Number=SeqID_77535
  Homolog annotation: Hit_ID=Q69K57; Match level="QueryCoverage=98%, HitCoverage=97%, E-value=1e-106, Identity=42%"; Hit description=Smr domain-containing protein-like
  Pfam annotation: Domain name=DUF1771; Domain location=417-482; Score =61.0; E_value=3.8e-15; Accession=PF08590.1; Description=Domain of unknown function (DUF1771)
  Pfam annotation: Domain name=PAM2; Domain location=18-35; Score=19.8; E_value=0.0099; Accession=PF07145.5; Description=Ataxin-2 C-terminal region
  Pfam annotation: Domain name=Smr; Domain location=519-600; Score =46.2; E_value=1.1e-10; Accession=PF01713.11; Description=Smr domain
  Pfam module annotation: Pfam domain module=DUF1771::PAM2::Smr; Domain location=417-482::18-35::519-600
  Subcellular localization annotation: CTP_CleavageSite=36; ConfidenceScore=5.64e-01
MNLTKKGPLTDAKLLSPNKATTLNPNAAEFVPFALRSSSLSGTTSLVDATARLTAAGTLGKAVLDRSESSISNNSDDEVHRYWRCQLPDDITPDFKVLGEDESRVLDDISLAGLSIHDDNEASRFPSSKGSKYIINEQEEISQQHANGNSLADKLGFSNSSYREDPSSGSFLNALAKPWERPIGSADQRINSGQEGLTYDDNSRHGYLNDILAENAIVDDTDLNPLEFLASLFPGFAAESLAEAYFANRCDLHLTTEMLNQLELQVDGGFNQNLNSKTLSAPNLSAMDYPALTSPDGQTASVEYVVDNVQQSGNPYRSYDSDVLLFKSVSSVSSRGGAIDFASAVRKLASRDSGGIWKYDKNGSGDAAIGSSRNSNVLASGYNGGQGRAHFGDRLQNRGSARAFPVWLETGDAVANMYSELREEARDHACLRNAYFEQAQQAYLIGNKALAKELSAKGQLHNMHMKVAHGKAQESIYLQRFVVPQCFDSCSPFIASVDFFRNPVAPELQGDGRGNERIIDLHGLHASEAIHVLKHELSVLKSTAIAAEQRLQVYILVGTGHHTRGSRTPARLPIAVQRFLLEEGIDFTETQPGLLRVVIY

SEQ ID NO: 194314 - protein, 560 aa, Glycine max
  Coding DNA Sequence Number=SeqID_77536
  Gene Ontology: Mol. function=metal ion binding; Cellular component =intracellular; Biological process=metabolic process
  Homolog annotation: Hit_ID=Q1SQK8; Match level="QueryCoverage=88%, HitCoverage=96%, E-value=0.0, Identity=41%"; Hit description =Tetratricopeptide-like helical
  Pfam annotation: Domain name=PPR; Domain location=118-152; Score =35.7; E_value=1.6e-07; Accession=PF01535.11; Description=PPR repeat
  Pfam annotation: Domain name=PPR; Domain location=17-51; Score=32.6; E_value=1.4e-06; Accession=PF01535.11; Description=PPR repeat
  Pfam annotation: Domain name=PPR; Domain location=219-253; Score =52.4; E_value=1.5e-12; Accession=PF01535.11; Description=PPR repeat
  Pfam annotation: Domain name=PPR; Domain location=254-288; Score=5.1; E_value=1.9; Accession=PF01535.11; Description=PPR repeat
  Pfam annotation: Domain name=PPR; Domain location=290-323; Score =12.2; E_value=0.26; Accession=PF01535.11; Description=PPR repeat
  Pfam annotation: Domain name=PPR; Domain location=356-390; Score=6.6; E_value=1.2; Accession=PF01535.11; Description=PPR repeat
  Pfam module annotation: Pfam domain module=PPR::PPR::PPR::PPR::PPR::PP R; Domain location=118-152::17-51::219-253::254-288::290-323::356-390
MEEAEFLFVNQDGFDLASWNAMMHGYIVSGDFPKALRLYILMQESGERANQITLANAAKAAGGLVGLKQGKQIQAVVVKRGFNLDLFVISGVLDMYLKCGEMESARRIFNEIPSPDDVAWTTMISGCVENGQEEHALFTYHHMRLSKVQPDEYTFATLVKACSLLTALEQGRQIHANTVKLNCAFDPFVMTSLVDMYAKCGNIEDARGLFKRTNTSRIASWNAMIVGLAQHGNAEEALQFFEEMKSRGVTPDRVTFIGVLSACSHSGLVSEAYENFYSMQKIYGIEPEIEHYSCLVDALSRAGRIREAEKVISSMPFEASASMYRTLLNACRVQVDRETGKRVAEKLLALEPSDSAAYVLLSNVYAAANQWENVASARNMMRKANVKKDPGFSWVDLKNKVHLFVAGDRSHEETDVIYNKVEYIMKRIREEGYLPDTDFALVDVEEEDKECSLYYHSEKLAIAYGLMKTPPSTTLRMQIDFIISGVGFALVVITDSKPNEIMFWLDLMLLPLVCSIWGDDSGLALGTRSVARWMHPPQGRLKLNCDASVSLKFFCFHCQE

SEQ ID NO: 194315 - protein, 182 aa, Glycine max
  Coding DNA Sequence Number=SeqID_77537
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=3e-22, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
TTCPHLQRNNGADLQRATRLHLKRPTRPRLQRATHAHLQRITGPDLQRATRPQLKMPTCPRFQSTTRPPLQWSTRPHLPRTTHPRLQRPTHAHLQRTTPPRLQRARFPHLESTTRPRLPRTLRPHFRRATRPPLQRTTRHQLQRATRPNLLRTTRPRIQRTACPPLQRRTFPHLPRTTRPRL

SEQ ID NO: 194316 - protein, 317 aa, Glycine max
  Coding DNA Sequence Number=SeqID_77538
  Gene Ontology: Mol. function=ATP-dependent helicase activity; Cellular component=intracellular; Biological process=RNA processing
  Homolog annotation: Hit_ID=Q1SQK6; Match level="QueryCoverage=98%, HitCoverage=78%, E-value=4e-63, Identity=62%"; Hit description =Helicase, C-terminal; Argonaute and Dicer protein, PAZ; Type III restriction enzyme, res ...
  Homolog annotation: Hit description=subunit; Ribonuclease III, bacterial
  Pfam annotation: Domain name=Ribonuclease_3; Domain location=227-314; Score=62.1; E_value=1.9e-15; Accession=PF00636.16; Description=RNase3 domain
YQIEVYEVARRRNTIAVLDTGSGKTLNAVMLMKEQFKNMKFLTDFQVEEYYGAKGVDTWSLKMWEKVISNNDLISYINCNALDCRLLGGLHITTLHTVTLHTVTLHSTFLLVRTLCRSNDYLGKFFAGCVLKTIADCVEALIGAYYVDGGLFASLNVMKWLGIGVELELSSLDEAITAASLSTCVPIESDIASLEKKIEYEFSVKGLLLEAITHLSEKELGIGCCYERLKFLGDSVLDLLITWHLYQSHTDIDPGVLADLRSASVNNDNFAQVAVRHNLHQHLLHSSGLLVSQILEYVKVISESDPRSLPSIRAPKV

SEQ ID NO: 194317 - protein, 142 aa, Glycine max
  Coding DNA Sequence Number=SeqID_77539
MKKNQVVSMMPKSTLIYEVFGIKMVIDQSLFYDLTQLSSEGVPFEGALNDDWKFDFSMHDAHRLVCTNQADMTGRLFVGSLALESRILHYLIVRILLPRSSNLAQVSKEDFIVMWAFHTGRQIDWAHLVEYHMHKALRLGIL

SEQ ID NO: 194318 - protein, 434 aa, Glycine max
  Coding DNA Sequence Number=SeqID_77540
MKLGGRRKYPSGYPYKHFCYPSDPEHDSMQRLTSSSAPFVNRSQARLHAEIYAFFRAFCHTDPKVRRKYPSGYPYKHFCYPLDPEHDSMQRLTSSSAPFVIRIRTRLDAEIYAIFRAFCHTDPKVRWKYPSGYPYKHFCYPSDPEHDSMQRLTSSSAPFVNRDPENDSTQRLTSSPAPFVVLTVKSGDMRGYLMVTRTFRQTGANEPVDAQRLTSSPGPSFVLTRANEPVNAQRLTSSPAPSVLLTREVRWQAEIPYGHLRLSSTEGNEFDGIRMMLVVRDDRMCWRREVSWLSNFVIFKTLKGVQIATKPTWAFQGVPTEGGAFWWKQPSSPGRAGRQPPPYVIVSDFVMIFHHSSSFFVVLRSSTDAPVSLASPSRRRGRLGLHPPQFLLYRGTLKIQRAINSSRMRAAIPVPTFTSLLPLSVPKSTSSVSS

SEQ ID NO: 194319 - protein, 63 aa, Glycine max
  Coding DNA Sequence Number=SeqID_77541
GQGSAPFVCPTPEQFGAEVAWPGDWPDAQAGEEPAGSPGEADESYMDEDMIDLLGFLEGSEAA

SEQ ID NO: 194320 - protein, 81 aa, Glycine max
  Coding DNA Sequence Number=SeqID_77542
MRGEEEVRECNWEATRCKDPVIVAIAMVFGQRGAEAEKRKEKEGWQSLLVMVHRQERKERGKEKKRGREQRAKGQNGQFVN

SEQ ID NO: 194321 - protein, 218 aa, Glycine max
  Coding DNA Sequence Number=SeqID_77543
  Gene Ontology: Mol. function=isomerase activity; Biological process =carbohydrate metabolic process
  Homolog annotation: Hit_ID=Q9M1T1; Match level="QueryCoverage=52%, HitCoverage=31%, E-value=3e-25, Identity=62%"; Hit description=Sugar- phosphate isomerase-like protein
  Pfam annotation: Domain name=SIS; Domain location=75-197; Score=-2.9; E_value=0.045; Accession=PF01380.12; Description=SIS domain
MTGSKSNGTTEKRPLLYDHRPYFLFEDDYLRVCQIPKRKGANFRDLPGVIVGADNVVRRHPTENPLLPSGKPLESSHHQHRLLHQHWKIQLLVTHKILQMLISFDVRLTFLSSMDALHGNIGILTNCDMLILLGNSGSTKELLCLVPYARAKGKLLVVLTFDKGNMFAAACDMAVHLLLQRELCPTVSIQPHTGHLHCHSDGVRLYCGGGRRRGGRRL

SEQ ID NO: 194322 - protein, 403 aa, Glycine max
  Coding DNA Sequence Number=SeqID_77544
  Gene Ontology: Mol. function=DNA (cytosine-5-)-methyltransferase activity; Cellular component=chromatin; Biological process =regulation of transcription, DNA-dependent
  Homolog annotation: Hit_ID=Q94F87; Match level="QueryCoverage=70%, HitCoverage=23%, E-value=1e-105, Identity=65%"; Hit description=DNA (cytosine-5)-methyltransferase CMT2
  Pfam annotation: Domain name=Chromo; Domain location=202-258; Score =53.3; E_value=8.3e-13; Accession=PF00385.14; Description='chromo' (CHRromatin Organisation MOdifier
MWALPNGYEVTDSHALVRYWLSGLGFTHFTNHVSATKAGQLMKKIISIKCQYTALNNPVKTNELSPPSVLESLSTDASTVTESQPCSELNKTELALLDLYSGCGGMSTGLCLGAKTASVNLVTRWAVDSDRSAGESLKLNHSDTHVRNESAEDFLELLKAWEKLCKRYNVSSTERKLPFRSNSSGAKKRGNSEVHEISDGELEVSKLVDICFGDPNETGKRGLYLKVHWKGYSASEDTWEPIKSLSKCKESMQDFVRKGMKSNILPLPGEVDVICGGPPCQGISGYNRFRNCASPLDDERNRQIVIFMDMVKFLKPRYVLMENVVDILRFDKGSLGRYALSRLVHMNYQARLGIIAAGCYGLPQFRLRVFLWGAHPSEIVYVNPSIFMGKHMPLSIDVFNSLR

SEQ ID NO: 194323 - protein, 624 aa, Glycine max
  Coding DNA Sequence Number=SeqID_77545
  Gene Ontology: Mol. function=GTP binding; Cellular component =intracellular
  Homolog annotation: Hit_ID=Q2HRG7; Match level="QueryCoverage=99%, HitCoverage=100%, E-value=0.0, Identity=63%"; Hit description=SDL-1 protein
  Pfam annotation: Domain name=MMR_HSR1; Domain location=365-472; Score= 23.0; E_value=7.8e-06; Accession=PF01926.13; Description=GTPase of unknown function
  Subcellular localization annotation: CTP_CleavageSite=60; ConfidenceScore=5.26e-01
MTMLLSTIIVPSTKLIIFNNNNTQERALPTFRHFSDSSKRFEKVSSFIAFAVNGGSAHVKATHRRDGSRNPLMSEGRDEDEARGPICPGCGVFMQDKDPNFLGYYQPRKMKMEEFSEEEDDDVGFLNGSESELGEESEGLIDELDWDSDDLEDELLGEDDNEKLELDGFTPAGVGYGNITEEYLERVKKKKVSKAEKKRMAKEADKEKEEATVCARCHSLRNYGQVKNQTVENLIPDFDFDRLISTRLMNPSGSGSATVVVMVVDCVDFDGSFPRTAVKSLFQALERIQDNSKRSKKLPKLVLVATKVDLLPSQVSPARLDRWVRNRARSGGAPKLNGVYMVSSKKDLGVRNLLSFVKDLAGPRGNVWVIGAQNAGKSTLINAFAKKQGAKVTKLTEAPIPGTTLGILRIAGVLPAKTKMFDTPGLLHPYLMSMRLNRDEQKMVEIRKELRPRTYRIKARQAIHIGGLTRLDLVEASVETIYATVWASLNVSLHMGKIENADEPPTGNDRAAELGTWQEREVKVSGTSWDVNTIDIAIAGLGWFSLCLKGEATTKLWVFHGVEVTLREPLVLDRAPSLEKPGFWLPKAISDAIGNQTKLEAQRRKQQLEDEGTEYVGAGAELSA

SEQ ID NO: 194324 - protein, 100 aa, Glycine max
  Coding DNA Sequence Number=SeqID_77546
MDYYNESILLALIATMEKSLKVDIKKINTSGRLIPQERVVCHAGDDDIDQVHGDATHANPNVNEVIIGIKDISKERIFVWILDYGHKRKTHVEVKYLYGD

SEQ ID NO: 194325 - protein, 428 aa, Glycine max
  Coding DNA Sequence Number=SeqID_77547
  Gene Ontology: Mol. function=N-acetyltransferase activity; Cellular component=intracellular; Biological process=metabolic process
  Homolog annotation: Hit_ID=Q2HRG1; Match level="QueryCoverage=99%, HitCoverage=65%, E-value=1e-161, Identity=70%"; Hit description=BRCT
  Pfam annotation: Domain name=Acetyltransf_1; Domain location=129-207; Score=25.0; E_value=0.00026; Accession=PF00583.14; Description =Acetyltransferase (GNAT) family
MAPKRKPSSPISIGNCEITVEANRFTCNSDSNGVVISLPRSGKIKVSAVAPNRGSASEDLRSGDKEHEFVLVNPKDVDAISKSYLQEVLQMYTTELPGMNYAANTGKQSKFLERCVTNGKYRTLLIKSTSVGNSGKVIAAITYQIIPADTEYAEIPLAAVNAIYQRKGFGHLMFLELRKRLQSVGVRSILCWGDKESEGFWLKQGFVEIAQVGTKGRARRLPIKADIQKSLCFLGGSTLMVCHLGKELLADDANTVKYLPSQFHQNSFTSAIAEDEQLEFSGKLHVDLKFPDKSSHRTESSKNQHEALVKEGSSTEYDKLSGFDSHNAKECCTGISPFAKVNDDRQASPESSQDGIDANVKYSSQSTKGAKRAWEASLSSLKSKRVKGSQMVDYQPDSSCGFIFETDKANPCFDEVPHDPSITKSSEK

SEQ ID NO: 194326 - protein, 78 aa, Glycine max
  Coding DNA Sequence Number=SeqID_77548
MAKEFVNGSVHQNGVIVIIIDRLKALNAINLDYKARKLALQLWLEAVCYTLDHTNALKLFNMAPPPPSENNQDSSTPS

SEQ ID NO: 194327 - protein, 276 aa, Glycine max
  Coding DNA Sequence Number=SeqID_77549
  Homolog annotation: Hit_ID=UPI000034F0B3; Match level="QueryCoverage =31%, HitCoverage=6%, E-value=2e-12, Identity=43%"; Hit description =ATP binding / DNA binding / chromatin binding
MERIAYLKDQNVDSNLHSDAKPIKNSHGKFFGEKHLRQCPGLDPSCEAYAEKLEVKLHGTLEPRRSPRLSSSNGNENTEINASQVKRTSKVVHQKKKNTKVISTYIELSNSPVEQHMCGIDDTKYLIRSSEAITSPSWTENGRTTSNSFALPESDDRPPRKKFNTSTSSTKECIDSENFPSFIGDPIPDDEAQKRWGWRYELKVVDLILSDKKCKDNMFKINEGEEDEIIANVKCHYAQAEIGNCIFSLGDCAFVKHCISTMSLCNVNLMKDIYAA

SEQ ID NO: 194328 - protein, 362 aa, Glycine max
  Coding DNA Sequence Number=SeqID_77550
  Gene Ontology: Mol. function=phosphatidylinositol N-acetylglucosaminyl transferase activity; Cellular component=integral to membrane; Biological process=GPI anchor biosynthetic process
  Homolog annotation: Hit_ID=Q2HRH2; Match level="QueryCoverage=94%, HitCoverage=47%, E-value=1e-133, Identity=67%"; Hit description=N -acetylglucosaminyl transferase component
MRRHCRLWWPKQLLSNEESSSSILLGWFVTCSPSSLDIIVAFTCSEVLLSSYSPGIEGIIDGTCGSMPSVLEDKSKFSVLGLCVTGPTTSNGLMNGAEDDKKKFSEHGNALQEGGTDGKNNSMSCRCFQLDGSLRKSSQYVLGRSNWVLLMFDSPEQNDVVIHRLPKLHHIHWNGLTVSQYDVHVIIYETPSYGAHHFSLCHSGSNEQAKTSIKNPKWVDELHKKQQFIELDTIILAINCTAAAKRIFETHLVPRRSLSQLSIFPMLYVVIGHLFSKFWASISTMLYIVLQFFQTHFSYESESWAYVKSTNVFMKTAWINMRIRCGQILYWPIFLRENDPRTSFGGAVKETKSNPTKLVKLN

SEQ ID NO: 194329 - protein, 151 aa, Glycine max
  Coding DNA Sequence Number=SeqID_77551
  Subcellular localization annotation: CTP_CleavageSite=55; ConfidenceScore=5.35e-01
MKSPQHKNKTPKSRSDPQQQQKSNSLAVTVFRNAPDYYSCDPLIPLSTCLPASGTCAARMRLLPHADQALSLRRSPRFNSAPAAVDGGNAGSRKRKRSPETAATAAEEETSRRRSPRFSTPVKKVQIVLQLPAACQLVAGQFLYVYRYRYR

SEQ ID NO: 194330 - protein, 273 aa, Glycine max
  Coding DNA Sequence Number=SeqID_77552
  Gene Ontology: Mol. function=phosphatidylinositol N-acetylglucosaminyl transferase activity; Cellular component=integral to membrane; Biological process=GPI anchor biosynthetic process
  Homolog annotation: Hit_ID=Q2HRH2; Match level="QueryCoverage=89%, HitCoverage=33%, E-value=1e-106, Identity=77%"; Hit description=N -acetylglucosaminyl transferase component
  Pfam annotation: Domain name=Gpi1; Domain location=1-137; Score =140.4; E_value=5e-39; Accession=PF05024.5; Description=N -acetylglucosaminyl transferase component (Gpi1)
MGNPAGFKLNAELAGVLGMASLNAVQIWSTLWIFVGYIFNYIIQGLSVLGILCGFTVPAALVIDMIALATLHISTLHWFISLVYSSQLQALAALWRLFRGRKWNPLRQRLDSFDYTVKQHIVGSLLFTPLLLLLPTTSVFYIFFSIMDTTINLVCLLIEVTISVIHVTPYTKIFLWLVRQGRFPSGIWLEIIGCQSNSTASPSADITDEMTSYKESLHLKDFNREKSSSLVSALHSNYLSIGKLNVTSCGQCAALFYENTFPLDILIAVTWEW

SEQ ID NO: 194331 - protein, 56 aa, Glycine max
  Coding DNA Sequence Number=SeqID_77553
  Gene Ontology: Mol. function=small conjugating protein ligase activity; Cellular component=proteasome complex (sensu Eukaryota); Biological process=protein modification process
  Homolog annotation: Hit_ID=Q42973; Match level="QueryCoverage=97%, HitCoverage=37%, E-value=5e-15, Identity=77%"; Hit description =Ubiquitin conjugating enzyme
MECYSYNIQGSSIYMLSADRPQPDDPLVPEIAHMYKIKRAKYEATARSWTEKYVVG

SEQ ID NO: 194332 - protein, 183 aa, Glycine max
  Coding DNA Sequence Number=SeqID_77554
  Gene Ontology: Mol. function=oxidoreductase activity
  Homolog annotation: Hit_ID=Q9C936; Match level="QueryCoverage=67%, HitCoverage=48%, E-value=4e-33, Identity=46%"; Hit description =Putative oxidoreductase; 38288-39393
  Pfam annotation: Domain name=2OG-FeII_Oxy; Domain location=1-81; Score=5.2; E_value=0.037; Accession=PF03171.10; Description=2OG -Fe(II) oxygenase superfamily
MDEHMNSTNYLARLIKCQGPQTNEAKVGIGEHTDKNILTTLCQNQIDGLEAWTNGRVHTPNHRVMMSGNETRFTIGLFTVPKPGFIIKAPEELVTEEHPLLFKPFVQSEFMKFLHSSESTKNALKGNHHQCATTIDHAAPPPWLTASSNPFCEEEKKGSVVDGVRAVQGMLWEGRKGEGEGVG

SEQ ID NO: 194333 - protein, 139 aa, Glycine max
  Coding DNA Sequence Number=SeqID_77555
  Gene Ontology: Mol. function=oxidoreductase activity
  Homolog annotation: Hit_ID=Q9C937; Match level="QueryCoverage=70%, HitCoverage=34%, E-value=3e-24, Identity=56%"; Hit description =Putative oxidoreductase; 36199-37309
VPSSKSINKVKSNSEGRKSMGSEPELKLPTIDFSIEDLEFNVAKWELVKSQVHKALVEYGCFEALFDKVPLDLRKAIFLQVEEMFDLPLQTKQRVVSSRPYHGYVGPLQLYENMVIDDVDNHDSGKFNQDLMATRKTKF

SEQ ID NO: 194334 - protein, 215 aa, Glycine max
  Coding DNA Sequence Number=SeqID_77556
  Gene Ontology: Mol. function=oxidoreductase activity; Biological process=gibberellin metabolic process
  Homolog annotation: Hit_ID=Q2HRI0; Match level="QueryCoverage=98%, HitCoverage=67%, E-value=2e-60, Identity=51%"; Hit description =Immunoglobulin/major histocompatibility complex; 2OG-Fe(II) oxygenase
  Pfam annotation: Domain name=2OG-FeII_Oxy; Domain location=67-166; Score=49.0; E_value=1.5e-11; Accession=PF03171.10; Description=2OG -Fe(II) oxygenase superfamily
MAIDNPLNDKDCHKYTTNMWPQGNDQFSESVNSYANEVVELDYLVKRMAFQSYGLDNKKCNSLLESTDYVLRCYKYRTPKKGETNLGVRPHTDSGFLTILNQKLNSLKIQLKDGEWFKVDASPNMLAVLASDAFMVWSNDRIRGCVHQVFMNSKVDRYCLALLSYAGKVMEPEEKLEDEKHPLRYKPFDHYGYLRFFLTEEAVKSAFRIKVYCGI

SEQ ID NO: 194335 - protein, 45 aa, Glycine max
  Coding DNA Sequence Number=SeqID_77557
MGPGIDVENLYSSSGERILGVFTKTDLMDKGTDAVDVGQMWPQLS

SEQ ID NO: 194336 - protein, 332 aa, Glycine max
  Coding DNA Sequence Number=SeqID_77558
  Gene Ontology: Mol. function=oxidoreductase activity; Cellular component=cytoplasm; Biological process=response to gibberellin stimulus
  Homolog annotation: Hit_ID=Q2HRI0; Match level="QueryCoverage=98%, HitCoverage=98%, E-value=1e-129, Identity=66%"; Hit description =Immunoglobulin/major histocompatibility complex; 2OG-Fe(II) oxygenase
  Pfam annotation: Domain name=2OG-FeII_Oxy; Domain location=176-277; Score=69.8; E_value=8.4e-18; Accession=PF03171.10; Description=2OG -Fe(II) oxygenase superfamily
MGSQTQSQELHVVDFTDENTKKPGTDAWLSACSVVRTALEDNGFFMARYDKVGKELCDSVVSAVEELFDLPVETKAQKTSEKLFHGYLGQVSWLPLYESVGIDDPLTLLGCQKFGHIMWPEGNHRFCSWQRFNFPYSESINEYSKLLGELDHMAKRMVFESYGVDMQRCDSFIESNDYLLRCMMYRTPQTGEIDLGLQPHSDLTITSIVHQLNNLNGLEIKLKDGEWKGIDASPSSFVVMAGDAFNVWSNGRIRPCEHRVTMNAKKTRYSMGLFSFGGNKVMRIPEELVNKQHPLRYKPLFDHYEYLRFYDKEKIKEPYSRIQAHCGISTLQ

SEQ ID NO: 194337 - protein, 235 aa, Glycine max
  Coding DNA Sequence Number=SeqID_77559
  Gene Ontology: Cellular component=nucleus; Biological process =regulation of transcription
  Homolog annotation: Hit_ID=O64647; Match level="QueryCoverage=71%, HitCoverage=46%, E-value=1e-58, Identity=70%"; Hit description =Putative PCF2-like DNA binding protein
  Pfam annotation: Domain name=TCP; Domain location=60-232; Score =139.3; E_value=1e-38; Accession=PF03634.4; Description=TCP family transcription factor
MADEASGDVDLRLGEPKAPKEEPETEEGSAIRVMPVAVHVPAGMSMSMSKALAQAQAQAQAQAQPQKRASTKDRHTKVEGRGRRIRMPATCAARIFQLTRELGHKSDGETIRWLLEHAEPAIIAATGTGTVPAIAMSVNGTLKIPTTSPSDQEPGDQPERKKRKRPANSAYVDINDAAVSISTGLASSNNNNQNAATTTTMTIPQHTAIPLPQGMVPVWAIPSNAVVPAAGAFFV

SEQ ID NO: 194338 - protein, 67 aa, Glycine max
  Coding DNA Sequence Number=SeqID_77560
MSSRRGQIPVVTMAMGELDTAEPEEIIYCNIGGNFWLLVEFGSFLDSGHTVVQFKSHQIGLSFQYDW

SEQ ID NO: 194339 - protein, 186 aa, Glycine max
  Coding DNA Sequence Number=SeqID_77561
MSEVEEVQEQMKTDIDAMKEQMTTMMEAMMSMRRMMEVNTTTVVVESTATKVDPTHPPGFNQVNRPASDMVGQGGEALGSTGGPYLVQVQNKHSFPPYVLPPNYTPPNVAHTPDENVKNSAPIPIESQQPQFGHAQVPLPMGGHMKYPETTLYPTLSLTSDMPLRDRHFVWEEYLLLWWKGKNSII

SEQ ID NO: 194340 - protein, 843 aa, Glycine max
  Coding DNA Sequence Number=SeqID_77562
  Gene Ontology: Mol. function=GTP binding; Cellular component =monolayer-surrounded lipid storage body; Biological process=lipid metabolic process
  Homolog annotation: Hit_ID=Q1RUV0; Match level="QueryCoverage=98%, HitCoverage=99%, E-value=0.0, Identity=80%"; Hit description =Phospholipase, patatin family, putative
  Pfam annotation: Domain name=Patatin; Domain location=233-436; Score =89.4; E_value=1.1e-23; Accession=PF01734.12; Description=Patatin -like phospholipase
MDHISNEASVDRFPIGPSGILGRTIAFRVLFCKSISHFRHHIFIVLLDLFYRFRGGLASFISWLHPRNPQGILAMMTIVAFLLKRYTNVKSRAEMAYRRKFWRNMMRSALTYEEWAHAAKMLDKETTKMNESDLYDVELVRNKLQELRHRRQEGSLGDIMFFMRADLIRNLGNMCNPELHKGRLQVPKLIKEYIDEVTTQLRMVCDSDSEELSLEEKLAFMHETRHAFGRTALLLSGGASLGASHVGVVKTLVEHKLMPRIIAGSSVGSIMCAVVATRTWPELQSFFEDSWHSLQFFDQMGGIFAVVKRVTTLGAVHEIRQLQMMLRHLTSNLTFQEAYDMTGRILGITVCSPRKHEPPRCLNYLTSPHVVIWSAVTASCAFPGLFEAQELMAKDRSGEIVPYHPPFNLGPEEGSTPVRRWRDGSLEIDLPMMQLKELFNVNHFIVSQANPHIAPLLRLKEFVRTYGGNFAAKLAHLVEMEVKHRCHQILELGFPLGGLAKLFAQDWEGDVTVVIPATLAQYTKIIQNPSYGELQKAANQGRRCTWEKLSAIKANCGIELALDECVVILNHMRRLKRIAERAASASHGLSSTVRFSASKRIPSWNCIARENSTGSLEDLTDVASSLHQGIGSSSRANGKTWKTHRGIHDGSDSDSESVDLHSWTRTGGPLMRTTSANMFVDFLQNLEVDTDPNKGLVSHTIHNDFQYHSPRLTTLDRNSDSTESEPRETGNRVVNVSSILVTEGDLLQPERIHNGIVFNVVKKEDLSPLSSSSHGFENYNIEVAECVQDECPGKEIDAASSASEHGDDEESMPARSLTDMPDYNSIDHHSGTDSGMDQSIVDS

SEQ ID NO: 194341 - protein, 1160 aa, Glycine max
  Coding DNA Sequence Number=SeqID_77563
  Gene Ontology: Mol. function=calmodulin binding; Biological process =protein amino acid phosphorylation
  Homolog annotation: Hit_ID=Q1T1F5; Match level="QueryCoverage=97%, HitCoverage=99%, E-value=0.0, Identity=40%"; Hit description =Calmodulin-binding, plant
  Pfam annotation: Domain name=CaM_binding; Domain location=1045-1156; Score=235.1; E_value=1.5e-67; Accession=PF07839.2; Description=Plant calmodulin-binding domain
  Pfam annotation: Domain name=CaM_binding; Domain location=529-643; Score=184.4; E_value=2.8e-52; Accession=PF07839.2; Description=Plant calmodulin-binding domain
  Pfam module annotation: Pfam domain module=CaM_binding::CaM_binding; Domain location=1045-1156::529-643
MKVEIEGSHSDYAESVSRQPENRGRLESKKKLKKVRSIRLVRLPSKRSSTRGGRHRHDYLFIDTESLEGPTPIEMVDASPNYMKATSSSHAKDSIQNTQRILFTKKTLTRMSTTLKLKRSLTRKLSGRTEPKRELKSSRSIKFAAVKGQKSTRKFYESNYGSDDQNWKSASDAGNKLQRVITRRLSLKPVRILAKMPTFKSKNSSMERGNQISQSPYTSLLRATCTSALKDSHFPEKIDLPQEGSDSQGVSAVKVCPYSYCSLHGQRHTNLPPLKRFVSMRRRTLKSQKPTKMDCQPDTRSKQIGNAKKAAQKTQTVHKEDGRSHFQNKKKLARGLWIRPHGTPASTVSEGVESTSTDRVEFSAPDTEILEREVTNTGNTSKNMKLDCEVLKMSSLQKESTHASTTDMARGMQERDKKFVKMWQLMYKHAVLSNTGENKQQFDGKDKEGREQDFFATNEVNNSCRDDCDTDQDMDEENKDAIELVQKAFDEILLPEPEDLFSDDQFKSEGIDSDVVHLEKSEVERKRNTSTSTESPTAQRMGTKPDQRAPRSWSNLKKLILLKRFVNALEKVRNINPKRPRRFPSDANLEIEKVFLKHQTAEEKKNAEEWMLDYALQKVVSKLAPAQRQKVTLLVKAFETILPFQVAENSPRFSPTMEPQANPVQPLDNSSNHSEEETSFSHDSSMELTENTSDDPMPELHNPTTLKERCLESLDFPGTETVKNMPAFGATEEDLSGKQSLAGSYDNEEKISSDSDNIYLVEIKDTTSSSLNEPVEIIRSSHEEAPTNETVNDVPEDLLSSVNTENPDIKSESPGRDVETKNLNGDNGEKISMSKSLVLEGLVRSLRSNLIGSGAPVNEPTANNRKEGIENVKQETETLEEFPTKEQSEAHISAVVEPETPVEKQNNTGLWYLVYKHMVSNMDENNSESLIDGADEKESGFDGSRTRGASFSHESTPVTDEEMKFKDHVVADPEVARQQNEAIKMVEEAIDSILPDDQDDLSDKESLTDSTISDNSKQSNRTERVYSEGLNQKEEQMESGNGMIQKQEESAPKEQNKTNQKMSTSWSNLKKVILLRRFIKSLEKVRKFNPRGPRYLPLEPDSEAEKVNLRHQDMEERKGTEEWMLDYALRQVVSKLTPARKRKVELLVEAFETVMPTIKT

SEQ ID NO: 194342 - protein, 132 aa, Glycine max
  Coding DNA Sequence Number=SeqID_77564
  Homolog annotation: Hit_ID=O21999; Match level="QueryCoverage=42%, HitCoverage=38%, E-value=8e-21, Identity=84%"; Hit description=LacZ -alpha
MEVVDVLCGVLSERGKLLGYITGRATGLRVRTENLEEGRRHSQRAKEGVKLWQCRVGTWGESSGHDSWTSAGMQAWHWPSFYNVVTGKTLALPNLIALQHIPLSPAGVIAKRPAPIALPKQLRSLNGEWRLM

SEQ ID NO: 194343 - protein, 195 aa, Glycine max
  Coding DNA Sequence Number=SeqID_77565
GGESHRHGSDHYHRHHHYHADAEGFLVGDLRQAGVAVHVARVFQALSEEREDELESGFFASAMNNDVVAAGKRKSTCARDAGLKMVGTSCVWVWVNTKSGRHGGDPVRGWVRDPKGRSVRAMGGPYGTVYAPFSSRPFQSGPSARESPEGHVSLSGSSTGGAPLLPFDTWGFRRGPTLLDTNHFVGFGLLGPEKT

SEQ ID NO: 194344 - protein, 619 aa, Glycine max
  Coding DNA Sequence Number=SeqID_77566
  Gene Ontology: Mol. function=phospholipase D activity; Cellular component=membrane; Biological process=metabolic process
  Homolog annotation: Hit_ID=Q8H1U2; Match level="QueryCoverage=77%, HitCoverage=43%, E-value=0.0, Identity=65%"; Hit description =Phospholipase D beta 1 isoform 1a
  Pfam annotation: Domain name=C2; Domain location=234-341; Score=81.4; E_value=2.8e-21; Accession=PF00168.20; Description=C2 domain
  Pfam annotation: Domain name=PLDc; Domain location=558-593; Score =42.6; E_value=1.3e-09; Accession=PF00614.12; Description =Phospholipase D. Active site motif
  Pfam module annotation: Pfam domain module=C2::PLDc; Domain location =234-341::558-593
MDNYGSSQHPYGYPNPYSYPPHDPYAQPPYPYPYPYPYPYPHPTNPPHNNNSNYPYPPPPPPPHSSSPYSSPINYSSYPPPPPPPPPPPSTSSHGSFDYPMPQPPHTYPYPHRVPPEWSVTTGGGVSHSHASDSYNPPHSAAYPTLDDLMSNDRLSDNNNLPSAPPLTHSPPILYLDRRDEFYGYSSYSSSSLDQGDPSRLSDNNDDSVNSESLQIVPAQHKGSLRVLLLHGNLDIWVHGAKNLPNMDMFHKTLEDMIGRFPGTVASNKIEGTVSRKITSDPYVTISVSNAVIGRTFVISNSENPVWEQHFYVPVAHHAAEVHFVVKDSDVVGSQLIGVVAIPVEKIYSGQKVQGTYPILNSNGKPCKPGAVLMVSIQYIPMHTLIMYYQGVGAGPDYIGVPGTYFPLRKGGTVTLYQDAHVPDGCLPNVVLDNGVYYAHGKCWLDIFDAINRAKRLIYITGWSVWHKVRLVRDPGNPSKFTLGDILRSKSSEGVRVLLLIWDDPTSRSILGYKVDGVMATHDEETRRFFKHSSVHVLLCPRIAAKRHSWAKQKEVGTIYTHHQKTVIVDADAGNNQRKIVAFVGGLDLCDGRYDTPHHPLFRTLQTLHKDDYHNPTFT

SEQ ID NO: 194345 - protein, 198 aa, Glycine max
  Coding DNA Sequence Number=SeqID_77567
MMEAMMSIRRMMEVRKVKRWEVRAAPILCKFKTSIPSHHMDCLPTIHRPMLHTLPMRMSTTSLPYQLRANNPNLVMHRVPPAMVEREKFDHIEERPRAIEGGRDYAFADMTELCLMSDVVIPPKFKVPDFVKYKGTTCPKNHLKMYCRKMGAYTKDEKLLMHFFQESLTGVAVTWYTNLESSRVHSWKDLMVAFIRQY

SEQ ID NO: 194346 - protein, 849 aa, Glycine max
  Coding DNA Sequence Number=SeqID_77568
  Homolog annotation: Hit_ID=Q9LJL0; Match level="QueryCoverage=75%, HitCoverage=39%, E-value=1e-135, Identity=43%"; Hit description =Arabidopsis thaliana genomic DNA, chromosome 3, P1 clone: MVI11
LKVQKFELLSVTNTGGVKAVSFFRLTHGEGKLWGFVTGVPDHEFLLITCSNSSVKRGDGGGSNALSSKCAGSDVICLSDPEISHSITSVTVSCGTVLAVGGRLDWFDAILSFFSLSASNTKDAGDTSMPKKEQNISYTTYFVLCLIDIALSYEPYMKNLVVQSELNSESGCSSIKKDTSEQCVSCLLAASSLTLSNSSSKDTVGSVFQIRVHDLGLLLHLMSELNSLSGIYSVEHLQKTGYFKVAQEAFMEAILKTNCASGLLWELELSKSHLSVETCYDTTATLIRLAAQLQQLFAPDVEESIVHLQNRWDNVQQAQQRNEFKNENKNLRFDSMSATSKQYSAQTFSTDGSSIAGLMDEICEDAFQVNNNNAHQSYPFESGFCMPLDGSLIEVGQMNLDEPEVLSHELTLTESVSVIGPEGSHTSYLQEGCFPEIIESYCLSDLRPLSELSLGIHSDELSRHKLRNVEHREIERGSGGWYGGTSLKVLENHISEESKQAGPLKVVDHHGMLSSDGSSSYGETCGRVILKKIDIRWRMYGGSDWLDSEKSGPHSGRDTSVCLELALSGMKFQYDVFPVGGLRVSKMSVSVQDFFLYDRSQDAPWKLVLGYYHSKGHPRESYSRAFKLDLEAVRPDPLTPLEEYRLNVAILPMLLHLHQSQLDFLVNFFGRKNTLKDQFPNSCQDLEGSKSLPETTQKNKDLAFHSIAPEALLPYFQKLDIWPINVRVDYSPNRVDLAALSHGKYVELVNLVPWKDPFPLYLVVPLGVELNLKHVHASGIYGWASVCETTVGEWLEDISQNQIHKILRGLPTVRSLIAVGAGAAKLVSSPVQSYKKERRVLKGVQRGRLD

SEQ ID NO: 194347 - protein, 39 aa, Glycine max
  Coding DNA Sequence Number=SeqID_77569
MASSWLGSFFNQHVHLTWTCVGVEPHAVNQQGQRNMQFK

SEQ ID NO: 194348 - protein, 65 aa, Glycine max
  Coding DNA Sequence Number=SeqID_77570
MVIFQCTKVLTSIAEGLRRTIESYTHLKADNEPKTKREGPSKASKYLGSGRGVNNQLYLSNFFAW

SEQ ID NO: 194349 - protein, 109 aa, Glycine max
  Coding DNA Sequence Number=SeqID_77571
  Homolog annotation: Hit_ID=Q2PMM5; Match level="QueryCoverage=99%, HitCoverage=4%, E-value=6e-47, Identity=91%"; Hit description =Protein ycf2
MVKRKSPYLTRLLTIPMNSIGPKNDTLEESSESSNINRLIVPLLYLPKGKKIFESYFLDPKESTRVLPITKMYIMPESNWVRGGGGIEILVVRYLMKPLLELRSHSKRK

SEQ ID NO: 194350 - protein, 71 aa, Glycine max
  Coding DNA Sequence Number=SeqID_77572
MDGKDGCKKGFLPRSRPFVRVDGCHLKTPFGGQLLVVVDRDDNDQYFPLAWPVVVESEAKDVTLEMVFNHG

SEQ ID NO: 194351 - protein, 281 aa, Glycine max
  Coding DNA Sequence Number=SeqID_77573
  Gene Ontology: Mol. function=cation transporter activity; Cellular component=membrane; Biological process=cation transport
  Homolog annotation: Hit_ID=UPI00005F9472; Match level="QueryCoverage =92%, HitCoverage=76%, E-value=5e-77, Identity=56%"; Hit description =COG2239: Mg/Co/Ni transporter MgtE (contains CBS domain)
  Pfam annotation: Domain name=CBS; Domain location=23-139; Score=50.4; E_value=6e-12; Accession=PF00571.18; Description=CBS domain
  Pfam annotation: Domain name=MgtE; Domain location=205-281; Score =14.4; E_value=1.6e-05; Accession=PF01769.7; Description=Divalent cation transporter
  Pfam module annotation: Pfam domain module=CBS::MgtE; Domain location= 23-139::205-281
MSSIQLCAAHQATYGFDGDAIAQYMRTDFITLQEHFSVHEAREHFISQLASDDIPGQVFVVAGNKLRGSLSVKKLLQEVEVGQSIRYLMDSCLFRVKPDDERPQVIAELTERGLDLVPVVDKGELVGCLMEKEIAHLLEDDVTEDAQLQGATLPLEKPYLEISPWTLWKKRSVWLLLLFVAEAYTSSVLQHFEEALESAIALAFFIPLLIGTGGNSGTQITSTLVRSMALGEVRLRDMGRVIRKEVSTSFLIALTLGLAGCLRAWMMGIGMEITLIVSLTL

SEQ ID NO: 194352 - protein, 134 aa, Glycine max
  Coding DNA Sequence Number=SeqID_77574
IDWAYLVRYRMHKALRANAPLPYPQLVTLFLHHFQIPLDDEPFVQVKRSFAIGAGAVTSFGYRKDRNGQWLKKDALPPQDERTPSPPPQRDDSALMTEVLSELRGLRTYVGERFDSWIIALPEWISVSHSLKKM

SEQ ID NO: 194353 - protein, 92 aa, Glycine max
  Coding DNA Sequence Number=SeqID_77575
MHLRDEGGLVRARALSALMDRLAHVSDFWLSAPFSLSQHALRGRVRARLMGALSKGGKMRGVATNVYLWKTSEKPKETGQNENSKFGSCIYA

SEQ ID NO: 194354 - protein, 36 aa, Glycine max
  Coding DNA Sequence Number=SeqID_77576
MEQVREYENLVYIICTRSFYEIRDVTFHSYIQQQIA

SEQ ID NO: 194355 - protein, 157 aa, Glycine max
  Coding DNA Sequence Number=SeqID_77577
  Gene Ontology: Mol. function=serine-type endopeptidase activity; Cellular component=cytoplasm; Biological process=negative regulation of enzyme activity
  Homolog annotation: Hit_ID=Q9LLL8; Match level="QueryCoverage=95%, HitCoverage=20%, E-value=1e-39, Identity=51%"; Hit description=Xylem serine proteinase 1 precursor
MSHRVNKKVEFAYSAGQVHPTRALSPSSIYDMDNFAYIHFLCHEGYNGSSLSMLVGSPVNYTYLLPGLGHEAINYPTMQLSVQNNTSTIIGVLRVTNVGPTPTIFNATIKSLKGVEITVKPTSLIFSHTPQKKSFKVVVKAKPMASMEIMSDHKYLN

SEQ ID NO: 194356 - protein, 1110 aa, Glycine max
  Coding DNA Sequence Number=SeqID_77578
  Gene Ontology: Mol. function=protein binding; Cellular component =integral to membrane; Biological process=defense response to fungus
  Homolog annotation: Hit_ID=Q1SLU2; Match level="QueryCoverage=99%, HitCoverage=99%, E-value=0.0, Identity=47%"; Hit description=Leucine- rich repeat, plant specific
  Pfam annotation: Domain name=LRRNT_2; Domain location=29-71; Score =29.2; E_value=1.4e-05; Accession=PF08263.3; Description=Leucine rich repeat N-terminal domain
  Pfam annotation: Domain name=LRR_1; Domain location=121-143; Score =14.3; E_value=0.45; Accession=PF00560.23; Description=Leucine Rich Repeat
  Pfam annotation: Domain name=LRR_1; Domain location=204-226; Score =14.4; E_value=0.4; Accession=PF00560.23; Description=Leucine Rich Repeat
  Pfam annotation: Domain name=LRR_1; Domain location=228-250; Score =9.6; E_value=4.5; Accession=PF00560.23; Description=Leucine Rich Repeat
  Pfam annotation: Domain name=LRR_1; Domain location=252-275; Score =8.2; E_value=8.2; Accession=PF00560.23; Description=Leucine Rich Repeat
  Pfam annotation: Domain name=LRR_1; Domain location=276-298; Score =10.4; E_value=3.2; Accession=PF00560.23; Description=Leucine Rich Repeat
  Pfam annotation: Domain name=LRR_1; Domain location=300-322; Score =10.8; E_value=2.7; Accession=PF00560.23; Description=Leucine Rich Repeat
  Pfam annotation: Domain name=LRR_1; Domain location=324-346; Score =12.3; E_value=1.4; Accession=PF00560.23; Description=Leucine Rich Repeat
  Pfam annotation: Domain name=LRR_1; Domain location=348-369; Score =15.8; E_value=0.15; Accession=PF00560.23; Description=Leucine Rich Repeat
  Pfam annotation: Domain name=LRR_1; Domain location=371-394; Score =14.4; E_value=0.41; Accession=PF00560.23; Description=Leucine Rich Repeat
  Pfam annotation: Domain name=LRR_1; Domain location=396-418; Score =8.4; E_value=7.5; Accession=PF00560.23; Description=Leucine Rich Repeat
  Pfam annotation: Domain name=LRR_1; Domain location=420-441; Score =6.6; E_value=17; Accession=PF00560.23; Description=Leucine Rich Repeat
  Pfam annotation: Domain name=LRR_1; Domain location=445-467; Score =17.4; E_value=0.053; Accession=PF00560.23; Description=Leucine Rich Repeat
  Pfam annotation: Domain name=LRR_1; Domain location=469-492; Score =10.6; E_value=3; Accession=PF00560.23; Description=Leucine Rich Repeat
  Pfam annotation: Domain name=LRR_1; Domain location=494-519; Score =5.4; E_value=28; Accession=PF00560.23; Description=Leucine Rich Repeat
  Pfam annotation: Domain name=LRR_1; Domain location=522-542; Score =8.5; E_value=7.2; Accession=PF00560.23; Description=Leucine Rich Repeat
  Pfam annotation: Domain name=LRR_1; Domain location=545-567; Score =16.1; E_value=0.13; Accession=PF00560.23; Description=Leucine Rich Repeat
  Pfam annotation: Domain name=LRR_1; Domain location=569-590; Score =12.4; E_value=1.4; Accession=PF00560.23; Description=Leucine Rich Repeat
  Pfam annotation: Domain name=LRR_1; Domain location=593-612; Score =7.7; E_value=11; Accession=PF00560.23; Description=Leucine Rich Repeat
  Pfam annotation: Domain name=LRR_1; Domain location=614-636; Score =1.6; E_value=1.5e+02; Accession=PF00560.23; Description=Leucine Rich Repeat
  Pfam annotation: Domain name=LRR_1; Domain location=639-661; Score =11.2; E_value=2.3; Accession=PF00560.23; Description=Leucine Rich Repeat
  Pfam annotation: Domain name=LRR_1; Domain location=663-682; Score =11.9; E_value=1.7; Accession=PF00560.23; Description=Leucine Rich Repeat
  Pfam annotation: Domain name=LRR_1; Domain location=688-710; Score =8.8; E_value=6.5; Accession=PF00560.23; Description=Leucine Rich Repeat
  Pfam annotation: Domain name=LRR_1; Domain location=712-734; Score =17.0; E_value=0.066; Accession=PF00560.23; Description=Leucine Rich Repeat
  Pfam annotation: Domain name=LRR_1; Domain location=736-757; Score =11.3; E_value=2.2; Accession=PF00560.23; Description=Leucine Rich Repeat
  Pfam annotation: Domain name=LRR_1; Domain location=760-780; Score =1.5; E_value=1.5e+02; Accession=PF00560.23; Description=Leucine Rich Repeat
  Pfam annotation: Domain name=LRR_1; Domain location=786-809; Score =10.8; E_value=2.7; Accession=PF00560.23; Description=Leucine Rich Repeat
  Pfam annotation: Domain name=LRR_1; Domain location=903-925; Score =12.3; E_value=1.4; Accession=PF00560.23; Description=Leucine Rich Repeat
  Pfam annotation: Domain name=LRR_1; Domain location=927-949; Score =15.1; E_value=0.25; Accession=PF00560.23; Description=Leucine Rich Repeat
  Pfam annotation: Domain name=LRR_1; Domain location=951-973; Score =13.6; E_value=0.71; Accession=PF00560.23; Description=Leucine Rich Repeat
  Pfam annotation: Domain name=LRR_1; Domain location=97-119; Score =13.7; E_value=0.68; Accession=PF00560.23; Description=Leucine Rich Repeat
  Pfam annotation: Domain name=LRR_1; Domain location=975-994; Score =3.6; E_value=61; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::LRR_1; Domain location=29-71::121-143::204-226::228- 250::252-275::276-298::300-322::324-346::348-369::371-394::396 -418::420-441::...
  Pfam module annotation: Domain location=445-467::469-492::494 -519::522-542::545-567::569-590::593-612::614-636::639-661::663 -682::688-710::712-734::736-757::760-780::786-809::903-925::927 -949::951-973::97-119::975-994
MSITLWFFLLPFCLINLSTNIILATGHCLGHQQSLLLQLRNNLIFNSTKSKKLIHWNQSDDCCEWNGVACNQGHVIALDLSQESISGGIENLSSLFKLQSLNLAYNGFHSGIPPEFQKLKNLRYLNLSNAGFEGKIPIEISYLTKLVTLDLSSTVTSQHALKLEMPNIAMLVQNFTEIKVLHLDGIAISAKGKVWSHALSSLTNLQVLSMSSCNLSGPLDSSLAKLQSLSILQLDQNNLASPVPESLGSLSNLTILQLSGCGLNGVFPKIIFQIPSLQVIDVSDNPSLNGSLANFRSQGSLYNFNLSHTNFSGPLPMSIHNLKELSKLDLSNCKFIGTLPYSMSNLTQLVHLDLSFNNFTGPIPSFNRSKALTVLSLNHNRFKGTLPSTHFEGLTNLMSIDLGDNSFDGRIPSSLFRLQSLQHLMLYYNKFDGVLDEFPNASLSSLEMLDLSGNNFEGPIPMSIFQLKRLRLLQLSKNKFNGTIQLGMLGRLQNLSSLDLGHNNLLVDAGIEDDHDASSFPSLKTLWLASCNLREFPDFLRNKSSLLYLDLSSNQIQGTIPNWIWKFNSMVVLNISYNFLTDIEGSLQKLSSNLFKLDLHSNHLQGPAPTFLKNAIYLDYSSNRFSSINSVDIGSHIPFLYFLSLSNNSFQGRIHESFCNISDLRALDLSHNRFNGQIPMCLTSRSSTLRLLNLGGNELNGYISNTLSTSCSLRFLDLSGNLLRGTIPKSLANCHKLQVLNLGNNQLVDRFPCFLKSISSLRVMILRSNKLHGPIGCSNSIGSWETLQIVDLASNNFSGTLPASLLLSWKTLMLDEDKGGQFGHLYFDLYDDFNPMNFITAIVDLNHELQIKLAKIIALEPHLIIDHIISHIFEEGVGVRAYEDSVTIVNKGRQLNLVKILIAFTSLDFSSNNFEGPIPKELMNLTALHALNLSQNSFSGSIPSSIGNLKHLESLDLSINSLGGEIPMELAKLSFLAVMNISYNHLVGKIPTGTQIQTFEADSFIGNEGLCGPPLTPNCDGEGGQGLSPPASETLDSHKGGSIEWNFLSVELGMIFGFGIFIFPLIFWKRWRIWYSKHVDDILCKIVPQLDFVYVQRGGQNYRIMRWKPY

SEQ ID NO: 194357 - protein, 268 aa, Glycine max
  Coding DNA Sequence Number=SeqID_77579
  Gene Ontology: Mol. function=binding; Cellular component =intracellular; Biological process=protein kinase C activation
  Homolog annotation: Hit_ID=Q2HSJ7; Match level="QueryCoverage=99%, HitCoverage=77%, E-value=1e-112, Identity=73%"; Hit description =Tetratricopeptide-like helical
  Pfam annotation: Domain name=PPR; Domain location=129-163; Score =41.9; E_value=2.2e-09; Accession=PF01535.11; Description=PPR repeat
  Pfam annotation: Domain name=PPR; Domain location=164-198; Score =13.9; E_value=0.17; Accession=PF01535.11; Description=PPR repeat
  Pfam annotation: Domain name=PPR; Domain location=200-234; Score =17.9; E_value=0.038; Accession=PF01535.11; Description=PPR repeat
  Pfam annotation: Domain name=PPR; Domain location=28-62; Score=16.4; E_value=0.085; Accession=PF01535.11; Description=PPR repeat
  Pfam module annotation: Pfam domain module=PPR::PPR::PPR::PPR; Domain location=129-163::164-198::200-234::28-62
  Subcellular localization annotation: CTP_CleavageSite=71; ConfidenceScore=5.17e-01
KLVSSYACCAQLHEANILFSFTIRQPTFLFNSLIRAYSSLNLFSQSLCIFRQMLLARKPFDRHTLPVVLKSCAGLSALRLGQQVHGAVLVNGFGLDLANSNALINMYSKCGHLVYARKLFDRMWQRNEITFSTMMAGYGMHGKCGEVFELFDKMVEAGERPDGVTFTAVLSACSHGGFIDKGREYLKMMEVRFGVKPGLHHYTCMVDMLGRVGQVEEAEKLILRMEVKPDEALWGALLGACKTHGKLEVTERVEERVYGRELSFASSV

SEQ ID NO: 194358 - protein, 110 aa, Glycine max
  Coding DNA Sequence Number=SeqID_77580
  Gene Ontology: Mol. function=hydrolase activity; Cellular component =nucleus; Biological process=regulation of transcription, DNA -dependent
  Homolog annotation: Hit_ID=Q2HSH7; Match level="QueryCoverage=63%, HitCoverage=18%, E-value=1e-27, Identity=76%"; Hit description =Histone deacetylase superfamily
MAQQRDFIDQIRVSSLSLRCETNPLDPYFDLPLPTVMHSEGRLLIVQEGSYHVTYSAYCLHATLEEILNLPMPLVPDPIAYYLEDETFSIKVIEAIKNYQKDKVPLWRNS

SEQ ID NO: 194359 - protein, 763 aa, Glycine max
  Coding DNA Sequence Number=SeqID_77581
  Gene Ontology: Mol. function=identical protein binding; Cellular component=cytoplasm; Biological process=negative regulation of enzyme activity
  Homolog annotation: Hit_ID=Q84WS0; Match level="QueryCoverage=99%, HitCoverage=97%, E-value=0.0, Identity=55%"; Hit description =Putative subtilisin-like serine protease
  Pfam annotation: Domain name=PA; Domain location=363-462; Score=85.3; E_value=1.9e-22; Accession=PF02225.12; Description=PA domain
  Pfam annotation: Domain name=Peptidase_S8; Domain location=113-604; Score=46.6; E_value=8.3e-11; Accession=PF00082.12; Description =Subtilase family
  Pfam annotation: Domain name=Subtilisin_N; Domain location=24-110; Score=40.2; E_value=6.9e-09; Accession=PF05922.7; Description =Subtilisin N-terminal Region
  Pfam module annotation: Pfam domain module=PA::Peptidase _S8::Subtilisin_N; Domain location=363-462::113-604::24-110
MIFRTLLFLLAFMVTNSVAVMDKKTYIIHMDKTKIKASIHSQDNTKPWFKSVVDFISEASLEEDIAPQLLYVYETSMFGFAAQLSNKQLEYLNQIDGFLSAIPDELLNLHTTYSSHFLGLQNGKGLWSASNLASDVIIGVLDTGIWPEHISFQDTGLSKVPSRWKGACEAGTNFSSSSCNKKLVGARVFLQGYEKFAGRINETLDYRSARDAQGHGTHTASTAAGNMVSNASLFGLARGSASGMRYTSRIAAYKVCWRLGCANSDILAAIDQAVADGVDVLSLSLGGIAKPYYNDSIAIASFGATQKGVFVSCSAGNSGPSSSTAGNVAPWIMTVAASYTDRSFPTKVKLGNGKVFKGSSLYKGKQTNLLPLVYGNSSKAQRTAQYCTKGSLDPKFVKGKIVACERGINSRTGKGEEVKMAGGAGMILLNSENQGEELFADPHVLPATSLGSSASKTIRSYIHSAKAPTVSISFLGTTYGDPAPVMAAFSSRGPSAVGPDVIKPDVTAPGVNILAAWPPTTSPSMLKSDKRSVLFNIVSGTSMSCPHVSGIATLIKSVHKDWSPAAIKSALMTTASTSNNKGAPIADNGSNNSAFADPFAFGSGHVNPERASDPGLVYDITTKDYLNYLCSLKYTSSQIAILSKGNFKCAKKSALHAGDLNYPSFAVLFGTSARNASVAYKRVVTNVGKPSSSYAVKVEEPKGVSVSVEPRNISFRKIGDKLSYKVTFVSYGRTAIAGSSSFGSLTWVSDKYTVRSPIAVTWQ

SEQ ID NO: 194360 - protein, 801 aa, Glycine max
  Coding DNA Sequence Number=SeqID_77582
  Gene Ontology: Mol. function=protein serine/threonine kinase activity; Cellular component=cell surface; Biological process =protein amino acid phosphorylation
  Homolog annotation: Hit_ID=Q5QLR7; Match level="QueryCoverage=95%, HitCoverage=93%, E-value=1e-167, Identity=42%"; Hit description=S -receptor kinase-like
  Pfam annotation: Domain name=B_lectin; Domain location=69-173; Score =90.5; E_value=5.1e-24; Accession=PF01453.15; Description=D-mannose binding lectin
  Pfam annotation: Domain name=PAN_2; Domain location=334-402; Score= -16.5; E_value=0.068; Accession=PF08276.2; Description=PAN-like domain
  Pfam annotation: Domain name=Pkinase; Domain location=518-796; Score =174.9; E_value=2e-49; Accession=PF00069.15; Description=Protein kinase domain
  Pfam annotation: Domain name=Pkinase_Tyr; Domain location=518-796; Score=109.8; E_value=7.8e-30; Accession=PF07714.7; Description =Protein tyrosine kinase
  Pfam annotation: Domain name=S_locus_glycop; Domain location=209-322; Score=-38.3; E_value=0.024; Accession=PF00954.11; Description=S-locus glycoprotein family
  Pfam module annotation: Pfam domain module=B_lectin::PAN _2::Pkinase::Pkinase_Tyr::S_locus_glycop; Domain location=69-173::334- 402::518-796::518-796::209-322
MASSPTLIPFLLIFFLFHFHRSSSLPLSVENPEDDVIVSSPKGTFTAGFSPVGENAYSFAIWFSTQATTKTVVWMANRDQPVNGKRSTLSLLKTGNLVLTDAGQFDVWSTNTLSSKTLELHLFDTGNLVLREQSNQSAVLWQSFGFPTDTLLPGQIFTRFTKLVSSRSEGNHSSGFYNLYFDNDNVFRILYDGPQVSSVYWPDPWLVSDNVGFGNGRSTYNSSRVAVLDNLGEFSASDHFSFKTIDYGLLLQRRLTLDHDGNVRVYSRKNGEENWSITGQFKSQPCFIHGICGPNSICSHEQVIGRKCSCLEGYSWIDSQDWTLGCKPNFQPTCDNKTEYRFVPYYEVDFYGYDYGSSFSNYTYKQCEKLCSGLCECMGFQYSFARENGLFWCYPKRQLLNGHHSPGFTGQIFLRLPKNDVQENRVQNSDDLACSRNAEKVLERPYVKGKENGSVKFMLWFAIGLGGFEVLCIFMVWCFLFRSSNHLVSADQQGYVLAAATGFRRYTYSELKQATKGFSEEIGRGAGGTVYKGVLSDKRIAAIKKLHEFADQGESEFLTEVSIIGRLNHMNLIGMWGYCVEGKHRMLVYEYMENGSLAHNLPSNALDWSKRYNIAVGMAKGLAYLHEECLEWILHCDIKPQNILLDSDYQPKVADFGLSKPLNRNNVNNSSFSRIRGTRGYMAPEWVFNLQITSKVDVYSYGIVVLEMITGRSPMIGVQVTELGADQSHNERLATWVRERRRKAREGECWVEQIVDPTLGSDYDVEQMEILTTVALECVEEEKDVRPSMSQVVERLQSHDS

SEQ ID NO: 194361 - protein, 192 aa, Glycine max
  Coding DNA Sequence Number=SeqID_77583
  Homolog annotation: Hit_ID=Q2HPL4; Match level="QueryCoverage=24%, HitCoverage=18%, E-value=2e-09, Identity=70%"; Hit description=Expp1 protein precursor
MEVIRVLVATITMVVLAAVLPTDDKFFYNNNISNIQLSSCDMRLSLSNANSQISVFRPKVDEILLLIVNFSSFVTNKLALAHSVTHEETVKAWFDLGAVRGNSLCDKVNLHMVWVEENDNEVGAIGIGIGILEVEGFVRFKGEGLEGAGGNLLVVSSLPLQWFRCVLPLMASLWWLRWCHLNDYARAIGEWD

SEQ ID NO: 194362 - protein, 105 aa, Glycine max
  Coding DNA Sequence Number=SeqID_77584
MASKFIFTTVVLVMLLCLLLMRDPSGCGSAYECFGANAAGLTDIPNRKVLPVLKDKKTSALKASLRGSSSNKYGEKPLNWELRKVPSGPDPLHHNGVNPKNPQTP

SEQ ID NO: 194363 - protein, 72 aa, Glycine max
  Coding DNA Sequence Number=SeqID_77585
LAAGVSLSEACALSESHALSEALSSLSELGECGGESEKHLRAQRVFSSLSEAFFSSCAKRAQLTQRIFTNSR

SEQ ID NO: 194364 - protein, 111 aa, Glycine max
  Coding DNA Sequence Number=SeqID_77586
  Gene Ontology: Mol. function=small conjugating protein ligase activity; Cellular component=proteasome complex (sensu Eukaryota); Biological process=ubiquitin-dependent protein catabolic process
  Homolog annotation: Hit_ID=Q9FKT3; Match level="QueryCoverage=99%, HitCoverage=75%, E-value=3e-54, Identity=86%"; Hit description =Ubiquitin-conjugating enzyme-like protein
  Pfam annotation: Domain name=UQ_con; Domain location=1-105; Score =167.1; E_value=4.4e-47; Accession=PF00179.16; Description=Ubiquitin -conjugating enzyme
  Subcellular localization annotation: CTP_CleavageSite=48; ConfidenceScore=5.09e-01
MGPIDSPFAGGVFLVSIHFPPDYPFKPPKVSFRTKVFHPNINSNGSICLDILKEQWSAVLTISKVLLSICSLLTDPNPDDPLVPEIAQMYKTNRAKYQATARSWTEKYAMG

SEQ ID NO: 194365 - protein, 90 aa, Glycine max
  Coding DNA Sequence Number=SeqID_77587
  Homolog annotation: Hit_ID=Q1SRJ5; Match level="QueryCoverage=83%, HitCoverage=9%, E-value=5e-12, Identity=44%"; Hit description =Probable helicase [imported]-Arabidopsis thaliana-related
MMEQQDSVLMMLSTMLMRGPNDYEEILTVNGQLYPTFREACFAIGFLLDDKEYIQALREAYHWGSGQFLRRLFVTWECLIISNNIKQTYH

SEQ ID NO: 194366 - protein, 62 aa, Glycine max
  Coding DNA Sequence Number=SeqID_77588
MERFAANLTLPNTCQQEKQLQIQAVLSVSKGKRLSYQNEADMHQIGKIKGKSFEPRKGARKA

SEQ ID NO: 194367 - protein, 318 aa, Glycine max
  Coding DNA Sequence Number=SeqID_77589
  Homolog annotation: Hit_ID=Q9XIN3; Match level="QueryCoverage=46%, HitCoverage=60%, E-value=2e-10, Identity=27%"; Hit description =Expressed protein
MELTKENSRPHLTFPISADQITGAGLGRDADGYFAAQNLENPRPEPPRAGAERGGGDDLNVEEDRAGVPLGVEIVDQFGLEVGAGGGEGGIECGLGPGVLPEGSELRLGDVVLAVEDGRAEGVVGDGHLLVAVADEEGEVPRGGEGLGGAGEVGNGEGVEGEVGEGGAEDEPGDDEDDAEDDGEADHGGEESAEEGAGGVGARRRVSGVVVLLLGSVGVAGGDGGGGGGGRRLAAVLVVEGRRGGARRVLHNSKAVCLLCSVRSEKLDTENELIGNPVHEVHDDKPIMLSVKLRKRVSNSEPEQCKFWKQYFLRVKLA

SEQ ID NO: 194368 - protein, 875 aa, Glycine max
  Coding DNA Sequence Number=SeqID_77590
  Gene Ontology: Mol. function=protein serine/threonine kinase activity; Biological process=protein amino acid phosphorylation
  Homolog annotation: Hit_ID=Q2HSJ8; Match level="QueryCoverage=99%, HitCoverage=83%, E-value=0.0, Identity=63%"; Hit description=Protein kinase
MVVGTPNYMCPELLADIPYGFKSDIWSLGCCIYEMAAHRPAFKAFDMAGLISKINRSSIGPLPPCYSPSLKTLIKGMLRKNPEHRPTASEILKHPYLLPYVDQYRSSFCTPTAGSPEKPISAVHHALKNKPGSQNRSSSSTEKDSLMSNEKNNAKALHKCDCKITEIDLTSIEDDSSEQLLPGEEGNGSSKVNAKTNEKELTKQSNNEQHSNVVSKQPKAIKTVVTALKDGKLKETSSPIRSNRIKVGGVLTHKINTETVSNLPKPNFGAYDLKPNLEVPTTAPSKTTPDSAKRMQGSNTSKHQLPMIESTPKTKPRHNVIPPSGPVKQVEGREVPSKTRQKTPPSLLKPPSFTGHVRQAGFDVLNAANNTGKTSPKKMVREPKMSHHQLTNSHLPHVSREITREPLKTFESSSKGMQTDGSNSVSSSLSIQGFELSDFATTFIDLSEPTLPDHENLNHTENKESRPDSSSPASYLHFDMSEQLSGETPVVTPRFQNITSSNEKVSPGLTLDHSSQNAEVMLSSDDSFSINQRTSSAGSRCDDRSVDPSAEITEEDISKEMTSTKSLQQPLPIFGEKSVCEEFGPASKPNNRFDKVSPPKLMCISTGDDQFMVRGRLSSVDETAPLIISTNISSQKVLQEEKATVLQNPAPERPAVGHLPPAFDDVIHVIRHSSYRVGSEQPVKESLEMGVQSVDVGKFINIVRDDLEMRNVSTPLTLKSSNCSEAIGLKSNISDNMEIRNLSNPPNLKSSSCTDLMNIKSSFSDHPVVRQQDVENTDSLVSKSDSSEYTKHKTPTAAEGTPPKEILDVKSSRQRAEALEGLLELSADLLQQNRLEELAVVLKPFGKDKVSPRETAIWLAKSLKGLMIEESGGRS

SEQ ID NO: 194369 - protein, 148 aa, Glycine max
  Coding DNA Sequence Number=SeqID_77591
  Gene Ontology: Mol. function=transposase activity; Biological process= transposition, DNA-mediated
  Homolog annotation: Hit_ID=Q1SC10; Match level="QueryCoverage=56%, HitCoverage=12%, E-value=3e-11, Identity=42%"; Hit description =Ubiquitin-activating enzyme, E1; Transposase, IS4
MDANIVDTTITSRKRKREKFKKIIKIASACVLYMIMSVVAWQFNNALRAVMKVTKGYLKFHTYNLEGLEAIKWSWFENYVGALDGTYFPVLVSPEDRPRYCNRKCDVSINVLAACNPDLRLIGGTNCNGAIQRKHQREKKGGTKKMRK

SEQ ID NO: 194370 - protein, 74 aa, Glycine max
  Coding DNA Sequence Number=SeqID_77592
  Homolog annotation: Hit_ID=Q1SCR5; Match level="QueryCoverage=80%, HitCoverage=6%, E-value=1e-16, Identity=73%"; Hit description =Moesin; Prefoldin
MDGNFEGLSYDEPEEDADAELMRRSNEAEERVILLSKKLERDSFFLDGGYDVMRTWQGLREGTFKRTWRTYDKG

SEQ ID NO: 194371 - protein, 130 aa, Glycine max
  Coding DNA Sequence Number=SeqID_77593
MGDVGLGFVLWDLNVFVKMKMKMVELLEVLEIGKKNSHQTKFLNRQHELDLEAKSTRASSDSLYPNHEKHLRRSVLRNQIMEEDDIVQELNSGILQSVASKLQEQRFKVETLLLHLDDIVSGSIFAPTQI

SEQ ID NO: 194372 - protein, 184 aa, Glycine max
  Coding DNA Sequence Number=SeqID_77594
  Gene Ontology: Mol. function=hydrolase activity, hydrolyzing O -glycosyl compounds; Biological process=carbohydrate metabolic process
  Homolog annotation: Hit_ID=Q9M2K6; Match level="QueryCoverage=48%, HitCoverage=49%, E-value=8e-26, Identity=60%"; Hit description =Glucan endo-1,3-beta-glucosidase-like protein 1 precursor
  Pfam annotation: Domain name=X8; Domain location=30-115; Score=144.1; E_value=3.6e-40; Accession=PF07983.3; Description=X8 domain
MTTRKSLVLSLLLLLGLSPLCAGAAPPQELWCVAKNNAEDAALQAALDWACGAGGADCGPIQRGGPCYDPTSVQNTASFSFNDYFLKHGMTDDSCNFNNNAAVTSLNPSHDNCKFPSGFECEEKWVFHFNGEDLELRHVFVDAARRGATGVFLDQHPLHLLDWDPVKISVGAREFLGGGGGFGL

SEQ ID NO: 194373 - protein, 45 aa, Glycine max
  Coding DNA Sequence Number=SeqID_77595
MQYLGSDPRSSPNNKQKAESVAKFVSKTVAKQGMQLKYKTERYTK

SEQ ID NO: 194374 - protein, 591 aa, Glycine max
  Coding DNA Sequence Number=SeqID_77596
  Gene Ontology: Mol. function=catalytic activity; Cellular component =intracellular; Biological process=metabolic process
  Homolog annotation: Hit_ID=Q1S316; Match level="QueryCoverage=63%, HitCoverage=66%, E-value=0.0, Identity=86%"; Hit description =Pentatricopeptide repeat
  Pfam annotation: Domain name=PPR; Domain location=313-347; Score =24.6; E_value=0.00036; Accession=PF01535.11; Description=PPR repeat
  Pfam annotation: Domain name=PPR; Domain location=348-382; Score=7.1; E_value=1.1; Accession=PF01535.11; Description=PPR repeat
  Pfam module annotation: Pfam domain module=PPR::PPR; Domain location =313-347::348-382
  Subcellular localization annotation: CTP_CleavageSite=41; ConfidenceScore=5.34e-01
MATFTSIQRARTTMLSSSFKLRTHLLHGNHFTQTLTTNSLSTSALPHEYQRFPSQQNQHQPPSDPSHFQAQQQWQQQHQHQQPQHFNPQTHHPPNPPPPSNQFPHHHNHQPRQHNVPRPFLEHGGNHNNQWNPQPPPPQNHNFQTPTSQNPNFRPPTTPNRWNNQNPAAPNQWNPRSQGFPNSNQFQNPNNQLNNNQASIQAQTHPAPPPPPHPLPPSITDLTRLCKEGKVKEAIELMDKGVKADAGCFDLLFDLCGQSKSLEDAKKAHDHFLQSTFRSDLTLNNKVIEMYGNCKSMTDARRVFDHMPNRDMGSWHLMLRGYAYNTNGDDALQLFEQMNELGLEITSETLLAVLSACASAEDVEDAFLHFESMKSKYGIEPGVEHYMGLLDVLGQSAYLKEAEEFIDQLPFEPTVAVWEKLKHYARVHGDVDLEDYTEELIVSLDPSKAVANKIPTPPPKKYTAINMLDGRNRIIEYKNPTLYKDDEKLKALSGMKETGYVPDTRYVLHDIDQEAKEQALLYHSERLAIAYGLISTPPRTPLRIIKNLRVCGDCHNAIKIMSRIVGRELIVRDNKRFHHFKDGKCSCGDYW

SEQ ID NO: 194375 - protein, 240 aa, Glycine max
  Coding DNA Sequence Number=SeqID_77597
  Homolog annotation: Hit_ID=Q9SMB6; Match level="QueryCoverage=16%, HitCoverage=6%, E-value=2e-07, Identity=74%"; Hit description =Phragmoplastin
MACMLRISSYFTMAWPLMEWPFSRAATVRLDNAEILIGDSSGTEFIDVGLKLKRFGEACYQKLMSVLLLLLVEVWRYLSRNLHSVNTFYDDDFKDDFGTVVEWVLKSTLKAFILVAVSMVDSLSIRIFNFLVLTFVLLDLSITQWERTFGFLTKIDLMSKVTNAAELLESVIKARIPSLQSPINKTIIELEIELNRMGKPIVADTGSGHSVARVPRVESRDGESKRVSRAWSHEMVRVIE

SEQ ID NO: 194376 - protein, 84 aa, Glycine max
  Coding DNA Sequence Number=SeqID_77598
MVAVVNKPSSQLQQPNTAPQPHSLLVVIGLLIMPSIDSDCYNTHSDTVLLGSAALHCYQGSIDNYGQNNFARSHKSDEMNGAWL

SEQ ID NO: 194377 - protein, 204 aa, Glycine max
  Coding DNA Sequence Number=SeqID_77599
  Gene Ontology: Mol. function=small conjugating protein ligase activity; Cellular component=cytosol; Biological process=protein modification process
  Homolog annotation: Hit_ID=P35132; Match level="QueryCoverage=61%, HitCoverage=85%, E-value=5e-62, Identity=85%"; Hit description=SUMO -conjugating enzyme UBC9
  Pfam annotation: Domain name=UQ_con; Domain location=64-198; Score =221.1; E_value=2.5e-63; Accession=PF00179.16; Description=Ubiquitin -conjugating enzyme
MALKRINTELKDLQKDPPVSCSAVMVWLGFCRDEHYGRNGPKNLALLLKSWSQTAPSYHNISLKMYEQYSVWVLNTSTTSPVTNDMFHWQATIMGPANSPFAGGVFLVSIHFPPDYPFKPPKVSFRTKVFHPNINSNGSICLDILKEQWSAALTISKVLLSICSLLTDPNPDDPLVPEIAQMYKTNRTKYEATARSWTEKYAMG

SEQ ID NO: 194378 - protein, 53 aa, Glycine max
  Coding DNA Sequence Number=SeqID_77600
MYVYEGTEVISPYSDVVTARPLYRELLRLPQWRRDACKGTLTLKSELSPIWKM

SEQ ID NO: 194379 - protein, 179 aa, Glycine max
  Coding DNA Sequence Number=SeqID_77601
  Subcellular localization annotation: CTP_CleavageSite=20; ConfidenceScore=5.27e-01
MFATNATSNLFFPCSPSSFRCRAAAGDLSAGPSFIQSVAGGLRIGQFPDGAGLAVEGRRGGGGNEPIRVKKWSRKNESYLDNDAEPLPLPMTYPDSSPVSQEEIDKRLQCDPQIQDCKEVVYEWTGKCRSCQGSGYVSYYGKRGKPKLDPSDSPNYTQWLELCAVGHSFSETRGAGGGL

SEQ ID NO: 194380 - protein, 114 aa, Glycine max
  Coding DNA Sequence Number=SeqID_77602
MKEVSAEGGGGLGQASSSVPAPQNGNSMQPSSMKISKSGEVYSYDYEETGDEPSRFEVWGWYLYEFCSYFVQTVLIPVVLPLMISQLQNLPMDPVRVWFKSHQGRACAAKEINL

SEQ ID NO: 194381 - protein, 169 aa, Glycine max
  Coding DNA Sequence Number=SeqID_77603
ASNFNNLIAGFVVKNEELNETYKYSECMRNSYEVAQGVCPDSIYEGLDGPSDSINSYYLPHNHGVLNYDHLVLKVLEHVNECTGPLDDEDKEDQGLQMQMFHGNQEQFKTQEEKLKNTSRFKKKDEFKNQDSRIKLQESRSRFKIQDSRIKRRHNQEDQDSRLKNKEKT

SEQ ID NO: 194382 - protein, 119 aa, Glycine max
  Coding DNA Sequence Number=SeqID_77604
MQDHICLREVKGHFVEPAYKRGKKGYSTKEEDLEIGWIREAERPWVVATTDDKRQAGSFKGILENFRYERGGEKGSPPCAVVRIWQQSAALSNSVGDNLDLGFQFLIKDNKVIVCLYKK

SEQ ID NO: 194383 - protein, 447 aa, Glycine max
  Coding DNA Sequence Number=SeqID_77605
  Gene Ontology: Mol. function=protein binding; Cellular component =integral to membrane; Biological process=protein amino acid phosphorylation
  Homolog annotation: Hit_ID=Q1S313; Match level="QueryCoverage=96%, HitCoverage=78%, E-value=0.0, Identity=74%"; Hit description=Leucine- rich repeat, plant specific
  Pfam annotation: Domain name=LRRNT_2; Domain location=375-414; Score =14.3; E_value=0.028; Accession=PF08263.3; Description=Leucine rich repeat N-terminal domain
MTITIFQESLGGVNPCGAVAFDSMSPSVFLLWIITISLLAHSALASIPLGYFLDCGGTKEVTIDNNLTYIPDGSYIKVGKTTTISKPDLLPILSTLRYFPDMWAKKYCYSLPVIKGSKYLVKTMYYYGGFDGRNKQPPVFDQIVEGTRWSVVNTTEDYAKGLSSYYDIVVVPPGKTLSVCLARNAHTGGASPFISALEVKMLDASFYNPIDFNKYALLTVARNTFGDDKFNRMWQPYKDQNPVVESNSNVTSSDFWNQPPVKAFSSAVTTSRGKTLEIQWPSMSLPSTYYYISLYFQDNRHPSPYSWRVFNVSINGHTFYSSLNATTNGVTVYATKWPLSGKTKITLTPGSGIPVGPLINAGEIYQVLPLGGRTHTRDVIAMEDLARSIQNPPVDWHGDPCLPKGNSWTGVTCSNGFHARVTIVNLTNAGVSGSLPPTLGHLSALEH

SEQ ID NO: 194384 - protein, 71 aa, Glycine max
  Coding DNA Sequence Number=SeqID_77606
MLPLIELAGKGYGKKVVEGDMKIRAIIWEGHGRNGNEIMQESIERYRRHTKHVNPTTFRSVEQNMQASAIT

SEQ ID NO: 194385 - protein, 411 aa, Glycine max
  Coding DNA Sequence Number=SeqID_77607
  Homolog annotation: Hit_ID=Q1S312; Match level="QueryCoverage=99%, HitCoverage=69%, E-value=1e-163, Identity=69%"; Hit description =Quinoprotein amine dehydrogenase, beta chain-like
MGTSPSREGLEVTDSDSDYEHEEEETEHYEHAKTHSTELDDLDAKLKALKLKYQTPSSSSSKSLPQNAVKLYLHIGATTPNAKWILSDKRTSYAFLKDSDDENDAVWFLTVGSKVRARVSSEMQLKMFGDQRRVDFVADGVWALKFPSDDTYRRFVTEFQNCVFENVYGIECTEENKVKIFGKEFIGWVKPEAADDSVWEDAFAADPSPSRRRDDLMEEFEEAANGGVQTLTLGALDNSFMVNDAGVHVYRNFNRGIHGKGVAVKFAGGDATPNKALLMRAETNMMLMSPLKDGKPHASKLHQLDIETGKIVTEWKFGKDGVDLTMRDITNDTKGSQLDPSESTFLGLDDNRLCQWDMRDRKGIVQNIATASSSPVLHWSQGHQFSAGSNFQSFATTGDGSIVVGSLDGKI

SEQ ID NO: 194386 - protein, 121 aa, Glycine max
  Coding DNA Sequence Number=SeqID_77608
  Gene Ontology: Mol. function=oxidoreductase activity; Biological process=metabolic process
  Homolog annotation: Hit_ID=Q1SZJ6; Match level="QueryCoverage=89%, HitCoverage=17%, E-value=3e-37, Identity=68%"; Hit description =Alcohol dehydrogenase superfamily, zinc-containing; Short-chain dehydrogenase/reductase SDR
SLSHLFVKSVRRVYDTGLEIAYQGEKGWTPSKYPGLLEKLLAKSQTVSGFFLVQYGHLWQEHLDRLFNLYSSGKLKVAIDPKKFIGLHSAADAVEYLHSGKSVGKVVVSVDPSFLPQVAKL

SEQ ID NO: 194387 - protein, 415 aa, Glycine max
  Coding DNA Sequence Number=SeqID_77609
  Homolog annotation: Hit_ID=Q2R179; Match level="QueryCoverage=85%, HitCoverage=93%, E-value=4e-82, Identity=44%"; Hit description =Expressed protein
  Pfam annotation: Domain name=DUF829; Domain location=100-368; Score =151.0; E_value=3.1e-42; Accession=PF05705.5; Description=Eukaryotic protein of unknown function (DUF829)
LKFARFGYWVGLRAMRGGGFAVRGGNIYWGRKEETDFRGIVVIFAWVSVPQNLLQEFVDLCSSLSFHDESAMPLAFCVLDELIEELRTRSCPVVFAAFSAGSKACLFRVFQPNYQLLRNCLSGHIYDSGPIDVTSDFGFRFTLHPSIVKVPGPSKLVSWVAKSVTSGLDALYLTRFESQAAEHWQALYSSVNFGAPFLILCSENDDLVRYQSIYEFAQQLRNLSGDVNLVNFSSSSHLGHYKHHPIEYRAAVSHLLEKASSIYSQKMLLERERTGMDGTQDEISELICDLQKVAINSNKSLRRVAVGPTDHFFLPSSAGHYSDRESGAPQDEQKEKPVFVPSFPSISAHSVLGQFLFDVCVPKNVEGWDVKSSGNLNGRRYFMINLFETSAVSLDNTGRGHVMAAMVQQLIPWHF

SEQ ID NO: 194388 - protein, 267 aa, Glycine max
  Coding DNA Sequence Number=SeqID_77610
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q1RXT3; Match level="QueryCoverage=64%, HitCoverage=35%, E-value=2e-51, Identity=66%"; Hit description =Glycoside hydrolase, family 17
  Pfam annotation: Domain name=Glyco_hydro_17; Domain location=30-242; Score=-151.8; E_value=0.019; Accession=PF00332.9; Description =Glycosyl hydrolases family 17
MAVNGFDVAPGQLPHAPEDHPHPPLRPQPRHPPRPVGYPHPRHHQRPQQPAPRHRLLQHHCHLLDPQKRRRRLPRRRGPLHPPLLLPALRSLHAALVYSNIHNDVFVSTPHSASVILNPFPPSQAFFNQTLETFIRPLIHFLSQTNSPLMLNLYPYYVFMQNRNLVPLENTLFKWCHIIIKLVWKDFNIAYEAGGVGKEIKIPFPAYVNNNSLEIRFYWARKGTNAIPYKSIYGPLILAISVTRDSTGGSTSAGVVVGEFILGKEIH

SEQ ID NO: 194389 - protein, 114 aa, Glycine max
  Coding DNA Sequence Number=SeqID_77611
  Homolog annotation: Hit_ID=Q1S312; Match level="QueryCoverage=80%, HitCoverage=14%, E-value=1e-45, Identity=93%"; Hit description =Quinoprotein amine dehydrogenase, beta chain-like
MSEHRWHYYEIDLVEQNVQVTENGKQERHLVATVGKFSVIWDFQRVKNSAHECYRNQEGLKSCYCYKIVLKDESIVESRFMHDKFAVSDSPEAPLVVATPMKVSSISLSGKRHG

SEQ ID NO: 194390 - protein, 99 aa, Glycine max
  Coding DNA Sequence Number=SeqID_77612
  Gene Ontology: Mol. function=protein serine/threonine kinase activity; Cellular component=membrane; Biological process=protein amino acid phosphorylation
  Homolog annotation: Hit_ID=Q49N12; Match level="QueryCoverage=98%, HitCoverage=9%, E-value=9e-41, Identity=80%"; Hit description =Putative receptor-like protein kinase 2
  Pfam annotation: Domain name=Pkinase_Tyr; Domain location=11-98; Score=-172.4; E_value=0.068; Accession=PF07714.7; Description =Protein tyrosine kinase
MHQIKVATNNFDISNKIGEGGFGPVYKGILSNGTIIDVKMLSSRSKQGNREFINEIGLISALQHACLVKLYGCCVEGDQLLLVYKYMENNSLAQALFGK

SEQ ID NO: 194391 - protein, 142 aa, Glycine max
  Coding DNA Sequence Number=SeqID_77613
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q1RXT3; Match level="QueryCoverage=77%, HitCoverage=34%, E-value=3e-32, Identity=47%"; Hit description =Glycoside hydrolase, family 17
MAPFEEGVFERDEVSVLHEDVVRGLVEEGLGGREGVEDDGGGGGEDLVAEGDGGDVSADPGGGSGVGGGDGEELVVGDADGDVDVGTRQGAEDVGVGVVEADVGDLLVHEEVDQEARVTIWAEENDIVLWNPNNVVVAIAPE

SEQ ID NO: 194392 - protein, 94 aa, Glycine max
  Coding DNA Sequence Number=SeqID_77614
MTRGPGSMQRLTSSSAPLSSRDGMSDDIQRYLMVIHTFCQLEGSELVDTQRLMSSSAPLSSRDGKSNDMRRYLMVIRTFCQLEANEPVDAKRLT

SEQ ID NO: 194393 - protein, 421 aa, Glycine max
  Coding DNA Sequence Number=SeqID_77615
  Gene Ontology: Mol. function=monooxygenase activity; Cellular component=membrane; Biological process=electron transport
  Homolog annotation: Hit_ID=Q1SI93; Match level="QueryCoverage=96%, HitCoverage=85%, E-value=1e-127, Identity=56%"; Hit description=E -class P450, group I
  Pfam annotation: Domain name=p450; Domain location=28-421; Score =148.7; E_value=1.5e-41; Accession=PF00067.12; Description=Cytochrome P450
MLLHYCTEKLSSAQKKKSHQNQVNSNIPPGPWKLPNIGNIPHLVTSTPHRKLRDLAKKYGPLMHLKLGDLNHSCFLSRVCQRGYDKKTIAFAPYGNYWRQLRKNCTLELFTIKRINSFRPIREEEFNILIKRIASANGSTCNLTMAVLSLSYGIISRAAFLQRPREFILLTEQVVKTSGGFNIGEFFPSAPWIQIVAGFKPELERLFIRNDQILQDIINEHKDHAKPKGKEGQGEVAEDMVDVLLKFQDMGGENQDASLTDDNIKAVIEKMFASGGETSANSINWTMAELMRNPRVMKKAQAEVREVFNMKGRVDETCINQMKYLKAVAKETMRLHPPVPLLFPRECGEACEIDGYHHIPVKSKVIVSAWAIGRDPKYWSEAERLYLERFFASSIDYKGTSYEFISFGAGRRICPGGSFGL

SEQ ID NO: 194394 - protein, 127 aa, Glycine max
  Coding DNA Sequence Number=SeqID_77616
MKLLMRHEAKVGKISCLILKADFQKMKWTYWIEIGLEFASIYELVNGSPTGECRSKPSWRIKGDSKNNSRVQDKNQEEFKTQEESLESRIKIQGSRSQESRSRFKTQDSRIKRRLNQDKYEKVFLKN

SEQ ID NO: 194395 - protein, 384 aa, Glycine max
  Coding DNA Sequence Number=SeqID_77617
  Gene Ontology: Mol. function=protein serine/threonine kinase activity; Cellular component=outer kinetochore of condensed chromosome; Biological process=protein amino acid phosphorylation
  Homolog annotation: Hit_ID=Q1SKH6; Match level="QueryCoverage=99%, HitCoverage=100%, E-value=1e-167, Identity=75%"; Hit description =Cellular retinaldehyde-binding/triple function, C-terminal
  Pfam annotation: Domain name=Mad3_BUB1_I; Domain location=64-188; Score=208.1; E_value=2e-59; Accession=PF08311.2; Description =Mad3BUB1 homology region 1
MAEAEMEKITTIDPETEFLASKRKNGNEWETFKENVRPLKRGRNVNLLNHALNSHTDNQLKKSLVQQRSKLIQAIQEYQGDDPLLPWIQCIKWVQEAFPPGGDSSGLVVIYEQCVRAFWHSERYKDDLRYLKVWLEYADNCFDADVIYAFLDANGIGKPHSIFYISYALHLESKNKFKAANQMLELGISRNAQPIEKLKAAYRQFFARSMARPIAIDDSVEKLAPTRSFGTVLAKGENRAPLSILNSNRDPSAKNDRTRAAPLSIYKDSADTGDTDPHKPDPSHSWHTLGARADRNKENNAIPGKWKSYKVPQRPGTRVGGATPSAFIPVFVDEECQDSQSKKAEGCKSSSLKIRQEDDKELKRETELLRKNPLRNFPQNSLPR

SEQ ID NO: 194396 - protein, 298 aa, Glycine max
  Coding DNA Sequence Number=SeqID_77618
  Gene Ontology: Mol. function=monooxygenase activity; Cellular component=membrane; Biological process=electron transport
  Homolog annotation: Hit_ID=Q1SI93; Match level="QueryCoverage=93%, HitCoverage=61%, E-value=2e-99, Identity=61%"; Hit description=E -class P450, group I
  Pfam annotation: Domain name=p450; Domain location=1-275; Score= -59.0; E_value=2.8e-08; Accession=PF00067.12; Description=Cytochrome P450
MTCKDQEEFISAVKEGVTVAGGFNLGNLFPSAKWLQLVTGLRPKIERLHRQIDRILLDIINEHREAKAKAKEGQQGEAEEDLDIFGAGGETAATAINWAMAKMIRDPRVLKKAQAEVREVYNMKGKVDEICIDELKYLKLVVKETLRLHPPAPLLLPRACEIDGYHISVKSMVIVNAWAIGRDPKYWSEAERFYPERFIDSSIDYKGGNFEYIPFGAGRRICPGSTFGLKNVELALAFLLFHFDWKLPNGMKNEDLDMTEQSGVTVTRKADLFLIHITFRPIMLTHTEAQRRGGERIL

SEQ ID NO: 194397 - protein, 503 aa, Glycine max
  Coding DNA Sequence Number=SeqID_77619
MGERPCDARGELRNPGPDSGPGRKSGDPDGAGKAPPQRPRGARAPAAHAARHGATDCRYRAGQRTAAVLVSRVDCGEPYCARAVRQPGRGDLGAGERRTGGTPDGYQPPHGVRRHTDRSRRARPENDVQQLAALHARRASAAGGTVMSVQNTLSPDAAQQKVTQADITRALGEFCFIRLDNGDEAFYYNGFWLTGADGESNEPSVQGLAQRTARAGNKHLRCVELPVPEDKEWCWDDVVTELARCAVTRELRGELIVTGSETRYGRGIHICNDPLLSGINSNLWFPLNQAEDWFTGIERVLMMNGVAENVVRIESLRDCAAYHDWKVVYNRKLTLGELPLFPMKTIAPAIFKWQNSCSTLYSVLPDRAACEETMMSFLMLGSLLSLGYALAFGFVVPGDISLTYWCGYAMCFVLARLLASKHPQPAGDWVVIKLLALTVPVGGVFLCVWGAMNLLADPAAGGPAGADMLYSASHGLLLPLLAMIMGAAIVAVSLYRIRTRAQG

SEQ ID NO: 194398 - protein, 73 aa, Glycine max
  Coding DNA Sequence Number=SeqID_77620
MDCRLSRIVHEFQVIYPTLGLRALVGCEVVSFSAMISHVDLTLPPRDHPYIIHFSFGEWMFISACNGCLHQIT

SEQ ID NO: 194399 - protein, 571 aa, Glycine max
  Coding DNA Sequence Number=SeqID_77621
  Gene Ontology: Mol. function=protein binding; Cellular component =intermediate filament; Biological process=intracellular signaling cascade
  Homolog annotation: Hit_ID=Q1SKH2; Match level="QueryCoverage=91%, HitCoverage=40%, E-value=4e-23, Identity=26%"; Hit description =Calcium-binding EF-hand
MTEEQVVNVRGEVSDSVTDHRSVKANGVAHGVGGDLDLAADNNGAALSEKICKDAVSNGTAEEVSETAMVNVVSRDDELKCADGQNDTGSVQNGVVENDDKSANAVAEELVTDHDEYVVVGDSDVQNGDDVNANANGVEECEMLDGAEGSGDENGVVVSAVEGDADVNHSDREFECVDVHNDVAVETVEEEVTATTDQNVGNGNDVQGRSESVSDEDVDKSGESVNVVSADVLDEKDIVTDGDHDAEEVLEKNEILVDADGVSATTDLKQCEPEDARNSSEKGQVESVSGLAKPEPSECTEENEIAVEGEPGSKLERSEEEAGSEIVPQGENLTALNSTDVTGDGDVVSDIAVESKDEPSVDVCELKSIAVENDVDVQELKNGAVQSEIVSEMKNNTEESVAEPSNGAVESEAEPSNGAVESEADPSNGAVEWETEHSNGAVERETEHSNGAVESVAEPSNGAVESVAEPSNSAVDREDEPSNGAVDKEAEPSNGAVDKEAEPSNGAVDSEAEPSNGTVEREAEPSNGAVESEAEPSNGAVRCVAEPSNGAVESEAEPSNGAVAREAKPSN

SEQ ID NO: 194400 - protein, 58 aa, Glycine max
  Coding DNA Sequence Number=SeqID_77622
MKFCGFSIGGSERGVKERKIGLYGTCFGEDLSKIRRSNKPSGNRLQDVVIDYRLLVLV

SEQ ID NO: 194401 - protein, 883 aa, Glycine max
  Coding DNA Sequence Number=SeqID_77623
  Gene Ontology: Mol. function=metal ion binding; Biological process =conjugation with cellular fusion
  Homolog annotation: Hit_ID=Q1SKH2; Match level="QueryCoverage=98%, HitCoverage=68%, E-value=1e-150, Identity=48%"; Hit description =Calcium-binding EF-hand
  Pfam annotation: Domain name=S-antigen; Domain location=8-220; Score=- 254.5; E_value=0.048; Accession=PF05756.2; Description=S-antigen protein
DSEAEPSNGAVDSEAEPSNGAVDKEAEPSKGTVESEAGPSNGAVESEAEPSNGAVESEAEPSNGAVRCVAEPSNGAVESEAEPSNGAVAREAKPSNGAVESEAEPSQGAVDSEAEPSNGAVESEVKPSQGAVESEAEPSQDAVESEAELSNGAVNREAETASGAVESEAKTSSGAVETEVKPSHGVVESEAKPSNGVAESESEPSVDVCETKNDVVNSEAETSSGALQSEREACVVSEMKNNAVESEAQPSVDVSEKKTNAVDSEAELSVKGGLSVESEGSNQGDEDSRPASDALDGQNVGTEVVKKPFYYLIRVPRYDDDENIKEKIKNALHQVEEKTKIRDAIRIESQTIKASCKDFDQEFRAAIAAHRAARDLLKSKRQEIDSVQSTMNRLNNAISVGDIDDKIRSMEHMIQHETLPLNKEKQLIREIKQLKQNREELSSNMKKQDQSQQSVDNKDDNIEEHFKHLQLLKKEMEVLRNNVLKSDTETKAAKKKYNDECDKLNELLARFRAADDSRQEAYAKLLALKKQLHEKSKNFWEYRDAANKAQELAAGGKKEELQCFCVDQVERIMELWNKNDGFRRDYVRCNTRSTLRRLQTLDGRSLGPDEEPPVIPNVITERASKNIPMVLQSTLEQEKKSTPTESVNVKDEPVSKVVVQRTETSQTTKAKKPTKPAPLEKHVARWGDESDEDEVKKEEPVRTKEEEELILKAEKARMEEEEAKLKEKRRLEEIEKAKEALLRKKRNAEKAQQRAALKAQKEAELKEKEREKRAKKKERRKAGSAVTAENTEQESAPIPETLTRSVEEFEQTEKTAEVTKKPQKTSQFTRQTKVKSVPAALRNRGKRRIQPWVCVLIALVVAVALFYVGHNCSLRSSLEGFGY

SEQ ID NO: 194402 - protein, 67 aa, Glycine max
  Coding DNA Sequence Number=SeqID_77624
SLKCYPLSIVVFFMLSKIPPPVALLGFPNVREKKKRLKPSFHGPRCDASFSLDRHNFANPDGKDVRK

SEQ ID NO: 194403 - protein, 1009 aa, Glycine max
  Coding DNA Sequence Number=SeqID_77625
  Gene Ontology: Mol. function=DNA binding; Cellular component=nucleus; Biological process=regulation of transcription, DNA-dependent
  Homolog annotation: Hit_ID=Q1SKG8; Match level="QueryCoverage=99%, HitCoverage=100%, E-value=0.0, Identity=66%"; Hit description=SBP
  Pfam annotation: Domain name=SBP; Domain location=93-171; Score =175.3; E_value=1.5e-49; Accession=PF03110.5; Description=SBP domain
MDQVAPPPILMHRKRDLSYAVVSPAPNPSWSWDWDSVRFAGKPPPPLSSPNDDVVFEESVAPPLQLNLGGRTNNSNSNKRVRSGSPGTSSYPMCQVDNCREDLSKAKDYHRRHKVCEAHSKASKALLANQMQRFCQQCSRFHPLSEFDEGKRSCRRRLAGHNRRRRKTQPEDVTSATPAPAAAANLEIFDLLTAIAGASQGKFEEKRSQVPVREQLVQILNRIPLPADLATKLLDAGSGNVNGKKDQVQLQTPSSYQRHESHDQLNHTPAAPLTMDLLAVLSTTLSGGSAPDASASPSQNHSCNSDGGSADQTRQQQFFSVGGERSSSSSRSPVEDSDCQEDVRVNLPLQLFSSSPEDDSLPKLASSRKYFSSDSSNPAEERSPSSSPVVEMLFDLQGGARGLKPESISSGREVIANKEASQSHSSNISLDLFKGSNNRIQQPSSLQSVPFQAGYTSSGSDHSPPSLNSDAQDRTGRIMFKLFDKHPSHFPGTLRAQIYNWLSNRPSDMESYIRPGCVVLSIYASMSSADWEKLEENFLQHVHSLIQNSDSDFWRNGRFLVHSGSQFVSHKDGKIRICKPWRTWKSPELISVSPLAIVSGHETSISLKGRNLSTPGTKIHCTGTGSYASAEVIGSAYSGVMYDKIKLSAFKVQDVSHGVLGRCFIEVENGFKGNSFPVIIADETICKELRPLESEFDEEEKICDAISEEHEHHFGRPRSREEALHFLNELGWLFQRERFSYVHEVPYYSLDRFKFVLTFAVERNCCMLVKTLLDVLVGKHLQGEWLSTGSVEMLNAIQLLNRAVKGKYVGMVDLLIHYSIPSKNGTSRKYVFPPNLEGPGGITPLHLAAGTSGSESVVDSLTSDPQEIGLKCWESLVDANGQTPHAYAMMRNNDSYNALVAHKLADRRRGEISVTIENAIEQQSLRVELKEKQSNLVKRGQSSCAKCANAEFRFNRRVPGSHGLLHRPFIYSMLAVAAVCVCVCVFFRGRPFVGSVAPFSWENLDYGTM

SEQ ID NO: 194404 - protein, 302 aa, Glycine max
  Coding DNA Sequence Number=SeqID_77626
  Gene Ontology: Mol. function=kinase activity; Cellular component =intracellular; Biological process=intracellular signaling cascade
  Homolog annotation: Hit_ID=Q1SKG4; Match level="QueryCoverage=97%, HitCoverage=99%, E-value=1e-129, Identity=73%"; Hit description=Zinc finger, ZZ-type; Zinc finger, PHD-type; Protein kinase C, phorbol ester/diacylglycerol binding; C1-like
  Pfam annotation: Domain name=C1_2; Domain location=147-174; Score =26.3; E_value=0.00011; Accession=PF03107.7; Description=C1 domain
  Pfam annotation: Domain name=C1_2; Domain location=203-230; Score =18.4; E_value=0.026; Accession=PF03107.7; Description=C1 domain
  Pfam annotation: Domain name=C1_2; Domain location=88-115; Score=9.4; E_value=0.26; Accession=PF03107.7; Description=C1 domain
  Pfam annotation: Domain name=C1_3; Domain location=146-174; Score =22.0; E_value=0.0013; Accession=PF07649.3; Description=C1-like domain
  Pfam annotation: Domain name=C1_3; Domain location=202-230; Score =29.5; E_value=1.2e-05; Accession=PF07649.3; Description=C1-like domain
  Pfam annotation: Domain name=C1_3; Domain location=87-115; Score =27.9; E_value=3.7e-05; Accession=PF07649.3; Description=C1-like domain
  Pfam module annotation: Pfam domain module=C1_2::C1_2::C1_2::C1_3::C1_ 3::C1_3; Domain location=147-174::203-230::88-115::146-174::202 -230::87-115
PPTMMKSLKQVRKTRSYKLERSSSAMEYQITSPSDHHYSTGYVTKKSPPPPPHVEFPTSPQLIFGEEILHFSHPQHPLSMVDLPDLFNCVGCKEYGSGKRFVCQQCDFQLHDFCALAPPALKAHPFHSQHSVLFHSKPVKSGMAKSKCDVCGKPTKGFGFLCTACAFQMHPCCAMLNNEIEYPAHPHTLRMLPTTVPDPASFVCGECKKQRSGKVYRCTVCEYHLHAVCAKTKINGLQANGIRPPEKPSVLAAAARVASQVVIEFIGGLVEGIGESVGDVLVQNIAKGNNAPANATPKPRYK

SEQ ID NO: 194405 - protein, 48 aa, Glycine max
  Coding DNA Sequence Number=SeqID_77627
MACDATSTILNSFLLSHHLNTINFFSSSSVFAVAMDNGLMAYSNLRSY

SEQ ID NO: 194406 - protein, 297 aa, Glycine max
  Coding DNA Sequence Number=SeqID_77628
  Gene Ontology: Mol. function=binding; Cellular component =intracellular; Biological process=metabolic process
  Homolog annotation: Hit_ID=Q10IY6; Match level="QueryCoverage=98%, HitCoverage=61%, E-value=2e-57, Identity=29%"; Hit description =Pentatricopeptide, putative, expressed
  Pfam annotation: Domain name=PPR; Domain location=135-169; Score =34.3; E_value=4.1e-07; Accession=PF01535.11; Description=PPR repeat
  Pfam annotation: Domain name=PPR; Domain location=183-217; Score=5.2; E_value=1.8; Accession=PF01535.11; Description=PPR repeat
  Pfam annotation: Domain name=PPR; Domain location=253-286; Score =16.8; E_value=0.077; Accession=PF01535.11; Description=PPR repeat
  Pfam annotation: Domain name=PPR; Domain location=49-83; Score=30.8; E_value=4.6e-06; Accession=PF01535.11; Description=PPR repeat
  Pfam module annotation: Pfam domain module=PPR::PPR::PPR::PPR; Domain location=135-169::183-217::253-286::49-83
MLSLHAYVYKLGHQAAAFVGNALIDAYPVCGNVIAACQVFDGICCKGMVSWTGMMACYAENYCHEDSLLLFCQMRVMGFRPNNFEVGKSVHGCALKACYDRDLYVGTVLLELLTKSGEIAETQQFFEEMPKDDLIPWSLMIARYAQSDKSREALELFCRMRQSSVVPNNSTFASVLQACASSVSLNLGKQIHSNLGDGEKALNLFSNMLGYDIHPTEVTYSSVLRASASLVALEPGRQIHSLTIKTMYNKDSVVANSLIDMYAKCGRIDDSRLAFDKMDKRDEVSWNAIICGGSKFI

SEQ ID NO: 194407 - protein, 163 aa, Glycine max
  Coding DNA Sequence Number=SeqID_77629
  Gene Ontology: Mol. function=hydrolase activity, hydrolyzing O -glycosyl compounds; Cellular component=cellulose and pectin -containing cell wall; Biological process=polysaccharide catabolic process
  Homolog annotation: Hit_ID=Q9CAC1; Match level="QueryCoverage=97%, HitCoverage=32%, E-value=1e-56, Identity=63%"; Hit description =Endoglucanase 8 precursor
  Pfam annotation: Domain name=Glyco_hydro_9; Domain location=1-157; Score=-177.3; E_value=6.9e-06; Accession=PF00759.9; Description =Glycosyl hydrolase family 9
GLLFKPGGSNLQHTTALSFLLIVYARYMQSAKKTVTCGNEVADPARLINLAKSQVDYILGKNPLGMSYMVGYGAKYPKKIHHRGSTLPSVNMHPQHIQCREGDQYFKSEKPNPNILTGAVVGGPAEDDSFQDSRYNVGQSEPTTYINAPFVGLLAYFNKHTIS

SEQ ID NO: 194408 - protein, 142 aa, Glycine max
  Coding DNA Sequence Number=SeqID_77630
MKILGFFLSLISSGFGFYFWNNHWKWGHLLVFGAIQGTASGLVHTFGRVLVLDSAPSGEEGAFSVWYSWLRGVGLCGGFTVGSVVPGKVKTSFGAAFCSAIVGIVVLLFGKENDFGGAVREGHETRSRDHPGALNSKESFSV

SEQ ID NO: 194409 - protein, 181 aa, Glycine max
  Coding DNA Sequence Number=SeqID_77631
  Homolog annotation: Hit_ID=Q1SC10; Match level="QueryCoverage=28%, HitCoverage=8%, E-value=1e-07, Identity=52%"; Hit description =Ubiquitin-activating enzyme, E1; Transposase, IS4
MDANIVDTAITSRKHKREEFKKIIKVASACVLYMIMGVVAWYHNSHFVKEPTPCGPDLRFIYELPRWEGSNGDSRVLRDALHRQNKLEIPTACDPRLTASRYLTPIVRQSVEFRDMPEVEGKHCCSIRKVPQHSRIKRGVQIAIRPTWAFQDVPTEGGAFWWKQPSSPGRAGRQPPPSFPL

SEQ ID NO: 194410 - protein, 78 aa, Glycine max
  Coding DNA Sequence Number=SeqID_77632
MEMKDSVRGTPGCMRFIGVQNLDDVKSRKVEPRRQKVDDDADFAAGADGEGGVKVQYPLQGGGPPRREGAPGKDDRQQ

SEQ ID NO: 194411 - protein, 1051 aa, Glycine max
  Coding DNA Sequence Number=SeqID_77633
  Gene Ontology: Mol. function=RNA-directed DNA polymerase activity; Cellular component=chromatin; Biological process=RNA-dependent DNA replication
  Pfam annotation: Domain name=RVP_2; Domain location=272-393; Score= -59.0; E_value=0.039; Accession=PF08284.2; Description=Retroviral aspartyl protease
  Pfam annotation: Domain name=rve; Domain location=829-983; Score =59.1; E_value=1.5e-14; Accession=PF00665.16; Description=Integrase core domain
  Pfam module annotation: Pfam domain module=RVP_2::RVT_1::rve; Domain location=272-393::421-590::829-983
SANITIGALVASMTDSSPQLTEVLARLGDTMHSMSLKLDEILHRLSPSSHSSASPNPSPQPHPPVPTSTHKMKLEVPRFNGTEPLGWIFKINQYFEYHNTLDKDRLTIASFYMEGRALAWPYRRGLCRRSTTTLLACYSNSHDPIGETDHWLASSISPRMLHFWSRARYSEGGAGSPTPHAGSGCRPCQSLGGEDFLVPGDSTAFPASIVVGPLAFHTSTSLVAVTPSTASTSGHRCASRVLLMVAEEEDLSWSNIDPGDPALNTDPLDSPNPLQAQISLNSLSGHLAPKALRLLALISNHYVTVLVDGASIHNFVQPQVVTSLSLPCRRISTPLRVMVGNGQYLECASVCEDVLVYIQNHTFKIDLYILPISGANVILEVQWLKTLVNVRPYRYPHYQKHEIELQVDSMLQQGLIQPSTSPFSSPVLLVRKPDGTWRFCVDYRALDAVTVKDRFPIPSIDELLDELGGATCFLKLDLLQGYHQIRMNEDDVPKNAFRTHHGHYEFRVMSFGLFNAPSSFQATMNMIFKPYLRHFIIVFFDDILIYSTSFTNHLLHLQFVFQILLDNQFALKLSKCFFAQPQVEYLGHLVSARGVEPVALKVVAIHQWPTPRSTRAVRSFLGLVGFYRRFIRGYATIATPLVAATTIKPFKWTTQAQLAFEQLKQELASAPVLALPQFELPFTVETDASGVGMGAVLSQQGHPIAFFSKPFSPKLLRSSTYVRELCAITTVKKWRQYLLGHHFIILTDHRSLKELLTQTIQTPEQHMYLARLMGYDYEIHYRSGNHNQVADALSRLPEAEYGYPGEFHSLILCSLNITQHPQGSGKTSSNLWPNASISKSLSLPPYQGNTTILVVVDQFSKGIHLGMLPATHTAHMTASLFINIMVKIHGIPRSLVSDRYPLFIRKFWQDLFHASGTLLRMSSSYHPQTDGQTEVLNRVIEQYLRAFIHRRPSLWGKLLSGVEWSHNTSWNVGTGATPYEITFGRKPFNFAEYILGSSKVDAVEEMMIDRNIDVSSIGACRPRIFFINGFLCFLEDKWKRNGEGRERGDAT

SEQ ID NO: 194412 - protein, 118 aa, Glycine max
  Coding DNA Sequence Number=SeqID_77634
  Homolog annotation: Hit_ID=Q8S3T1; Match level="QueryCoverage=75%, HitCoverage=58%, E-value=6e-10, Identity=40%"; Hit description =Putative n-calpain-1 large subunit
MDRALLLACVICGILFLVLGLASFFILWAVNWRPWRIYSFKIQLPCCNVNAVDFFFFLWRMVFVAKISSCFKIIDNLIFTGIGCRVLSLNFITDFQLPCFFVFFDGLLSMAVLNRVSR

SEQ ID NO: 194413 - protein, 79 aa, Glycine max
  Coding DNA Sequence Number=SeqID_77635
  Homolog annotation: Hit_ID=Q9C8A6; Match level="QueryCoverage=97%, HitCoverage=3%, E-value=3e-26, Identity=70%"; Hit description=N -calpain-1 large subunit, putative; 13921-23959
MAKYLARSSTSFALWFPESFCMGSCYFSNSGTYHLGLLVDCNIGSRPDWFGCNNGWHCPSIGILFNYALVENSVAKLNY

SEQ ID NO: 194414 - protein, 67 aa, Glycine max
  Coding DNA Sequence Number=SeqID_77636
MPEKVPWRREVLTEDAISVVSMNWLFRGHLGFEQSSQSHDKVLLLSCLRLSGYPVGMGTIILQRVRE

SEQ ID NO: 194415 - protein, 80 aa, Glycine max
  Coding DNA Sequence Number=SeqID_77637
MDADEVMSIGDASASIDLEELGSGSKIRGQSSSSTSVQSQRRKIGEKDGIVALMKLVAESFDRLTQAYDKKVEENDIQEV

SEQ ID NO: 194416 - protein, 50 aa, Glycine max
  Coding DNA Sequence Number=SeqID_77638
MAKMRWRGAVDGDVDFAIGADGEGGGASAVSVARRGPPGREGAPRKDDRQ

SEQ ID NO: 194417 - protein, 228 aa, Glycine max
  Coding DNA Sequence Number=SeqID_77639
  Gene Ontology: Mol. function=microtubule motor activity; Cellular component=microtubule associated complex; Biological process =microtubule-based movement
  Homolog annotation: Hit_ID=Q9C7T0; Match level="QueryCoverage=77%, HitCoverage=14%, E-value=1e-76, Identity=80%"; Hit description =Kinesin, putative; 56847-62063
  Pfam annotation: Domain name=Kinesin; Domain location=1-116; Score= -40.7; E_value=1.2e-11; Accession=PF00225.13; Description=Kinesin motor domain
MIKGENLLNGECTRSKLWLMDLVGSERVAKTEVHGDGLKETQNINRSLSALGDVISALATKSSHIPFRNSKLTHLLQDSLGGDSKALMFVQISPNENYLSETICSLNFASRVRGIELGPARKQLDTVELLRHKQMVEKVKQEVRLKDLQIKKLEETIHGLESKMKERDSKNKNLQEKIAFLRYSQQWKKKAIFVLNKVDIYKNNHEGHVHYSRTNVHLVLQQPSTRLG

SEQ ID NO: 194418 - protein, 520 aa, Glycine max
  Coding DNA Sequence Number=SeqID_77640
  Gene Ontology: Mol. function=cysteine-type endopeptidase activity; Cellular component=intracellular; Biological process=proteolysis
  Homolog annotation: Hit_ID=Q6SSJ2; Match level="QueryCoverage=85%, HitCoverage=20%, E-value=1e-164, Identity=66%"; Hit description =Phytocalpain
  Pfam annotation: Domain name=DUF554; Domain location=83-292; Score= -144.5; E_value=0.089; Accession=PF04474.3; Description=Protein of unknown function (DUF554)
  Pfam annotation: Domain name=MFS_1; Domain location=156-499; Score= -53.5; E_value=0.088; Accession=PF07690.6; Description=Major Facilitator Superfamily
  Pfam module annotation: Pfam domain module=DUF554::MFS_1; Domain location=83-292::156-499
MKINGSLKFIPFIDPSNLLSSVKSGLYTFMEIVESNNPTSKIVIFDILPYRSSYSLWVLIAFGETLVLVHAFNNMMSDKYGFIAWLLSTCVGLLLSFLSKSSVLLGISLTVPLLVACLSVAIPIWICNGYQFWVPRVNCTGSAGNDRIPRTKEGIVLLISMSVFVGSVLALGAIVSAKPLDDLRYKGWNGDPKILGSPYTSSVFLGWAMASAIGLVVTSVLPIISWFATYRFSLSSAIFIGLFAVILVAFCGVSYLEVIKTRDDQVPTNGDFLAALLPLVCIPAVLSLCCGLLKWKDDDWKLSRGVYIFVIIGLLLLLGAISALIVVVKPWTIGVAFLLVLLLMVLAIGAIHHWASNNFYLSRTQMVFVCFLAFLLALAAFLVGWFEGKPFVGASVGYFSFLFLLAGRALTVLLSNPIVVYSPRVLPVYVYDAHADCGKNVSVAFLMLYGIALATEGWGVVASLKIYPPFAGAAVSAITLVVSFGFAVSRPCLTLKMMEDAVHFLGKETVIQAIARSATK

SEQ ID NO: 194419 - protein, 593 aa, Glycine max
  Coding DNA Sequence Number=SeqID_77641
  Gene Ontology: Mol. function=cysteine-type endopeptidase activity; Cellular component=intracellular; Biological process=proteolysis
  Homolog annotation: Hit_ID=Q6SSJ2; Match level="QueryCoverage=90%, HitCoverage=24%, E-value=0.0, Identity=69%"; Hit description =Phytocalpain
MIYSQEAVLYRLDMKRAVAILLLLAVALLCAYELCAVYVTTGSRASDRYSPSGFFFGVSAIALAINMLFICRMVFNGNGLDVDEYVRRAYKFAYSDCIEVGPVACLPEPPDPNELYPRQSRRASHLVLLYLGSLCVLLVYSILYGLTAKEENWLGAITSVAVIILDWNLGACLYGFQLLDSRVAALFIAGTSRVFLICFGVHYWYLGHCISYAVMASVLLGAAVSRHWSATNPLAARRDALQSTVVRLREGFRRKEHNSSSSFSEGCGSSMKRSSSVEAGNLGNVIEAGRAMAAGDGSNWNNVLSQTTSLPDGINSDKSIDSGRSSLALHSSSCRSVVHEPEVGTSSDDRNLDHNNSLVVCSSSGLDSQGNDSSASNSANQQTLDLNLALAFQESLNDPRIATMLKSRTRQGDRELSSLLQDKGLDPNFAMMLKEKSLELDPTILALLQRSSMDADRDHNENTDNTSVDNAMPNQISLSEELRLHGLEKWLQLCRLVLHHITGTPERAWVLFSFIFILETIIVAIFRPKTIKIINATHQQFEFGLAVLLLSPVICSIMAFLRSLTAEEMSMTSKPRKEVLLFFIKFLVLMRLF

SEQ ID NO: 194420 - protein, 157 aa, Glycine max
  Coding DNA Sequence Number=SeqID_77642
  Gene Ontology: Mol. function=microtubule motor activity; Cellular component=microtubule associated complex; Biological process =microtubule-based movement
  Homolog annotation: Hit_ID=Q9C7T0; Match level="QueryCoverage=96%, HitCoverage=15%, E-value=7e-48, Identity=54%"; Hit description =Kinesin, putative; 56847-62063
  Pfam annotation: Domain name=Kinesin; Domain location=2-157; Score= -71.4; E_value=9.7e-10; Accession=PF00225.13; Description=Kinesin motor domain
MALDFESMKDGDLTIMSNGAPKKTFKFDVVFGPQAEQADIFKDTTPFATSVLEGFNVCIFAYGQTGTGKTFTIEGTKEAQGVNFRTLEKMFDIIKERHKLYCYNISEIIQEQLQKGLVEAHVNNMTEVWEVLQTGSNARAVSSTNSNEHSIRSQWSA

SEQ ID NO: 194421 - protein, 323 aa, Glycine max
  Coding DNA Sequence Number=SeqID_77643
  Gene Ontology: Mol. function=oxidoreductase activity; Cellular component=membrane; Biological process=electron transport
  Homolog annotation: Hit_ID=Q8LF37; Match level="QueryCoverage=90%, HitCoverage=62%, E-value=1e-116, Identity=67%"; Hit description =Cytochrome P450, putative
  Pfam annotation: Domain name=p450; Domain location=1-321; Score= -30.1; E_value=1.3e-09; Accession=PF00067.12; Description=Cytochrome P450
MALNFVFICWFLINFLVTGVLHYCMVMYFSFNIGILSVFGHLEDNYRDQLKENYCIVEKGYNSFPNRIPGTVYSKALLARRRIREIISEIICKRKEQRLMEMDLLGHLLNYKDEKEQTLSDDQIADNVIGVLFAAQDTTASVLTWILKYLHDDQKLLEAIKADQMAVYEANEGGKKPLTWGQTRNMPTTHRVILESLRMSSIISFTFREAVVDVVYKGYLIPKGWKVMPLFRNIHHNPEFHPSPHNFDPSRFEVAPKPNTFTPFGNGVHSCPGNELAKLNMFILIHHLVTKYRWEVVGYQNGIQHSPFPVPLHGLPTRFWRNE

SEQ ID NO: 194422 - protein, 276 aa, Glycine max
  Coding DNA Sequence Number=SeqID_77644
  Gene Ontology: Mol. function=sequence-specific DNA binding; Cellular component=endoplasmic reticulum; Biological process=lipid biosynthetic process
  Homolog annotation: Hit_ID=Q9LJK3; Match level="QueryCoverage=86%, HitCoverage=81%, E-value=6e-96, Identity=66%"; Hit description=LAG1 longevity assurance homolog 2
  Pfam annotation: Domain name=LAG1; Domain location=73-276; Score =326.3; E_value=5.4e-95; Accession=PF03798.6; Description=Longevity -assurance protein (LAG1)
MAFYMAEFWPSTIFHHPPLITLVIVAVIRLAIRILTKGRAPLHITKEMQVKIGKCSESMWKLTYYATVEAFILKITYQEPWFSNTKLYFNDWPNHELKSPLVLYYMCQCGFYIYSIAAILTWETRRKDFAVMFTHHVITVLLIGISYLTSFFRVGSIILALHDASDVFMEAAKVFKYSGREFGASVCFGFFAVSWLILRLIFFPFWVIKATSIDLQQVLNLSEGFHMFLYYVFNTMLIMLLIFHIYWWKLICAMILRQLKNRGKVGEDIRSDSDDD

SEQ ID NO: 194423 - protein, 1057 aa, Glycine max
  Coding DNA Sequence Number=SeqID_77645
  Gene Ontology: Mol. function=cysteine-type endopeptidase activity; Cellular component=intracellular; Biological process=proteolysis
  Homolog annotation: Hit_ID=Q6SSJ2; Match level="QueryCoverage=95%, HitCoverage=46%, E-value=0.0, Identity=76%"; Hit description =Phytocalpain
  Pfam annotation: Domain name=Calpain_III; Domain location=874-1011; Score=-34.2; E_value=0.00021; Accession=PF01067.12; Description =Calpain large subunit, domain III
  Pfam annotation: Domain name=Peptidase_C2; Domain location=571-872; Score=271.9; E_value=1.3e-78; Accession=PF00648.11; Description =Calpain family cysteine protease
  Pfam module annotation: Pfam domain module=Calpain_III::Peptidase_C2; Domain location=874-1011::571-872
  Subcellular localization annotation: CTP_CleavageSite=56; ConfidenceScore=5.02e-01
TRNALSGTYSAPQRSASSAALLIGDPTIMRDRAGNFVLPRADVMKLRDRLRNEELVAGSFFSRLRYHRTFRHEPTSDVDHRRVMCAHARILALEEAIDTEWVYMWDKFGGYLLLLLGLTSKAERAQDEVRLRLFLDSIGFSDLSAKKIKKWMPEDRRQFEIIQESYIREKEMEEEVFMQRREEEGRGKERRKALLEKEERKWKEIEASLLSSIPNASSREAAAMAAAVRAVGGDSVLDDSFARERVSSIARRIRASQLSRRALQTGVAGAICVLDDEPTASGRHCGPIDSSLCQSQKVSFSIALMIQPESGPVCLLGTEFQKKICWEILVAGSEQGIEAGQVGLRLITKGDRQTTVAKEWSISATSIADGRWHIVTMSIDADLGEATCYLDGGFDGYQNGLPLCVGSSIWEQGTEVWVGVRPPTDIDAFGRSDSEGVESKMHIMDAFLWGRCLTDDEVSSLYTSMASADFGALDFPEDNWQWADSPSRVDGWDSDPADVDLYDRDDVDWDGQYSSGRKRRSERDGMVVDIDSFSRKYRKPRIETQEEINQRMLSVELAIKEALYARGETRFTDQEFPPNDHSLFVDPANPPAKLQVVSEWLRPGEIGRQNHLDCRPCLFSGAPNPSDVCQGRLGDCWFLSAVAVLAEVSRISEVIITPDYNEEGIYTVRFCVQGEWIPVVVDDWIPCELPGKPAFATSKKAYELWVSILEKAYAKLHGSYEALEGGLVQDALVDLTGGAGEEIDMRSGEAQIDLASGRLWSQLLRFKQEGFLLGAGSPSGSDVHISSSGIVQGHAYSILQVRDVDGHKLVQIRNPWANEVEWNGPWSDSSPEWTDRIKHKLKHVPQSKDGIFWMSWQDFQIHFRSIYICRIYPSEMRHSVHGQWRGYSAGGCQDYDTWNQNPQFRLTATGQDASFPIHVFITLTQGVGFSRTTAGFRNYQSSHDSQMFYIGMRILKTRGRRAAFNIYLHESVGGTDYVNSREISCEMVLEPEPKGYTIVPTTIHPGIAYMYLVLLISFSAWVLGGSCTCTAGALLRTIGIEILFLGEMMASVREMDE

SEQ ID NO: 194424 - protein, 201 aa, Glycine max
  Coding DNA Sequence Number=SeqID_77646
  Subcellular localization annotation: CTP_CleavageSite=88; ConfidenceScore=5.49e-01
MGKNKGRQSHSAAKQIMVKGTTSGSGKSQTSATSGLAGCLDVVQANQNAYTASQDNLVGKVLVKKAGTSSAKTDDVTHQVFDNLSECSAESESSPEVSCTLGDNDSTTDDDSSHSCGSKSSLQLDDNKAPTPWVNLFKDNRSPSKGFGMKFSPPPSDDKVLLEEIDLQPLEEAWGHSLIGYVAGRFPRKKALLDCWPKWGV

SEQ ID NO: 194425 - protein, 103 aa, Glycine max
  Coding DNA Sequence Number=SeqID_77647
MVVAAGADGAGAVAGEGAGPRWRATCASSVPTPNAPLGTQWNVLGAILDMGDLLGVDLRDQFFAEADEVEAGRHRGIRNHDRQAGRWDRPYGISSRHHGYHND

SEQ ID NO: 194426 - protein, 123 aa, Glycine max
  Coding DNA Sequence Number=SeqID_77648
  Gene Ontology: Mol. function=microtubule motor activity; Cellular component=microtubule associated complex; Biological process =microtubule-based movement
  Homolog annotation: Hit_ID=Q2QM62; Match level="QueryCoverage=93%, HitCoverage=11%, E-value=5e-23, Identity=49%"; Hit description =Kinesin motor protein, putative, expressed
MEAKFKRLKRDFDSQRKKLTETRRELGEIKRENQQKSRECQEAWNSLKELQNELMCKSMHVGSLAFAIEGQVKDKSKWFSSLRNFTRKLKIMKMEHIKLLEEAEASKKYQADMREMGLIIKSK

SEQ ID NO: 194427 - protein, 158 aa, Glycine max
  Coding DNA Sequence Number=SeqID_77649
  Homolog annotation: Hit_ID=Q1SU11; Match level="QueryCoverage=31%, HitCoverage=7%, E-value=2e-12, Identity=72%"; Hit description=KH, type 1
  Pfam annotation: Domain name=KH_1; Domain location=36-95; Score=34.0; E_value=5.1e-07; Accession=PF00013.19; Description=KH domain
  Pfam annotation: Domain name=KH_2; Domain location=36-86; Score=8.3; E_value=0.012; Accession=PF07650.7; Description=KH domain
  Pfam module annotation: Pfam domain module=KH_1::KH_2; Domain location=36-95::36-86
MKFPLWTPRTRLVRGCWSLGRSNLRCCDMFAKGFKWERLLILTAQVGCVLGKGGSVIKRMTAESGAQIRILPKDKVPVVFCSAFFAERGFTEKLIADINTAATNNGYDDSILKPFQEAKGVCTKKNTKLAASSVSTDVSSSHDDVGPKLAKELSNKDG

SEQ ID NO: 194428 - protein, 373 aa, Glycine max
  Coding DNA Sequence Number=SeqID_77650
  Gene Ontology: Mol. function=ATPase activity, coupled to transmembrane movement of substances; Cellular component=integral to membrane; Biological process=auxin mediated signaling pathway
  Homolog annotation: Hit_ID=Q9ZR72; Match level="QueryCoverage=92%, HitCoverage=17%, E-value=9e-55, Identity=55%"; Hit description =Multidrug resistance protein 1
MGRDQKSVVAMVGQERKTNKKNGSLGFRSIFMHADGKDLFLMVLGTIGAVGEGLATPLVLYISSRMMNNIGISSNMDGNTFIHNINKNAVAWLYLAGASFGVCFLEGYCWTRTSERQAARMRCSTSEIITSVSSDSLVIQDVLSEKKKENSKRRKDDHNLTKKTKDKKLCLKTSVQVIYVPADDLTVRLYVIRKLNWLLSMIHIECIYDCWGKQDAIELRKLDLCMHFTSWWWGLLYGLLHGQYAFYLEAVLNQDIQFFDTEVRTSDIVFVINTDAIMVQDAISEKLGNFIHYMATFVSGFVVGFTAVWQLALVTLAVVPMIAVIGGIHTVTLAKLSGKSQEALSQAGNIVEQGRLQSILKLRNFVNCNFRVY

SEQ ID NO: 194429 - protein, 477 aa, Glycine max
  Coding DNA Sequence Number=SeqID_77651
  Gene Ontology: Mol. function=transferase activity, transferring glycosyl groups; Cellular component=cytoplasm; Biological process =metabolic process
  Homolog annotation: Hit_ID=Q9M6E7; Match level="QueryCoverage=97%, HitCoverage=97%, E-value=1e-128, Identity=48%"; Hit description=UDP -glucose:salicylic acid glucosyltransferase
  Pfam annotation: Domain name=UDPGT; Domain location=9-477; Score= -47.2; E_value=3e-08; Accession=PF00201.9; Description=UDP -glucoronosyl and UDP-glucosyl transferase
  Subcellular localization annotation: CTP_CleavageSite=38; ConfidenceScore=5.17e-01
MEERVSGCSHVLMVPYPSQGHINPMLQFSKRLSTKGVRVTMVTTIFISKSMHLQSSSLLGNVQLDFISDGCDQGGFGQAGSVSTYLSRMQEIGSNNLRELIKKYNSSDHPIDCVVYDPLVIWVLDVAKEFGLFGAAFFTQMCAVNYIYYHVYHGLLKVPISSPPISIQGLPLLDLRDTPAFVYDPGFYPAYFDLVMNQFSNIHKADIILVNSFYKLEEQLGLVGQHHHDYFFWPALVVDSMSKLCPILMIGPTVPSFHLDKAVPNDTDNVLNLFQVDSSAISWLRQKPAGSVIYISFGSMVCFSSQQMEEIALGLMATGFNFLWVIPDLERKNLPKELGEEINACGRGLIVNWTPQLEVLSNHAVGCFFTHCGWNSTLEALCLGVPMVALPQWTDQPTNAKFVEDVWKVGIRVKENENGIVTREEVENCIRVVMEKDLGREMRINAKKWKELAIEAVSQGGTSDNNINEFINNLKRS

SEQ ID NO: 194430 - protein, 779 aa, Glycine max
  Coding DNA Sequence Number=SeqID_77652
  Gene Ontology: Mol. function=protein serine/threonine kinase activity; Cellular component=membrane; Biological process=protein amino acid phosphorylation
  Homolog annotation: Hit_ID=Q17U57; Match level="QueryCoverage=99%, HitCoverage=99%, E-value=1e-170, Identity=44%"; Hit description =Receptor protein kinase, putative
  Pfam annotation: Domain name=B_lectin; Domain location=78-194; Score =87.7; E_value=3.5e-23; Accession=PF01453.15; Description=D-mannose binding lectin
  Pfam annotation: Domain name=Pkinase; Domain location=466-737; Score =157.3; E_value=4.1e-44; Accession=PF00069.15; Description=Protein kinase domain
  Pfam annotation: Domain name=Pkinase_Tyr; Domain location=466-737; Score=122.6; E_value=1.1e-33; Accession=PF07714.7; Description =Protein tyrosine kinase
  Pfam module annotation: Pfam domain module=B_lectin::Pkinase::Pkinase_ Tyr; Domain location=78-194::466-737::466-737
MVICYKQLGEYHFFLVLLLISVQCVIAANNILKPGDTLNTRSQLCSENNIYCMDFSPLNTNPIVNYTHLSISDNRKDDNSAVWVANRNQPVDKHSAVLMLNHSGVLKIESSKDAKPIILFSSPQPLNNNNTEAKLLDTGNFVVQQLHPNGTNTVLWQSFDYPTDTLLPGMKLGVNHKTGHNWSLVSWLAVSDPRIGAFRFEWEPIRRELIIKERGRLSWTSGELRNNNGSIHNTKYTIVSNDDESYFTITTTSSNEQELIMWEVLETGRLIDRNKEAIARADMCYGYNTDGGCQKWEEIPTCRHSGDAFETREVYVSMNMLNNLGNSSYGPSDCRDICWENCACNGYRNYYDGGTGCTFLHWNSTEEANFASGGETFHILVNNTHHKGTKKWIWITVAVVVPFVICAFILFLALKKRKHLFEEKKRNRMETGMLDSAIKDLEDEFKKRQNLKVFKYTSVLSATNDFSPENKLGQGGFGPVYKGILPTGQEAAIKRLSKTSRQGVVEFKNELMLICELQHMNLVQLLGCCIHEEERILIYEYMPNKSLDFYLFEDCTRSKLLDWKKRFNIIEGISQGLLYLHKYSRLKVIHRDLKASNILLDENMNPKISDFGLARMFEEQESTTTTSRIIGTYGYMSPEYAMEGIVSVKSDVYSFGVLVLEIISGRRNTSFNDDRPMNLIGHAWELWNQGVPLQLMDPSLNDLFDLNEVTRCIHIGLICVEKYANDRPTMSQIISMLTNESVVVPLPRKPAFYVEREILLRKASSKELCTNSTDEITIT

SEQ ID NO: 194431 - protein, 753 aa, Glycine max
  Coding DNA Sequence Number=SeqID_77653
  Gene Ontology: Mol. function=calcium ion binding; Cellular component =integral to membrane
  Homolog annotation: Hit_ID=Q6K1Y0; Match level="QueryCoverage=91%, HitCoverage=89%, E-value=0.0, Identity=60%"; Hit description =Putative leucine zipper-EF-hand containing transmembrane protein 1
  Pfam annotation: Domain name=LETM1; Domain location=215-485; Score =515.9; E_value=4.4e-152; Accession=PF07766.3; Description=LETM1-like protein
  Subcellular localization annotation: CTP_CleavageSite=22; ConfidenceScore=5.18e-01
MASRAILRRRRSLIHQYLNNCFASSSPSPSNRSLEFAIATTSPLFPCKHGTTPYRDGLFHRFGLGQLVPRFGSAVPLDGFSGLNAPIGVRWLSQSAAAAAKRHEPDENDETVAKKRKEASPEECDQAVEGLTTAKAKAMAKRAQEESQKDVQSVLRRVWTAFLGIGPALRAVASMSRNCGVVAAIAICCCRLKYETVKCLFVGDLAFREDWAKKLVHWKGEFVSTLQHYWLGSKLLWADVRISSRLLLKLAGGRSLSRRERQQLTRTTADIFRLVPFAVFIIVPFMELLLPVFLKLFPNMLPSTFQDKMKEQEALKRRLKARIEYARFLQDTVKEMAKEVQNSRSGELKKTAEDLDEFLNTIRRGATVSNEEILGFAKLFNDELTLDNISRPRLVNMCKYMGISPFGTDAYLRYMLRKHLRRIKEDDKLIQAEGVDSLSEDELQEDCRERGMLGMLSVEEMRQQLRDWLDLSLNHSVPSSLLILSRSFTVSGRLKPEEAVQATLSSLPDEVVDTIQVTSLPSEDSVSERRRKLEFLEMQEELIKEEEEREEVVQRMESSSSQDDKALKEMNVSTAKEAHQLARDRAFENKEQLCELSRALAVLASASIELYNSMVEEEGPNGKKDAFKAYKAAREEHEHTNELDEGDKVSSALIGRVDAMLQNLEKEIDDVDAKIGDRWRLLDRDYDGKVTPEEVASAAMYLKDTLGKEGIQELVSSLSKDRDGKILVEDIVKLGSWREDGNAHEDDETRERL

SEQ ID NO: 194432 - protein, 279 aa, Glycine max
  Coding DNA Sequence Number=SeqID_77654
  Gene Ontology: Mol. function=acetolactate synthase activity; Cellular component=chloroplast; Biological process=branched chain family amino acid biosynthetic process
  Homolog annotation: Hit_ID=Q9FFF4; Match level="QueryCoverage=55%, HitCoverage=81%, E-value=2e-64, Identity=63%"; Hit description =Acetolactate synthase-like protein
  Pfam annotation: Domain name=ACT; Domain location=128-192; Score =50.5; E_value=5.5e-12; Accession=PF01842.15; Description=ACT domain
  Subcellular localization annotation: CTP_CleavageSite=2; ConfidenceScore=5.03e-01
MVTRKKKHDRTKARLTLTDTLTLTLPVPPPPPPPPLLSLSEWQPFYLQSKPSNSVLPIPNLSSLPNRLPSPHLSPSAPINSLSSSPPPPPPPPSPPTALPLLPPLLAQSTSSYSVPFHSVLCVRVRRHTISVFVGDESGMINRIAGVFARRGYNIESLAVGLNEDRALFTIVVSGTDKVLRQVMEQLQKLVNVLKVEDLSREPQVERELMLIKVHADPKHHAELKWLVDIFRAKIVDISQHSVTIEVTGDPGKMAAVQRNFSKFGIKEIARTGKVGKFN

SEQ ID NO: 194433 - protein, 67 aa, Glycine max
  Coding DNA Sequence Number=SeqID_77655
  Homolog annotation: Hit_ID=Q153F8; Match level="QueryCoverage=70%, HitCoverage=13%, E-value=1e-18, Identity=89%"; Hit description =Pectin acetylesterase
MARDTFNDVGRGCPSLLVTRRNQMLNAIKGFSRSPQNGLFINSCFAHCQSERQDTWFADNSPVIGNK

SEQ ID NO: 194434 - protein, 83 aa, Glycine max
  Coding DNA Sequence Number=SeqID_77656
  Gene Ontology: Mol. function=small conjugating protein ligase activity; Cellular component=proteasome complex (sensu Eukaryota); Biological process=protein modification process
  Homolog annotation: Hit_ID=Q5YJR0; Match level="QueryCoverage=97%, HitCoverage=58%, E-value=2e-37, Identity=90%"; Hit description =Ubiquitin-conjugating enzyme 9
  Pfam annotation: Domain name=UQ_con; Domain location=1-77; Score =65.5; E_value=1.7e-16; Accession=PF00179.16; Description=Ubiquitin -conjugating enzyme
MVSFRTKVFHPNINSNGSICLDILKEQWSAALTISKVLLSICSLLTDPNPDDPLVPEIAQMYKTNRAKYEATARSWTEKYAMG

SEQ ID NO: 194435 - protein, 111 aa, Glycine max
  Coding DNA Sequence Number=SeqID_77657
  Gene Ontology: Mol. function=DNA binding; Biological process=DNA integration
  Homolog annotation: Hit_ID=Q1RVB5; Match level="QueryCoverage=82%, HitCoverage=7%, E-value=3e-30, Identity=70%"; Hit description =Peptidase, cysteine peptidase active site; Zinc finger, CCHC-type; Peptidase aspartic, ...
  Homolog annotation: Hit description=catalytic; Polynucleotidyl transferase, Ribonuclease H fold
MVFVNRNVVFGENELETLYSDCVMVIHDVYYPLIEKGEPSTFQKAMNSSVASLWMIAMPEEMEVFHRNKTWELVEFPKGRKAIGCKWVYKINDDNNQVEKYHARLVVKGYA

SEQ ID NO: 194436 - protein, 45 aa, Glycine max
  Coding DNA Sequence Number=SeqID_77658
MILDPNRQLFQTMGIARATGEIKDIASATGEIKDIASGADKIMQL

SEQ ID NO: 194437 - protein, 189 aa, Glycine max
  Coding DNA Sequence Number=SeqID_77659
  Gene Ontology: Mol. function=sequence-specific DNA binding; Cellular component=nucleus; Biological process=regulation of transcription, DNA-dependent
  Homolog annotation: Hit_ID=Q8LLR1; Match level="QueryCoverage=99%, HitCoverage=88%, E-value=1e-74, Identity=71%"; Hit description=MADS -box protein 3
  Pfam annotation: Domain name=K-box; Domain location=69-161; Score =81.4; E_value=2.8e-21; Accession=PF01486.8; Description=K-box region
  Pfam annotation: Domain name=SRF-TF; Domain location=9-59; Score =121.5; E_value=2.4e-33; Accession=PF00319.9; Description=SRF-type transcription factor (DNA-binding and dimerisation domain)
  Pfam module annotation: Pfam domain module=K-box::SRF-TF; Domain location=69-161::9-59
MGRGRVELKRIENKINRQVTFSKRRNGLLKKAYELSVLCDAEVALIIFSSRGKLYEFGSVGTTKTIERYHRSSFTPQDEHVECETQSWYQEVSKLKAKYDSLQRTQRHLLGEDLGPLNIKELQNLEKQLEGALAQARQRKLEAEGFNLKAMESLLSSTSEAGNSGFHFQQPPQTNPMDYQQAEPFLQIG

SEQ ID NO: 194438 - protein, 349 aa, Glycine max
  Coding DNA Sequence Number=SeqID_77660
  Gene Ontology: Mol. function=nucleic acid binding; Cellular component= intracellular; Biological process=DNA integration
  Homolog annotation: Hit_ID=Q1T6H5; Match level="QueryCoverage=82%, HitCoverage=66%, E-value=2e-61, Identity=39%"; Hit description =Integrase, catalytic region; Zinc finger, CCHC-type; Peptidase aspartic, catalytic
  Pfam annotation: Domain name=zf-CCHC; Domain location=107-124; Score =14.5; E_value=0.0041; Accession=PF00098.13; Description=Zinc knuckle
  Subcellular localization annotation: CTP_CleavageSite=78; ConfidenceScore=5.18e-01
MDSLNLVQTLINGGVCVPGHRQASLIVKTVSVGNPPFFLGNLPGALVHGLQSFFQSAVLYKRKNKEERLENSKQVEALTMTRGKSTKCGSSGSQNHGRSKSQRRKNLKCYNYGMKRHLKKDCWHKKSGGENSGVSTSQGCVAITSDNADVLCNEVAIGSRGGRQLHDCWILDLVLPNLKCIMVLYAQFKGWNLESSEEGNLVMMKVEKIIANLYMLLGDTLQEADASVITSQEEATMMWHCRLGHIKQHRLKFAKATAKSKKILDLIHFDVWELPKVSLGRAKIKCLRTNNGGEYVDDNFLIFYKQDDIVRQFSVLHTPQQNGVVEQMNMTLMDKTRVMLRTIELPKSF

SEQ ID NO: 194439 - protein, 65 aa, Glycine max
  Coding DNA Sequence Number=SeqID_77661
MVKKQTSPTSGSMRVAKERMRDLMRCVSLKSGKSVREIRVLGFECELRFGSCVNRGRKLVEIVGV

SEQ ID NO: 194440 - protein, 188 aa, Glycine max
  Coding DNA Sequence Number=SeqID_77662
  Gene Ontology: Mol. function=acetolactate synthase activity; Cellular component=chloroplast; Biological process=branched chain family amino acid biosynthetic process
  Homolog annotation: Hit_ID=Q6K1X7; Match level="QueryCoverage=99%, HitCoverage=100%, E-value=8e-67, Identity=67%"; Hit description =Putative acetolactate synthase small subunit
LNIVTGVFARRGYNIQSLAVGHAEVEGLSRLTTVVPGTDESISKLVQQLYKLVELHEVRDITHLPFAERELMLIKIAVNAAARRDVLDIASIFRAKAVDVSGHTITLELTGDLDKMVALQRLLEPYGICEPVLDQQFSADPASYHQFKASAVLNMLSDNWLVARTGRIALVRESGVDSKYLRGYSYPL

SEQ ID NO: 194441 - protein, 57 aa, Glycine max
  Coding DNA Sequence Number=SeqID_77663
  Subcellular localization annotation: CTP_CleavageSite=48; ConfidenceScore=5.07e-01
MATTTKMMMKVGSGDGGANSSSGIMVVAEKARCACSRGGMVKAIMVVVVMERWRWRR

SEQ ID NO: 194442 - protein, 88 aa, Glycine max
  Coding DNA Sequence Number=SeqID_77664
  Gene Ontology: Mol. function=Rab GDP-dissociation inhibitor activity; Cellular component=cytoplasm; Biological process=regulation of GTPase activity
  Homolog annotation: Hit_ID=O22402; Match level="QueryCoverage=93%, HitCoverage=18%, E-value=1e-41, Identity=97%"; Hit description=GDP dissociation inhibitor
  Pfam annotation: Domain name=GDI; Domain location=1-88; Score=-278.4; E_value=0.034; Accession=PF00996.9; Description=GDP dissociation inhibitor
LYAESLARFQGGSPYIYPLYGLGELPQAFARLSAVYGGTYMLNKPECKVEFDEEGKVVGVTSEGETAKCKKVVCDPSYLPGKVLETNL

SEQ ID NO: 194443 - protein, 73 aa, Glycine max
  Coding DNA Sequence Number=SeqID_77665
MEYKYYQMATFHVGGSSSGISWCFEDKPIIRDNVEEFSDNDQEDAVPDEVDTEKDTKDVNMSSFFHNFNRQSS

SEQ ID NO: 194444 - protein, 87 aa, Glycine max
  Coding DNA Sequence Number=SeqID_77666
MFATYSTTPPSAYNPTSLMDCYHPTLPTQMRNTNDYKDDGDEDNNNNDGSSLRASNDGDDTTTKGAQPTQRGHRPREQQAEPTQQQQ

SEQ ID NO: 194445 - protein, 199 aa, Glycine max
  Coding DNA Sequence Number=SeqID_77667
  Gene Ontology: Mol. function=zinc ion binding
MTLEDVVVQLGLPIDGEVITSISSGDLVAWCEPLLGYLPPTGCASGNMIKLSWLNNEFQQLPNDVDKVAFAQHTQAHILSLIGGLLMQNTISSWVHLMYLLLLLDLHSVQFLWTPYSKVELSCLINVKVSPITCAFVPLICFTIVELHQANRVMRQFGFRQHIPLDPLNTDILHKEDMRGRINRYWPQYISPRMDCYME

SEQ ID NO: 194446 - protein, 250 aa, Glycine max
  Coding DNA Sequence Number=SeqID_77668
  Gene Ontology: Mol. function=oxidoreductase activity; Biological process=metabolic process
  Homolog annotation: Hit_ID=Q1SZJ6; Match level="QueryCoverage=99%, HitCoverage=55%, E-value=1e-53, Identity=79%"; Hit description =Alcohol dehydrogenase superfamily, zinc-containing; Short-chain dehydrogenase/reductase SDR
  Pfam annotation: Domain name=ADH_N; Domain location=131-202; Score =25.7; E_value=2.3e-06; Accession=PF08240.2; Description=Alcohol dehydrogenase GroES-like domain
AGISSSVPFRDDQTDGTRTWRYTVNVNFTAVIDSTRLAIKIMEASKRPGVIINLGSASGLYPMVADPIYSGSKGGVVMFSRSLRLYKRQGIRVNVLCPEYYNAKSLVQFVETEMGNKIDPKIINLSGGFVPMEMVVKGRYFGGNNNDVVSRLPFDAGFEAVGIIAAVGDSVTDLKVGMPCAFMTFGGYAEFLMIPSKHALPVPRPDPEVVAMLTSGLTASIALEKAGQMESGKVVLVTAAAGGTGQFAVQ

SEQ ID NO: 194447 - protein, 111 aa, Glycine max
  Coding DNA Sequence Number=SeqID_77669
MPRQAQGDAHQAADAPPPPRQADPAGSLGMEHYLQHLVCQQAANHRGQGQGSAPFACPTSEQFGAEVAWSGDWPEARAGEEPAGSPGEAEEARMDEDMTDFLGFLGGSGAM

SEQ ID NO: 194448 - protein, 56 aa, Glycine max
  Coding DNA Sequence Number=SeqID_77670
RVSCSTVSDSSFLGDPIVPFSEGKDENSHPGSRFMQLRDKGNVPHYFHDTHATMMI

SEQ ID NO: 194449 - protein, 85 aa, Glycine max
  Coding DNA Sequence Number=SeqID_77671
  Gene Ontology: Mol. function=DNA binding; Cellular component=nucleus; Biological process=regulation of transcription
  Homolog annotation: Hit_ID=Q10S98; Match level="QueryCoverage=95%, HitCoverage=20%, E-value=2e-25, Identity=70%"; Hit description=Myb -like DNA-binding domain, SHAQKYF class family protein, expressed
  Pfam annotation: Domain name=Myb_DNA-binding; Domain location=20-71; Score=45.1; E_value=2.3e-10; Accession=PF00249.21; Description=Myb -like DNA-binding domain
MGSCGREGVVRQYIRSKVPRLRWTPELHRCFVYAIETLGGHHKATPKLVLQLMDVKGLTISHVKSHLQMYRSMKGDSCRQGTERC

SEQ ID NO: 194450 - protein, 215 aa, Glycine max
  Coding DNA Sequence Number=SeqID_77672
MDRTSTQHRKQSFQKHDEASDVGFHSCFKFIRKESDSLSGYSNFSSKRTRIEKTSLLSGILQCSQRICEADPNPYTTFYDYLQSMAKEKGIKKICVGSIWQQTQPLSTTFHMLTKQESDLLQVAKLNDKQPLNEVGNTWRKGLGAENEDIGGCELSLSITLPQPHPSSQKSNTSSVSETSEAFSLCPEFSNNVIMGCSSSSNVPKTINLDLSLAI

SEQ ID NO: 194451 - protein, 255 aa, Glycine max
  Coding DNA Sequence Number=SeqID_77673
  Gene Ontology: Mol. function=DNA binding; Biological process =regulation of transcription
  Homolog annotation: Hit_ID=Q8H883; Match level="QueryCoverage=92%, HitCoverage=45%, E-value=3e-74, Identity=55%"; Hit description =Putataive InsB from Escherichia coli
MVTNDYSLENILNEAAMQDRTVILTTLNEAWAATNSIIDLFLESFRIGDRTRRLLNHLVIIALDQKAFMRCQAIHTYCYLLVNEATDFHKEAYFMTPSYLKMMWRRIDFLRSVLEMGYNFVFTDVDIMWFRDPFPWFHRDADFQIACDHFTGSFDDVQNRPNGGFNFVKSNNRSIEFYKFWYSSRETYPGYHDQDVLNFIKVDPFITELGLKMIFLDTANFGGLCEPTSILSSIIMVHQKRVFKRIEVVMAYVNY

SEQ ID NO: 194452 - protein, 73 aa, Glycine max
  Coding DNA Sequence Number=SeqID_77674
MSHAFWLDIYNLQVPGNAFLVTEENKVTFELYIIEDSDLQASEVISIYQVPQLPHPKWNNKLQEVTNPKFIKS

SEQ ID NO: 194453 - protein, 73 aa, Glycine max
  Coding DNA Sequence Number=SeqID_77675
MHILKAFEPRKPNLDNNYKGLIKSDRDNTLKLRRGAEEENEEGPEEACSGVDAVGCDGAEGRCAASVTTERRE

SEQ ID NO: 194454 - protein, 123 aa, Glycine max
  Coding DNA Sequence Number=SeqID_77676
  Gene Ontology: Mol. function=caspase activity; Biological process =proteolysis
  Homolog annotation: Hit_ID=Q108Y0; Match level="QueryCoverage=62%, HitCoverage=9%, E-value=8e-16, Identity=48%"; Hit description=ICE -like protease p20 domain containing protein, expressed
MKLVVFYHFGHGLQQSEYYKGDEIDRLDEPICPDDFMRERMISENNINSTIVQPLKKGAHSHAIIDACHGGKTIDLMHLCQKENGSAGKKLAESIIKEKLAVANACSRSEAIPPEWAEAEQIS

SEQ ID NO: 194455 - protein, 157 aa, Glycine max
  Coding DNA Sequence Number=SeqID_77677
  Gene Ontology: Mol. function=nucleic acid binding; Cellular component= intracellular; Biological process=chromatin modification
  Homolog annotation: Hit_ID=Q8GYC1; Match level="QueryCoverage=82%, HitCoverage=25%, E-value=1e-62, Identity=84%"; Hit description =Putative C2H2-type zinc finger protein
  Pfam annotation: Domain name=RS4NT; Domain location=88-125; Score =17.8; E_value=0.015; Accession=PF08071.2; Description=RS4NT (NUC023) domain
  Pfam annotation: Domain name=zf-C2H2; Domain location=103-125; Score =20.5; E_value=0.0061; Accession=PF00096.16; Description=Zinc finger, C2H2 type
  Pfam annotation: Domain name=zf-C2H2; Domain location=27-49; Score =26.0; E_value=0.00013; Accession=PF00096.16; Description=Zinc finger, C2H2 type
  Pfam module annotation: Pfam domain module=RS4NT::zf-C2H2::zf-C2H2; Domain location=88-125::103-125::27-49
METCVYADPDAEVIALSPKTLMATNRFICEVCNKGFQREQNLQLHRRGHNLPWKLKQKTNKEPKRKVYLCPEPTCVHHDPSRALGDLTGIKKHYSRKHGEKKWKCDKCSKKYAVQSDWKAHSKTCGREYRCDCGTLFSSCYHVTENWCHDHIGRKKY

SEQ ID NO: 194456 - protein, 61 aa, Glycine max
  Coding DNA Sequence Number=SeqID_77678
MLGAYQYIYAINAEKENWMVKVEVIRLWSIPSLNASKAHFSLEMALMDEEGGKTHASVKKT

SEQ ID NO: 194457 - protein, 98 aa, Glycine max
  Coding DNA Sequence Number=SeqID_77679
MYHFSNMCASFIIDPTYDHFRARHKRLPFITNNTIYDLYKLDEDTFEDRVRLTHESQVIEAIALETGAVEEVALKQAKEEVALKQLNWMPTMPKSIKF

SEQ ID NO: 194458 - protein, 165 aa, Glycine max
  Coding DNA Sequence Number=SeqID_77680
MDPSSSLPPSLHLAIAALLGASFMALSAFYIHRHTVDHVLHRLVELRRKPLATSDDEDDDGEAETDADLRNYLGALSRSVDDSSNVLRSYRISSSMPNVVSATDWFGEDAKTSSLENLQFVPSGLPSLRTGSKNGESAQISSCSYKRISSVGRIMTLRSTGAYHV

SEQ ID NO: 194459 - protein, 68 aa, Glycine max
  Coding DNA Sequence Number=SeqID_77681
  Subcellular localization annotation: CTP_CleavageSite=54; ConfidenceScore=5.14e-01
MRLIFYLKWHLHSSFSFSILLQSDLKKQRNPLMKKIQGLQAPHRATSSGNQSTRASSVEGSCPKYEKP

SEQ ID NO: 194460 - protein, 111 aa, Glycine max
  Coding DNA Sequence Number=SeqID_77682
  Gene Ontology: Mol. function=protein binding; Cellular component =histone deacetylase complex; Biological process=regulation of transcription, DNA-dependent
  Homolog annotation: Hit_ID=Q6ZH90; Match level="QueryCoverage=68%, HitCoverage=50%, E-value=3e-32, Identity=83%"; Hit description =Putative P18
  Pfam annotation: Domain name=SAP18; Domain location=28-111; Score =109.1; E_value=1.3e-29; Accession=PF06487.3; Description=Sin3 associated polypeptide p18 (SAP18)
MTTWKSVASASERPSSLSLLLGTHRSRKVTIIQTCPLLLRVFTKIGSHHSMEDFAVRGKEPEDEVQIYTWKDATLRELTDLVKEVAPAARRRNAKLSFAFIFPDKNGRFKR

SEQ ID NO: 194461 - protein, 366 aa, Glycine max
  Coding DNA Sequence Number=SeqID_77683
  Gene Ontology: Mol. function=protein disulfide oxidoreductase activity; Biological process=intracellular signaling cascade
  Homolog annotation: Hit_ID=Q67UI1; Match level="QueryCoverage=45%, HitCoverage=23%, E-value=8e-23, Identity=35%"; Hit description =Glutaredoxin-related-like protein
  Pfam annotation: Domain name=Glutaredoxin; Domain location=168-227; Score=72.3; E_value=1.5e-18; Accession=PF00462.14; Description =Glutaredoxin
MGSEESGTEIQNPTHTQTQQHSNPTNVSSPENHANGYQHVTANNNDTEITSHHGGEHAQSDRQVTLVVHPHSLLPMPVPPQSFKVSHNDVVSLNDSNFSVGSFLRQRSSDLSAAIVKRVSSLRQSMEENNDNDIDGEENREVTEFNLSGVKVTVTPKPEKETSIKGRISFFSKSNCRDCTAVRRFFKEKGIKYVEINVDVFGERERELRERTGSGSVPQIFFNEKLIGGLVALNSLRNSGEFDRRVAEIVAGKVAGGDAPAPPVFGFDYVEEERADEMVGVARVLRLRLPIQDRLRRMKMVKNCFEGNELVEALLQHFHCSRNEYLINFNRHDFVVSLLKKIASDILNCTMLKKIASDILNCTIKC

SEQ ID NO: 194462 - protein, 320 aa, Glycine max
  Coding DNA Sequence Number=SeqID_77684
  Gene Ontology: Mol. function=AMP deaminase activity; Cellular component=integral to membrane; Biological process=purine ribonucleoside monophosphate biosynthetic process
  Homolog annotation: Hit_ID=Q84NP7; Match level="QueryCoverage=73%, HitCoverage=32%, E-value=7e-86, Identity=60%"; Hit description =Probable AMP deaminase
MKLQGLNSNVCNLPAIPFRVEDANNEKNQMYREASKEVKAGADMNGHGITDSTSVHVAGDDLVFVNNVLSARNTVNETTNIEEEEVYKMIRECLDLRKKYVYKDVPWKTEPVETNSDPYHFEPVEATAHHFRMEDGVIHVFASKTDTDELFPVASSTRFFTDMHYILKVMSIGNKFRLHLLLNADREFLAQKGAPHRDFYNIRKVDTHIHHSACMNQKHLVVIFRDGKYMMLKEVFESLDLTGYDLNVDLLDVHADNSTFHRFDKFNLMYNPCGQSRLREIFLKQDNLIQGCLQPPKFTGRFLAEVRKEVLTDLEASKYQ

SEQ ID NO: 194463 - protein, 310 aa, Glycine max
  Coding DNA Sequence Number=SeqID_77685
  Gene Ontology: Mol. function=protein disulfide oxidoreductase activity; Cellular component=intracellular; Biological process =intracellular signaling cascade
  Homolog annotation: Hit_ID=Q67UI1; Match level="QueryCoverage=91%, HitCoverage=40%, E-value=3e-70, Identity=46%"; Hit description =Glutaredoxin-related-like protein
  Pfam annotation: Domain name=DUF547; Domain location=99-238; Score =193.7; E_value=4.4e-55; Accession=PF04784.5; Description=Protein of unknown function, DUF547
MYVHCILYYTPKSSQLLSLFGNDFEEGNHLYRFLEHEPFIPRCFNFRGTTNDTEPKTADSICARLTKIMSAILESYASDDRQHVDYEAISRSEEFRRYVNLTQDLQRVNLLELSENEKLAFFLNLYNAMVIHAVISVGCQEGVIDRRSFLSDFQYLVGGHPYSLNLIKNGILRCNRRSPYSLVKPFSTRDKRLEVALIKLNPLLHFGLCNGTKSSPNVRFFTPHRVVDELRGAAREFFEKDGIEVDLEKRTVYLTRIFKWFSGDFGQEKEILLWIINYLDPNKAGLVTHLMGDSGPVHISYQNYDWSINS

SEQ ID NO: 194464 - protein, 45 aa, Glycine max
  Coding DNA Sequence Number=SeqID_77686
MWDPGIRYDGVIPAQSLRAVEDCQRGRFANGEDEALMDRHVAIRK

SEQ ID NO: 194465 - protein, 70 aa, Glycine max
  Coding DNA Sequence Number=SeqID_77687
  Homolog annotation: Hit_ID=Q2R1C3; Match level="QueryCoverage=78%, HitCoverage=8%, E-value=9e-09, Identity=46%"; Hit description=HAT family dimerisation domain containing protein
  Pfam annotation: Domain name=zf-C2HC_plant; Domain location=21-68; Score=9.7; E_value=0.0029; Accession=PF07567.3; Description=Protein of unknown function, DUF1544
MAKMSASSPSQAKEQDDDTKPLWTYVTSVGGGGNYEIKCNICDFIFNGSFTRVRAHLLKMTGKGVRVCQK

SEQ ID NO: 194466 - protein, 725 aa, Glycine max
  Coding DNA Sequence Number=SeqID_77688
  Gene Ontology: Mol. function=transferase activity, transferring hexosyl groups; Cellular component=integral to membrane; Biological process=carbohydrate biosynthetic process
  Homolog annotation: Hit_ID=Q9M3Y6; Match level="QueryCoverage=82%, HitCoverage=99%, E-value=0.0, Identity=80%"; Hit description=68 kDa protein
  Pfam annotation: Domain name=Glyco_transf_8; Domain location=373-699; Score=384.7; E_value=1.4e-112; Accession=PF01501.10; Description =Glycosyl transferase family 8
MGKNKNRALPNNQGIGGFQRWMPEEWDWGTVKGNVGSNRDGNIKDQAKQQNTCFKQLSLEEIQKKRMKGLCFAYDEKLSPNHVCKNKNLKILMLEEVEPVKPGEMVVNEDYISAVPSKQVLDVIVSSTNDLGPFSLDNFRKKLSASWRVGLGTSNARHELNQQTTHVRLEKPEVKEGRSSGDSLPQWTDSSAQQTRRHLIEKRREKRAAELVKKDNEVIVKLENTAIERSKSVESAILGKYNIWRKEIENENVDSTVRLMRDQIIMARVYLSIAKMKNKVELYEELIYRLKESQHALGDAVSDADLHRSTHGKIKAMGQVLSKAREQLYDCNLVTGKLRAMLQTADDQVRSLKKQSTFLSQLAAKTIPNGIHCLSLRLTIDYYLLPPEKRKFPGSENLENPSLYHYALFSDNVLAASVVVNSTIMNAKVTWTVFLTIPDPSKHVFHLVTDKLNFGAMNMWFLLNPPEKATIHVENVDDFRWLNSSYCPVLRQLESATLKEFYFKAGHPNSLSSGASNLKYRNPKYLSMLNHLRFYLPQVYPKLDKILFLDDDIVVQKDLTGLWTVDLNGKVNGAVETCGPSFHRFDKYLNFSNPHIARNFDPHACGWAYGMNMFDLKVWKKKDITGIYHKWQNMNEDRVLWKLGTLPPGLITFYGLTHPLDKSWHVLGLGYNPSLDRSEIENAAVVHYNGNMKPWLEIAMTKYRSYWTKYVKYNHPYLRNCKLNE

SEQ ID NO: 194467 - protein, 49 aa, Glycine max
  Coding DNA Sequence Number=SeqID_77689
MQYLGSDHRSSPNEQWSYPNEINIENAVSEEVILGRPPNEQWATNVQNR

SEQ ID NO: 194468 - protein, 134 aa, Glycine max
  Coding DNA Sequence Number=SeqID_77690
  Gene Ontology: Mol. function=zinc ion binding; Cellular component =intracellular; Biological process=regulation of transcription, DNA -dependent
  Homolog annotation: Hit_ID=Q9ZTK7; Match level="QueryCoverage=97%, HitCoverage=40%, E-value=3e-32, Identity=54%"; Hit description =CONSTANS-like protein 2
  Subcellular localization annotation: CTP_CleavageSite=61; ConfidenceScore=5.74e-01
MPLLPCTVAPTRHSSAAPMTLRFMPPTSSCCTTRVSRSARSASRRDACDLQGRRCRSLPLSASPVTAIFTMPTPSPAATSASLSCRSSSSFTQSRPPRRSTSTTASSLTSTLTLTSAPRRLRPRRGYYLIRRQI

SEQ ID NO: 194469 - protein, 225 aa, Glycine max
  Coding DNA Sequence Number=SeqID_77691
  Subcellular localization annotation: CTP_CleavageSite=56; ConfidenceScore=5.33e-01
MTSLHHHHTTASPSSSDLSNTCPKPSPITGFEQNYPASQPLPRLHPYPKSCKQPSLSSSVWAFLESSNPKPPHSKSHPHTSQTRPPLVLRCILFKVGPTLFMDETKVAIEDLNHDKGEANVDGGGCLAHAVLARGVHGDAGGGVRELRLAGLGFLRGRGENGDEGGMRSWGRWWRWGEGGERTLGRGEMEMEKKNMKKKKKKHSAITCGTEEDESCQLAFFFLLT

SEQ ID NO: 194470 - protein, 75 aa, Glycine max
  Coding DNA Sequence Number=SeqID_77692
MLLDAGVNALPPLNWTPPEDRGVGTELGYFGKSPNTLALAISLVIHLFATNESGGNHFEGDTTICCAIFKELGSG

SEQ ID NO: 194471 - protein, 205 aa, Glycine max
  Coding DNA Sequence Number=SeqID_77693
  Gene Ontology: Mol. function=two-component response regulator activity; Cellular component=nucleus; Biological process=two -component signal transduction system (phosphorelay)
  Homolog annotation: Hit_ID=Q948L2; Match level="QueryCoverage=82%, HitCoverage=26%, E-value=3e-24, Identity=39%"; Hit description =Response regulator 10
ITFSDAPLALNYVRENKGCVDVILIEVHMPNMDGFQFLHRVGKEINVPVIMQYAVMSHDDATSALMKAVTHGASDYWIKPLHQNQFRILRKLVARKLRIENNPPRKDNSDFASFIVDATMSVPKKRSSNSKEFDFYESDDCYAPPAKEHRVVWSEELHQEFVNAVMQIGLDSMIISSFHMIIFFVGIPIHEYMSDIIVCHLKFSP

SEQ ID NO: 194472 - protein, 760 aa, Glycine max
  Coding DNA Sequence Number=SeqID_77694
  Homolog annotation: Hit_ID=Q9LJL0; Match level="QueryCoverage=93%, HitCoverage=42%, E-value=1e-116, Identity=38%"; Hit description =Arabidopsis thaliana genomic DNA, chromosome 3, P1 clone: MVI11
MVKEGSIGYLLIKMPWSGKGCEVEVNGLEIVVSPCTDKMSTSEGETCGLDDSDNQHLKSSMRTEHEVLDDAQKSTSMDVHEGVKTIAKMIKWLLTSFHVTITNIIVAFDPSLDNEENKTHCRHSLVLQISEIQCGTSLSEDANSNVDVLGISRLTNFVKFRGAVIELLKIDNEDVYFQHESGAGCGEPVLGSNIATCPIMTGNQGGFSGNIKLSIPWKNGSLDVCKVDADVCVDPIVLKFQPSTIRWLLQSWETLKNLNKGGKGCTNHNSRGSAQLNSTLFCHSSTSVSITNAPSEMMTANGSLTADYTSLTQPETLAEDLLPAAHLISNWVPLSTHINPKDGIQEPDFGASVDQFFECFDGMRNSQSALGSSGMWNWTYSVYSAITAASSLASGSLHIPSEQQHMETNLRATFAGISVVLSFCVDEQNNFSDPEIGHKVGLQIDYLGAECNDIVIALQVCPQGMTLNGKVKHVEVANFLNIGIDAKNQSALVQHLQAKVLDALPSSTSYNVDSHSLIGPVATDFPFGNNDCLLKVTLFRTFGVTNCKCSTQSSSSDGCQKGMTSFSLNLPPFIFWVIFSVINVLLNLIKEVEKSLEMHNKVKEILSEVSDYKCGSSQSDMKEGSGPCVTSFSTTECLHGDISISNARVILCFPFGRDRDHKNSFSWEQFIALDFTSLSPLNKGCTPDYSQTSNASSKKRFPSVAAQSFQLSFYDLDIYLITSRGSSDCERYGRLEISNSTRDDSKLIISHACPSISSCE

SEQ ID NO: 194473 - protein, 102 aa, Glycine max
  Coding DNA Sequence Number=SeqID_77695
MAELCEISGGHVLAVGPQEGLQVLPQEETGPVHPRRNRPRPARRSTLAGHYSALRSRAQRRLRQLKGLGIGGVNIDDLSEGGSPGSRQASWIKEWFPDSAVT

SEQ ID NO: 194474 - protein, 195 aa, Glycine max
  Coding DNA Sequence Number=SeqID_77696
MKSLSSVGLGLSIIFGCLLLALVAEVYYLLWWKKRITNREIENNYGNPVKELFYMFCWKRPSSSSLRQTSFTPPEFCSSMRIGDTLVHDPEQVQSQSGKEFVFKPFGEDGTDAEYMRQQDLLLLGPPRFLFTIVEESKEDLESDDGKSKCDKSGKGSRGRSLGDLLVVETPYMTPTTSPPFFTPPFTTPISPLTN

SEQ ID NO: 194475 - protein, 173 aa, Glycine max
  Coding DNA Sequence Number=SeqID_77697
MTAILDRGFLLFSFDASKRADGVSSIFDSVLEGPQKGFNLLECNHFSNLEHTGGTGSSWMRGFPPTTDSLVWIGQTQPSRTRNSSTIGTLSGKSIKKDNSFSKMKMVWGMPRVSSPNYNQIQKNLDAEQSNGDPWKTIVAADPFKSRKLEKVVVVVVVEAFKRRLHGGQSWDI

SEQ ID NO: 194476 - protein, 73 aa, Glycine max
  Coding DNA Sequence Number=SeqID_77698
MTRRRQLWWHILSDRGKGSNCGGGDFQTEIPWRTILGYLKQGGADIFSKCNLYRTTHELGSYLASDAYVSYDP

SEQ ID NO: 194477 - protein, 366 aa, Glycine max
  Coding DNA Sequence Number=SeqID_77699
  Gene Ontology: Mol. function=protein serine/threonine kinase activity; Biological process=protein amino acid phosphorylation
MSSNSGAVKGREFPLPRCPCPSSNSNAPSLDLWSQIVAAETPRPERIDVVYRRRHPRNPQNHANSYLHFHSIIFLLLYFIFIFFKGFTETVFLFDRFSRKPPDSAIPRPPRQSLADPNKRVSWNRSLSTRGRTSIAVGAFMVYQPQLKKDKRKGKPALPKGKVVQPPNVDKERIYFQEVDAYELLEESPSPKKSTWTIGNMTQQEPIPAVCSRLEKWLHSRRLNPFCGPSSTLSKILDTPSTRLETIRDIDFGASDLKTLERTDRSNSLLHTIKTEEKETSIENGSHLQTNEKMLFAQSGEGCEDIEAGVKKLSLVSTSSSIDDDHINPFSVLLSICGQSAPSVLQDIFSRYWIVPYFQVTCYLSL

SEQ ID NO: 194478 - protein, 160 aa, Glycine max
  Coding DNA Sequence Number=SeqID_77700
MVGYTPSSFTDLVFASKKVEVDLKRGKFNNPAWMNEKTGANKEGEDEGETHPVTAIPVRPSFPPTQQCLYSANNKPSPYPPPSYPQRPSLNQPQSLSTALSMTKTTFSTNQKHQQKGILQQKTCRVHPKFRCHMLNLIPYPLDNSMVAITPTKVPQPPFF

SEQ ID NO: 194479 - protein, 135 aa, Glycine max
  Coding DNA Sequence Number=SeqID_77701
MTEGCGEGFCLANLPGDAFSLWGNFFEAKKQMMADAKFAGLLGLTLLKFFHVPGGRVGGAGLWPRAKFRIGWPPPPPREGRIKATRAESQWIVAARPLCHLQYPVAYLSRLQRILPAARWELRFKASRRANPPHE

SEQ ID NO: 194480 - protein, 68 aa, Glycine max
  Coding DNA Sequence Number=SeqID_77702
MSGFTRNSPQISASPHQLDLAPYASEPYNAQWNAPGLPHDMHMLRSSHILRKMGVVFVIGSAVDRLCG

SEQ ID NO: 194481 - protein, 98 aa, Glycine max
  Coding DNA Sequence Number=SeqID_77703
MATPNAPLGQQWDVPGVIPDMGDLLGVDLCHEFSAEAEEQGRRQRARRNPDRQARRVMGLCYELGLGLWGKVRGYGLGVRVYELVLGLRVYELGLGVM

SEQ ID NO: 194482 - protein, 331 aa, Glycine max
  Coding DNA Sequence Number=SeqID_77704
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=2e-44, Identity=33%"; Hit description= UPI00006A17C9 related cluster
LAFRGLHALTIRGLHVLPFRGLDILTIRGLHVLAFIGLHNLTIIGLHNLPFIGLHALAFRGLPILAFRGLHAIAFRGLHVLTFIKLHALTFRGLHALDFRGLHALAIRGLHILPFRGLDVLATRPGLQRAARRLHDLTFRGLHALTFRGLHVVAIRGLHVLAFRGLHVLTFRGLHVLAFRGLQAFAFRGLCVLTFRGLHALAFRGKHVLAFRGLDTLAFRGLHVLPFIGLHALTFRGLHVLTFIGLHALTFIGLHALTFIGLHALTFRGLHALAFRGLHALAFRGLHALALRGLHVLPFRGLHVITSPSKGYTPCLSKDYTSSPLEGFKPT

SEQ ID NO: 194483 - protein, 76 aa, Glycine max
  Coding DNA Sequence Number=SeqID_77705
MAELINKTQLSPQNNPNVITLAWRLLHIISCLHPTAVILLPRTRYLAPFVVHYVKSRDVPKIKRKQAYAIRESSVM

SEQ ID NO: 194484 - protein, 82 aa, Glycine max
  Coding DNA Sequence Number=SeqID_77706
MPLGGRSASNALKREKEEDPRGFTLAHLRRKPIRPGARGKCPKTIVIVGISPCHQVSVRSTDPWHHSMTLNQESFTWSYTKV

SEQ ID NO: 194485 - protein, 60 aa, Glycine max
  Coding DNA Sequence Number=SeqID_77707
PFAKRKLRAKHIFGHALSRESLALSSPPLHLRLIWSSKLAKAELSPFQFDLNWAKRWPAR

SEQ ID NO: 194486 - protein, 180 aa, Glycine max
  Coding DNA Sequence Number=SeqID_77708
  Gene Ontology: Mol. function=sequence-specific DNA binding; Cellular component=intracellular; Biological process=base-excision repair
  Homolog annotation: Hit_ID=Q1SJY1; Match level="QueryCoverage=68%, HitCoverage=37%, E-value=3e-24, Identity=48%"; Hit description=HhH -GPD
  Pfam annotation: Domain name=HHH; Domain location=94-123; Score=12.6; E_value=0.084; Accession=PF00633.13; Description=Helix-hairpin-helix motif
MTQALSLVREEDCCGFHPLILNLDSINEEVEDSILDQYENMVSLIPIFLNFSLGFDFDERESEEAAMGMAKYIIGTVNALQSKPGGGEEWLCSLRKMELRDVVSTLSTLPDVGPKVVACIALFLLDQHHVVLVDTYVWRGRQGGTLAPTYPQIYFNREQRVAKALDLEMTFKNLKSGWSR

SEQ ID NO: 194487 - protein, 44 aa, Glycine max
  Coding DNA Sequence Number=SeqID_77709
MCTIVEAKRNAKEKLPLRMRTGLQDNDDKHGVHDSTFGCAEKTT

SEQ ID NO: 194488 - protein, 231 aa, Glycine max
  Coding DNA Sequence Number=SeqID_77710
  Gene Ontology: Mol. function=hydrolase activity; Cellular component =membrane; Biological process=metabolic process
  Homolog annotation: Hit_ID=Q67Y53; Match level="QueryCoverage=84%, HitCoverage=75%, E-value=5e-75, Identity=70%"; Hit description=MRNA, , clone: RAFL25-14-B08
  Pfam annotation: Domain name=Hydrolase; Domain location=23-203; Score= 5.8; E_value=0.016; Accession=PF00702.16; Description=haloacid dehalogenase-like hydrolase
  Pfam annotation: Domain name=Hydrolase_3; Domain location=15-226; Score=27.9; E_value=7.4e-09; Accession=PF08282.2; Description =haloacid dehalogenase-like hydrolase
  Pfam annotation: Domain name=S6PP; Domain location=46-231; Score= -99.0; E_value=0.00064; Accession=PF05116.4; Description=Sucrose-6F -phosphate phosphohydrolase
  Pfam module annotation: Pfam domain module=Hydrolase::Hydrolase _3::S6PP; Domain location=23-203::15-226::46-231
MRPASFQMQRKDIWKRKTYLIAYVTLIIDMVVIRTTRGLLVYGRQGREIFRSNLDPNVCREACLYSLENKVPLIAFCEGRCLTLFHDPLVDSLHTIYHEPKAEVMPSVEHLLASADIQTLTRGWNVTLRPYWSDATKGRASVVQAVPYMLEIVPVGTSKGNGVKVLLDHFGVTAKEIMAIGDGENDMEMLELASLGIALSNGSEKTKAVANVIGLSNDEDGAADAIYRYAF

SEQ ID NO: 194489 - protein, 221 aa, Glycine max
  Coding DNA Sequence Number=SeqID_77711
  Gene Ontology: Mol. function=oxidoreductase activity, acting on the CH-OH group of donors, NAD or NADP as acceptor; Cellular component =mitochondrion; Biological process=metabolic process
  Homolog annotation: Hit_ID=Q67Y01; Match level="QueryCoverage=73%, HitCoverage=48%, E-value=1e-48, Identity=58%"; Hit description =Putative glycerate dehydrogenase
  Pfam annotation: Domain name=2-Hacid_dh_C; Domain location=2-146; Score=159.3; E_value=1e-44; Accession=PF02826.9; Description=D -isomer specific 2-hydroxyacid dehyd
ISFVFQLKGKRVGIVGLGKIGKEVAKRLEPFGCRIMYHSRNQKPFISYPFYSKVVELAGNSDVLVLCCPLNEQSRHLINREVMLALGKDGAIVNVGRGALIDEKELVRCLMEDEIRGAGLDVFENEPNVPNELFPLDNVVLSPHAASLTSDGFTEVCELAAEALELFFSTLSGTRCLVSQDHLILRLMTLQDNPFQDGAFALLPKFVRASVQLFMLVLYRG

SEQ ID NO: 194490 - protein, 392 aa, Glycine max
  Coding DNA Sequence Number=SeqID_77712
  Gene Ontology: Mol. function=ATPase activity, coupled to transmembrane movement of ions, phosphorylative mechanism; Cellular component=membrane; Biological process=metabolic process
  Homolog annotation: Hit_ID=Q5JNL2; Match level="QueryCoverage=78%, HitCoverage=48%, E-value=1e-96, Identity=59%"; Hit description =Haloacid dehalogenase-like hydrolase-like
  Pfam annotation: Domain name=UPF0054; Domain location=152-260; Score =77.3; E_value=4.9e-20; Accession=PF02130.7; Description =Uncharacterized protein family UPF0054
  Subcellular localization annotation: CTP_CleavageSite=45; ConfidenceScore=5.66e-01
MARAVTCATQPPHFHRSSGIATSRCGVSLPSKSSLFGRTFHALARCAGEEAATRRRPVAGVRTEQREYRKARRRAPPKSKGKELQLCVEICIEEDLPDDPEILSIAELLRLNVPMAMKLAFDGLKGLGYKTRDTAIRDVGGFDSVELSVLLCNDEFIQKLNKEWRNEDHATDVLSMSQHVPGLKIPILMLGDIIISVETAARQAEERGHTLLDEIRILMHKWKVSWSFIYFSAWVHGLLHLLGFDHEISEEAEVEMEREEDILLKSLDWKGKGLIKSACDAETNSNFYPDSSDDELSKDRKKEGSLRFYKPKFSYIFCDMDGTLLNSKSQISSTTANALREATSRGVKIVIATGKARPAVIDIFKMVDLAGKDGIVSEFSPGVFLQPGCPYM

SEQ ID NO: 194491 - protein, 106 aa, Glycine max
  Coding DNA Sequence Number=SeqID_77713
  Homolog annotation: Hit_ID=Q66NX3; Match level="QueryCoverage=40%, HitCoverage=7%, E-value=5e-07, Identity=55%"; Hit description =Polyphenol oxidase
MNKQVPKNCSRHGSDKYVKFDVHINDDEDNLSEPDQTEFVGTFVNLFHGQGHNIKVTSFKVGISKVLDCLEVEEDDVVLVTLVPKVGKGDVIIGGIKVEFISKYKD

SEQ ID NO: 194492 - protein, 51 aa, Glycine max
  Coding DNA Sequence Number=SeqID_77714
MLRLGGIDGNPVLRGTRRRTTGQETLGTSGWVLLPKTKLDQSRPNPGIVSQ

SEQ ID NO: 194493 - protein, 161 aa, Glycine max
  Coding DNA Sequence Number=SeqID_77715
  Gene Ontology: Mol. function=oxidoreductase activity, acting on the CH-OH group of donors, NAD or NADP as acceptor; Biological process =metabolic process
  Homolog annotation: Hit_ID=O64643; Match level="QueryCoverage=90%, HitCoverage=76%, E-value=5e-19, Identity=41%"; Hit description =Putative glycerate dehydrogenase
  Pfam annotation: Domain name=2-Hacid_dh; Domain location=42-147; Score=-4.8; E_value=0.0046; Accession=PF00389.20; Description=D -isomer specific 2-hydroxyacid dehydr
MANKQHNHNDNNKELQPLLVLGPPFMFPTFEAQNLHNYRFLNAFSSQIPLHQFLAEQNVDPSSIQAILCSPRQKISADAIRLLPSLSLIVTTSNGTRHIDLAECSYRGIQVASIPGDQLAVDVADMTVGLLIDVMWNISAADRHLRKWGPSKPCNLSSGSK

SEQ ID NO: 194494 - protein, 96 aa, Glycine max
  Coding DNA Sequence Number=SeqID_77716
MLTDQVIRKQPSNFPIAVSAIAGNNGERSKNAKEKLTSKKKQKRKEEAFLLITATMAATLGSFTWEEDAESWRGEEEEQRRCRISKKKQKNEEAEA

SEQ ID NO: 194495 - protein, 123 aa, Glycine max
  Coding DNA Sequence Number=SeqID_77717
SKRLKAPPSSGTLVIEDSDDAAEDPTRSMRGQIVEHCWQEIYNEANGSTLFREKLMEELKAPYCEEEYKRLLHDITVRKPVQHHRDLRGGIKIYEKPDLGKSFLGYHVDLAKKIETVRDDHPG

SEQ ID NO: 194496 - protein, 80 aa, Glycine max
  Coding DNA Sequence Number=SeqID_77718
MVVIKHRVSHTRRVKSAVIGVKTKLQGLMLPPLVVDRRRENNEMTKGGECVWVMDVQSYGGLREVQRRQKRIIFGGESGG

SEQ ID NO: 194497 - protein, 192 aa, Glycine max
  Coding DNA Sequence Number=SeqID_77719
MTITLDDVFCLLHLLVRDRSIDHVPSTFDRDTATAAASASARVKLTLLASCVWVAMTYLLHLISNKIFVNKSSSHIHVAYLQYLGSLDACHEYIYGVVALVYHYDHFSYASQYDNKQSWAFVHLSNVGYYEAKKTYDLMDVVIWYPYDSHGVRPFTKQALFSGFIRCKTDMWPYHPKKRHIPLDDFEPLGGP

SEQ ID NO: 194498 - protein, 98 aa, Glycine max
  Coding DNA Sequence Number=SeqID_77720
MESESVVAYCSGDITSSSEEMLFECPSGSKVVTISEDMSLDALRKTYMDAIGEFSSKGPIELNANFGRSPNEILALLHKPSKPRSIDEITVLMRDKSM

SEQ ID NO: 194499 - protein, 158 aa, Glycine max
  Coding DNA Sequence Number=SeqID_77721
  Gene Ontology: Mol. function=transcription factor activity; Cellular component=chloroplast; Biological process=regulation of transcription, DNA-dependent
  Homolog annotation: Hit_ID=O22058; Match level="QueryCoverage=57%, HitCoverage=16%, E-value=2e-24, Identity=55%"; Hit description =Plastid RNA polymerase sigma-subunit precursor
  Pfam annotation: Domain name=Sigma70_r4; Domain location=92-145; Score=79.2; E_value=1.3e-20; Accession=PF04545.6; Description=Sigma -70, region 4
MYVHVGTFTFSESFALPTSRLNCCYCHLRYVISSDQAYLTYVSEQVFGCIFSYPSRVIKHTWGSWELLPDATIESPEDAVMKQHMRKDVHDLLKGLNLRERKILTLRFGLNDNQPRSLQDIGTLFKVSKERIRKIEKKALTKLKNEATISKLHYYLDL

SEQ ID NO: 194500 - protein, 441 aa, Glycine max
  Coding DNA Sequence Number=SeqID_77722
  Gene Ontology: Mol. function=oxidoreductase activity, acting on the CH-OH group of donors, NAD or NADP as acceptor; Biological process =metabolic process
  Homolog annotation: Hit_ID=Q67Y01; Match level="QueryCoverage=72%, HitCoverage=88%, E-value=8e-60, Identity=45%"; Hit description =Putative glycerate dehydrogenase
  Pfam annotation: Domain name=2-Hacid_dh; Domain location=21-275; Score=54.1; E_value=4.6e-13; Accession=PF00389.20; Description=D -isomer specific 2-hydroxyacid dehydr
  Pfam annotation: Domain name=2-Hacid_dh_C; Domain location=129-324; Score=165.8; E_value=1.1e-46; Accession=PF02826.9; Description=D -isomer specific 2-hydroxyacid dehyd
  Pfam module annotation: Pfam domain module=2-Hacid_dh::2-Hacid_dh_C; Domain location=21-275::129-324
MEDQNQCTTRDEQLKNLNLPKVLIHGPPGFSSVLQPPFSQKFHILNHSSLPLHKFAATHAHHCSSVAAVLCDGGYPVTADVLRLLPSLRLLVTASAGTDHVDLEECRRLGVRVAGAGNMFSEDVADLAVGLLIDVMMKISAANRCLRERILVVSRDFPLASIFKFCTTKVEGRAWFGELNVRSKLTGKKVGIVGLGKIGLEVAHRLEAFGCMISYNSRSKKTFVSYPFYSSVVELATNNNVLVLCCALNDQTRHMINREVMLALGKGGIIVNVARGALIYEKELLRCLMEREIGGAGLDVFENEPLVCEEFFSLDNVVLSPHADDFEKFDLWKVFQRWGRVWDIFIAYRRDKGGHRYGFVCFLEVSNVLWLEKQLDTIWIRKLEDCMVGRLREIADFDIAFIGGSEGIEMSYLGDDLILIKGLNVKEVEDMLQQADDSFLQ

SEQ ID NO: 194501 - protein, 692 aa, Glycine max
  Coding DNA Sequence Number=SeqID_77723
  Gene Ontology: Mol. function=nucleotidyltransferase activity
  Homolog annotation: Hit_ID=O64642; Match level="QueryCoverage=94%, HitCoverage=84%, E-value=1e-121, Identity=42%"; Hit description =Expressed protein
  Pfam annotation: Domain name=NTP_transf_2; Domain location=435-521; Score=13.3; E_value=0.0061; Accession=PF01909.13; Description =Nucleotidyltransferase domain
  Pfam annotation: Domain name=PAP_assoc; Domain location=660-692; Score=9.4; E_value=0.0051; Accession=PF03828.9; Description=PAP25A associated domain
  Pfam module annotation: Pfam domain module=NTP_transf_2::PAP_assoc; Domain location=435-521::660-692
MNGGGGDLPPSNGGEFLLSLIQQRPHQPHPHPPPQSPAIDPAVAAIGPTIPVAPPLWQILSADHPHHHHHQPHPHHLPPPWSHSLSSSPLYPPNFFGLPHNAFPPPRTHFPITPNSVANGVNANINLAHDLRNLGFPIEESHNNNNNNNKVDGFVHHHHQQQQQQHELKLQFGSLPTVAYSAAEVSSNGGDSLLNLKFNRVDHPTSNSSGNVVVQGNHDAVERERRGLGGYRAGGSLPPETSRVPPGFGNRTRGKGLEGRNENLYDRREGGRMVSGERSNVRGNVGHKMGLVDQLDRPGPPAGSHLHSGSGNDAGIGEVGGRDGKHKEIGRLRMEGVPESGGGGADVDVLGEQLADSLLVKDESDDRTNLRQRRREKDVRLSDSRGQQIMSQRGRMYRRQMMCRRDIDVFNVPFLAIYGSLIPPEEEKLKQKKLVALLEKLVSKEWPTAKLYLYGSCANSFGVSKSDIDVCLAIEEADMEKSKIIMKLADILQSDNLQNVQGVFGSPVELGGIPTSFGLWANYGTNVQSRALTRARVPIVKLMDPVTGISCDICINNLLAVVNTKLLRDYAHIDPRLRQLAFIIKHWAKSRRVNETYHGTLSSYAYVLMCIHFLQMRRPAILPCLQEMETTYSVTVDDIHCAYFDQVEKLSDFGRHNKESIAQLVRGFFHYWAYCHDYANTVISVRTGSIIR

SEQ ID NO: 194502 - protein, 224 aa, Glycine max
  Coding DNA Sequence Number=SeqID_77724
  Homolog annotation: Hit_ID=Q1RPJ5; Match level="QueryCoverage=36%, HitCoverage=88%, E-value=2e-22, Identity=69%"; Hit description =Transposase 6
  Pfam annotation: Domain name=Transposase_8; Domain location=137-210; Score=18.0; E_value=0.0013; Accession=PF01527.10; Description =Transposase
MFSRSSESYAKHLLYLKDQIKDIERSLNLDGGRYDQITQEIAYVNKTVEDLNSMRNGIIEEEDLSSVIDAISSITSMLFKLQLEKSELHKISILEDKYVEMLNKRENALDKLEGLGFETLEQLKGSTKVRAILAYRSALIIIAVLKYVKAVRAVKYFCCEAGISVASNYNWEAKYSGMEASDIKKMKGLEDENRRLKRMFAELGREYGALKDVIEKSFKTNDKT

SEQ ID NO: 194503 - protein, 283 aa, Glycine max
  Coding DNA Sequence Number=SeqID_77725
  Gene Ontology: Mol. function=oxidoreductase activity; Cellular component=mitochondrion; Biological process=metabolic process
  Homolog annotation: Hit_ID=Q6D3E5; Match level="QueryCoverage=95%, HitCoverage=96%, E-value=1e-127, Identity=76%"; Hit description =Putative dihydrouridine synthase
  Pfam annotation: Domain name=Dus; Domain location=1-271; Score=301.7; E_value=1.4e-87; Accession=PF01207.8; Description=Dihydrouridine synthase (Dus)
MEGVLDSLVRELLSGVNDYDLCVTEFLRVVDQLLPYPEWLAENAARAVELGSWGVDLNCGCPSKLVNGSGGGATLLKDPELIYRGAKAMREAVPAHLPVTVKVRLGWDSGARRFEIADAVQQAGASELVVHGRTKEDGYRAESINWQAIGEIRQRLTIPVIANGEIWNWQDAQDCLRITGCDAVMLGRGALNVPNLGRVVKYNEAPMPWSQVVELLLRYTQLEKQGDTGNYHVARIKQWLGYLRKAYHEADGLFSEIRTLRVSAEIASAIERHAARMAQVSCI

SEQ ID NO: 194504 - protein, 54 aa, Glycine max
  Coding DNA Sequence Number=SeqID_77726
MVFEMSNEDGTPRSLRSSTASWLDRVELDELDSAEIATEGGGGGDVGGDPHLPP

SEQ ID NO: 194505 - protein, 222 aa, Glycine max
  Coding DNA Sequence Number=SeqID_77727
  Gene Ontology: Mol. function=oxidoreductase activity; Biological process=carotenoid biosynthetic process
  Homolog annotation: Hit_ID=Q3BMN3; Match level="QueryCoverage=84%, HitCoverage=40%, E-value=3e-39, Identity=48%"; Hit description =Putative membrane protein
  Pfam annotation: Domain name=DAO; Domain location=17-218; Score= -54.8; E_value=0.026; Accession=PF01266.14; Description=FAD dependent oxidoreductase
MAYNRRMTDSLRNGELDLAIIGGGAAGVLVAIQVLRQAKAPLALAIFEPASQLAQGIAYATPWPEHLLNVPAAKMSAFADQPGDFLDYLMDADAYPGEAREVLGERYVCRHYFAAYLQQRLQDAATASPAQLQVIAQPVLGLQPDDHGYRLQLGEGQTLHAAQAVLATGNSMRPLPVAGADALPADDVIEAWDYDGVRTLAGEQAVAIVGSGLSMADTVLAM

SEQ ID NO: 194506 - protein, 109 aa, Glycine max
  Coding DNA Sequence Number=SeqID_77728
MTRFLRILPISFISDSTPKVFMMYQTNGNVSQNIMVNTMLGHILEISNGGNAQNWVTNVVLKFHDDPTVDESEIVIFLRQVRWHAGKGEGFGRREKKRNCKAEEAEELV

SEQ ID NO: 194507 - protein, 137 aa, Glycine max
  Coding DNA Sequence Number=SeqID_77729
  Gene Ontology: Cellular component=chloroplast
  Homolog annotation: Hit_ID=P03938; Match level="QueryCoverage=59%, HitCoverage=61%, E-value=4e-11, Identity=64%"; Hit description =Hypothetical 14 kDa protein ycf68
MSPHGGDMDGGEKRKERDGVSLAFGIAGPGGRPARRAISSVVERAPDNCVVVPGLRIDGAIQVRSNVDPTFSSLVGSGRSGGDHHGSSLLENSYIPYQYMDSYLSSTGLGLASMEKNGAPNNVSSQTKTTRSPLHSG

SEQ ID NO: 194508 - protein, 61 aa, Glycine max
  Coding DNA Sequence Number=SeqID_77730
MATIELLSGYGIKWSSSLEVRNDIVGFGGKLGRIGMAVTAWVSPSFSPSSFAPVFSVVLVG

SEQ ID NO: 194509 - protein, 128 aa, Glycine max
  Coding DNA Sequence Number=SeqID_77731
TRAQLEVGNRGWWVYACIVDVENLLCTIARPPPSTTCDGVKLPAFIVDHRVVPGDMSRGSGDLGDVRRAPGSQQIKGTKTTKQGGLWWLASCEFCVICGLWPLVIDYQGLENEVRKIREPLVIDYQPV

SEQ ID NO: 194510 - protein, 319 aa, Glycine max
  Coding DNA Sequence Number=SeqID_77732
  Gene Ontology: Mol. function=hydrolase activity; Cellular component =nucleus; Biological process=metabolic process
  Homolog annotation: Hit_ID=O64640; Match level="QueryCoverage=97%, HitCoverage=93%, E-value=2e-66, Identity=41%"; Hit description =Expressed protein
  Pfam annotation: Domain name=Abhydrolase_3; Domain location=77-300; Score=192.7; E_value=9e-55; Accession=PF07859.3; Description =alphabeta hydrolase fold
MSKFDPYTHLGITINPDGTVTRAVKTPTVDANPDPSPGTATVSKDITLDSNKETWVRIFRPTRLPSNDNTVARLPIVIYFHNGGFLFLSPAAPGCHKKCTQIASDFPSIVVSASYRLAPENRLPAMYQDARDAVLWVKEQMNDPNGEQWLKDYGDASRVYIYGCDSGANIAFNVSMQVADLDLDPLRIRGLVINQPMFGGEKRTASELRYATDQTLPLPVLDVMWNLTLPKGTDRDHRYCNPMMKGPHLDNVRKLRKCLVVGYNGDIMVDRQQEFVTMLVKCGVQVEARFDQVGFHNIDMVDVARASSIINIAKDFILG

SEQ ID NO: 194511 - protein, 266 aa, Glycine max
  Coding DNA Sequence Number=SeqID_77733
  Gene Ontology: Mol. function=carboxylesterase activity; Cellular component=nucleus; Biological process=metabolic process
  Homolog annotation: Hit_ID=Q0ZPV6; Match level="QueryCoverage=94%, HitCoverage=86%, E-value=1e-38, Identity=47%"; Hit description=CXE carboxylesterase
  Pfam annotation: Domain name=Abhydrolase_3; Domain location=83-261; Score=62.1; E_value=1.9e-15; Accession=PF07859.3; Description =alphabeta hydrolase fold
  Subcellular localization annotation: CTP_CleavageSite=76; ConfidenceScore=5.25e-01
MSEPPPPSSSAMDPYDFLKIKLNPDGNSLTRNYVVPTVPPSATTPSSEPALSKDIPLNPTTNTSLRLFLPNPPPPSAAKLPLIIYFHGGGFILYHPSSLIFHRSCAALAASLPAIIASVDYRLCPEHRLPAAYHDALEALHWAQAQAQAQAQSDPWLRDYVDFSKTFLMGSSAGGNIAFFTALNSLSLSLSPLKILAPTCRRSHPSVTGERPHVVPLAARGRGSRPRVLQSRRLWITNTATRSDGCRRASSTDTVGIPWWTSRRSW

SEQ ID NO: 194512 - protein, 108 aa, Glycine max
  Coding DNA Sequence Number=SeqID_77734
  Subcellular localization annotation: CTP_CleavageSite=15; ConfidenceScore=5.09e-01
IMASPPGSPPPPPPPSDASSSPPPGAERPVVHVDPATSKADGPHRKKLRTYLGIVACDKVDVTYENWKEVPTTQKDLIWEDIKAEFEIPKASDSRTKKKLLKTVGERL

SEQ ID NO: 194513 - protein, 203 aa, Glycine max
  Coding DNA Sequence Number=SeqID_77735
MSSRKRKSVGSRPTTQYDTWRFHSFEAWTRYTDNVLGRHILAERKVEIYHTKLDEFKGELERRNFHKRLTNLANSSISLALVKEFYANLYSPEGPSPKQVKIQGHLIRIDADNLNAFLETHMVLAKGESLPAYSRYCRMPTDIREIEVALCIPGQGFILNVEGHPGKILRKDLTTLAQVWSVLSYSNLALTSHTSDLTMDRAR

SEQ ID NO: 194514 - protein, 156 aa, Glycine max
  Coding DNA Sequence Number=SeqID_77736
  Gene Ontology: Mol. function=protein serine/threonine kinase activity; Cellular component=integral to membrane; Biological process=protein amino acid phosphorylation
  Homolog annotation: Hit_ID=Q10P10; Match level="QueryCoverage=78%, HitCoverage=18%, E-value=5e-45, Identity=67%"; Hit description =Protein kinase domain containing protein, expressed
MGGGIARIGGTPSMRGTVCYIAPEYGGGGQLSEKCDVYSFGVLLLVLVAGRRPLQVTASPISEFERANLISWARQLAHNGRLLDLVDTSIHSLDKEQALLCVTIALLCLQRSPGKRPSMKEVVGMLSGEAEPPHLPFEFSPSPPSNFPFKARKKAR

SEQ ID NO: 194515 - protein, 94 aa, Glycine max
  Coding DNA Sequence Number=SeqID_77737
MSPRAALPSKGRLQQILMMTPSKFFCLHTPFTPTKSSPKKEDDIEKDCEFQRHRSPPEAPPDAPCGAYRPWIFFINGVHCSLKFNGSGMENEER

SEQ ID NO: 194516 - protein, 392 aa, Glycine max
  Coding DNA Sequence Number=SeqID_77738
  Gene Ontology: Mol. function=protein serine/threonine kinase activity; Cellular component=integral to membrane; Biological process=protein amino acid phosphorylation
  Homolog annotation: Hit_ID=Q9STJ8; Match level="QueryCoverage=94%, HitCoverage=56%, E-value=1e-69, Identity=43%"; Hit description =Receptor kinase-like protein
  Pfam annotation: Domain name=Pkinase; Domain location=75-385; Score =16.2; E_value=1.6e-09; Accession=PF00069.15; Description=Protein kinase domain
  Pfam annotation: Domain name=Pkinase_Tyr; Domain location=75-269; Score=-17.6; E_value=2.2e-11; Accession=PF07714.7; Description =Protein tyrosine kinase
  Pfam module annotation: Pfam domain module=Pkinase::Pkinase_Tyr; Domain location=75-385::75-269
MPSRPPPLSPPATAASHRRQIILCGAIGGALFLTALIISVTIFIYRKLSYSRTAPFEHNQRRFSYSVLRRATNSFSPSTKLGHGGFGSVHKATLPSGQTVALKVMDSPGSLQGEREFHNELTLCSNLKSPFVIALLGFSSDRRGKKLVLVYELMPNRSLQDALLDRRCPELMSWGKRFDIAVSVAMGLEYLHHECDPPVIHGDIKPSNVLLDRDFRAKIGDFGLARVKNVEDLEMVDEKKKDEEFSVLEGESVVDVDRSPESCPVRVAEYSDASPVGGDKLSVVSDGGGCFESVDSGSVSVNVNKKKCGGGGSGRDWWWRQESGGGGESGRVKDYVMEWIGSEIKKEEPKSEWVDSCSSSSPKVENGNENEKNKKKKERKRLDWWASLDEEK

SEQ ID NO: 194517 - protein, 58 aa, Glycine max
  Coding DNA Sequence Number=SeqID_77739
MKLHFSPGELDTSLGKFRVRKQSALGIGRCEVKGVVHSYGKVEGIGVDSRSKWWVLAY

SEQ ID NO: 194518 - protein, 103 aa, Glycine max
  Coding DNA Sequence Number=SeqID_77740
MGPRRSLMTPSHCSHNQKDPPPYCHHQYSPPKWVPNQSDVWARETLSCRSTYPYPGTMGRLLFTITGYALGDCWDCQVGYGCLLFMNVSGGVHSWCSDVVTKA

SEQ ID NO: 194519 - protein, 60 aa, Glycine max
  Coding DNA Sequence Number=SeqID_77741
MMTPPYYLYARLVAIEDLSLLVGEVTSLVMVLSDFESEEEEDPKEDLKETSCGYSSGGFA

SEQ ID NO: 194520 - protein, 66 aa, Glycine max
  Coding DNA Sequence Number=SeqID_77742
  Gene Ontology: Mol. function=catalytic activity; Biological process =metabolic process
  Homolog annotation: Hit_ID=Q8LRT1; Match level="QueryCoverage=64%, HitCoverage=5%, E-value=3e-09, Identity=60%"; Hit description=Acyl -CoA synthetase-like protein
MSTTNSITKCILLLSGQIFWGCGLKREGALPFYKVHYSLVMVVWPQTSGKMFLIFGDLLLRSMVIK

SEQ ID NO: 194521 - protein, 123 aa, Glycine max
  Coding DNA Sequence Number=SeqID_77743
MDCALTLPFNSRHVAELYGLPNDGCPVPRSGQAKAQNDCRNVPFCGRAKAWLTGVFPKEERCTESPPTFICGKRRENRRKPVKMKILSSGVVFTFEEGISTSHVNKSGALAPTYPPSKRKSDL

SEQ ID NO: 194522 - protein, 168 aa, Glycine max
  Coding DNA Sequence Number=SeqID_77744
  Gene Ontology: Mol. function=zinc ion binding
  Homolog annotation: Hit_ID=Q1RWM6; Match level="QueryCoverage=66%, HitCoverage=47%, E-value=5e-20, Identity=39%"; Hit description=Zinc finger, SWIM-type
  Pfam annotation: Domain name=SWIM; Domain location=99-131; Score =29.0; E_value=1.7e-05; Accession=PF04434.8; Description=SWIM zinc finger
MLKFTTVQLVDIEDMKVESSSSTRPNEFEFTTKLDLSNEELDPFSEDEDKVYMEVLNKVIEDTLRKENTHNILEFNRCDTRFLVQETINSREVWPIGDFIVKLDEIWCNCDKFQKLHMPCSHVVATCKHAHPVYMLESVSNVYKGLFEELYNEAYWPLCHEPMISPDP

SEQ ID NO: 194523 - protein, 65 aa, Glycine max
  Coding DNA Sequence Number=SeqID_77745
MPEIKRKQAYAIREFRNVAETKRRWCYAIRPSGTFWKLGCLRRKQLGGKLLHVFEKWFSGLPRLP

SEQ ID NO: 194524 - protein, 230 aa, Glycine max
  Coding DNA Sequence Number=SeqID_77746
  Gene Ontology: Mol. function=phosphopantothenoylcysteine decarboxylase activity; Cellular component=cytosol; Biological process=coenzyme A biosynthetic process
  Homolog annotation: Hit_ID=Q9SWE5; Match level="QueryCoverage=93%, HitCoverage=94%, E-value=1e-89, Identity=71%"; Hit description =Phosphopantothenoylcysteine decarboxylase
  Pfam annotation: Domain name=Flavoprotein; Domain location=23-162; Score=105.8; E_value=1.3e-28; Accession=PF02441.9; Description =Flavoprotein
MAGSEPVSAEGESMAVDAAPRKPRILLAASGSVAAVKFANLCHCFSEWADVRAVSSSGSLHFIDRASMPKDVILYTDEDEWSSWKKLGDSVLHIELRKWADIMVIAPLSANTLGKVSSVNDMCSYPSFGIQFSYIAGGLCDNLLTCIVRAWDYSKPFFVAPAMNTLMWNNPFTERHFISIDELGISLIPPVTKRLACGDYGNGAMAEPSTIYSTVRLFYESKAQQGNGDI

SEQ ID NO: 194525 - protein, 143 aa, Glycine max
  Coding DNA Sequence Number=SeqID_77747
  Subcellular localization annotation: CTP_CleavageSite=61; ConfidenceScore=5.75e-01
MSTLRLMLTPPPMPTLSPMLSLLSMPPPPSMPSLPSMPTTPPCPTTVQPFLAPLATPLPMPAAYLPNLCHTHATVSCNKFFSTVASYGRATTPNDKALEGRNMTLFEIGIEYHGPTMVACKRQPAVFALWMATDLEESCWNRP

SEQ ID NO: 194526 - protein, 46 aa, Glycine max
  Coding DNA Sequence Number=SeqID_77748
MLGAMSQDNLVFEERVPSEGNKEKRRKGYAHNRMDSALWNWQTSRG

SEQ ID NO: 194527 - protein, 42 aa, Glycine max
  Coding DNA Sequence Number=SeqID_77749
MEICNMCSETKTVVKATQKHARLHDPAIPLSNESAQDEKSGG

SEQ ID NO: 194528 - protein, 188 aa, Glycine max
  Coding DNA Sequence Number=SeqID_77750
GYSEVYALEHRQWKINSFLEEYMITLQGMVSGSLILLFMVHWCKSSRYLPLQFPNTPEELLESKFIVEDNQYDSSYGEETDLHLLIDCGVVQQIWKPAQRHSVLPSRWHILFGATIWSIWKGRNSKVFKNNEKLHLEECGLDCPTNGMLKLNVDGSIIQGGRKGCAYGHPDRAEIGLGKGFQECLVGV

SEQ ID NO: 194529 - protein, 307 aa, Glycine max
  Coding DNA Sequence Number=SeqID_77751
MTVWKDYAIQLHDAINKNHMLKEPLIVMLSLGKIQDVTDKYPLSVQNIKYGSRLYVNTDITEIQEFCDSPFSLCVPFYSGRVTDDKGVSQWFQLLFLPKPSELHSSKDATCIKMFGKTAAECREELIVAGDEIKGEASIGKEGVVEPESSPPSYHPTDFRRALGIQEGLVVHFAALDRNTTFHLHFMPPLDRQTSGRPYSTTMTYVFTVDITNRMISTPSPLVLPPYAIDVIGRTSQYLTVEPPRGRQIWRMSAHDGLQTLTTPWYQFLTDNNLMAIDEVVFYYQPNQGVWEIILRKEITWDEDESP

SEQ ID NO: 194530 - protein, 94 aa, Glycine max
  Coding DNA Sequence Number=SeqID_77752
MSPKKNLISQLHTKKGTWKIVVRVTDLWEVRKQNSKQAIDMVLMDQMNLKIVDNQSEYKVSPIALLVYFVKTTSVKEINHPEIPPNVYMITPFC

SEQ ID NO: 194531 - protein, 86 aa, Glycine max
  Coding DNA Sequence Number=SeqID_77753
  Pfam annotation: Domain name=zf-CCHC; Domain location=65-82; Score =20.6; E_value=0.0004; Accession=PF00098.13; Description=Zinc knuckle
MNRVSHIPSSDESEDDNSEGSDVENLNLFVRRFNKIPMKKKNYGTRTFQPKKNLKKGESSSSNGFTCFECKKIGHIKVDCLIYQKK

SEQ ID NO: 194532 - protein, 286 aa, Glycine max
  Coding DNA Sequence Number=SeqID_77754
  Homolog annotation: Hit_ID=Q6EUI5; Match level="QueryCoverage=49%, HitCoverage=4%, E-value=5e-32, Identity=46%"; Hit description =Putative lysosomal trafficking regulator 2
MTPPDILRWFLRNCLRFDFVKSDFSSSENYFLASMEFTVISTNLKTIFRNPKAIKPYAVPSPEHCNLPAAAMHTSSHMVEVVGLNAPAAQVAQHKWQPNTPDGQGTPFFFQHGKATSGSVGGNLTRTFKGPAGTGEEWQYPQALAFSVSGIRSQAIVSITCDKEIITELTFSSSISCMEISVDGRSALIGINSQENGRAHNNSLNSQSSMSGLSKRLTPKDDVFHVLKLKEGQDITALALYKDNTNLLVSTWDKQLIIFTDPALSLKVGDQMLKFGWESNILFFIN

SEQ ID NO: 194533 - protein, 197 aa, Glycine max
  Coding DNA Sequence Number=SeqID_77755
  Gene Ontology: Mol. function=oxidoreductase activity; Cellular component=membrane; Biological process=electron transport
  Homolog annotation: Hit_ID=Q2LAJ8; Match level="QueryCoverage=71%, HitCoverage=41%, E-value=2e-58, Identity=74%"; Hit description =Cytochrome P450 monooxygenase CYP76E3
  Pfam annotation: Domain name=p450; Domain location=1-194; Score= -193.9; E_value=0.038; Accession=PF00067.12; Description=Cytochrome P450
  Subcellular localization annotation: CTP_CleavageSite=31; ConfidenceScore=5.17e-01
MPSTQLGCAWVPSATRRAWVPDAPATTALLVAPVRRARPCVIFTGNAPFGEVNIHLEESHISKLPYLQATGKETFRLHPPTPLLPRKSDVDVEISGFMEPKSAQIMVNVWAMGRDSSIWKNPNQFIPERFLDSEINFKGQHLELIPFGAGRRICTGLPFAYRTVHIVLASLLYNYDWKVADEKKPQDIDISEAFGIT

SEQ ID NO: 194534 - protein, 81 aa, Glycine max
  Coding DNA Sequence Number=SeqID_77756
MDIERDKQTQSTKQPQHMEINKNLKIEVPGEVDSMESRVDIAIGDCKETKVAWEGTKRKKKTQTWIEPLPHKGEKEETKRP

SEQ ID NO: 194535 - protein, 418 aa, Glycine max
  Coding DNA Sequence Number=SeqID_77757
  Gene Ontology: Mol. function=oxidoreductase activity; Cellular component=membrane; Biological process=electron transport
  Homolog annotation: Hit_ID=Q2MJ01; Match level="QueryCoverage=96%, HitCoverage=78%, E-value=0.0, Identity=77%"; Hit description =Cytochrome P450 monooxygenase CYP704G7
  Pfam annotation: Domain name=p450; Domain location=1-412; Score=90.5; E_value=5.3e-24; Accession=PF00067.12; Description=Cytochrome P450
MASILFLQIFVQGLYNYHNLKDLVGDGIFAVDGKKWREQRKLLSHEFSTKMLRDFSISIFRKNAAKLANIVSEAATSNNTLEIQDLLMKSTLDSIFHVAFGTELDSMCGSNQEGKIFADAFDTSSALTLYRYVDVFWKIKKFLNIGSEARLKKNTEVVMEFFFKLINTRIQQMQTSNVDTDGKREDILSRFLQVKGSDSTYLRDIILNFVVAGRDTTAGTLSWFMYMLCKYPSVQEKAAEEVKEATNTETITSYTEFVSTVTDEALEKMNYLHAAITETLRLYPVIPVDAKICFSDDTLPDGYSVNKGDMVSYQPYAMGRMKFIWGNDAEDFRPERWLDENGIFKPESPFKFTAFQAGPRICLGKEYAYRQMKIFSAVLLGCFHFKLNDEKKNVSYKTMITLHIDGGLEIKAFHRYRD

SEQ ID NO: 194536 - protein, 94 aa, Glycine max
  Coding DNA Sequence Number=SeqID_77758
MVGAFSQNIVTLTGLPMILLSESDLTNPLCGVSCYVLLSAPGWFFTDMGVTEGGYECMKGGGRGGTRQWNWRVGHVAAPGGLASGVGELLSTWR

SEQ ID NO: 194537 - protein, 80 aa, Glycine max
  Coding DNA Sequence Number=SeqID_77759
MTEGRKGGRRKGEGAAEGKERSLLQKMGGGSHKAREGRGEKKESHEDIISGGFNLFSVSLTFGNSIGAVGGITERISGNR

SEQ ID NO: 194538 - protein, 746 aa, Glycine max
  Coding DNA Sequence Number=SeqID_77760
  Gene Ontology: Mol. function=nucleic acid binding; Cellular component= intracellular; Biological process=DNA integration
  Homolog annotation: Hit_ID=Q1RXN8; Match level="QueryCoverage=99%, HitCoverage=72%, E-value=0.0, Identity=47%"; Hit description =Peptidase S8 and S53, subtilisin, kexin, sedolisin; Integrase, catalytic region; Zinc finger, CCHC-type
  Pfam annotation: Domain name=rve; Domain location=46-215; Score=58.6; E_value=2e-14; Accession=PF00665.16; Description=Integrase core domain
  Pfam module annotation: Pfam domain module=RVT_2::rve; Domain location=334-505::46-215
YTTKVEDGMMKVSTGASIIAKGSRSNGLYILEGSTVIGQASVASQTMEDKFKLWHLRLGHISEKGLVELEKQHLLMGDKLHKLQFCDQCVMEKSHMVKFGTAETFQKFKEWHTQIENQQGIKLKVLRTDNGLEFVSDQFNTLCTHHGIKRHKTVAGTPKQNGLAERMNRTILERVRCMLLGAGLPKVFWGDAANTVVPADYSNLRVFGALAYVHVKKDKSQGIQAVEEKTHIEVEPLTDKVHENTQINPTTDLDSTTEETGHSASNLRRLDHAINDYQLVRDRERRIPKPNRKLGQADLICYALAAAEEIEGSVELRNFKEAHESEERQLWLHAMEEELEALRKNNTWRLVELPKGQKVVGCKWIFKKKGEIPGVQKTRYKARLVAKGFTQVEGVDYNEIFAPVVAFLHGDLEETIYMRQPKGFAVDDRMEFKRCSYNNCVYVLHQEDYLYLLLYVDDILVASCNKCMINDLKSRLNSEFEMKDLGEARFRMHQSKPVNTPLGQHMKLSKSQGPISDDDRKKMDVVPYTSGVGSIMYGMVCTRPDLAHVVSVVSRFMVEPSQAHWEALKRILRYINGTLDSGLLYQKNSQDGTMIEGFVDADFAGCLDTRKSLSGYVFTLFGTAVSWKSNLQSVVALSTTEVEYNALAEGVKEGIWLKGMLHELGIEQEIIQIHCDSQSAIHLANHQMYHTRTKHIDIKLHFIREVVESGVIKIVKIASKDNPANMLTKSLPRDKFKKCLGLVGFG

SEQ ID NO: 194539 - protein, 159 aa, Glycine max
  Coding DNA Sequence Number=SeqID_77761
  Gene Ontology: Mol. function=nucleic acid binding
MTKQMQRIMRQNNEELYGKFEGIKNQLNRDVGGPNVDRRWQARKGIRYEEGGLRKNRVEGVKLIKVKLVAAEFSKYAVIWWNKYQRERLRDEEPEVDTWAEMRRVMRRYVPTSYSRTVCLELQKLSQGNMSVEEYYKGMEMTLIRANIDEDNEATIVVF

SEQ ID NO: 194540 - protein, 91 aa, Glycine max
  Coding DNA Sequence Number=SeqID_77762
MEESVPNCKKISPYLQFMVLFAKEEKVQVADDSLSKADPLNEWHPLSEAYNSLSRLGNPKKERVKDVLAQRVASQPSEDIVSSCAQCTQSY

SEQ ID NO: 194541 - protein, 134 aa, Glycine max
  Coding DNA Sequence Number=SeqID_77763
  Gene Ontology: Mol. function=RNA-directed DNA polymerase activity; Cellular component=signal recognition particle, endoplasmic reticulum targeting; Biological process=SRP-dependent cotranslational protein targeting to membrane
MHGEITSESLASEGEQEEETEEEALEGDLLIIRRLLGSQMCSINGKLWSLTIDDGSYTNVASFILVSKLNLETKPHPKPFKLQWLSEDEEMMEYKDVLPKEVPNGLPPLKGIEHHIDLIPGPSLPNRPVYTSNP

SEQ ID NO: 194542 - protein, 442 aa, Glycine max
  Coding DNA Sequence Number=SeqID_77764
  Gene Ontology: Mol. function=oxidoreductase activity; Cellular component=membrane; Biological process=electron transport
  Homolog annotation: Hit_ID=Q2MJ01; Match level="QueryCoverage=91%, HitCoverage=79%, E-value=0.0, Identity=81%"; Hit description =Cytochrome P450 monooxygenase CYP704G7
  Pfam annotation: Domain name=p450; Domain location=14-436; Score =139.1; E_value=1.2e-38; Accession=PF00067.12; Description=Cytochrome P450
MTCRSLSKERRGDPEPLAYLLVWRLLKYDALQIFAMGLYNYHNLKDLLGDGIFTVDGEKWREQRKISSHEFSTKMLRDFSISIFRKNVVKLVNIVSEAATSNSTLEIQDLLMKSTLDSIFQVAFGTELDSMCGSSQEGKIFADAFDTSSALTLYRYVDVFWKIKKFLNIGSEAKLRKTTEILNEFVFKLINTRILQMQISKGDSGSKRGDILSRFLQVKEYDPTYLRDIILNFVIAGKDTTAATLSWFMYMLCKYPEVQEKAAEEVKEATNTKRISSYNEFVYSVTDEALERMNYLHAAITETLRLYPAVPVDAKICFSDDTLPDGYSVNKGDMVSYQPYAMGRMKFIWGDDAEDFRPERWLDENGIFKPESPFKFTAFQAGPRICLGKEFAYRQMKIFAAVLLGCFRFKLKDEKKNVTYKTMINLHIDEGLEIKAFNRYRD

SEQ ID NO: 194543 - protein, 126 aa, Glycine max
  Coding DNA Sequence Number=SeqID_77765
MTIEESIHVTFDETNITSSRKEFVDDIADTLEDTQNEEKNLKRKRDDEDKDDQDDTAQENDNLPKEWKTSRNHPLDNCHTLISSGDLCLMICDLSLVLVRCLAPIIRQFVKFQDMPENQKILMHNP

SEQ ID NO: 194544 - protein, 92 aa, Glycine max
  Coding DNA Sequence Number=SeqID_77766
MAKEFVNGFVHQNGIAVITHNPPKAWYLMFFVSSFMQAIPAPCPQVAEDEFLPQHIDLRRFRLHARNLLRTSFYHSTLTSGVSFFFPFFLDI

SEQ ID NO: 194545 - protein, 94 aa, Glycine max
  Coding DNA Sequence Number=SeqID_77767
MALFIKTASLSYPAIPPKAIPAPCPQVVEDEFLPQHMDLRRFRLHARKLLRMSFYRSTLTSASFSLRVFSAMAKEFVNGFVHQNGIAVITRNPP

SEQ ID NO: 194546 - protein, 162 aa, Glycine max
  Coding DNA Sequence Number=SeqID_77768
IPEHKGWVVPVWFRLYNGFYKDSGNLKPQGPTIDADEVMSRETNEVEFMGLGATATIDVEEPSSNTKGKRQGSTSSGTHSHKIEEKEGITTSLDKMANSFDRMVEKMDGKVNDEDIQEVLRETTLIPDLNRQQWAKAIKWLAEDPKQLAIVKALPIREKTDY

SEQ ID NO: 194547 - protein, 121 aa, Glycine max
  Coding DNA Sequence Number=SeqID_77769
EKYQHHRDEILQRSIEEDTSTQDSPNTTINDNEIYLNIVGGPNYKGNVYDLASSTSIALVEDQIEEMRETINKLNAELLAKANKEKTLEEKMLQMMENHDHQSQEMRQQMQQQNEQMQRIL

SEQ ID NO: 194548 - protein, 138 aa, Glycine max
  Coding DNA Sequence Number=SeqID_77770
  Pfam annotation: Domain name=G-patch; Domain location=68-112; Score =10.5; E_value=0.0098; Accession=PF01585.13; Description=G-patch domain
MDINLAYSYLLGHLIIVSGEEDILVSCPSSTPYVEVAEESLETAFQALEVVSNAHVESPQVQLPSSDAALMVARVMLGHGYEPSMGLGWNEDGVASLVEFTGNRGRFRLGYEPTRTDLRRISLERRGRSIGSVARNRK

SEQ ID NO: 194549 - protein, 84 aa, Glycine max
  Coding DNA Sequence Number=SeqID_77771
MMTQKNGKSSPATTPKYLFALWDTTCLCGCEIYQQVHRVVKYLKALGPLTEQIDVIKDVSLIKDVYVFYAEGSSTKHRCLVSLA

SEQ ID NO: 194550 - protein, 87 aa, Glycine max
  Coding DNA Sequence Number=SeqID_77772
MAPTRHPLDPEKSNRALGFPVLITGLFQFYGVHVTPSKVIRPPITRAFIEKYCTPRQVQGDAHQTAGASPPPRQADSAGPLSVEQYL

SEQ ID NO: 194551 - protein, 74 aa, Glycine max
  Coding DNA Sequence Number=SeqID_77773
  Subcellular localization annotation: CTP_CleavageSite=35; ConfidenceScore=5.36e-01
MWLRMPPDPWVTVTKSGVVDKSKAFAPTYPQFVMRNSNLRSSCQLISFLNDHLEETLGPTKIGENHSKCINLTQ

SEQ ID NO: 194552 - protein, 577 aa, Glycine max
  Coding DNA Sequence Number=SeqID_77774
  Gene Ontology: Mol. function=D-alanine-D-alanine ligase activity; Cellular component=cytoplasm; Biological process=peptidoglycan biosynthetic process
  Homolog annotation: Hit_ID=Q6AFK3; Match level="QueryCoverage=45%, HitCoverage=72%, E-value=1e-101, Identity=73%"; Hit description =Glycerol-3-phosphate dehydrogenase [NAD(P)+] (EC 1.1.1.94) (NAD(P)H- dependent ...
  Homolog annotation: Hit description=glycerol-3-phosphate dehydrogenase)
  Pfam annotation: Domain name=ATP-grasp; Domain location=360-546; Score=-18.7; E_value=3.1e-06; Accession=PF02222.12; Description=ATP -grasp domain
  Pfam annotation: Domain name=CPSase_L_D2; Domain location=360-568; Score=-109.7; E_value=0.0034; Accession=PF02786.7; Description =Carbamoyl-phosphate synthase L chain, ATP binding domain
  Pfam annotation: Domain name=Dala_Dala_lig_C; Domain location=360 -572; Score=328.6; E_value=1.1e-95; Accession=PF07478.3; Description =D-ala D-ala ligase C-terminus
  Pfam annotation: Domain name=Dala_Dala_lig_N; Domain location=263 -359; Score=23.2; E_value=9.1e-10; Accession=PF01820.11; Description =D-ala D-ala ligase N-terminus
  Pfam annotation: Domain name=NAD_Gly3P_dh_C; Domain location=75-219; Score=216.2; E_value=7.3e-62; Accession=PF07479.4; Description=NAD -dependent glycerol-3-phosphate deh
  Pfam module annotation: Pfam domain module=ATP-grasp::CPSase_L _D2::Dala_Dala_lig_C::Dala_Dala_lig_N::NAD_Gly3P_dh_C; Domain location=360-546::360-568::360-572::263-359::75-219
MKGVERGTGLRMSQVSEQELRCDPDRIAVASGPNLALEIAREQPTAAVISSRSQETAEIVARAARNGYFRTFVNTDVIGTEFGGVLKNLIAVAIGIVDGVGYGENTKASIITRGLVEMTDFAVANGAHPETLQGLAGLGDLIATCQSPLSRNNTAGRLLGQGYSFQDVVKQMQQTAEGLASVAPILQLARESEVDMPIVEQVKMVLDGKMDPRDIAPHLTTDDDTPQGERTNHGQADGGGALRRALQRAFDQFRNGGGRITREGAFVLEDDDPAKFPLDAEHLPEVVDNGTRVLWPEPGGDRTLRVVRADRSVEDLGAIDVVLPILHGPHGEDGTIQGYFDTLEVPYAGGGVLDSALCMDKHFMKIALQAAGISVAAWVTVRRGEWDTDRESVRTRAAALGLPLFVKPARAGSSVGVSKVGALDELDAALAIAFAEDDKVLIEAGVSGREIEVAVLESADGVRASLPGEIVLTSRGFYDFEGKYLGGDGVDVVCPAELTDIEVAAVQAAGLRAFAAVDGRGLARVDMFLTPSGELVVNELNTMPGFTPISMFPKCWVASGLSYGDLITELVEAGLRR

SEQ ID NO: 194553 - protein, 117 aa, Glycine max
  Coding DNA Sequence Number=SeqID_77775
MTYLPNLHISRAIDTKMVTNRAYPCLTVWDAAKKKDAYDARKFWSQIVWMDSQKAFTSGYDGSDNVVHHKIVQVLHPTRKYHFDDACVCFTKDDDDYSCIQHLLKLPTIQFEGNYNL

SEQ ID NO: 194554 - protein, 148 aa, Glycine max
  Coding DNA Sequence Number=SeqID_77776
MVEVVKVVEVLEPRIMVEVQERQDDIEVEELGCNGILHTEAELLILLSLMFYKGLHWLDNHILNLIKSDGGGILKVWFNFINHNCVGHFTSLVYNSSVSKVNDDPTYNGVIHNFSRCFSLGDGKNFSLSNGSSSNNIFFKSLILLRFI

SEQ ID NO: 194555 - protein, 173 aa, Glycine max
  Coding DNA Sequence Number=SeqID_77777
MALFVDKILVIQSLTHRLILLWSKGELDIAQVEQTSINQVFLLLSIKILRAGLDDFDMVQQLMVHNPEEEEKGLIMKVWVSSGGRKQEDEEEEEEHRLRKLTFEDNAGISTDVENKSFLDGAYINTFLESWISKTLLTLNSRQYFKITSHNIKMITSILGREFLIELAKGLAK

SEQ ID NO: 194556 - protein, 249 aa, Glycine max
  Coding DNA Sequence Number=SeqID_77778
MVEQLKRKKTRTKSQKEEKEEELLVREHMVKKRYKLSIASTLVRPTTTTSVPQRWKDLSETDEEDEDLLQVVLQKRKAVALVSPTPKRDKKVQPASKPWVYVIPSRIQRHIKTRATKSNPRISNKEWAVSFTRNKKDKALSSSGKRFRRVSPREPLKDAQRFPLVFINSNPTPKTPYFEFIYFEPVARETINVQPPTWTKHDSKHTPSKAFKALPKNAIVHLPLPQWTRPMQPNVIKMPPHWLASGTHQ

SEQ ID NO: 194557 - protein, 144 aa, Glycine max; identical to SEQ ID NO: 116941
  Coding DNA Sequence Number=SeqID_77779
  Homolog annotation: Hit_ID=O04892; Match level="QueryCoverage=48%, HitCoverage=13%, E-value=1e-23, Identity=76%"; Hit description =Cytochrome P450 like_TBP

SEQ ID NO: 194558 - protein, 212 aa, Glycine max
  Coding DNA Sequence Number=SeqID_77780
  Gene Ontology: Mol. function=glutaminase activity; Cellular component= cytoplasm; Biological process=glutamine metabolic process
  Homolog annotation: Hit_ID=Q7N7H7; Match level="QueryCoverage=61%, HitCoverage=42%, E-value=2e-48, Identity=72%"; Hit description =Glutaminase
  Pfam annotation: Domain name=Glutaminase; Domain location=82-211; Score=39.2; E_value=4.1e-16; Accession=PF04960.6; Description =Glutaminase
  Subcellular localization annotation: CTP_CleavageSite=44; ConfidenceScore=5.13e-01
ARWHQVRQTSSSSITTVERIGSAGKSWVAIGRNKPGRKSAMQCRLAAACSQNFARWIDAPTANHHDRARISHPGATRCRNSGKVADYIPALAGVDADQLGIAIATADGRSYQAGDAGTRFSIQSISKVLSLTVALTLYEDAEIWERVGKEPSGQAFNSLVQLELEQGKPRNPFINAGALVMCDLLESRLTAPRQRMLEFVRRLAQQPDIQYD

SEQ ID NO: 194559 - protein, 301 aa, Glycine max
  Coding DNA Sequence Number=SeqID_77781
  Gene Ontology: Mol. function=monooxygenase activity; Cellular component=membrane; Biological process=electron transport
  Homolog annotation: Hit_ID=Q1SI93; Match level="QueryCoverage=100%, HitCoverage=59%, E-value=1e-114, Identity=68%"; Hit description=E -class P450, group I
  Pfam annotation: Domain name=p450; Domain location=39-300; Score= -146.1; E_value=0.00025; Accession=PF00067.12; Description=Cytochrome P450
MDSELLSILPPIMSFFLFMIVALKIGSNLKKTESSPNIPPGPWKLPIIGNIHHLVTSAPHRKLRDLAKMYGPLMHLQLGEVFTIIVSSPEYAKEIMKTHDVIFASRPKILASDILCYESTNIVFSPYGNYWRQLRKICTLELFTQKRVNSFQPTREKELTNLVKMVDSHKGSPMNFTEAVLLSIYNIISRAAFGMECKDQEEFISVVKEAVTIGSGFNIGDLFPSAKWLQLVTGLRPKLERLHRQIDRILEGIINEHKQANSKGYSEAKEDLVDVLLKFQDGNDSNQDICLSINNIKAIIL

SEQ ID NO: 194560 - protein, 200 aa, Glycine max
  Coding DNA Sequence Number=SeqID_77782
DRAHKTPSGPKEVQQGPRVSSSGYGPLSVLQGAHPPARSCHCDIGIAPTRHPVDPKKSNRALGFPALVSSLCQSYRVPVPPARSCHRDIGIAPTQTPNGPREVQQGPGGSRPQETQWTRRSPTGSWSCQALITGLCQFYGVPVAPSKVIRPSTNRAFIKKYCVPRQAQGETPQQPGDGRQWATDAPPSLLEFTSAHPQKG

SEQ ID NO: 194561 - protein, 362 aa, Glycine max
  Coding DNA Sequence Number=SeqID_77783
  Gene Ontology: Mol. function=nucleic acid binding; Cellular component= proton-transporting two-sector ATPase complex; Biological process=DNA integration
MTLEEAWSGRKPTVGHFRIFGCIAYAHIPNKKRSRLDDKGEKCIFLGVSDQSKAYKLYNPTTKKIIISRDVFDEERFWENNIDETKQILANFDEDNEDEELQTRELEEQQILAITVEDERPQRVRRRPAWMSDYEELCDLPNGHNTIGVKRVFKTKLNENGEVDKYKARSVAKGYKQQYGVDYIEVFSPVARHDTIRYMENPTEMHLLVAKRILRYLQGTREFELFYKRGEKFNLLGFTDSDYDGDSDDRKKFVAVSACACQTIWLRNLLEEVYFKQQGPTLIYCDNSSTIKLSKNPIMHGRSKHKDVRFHFARDLSNEGIIDLIYCKSEEQIADIMTKPLELSAFQKLRNLLGVCMLNESH

SEQ ID NO: 194562 - protein, 91 aa, Glycine max
  Coding DNA Sequence Number=SeqID_77784
MAKRTLCAKPKCHSDEAELSAPCCEFDEFKEELKRRHWVEKLTDFADSSINIAIVKEFYANLYDPEDKSPKQVRVRDPDNFGGGGEFVYLF

SEQ ID NO: 194563 - protein, 211 aa, Glycine max
  Coding DNA Sequence Number=SeqID_77785
  Gene Ontology: Mol. function=acyltransferase activity; Cellular component=nucleus; Biological process=regulation of transcription, DNA-dependent
  Homolog annotation: Hit_ID=O04201; Match level="QueryCoverage=100%, HitCoverage=43%, E-value=1e-72, Identity=64%"; Hit description =Putative anthocyanin 5-aromatic acyltransferase
  Pfam annotation: Domain name=Transferase; Domain location=7-211; Score=-120.9; E_value=4.2e-05; Accession=PF02458.6; Description =Transferase family
MPSPAPTMLSKCTVFPDQKSTLGNLKLSVSDLPMLSCHYIQKGCLFTHPNLPLHSLIPLLKSALSRTLSLFPPLAGRLITDSHGYLYISCNDAGVDFIHANATGLRICDLLSPLDVPQSFKDFFSFDRKVSYTGHFSPILAVQVTELADGIFIGCAVNHAVTDGTSFWNFFNTFAQFSRGASNCIRNTPDFRRDSFLISDAVLRLPEDGPQ

SEQ ID NO: 194564 - protein, 197 aa, Glycine max
  Coding DNA Sequence Number=SeqID_77786
VDGQNPESPLDLAPLPATHNFSGDAGQFAKLKPRADGPFKVLKRMGENAYKIELPAEYEHVREMPRVPKLADREGGGWRELHLPRGMNSSSRDGWHVSLAGTGFGHRGQAIWLEYYAFLSLDSTRAFPEILIDRMILRPIVPQLGNLPATKLFVWPGASLWALGKQSHLCAVSLQQAYAGSESPKTLLPFPVSLTRS

SEQ ID NO: 194565 - protein, 124 aa, Glycine max
  Coding DNA Sequence Number=SeqID_77787
  Gene Ontology: Mol. function=chitin binding; Cellular component =extracellular region; Biological process=chitin metabolic process
  Homolog annotation: Hit_ID=UPI0000612705; Match level="QueryCoverage =87%, HitCoverage=93%, E-value=8e-13, Identity=30%"; Hit description =UPI0000612705 related cluster
MLSHQGGPLGTSTLSFRGLHVLTFRGLHALAFGGLHALAFKGLHVLAIRGLHVLAFRGLHVLASRGLHVLTFRGLHTLIFRGLYVFPLRGLHVLAFGGQHALAFRGQHVLAFGGQLTPSPLEGY

SEQ ID NO: 194566 - protein, 186 aa, Glycine max
  Coding DNA Sequence Number=SeqID_77788
  Gene Ontology: Cellular component=nucleus; Biological process =transport
  Homolog annotation: Hit_ID=Q94IP9; Match level="QueryCoverage=68%, HitCoverage=18%, E-value=3e-36, Identity=64%"; Hit description=WD-40 repeat protein
  Pfam annotation: Domain name=WD40; Domain location=147-186; Score =20.9; E_value=0.0046; Accession=PF00400.22; Description=WD domain, G- beta repeat
  Pfam annotation: Domain name=WD40; Domain location=72-108; Score =21.1; E_value=0.0041; Accession=PF00400.22; Description=WD domain, G- beta repeat
  Pfam module annotation: Pfam domain module=WD40::WD40; Domain location=147-186::72-108
MASNKRHFTEEDDDPHSFSKKSKESESESDASPSSLRIFLNPADYDLGIHSHFTIILVWDYISGKLKKDLQYQADEVFMMHDDVVLCVDFSTDSEMLSSGSQDGKIKDFRIRIPSSIQITQPPHPVFVPPYSSLIFSGYQVWRIRTGQCLQRLERVHSQGVTSVSFSRDGSQLLITSFDSTARFFI

SEQ ID NO: 194567 - protein, 562 aa, Glycine max
  Coding DNA Sequence Number=SeqID_77789
  Gene Ontology: Mol. function=nucleoside-triphosphatase activity; Cellular component=membrane; Biological process=cell division
  Homolog annotation: Hit_ID=Q6YUV9; Match level="QueryCoverage=72%, HitCoverage=86%, E-value=1e-157, Identity=70%"; Hit description =Transitional endoplasmic reticulum ATPase-like
  Pfam annotation: Domain name=AAA; Domain location=365-550; Score =259.8; E_value=5.7e-75; Accession=PF00004.19; Description=ATPase family associated with various cellular activities (AAA)
  Pfam annotation: Domain name=AAA_3; Domain location=365-491; Score= -17.9; E_value=0.03; Accession=PF07726.2; Description=ATPase family associated with various
  Pfam annotation: Domain name=AAA_5; Domain location=365-497; Score =5.8; E_value=0.00065; Accession=PF07728.4; Description=ATPase family associated with various
  Pfam module annotation: Pfam domain module=AAA::AAA_3::AAA_5; Domain location=365-550::365-491::365-497
MWIYCRPLTKGQRGEVYEVNGDRVAVILDINEDRVNKGEVENLNDDHTKPPIYWIHVKDIENDLDAQSQDCYIAVEALCEVLHHRQPLIVYFPDSSQWLHKAVPKSNRNEFFHKVEEMFDRLSGPIVFICGQNKVQSGSKEKEEFTMILPNFGRVAKLPLSLKRLTEGIKGDKTSEDDEINKLFSNVLSMHPPKDENLLATFKKQLEEDKKIVTSRSNLNVLRKVLEEHQLSCMDLLHVNTDGIFLTKHKAEKVVGWAKNHYLSSCLLPSVKGERLCLPRESLKIEGPGNYVTEAFSKPQGMNLAKDEFESNFISAVVPPGEIGVKFDDIGALEDVKKALNELVILPMRRPELFSRGNLLRPCKGILLFGPPGTGKTLLAKALATEAGANFISITGSTLTSKWFGDAEKLTKALFSFASKLAPVIVFVDEVDSLLGARGGAFEHEATRRMRNEFMAAWDGLRSKENQRILILGATNRPFDLDDAVIRRLPRRIYVDLPDAENRMKILRIFLAQENLNSDFQFDKLANLTDGYSGSDLKNLCIAAAYRPVQELLEEEKKIWML

SEQ ID NO: 194568 - protein, 117 aa, Glycine max
  Coding DNA Sequence Number=SeqID_77790
MDRSRVFVAFVDMNKRLMGLSLAYYSSMMCQWMRHLYQKVKKFNPRPTSQQPYVETNFMMMNQAILMMPKAQVIDSRLQDQASRIQSKIQDSREEIKKQQSDYSLVIDYQLSVIDYQ

SEQ ID NO: 194569 - protein, 435 aa, Glycine max
  Coding DNA Sequence Number=SeqID_77791
MYLRRIQCRDRTWALVLQPLKYFFRPRFSDQRCFQSLSPKTTVKEYASHGRIIRKHLLGLDSCRHTSSRNSFTVPDRRPSLCLNSTQLRAYSSESDGRNASEDKHAHVNDGANFDKGRKQDKFGKDVKYSNSHARLGEQEQEEWLNNEKLSIESKRRESPFLTRRDKFKKEFMRRIIPWEMINISWDTFPYHIHENTKNLLVECAASHLRHNKLASSFGSRLSSSSGRILLQSIPGTELYRERLVRALAQDLQVPLLVLDNSILAPYDIDDDLSSDYESDEDNAESGEEGSLESENEDDNDATNEEEWASSTEAKSDASDNEDAIAAAEAHLKKVKAAVLRKLVPYNVEELEKEVSGESENSESSKSNDVKSSNESGCQLRKGDRVKYIGPSVKVTDEDSKYVVVIVALLVIIEEVVILLDRGHSAQVTVKPMYN

SEQ ID NO: 194570 - protein, 152 aa, Glycine max
  Coding DNA Sequence Number=SeqID_77792
  Pfam annotation: Domain name=PPR; Domain location=17-51; Score=24.6; E_value=0.00035; Accession=PF01535.11; Description=PPR repeat
MVVAHKLFDTTALSNLVCWNTMICGFDHNQMFEKSLEMFCGMHLIGVEPMSLVMRVFFRLAIFASSNILQTRTKNLEMGADQGLGGEDQGGEEFQRVIAANSVMSFPTARKGEKSKQRIGLSKGTDCKKKQKYKHTCVIPVMQKSHVDCLRG

SEQ ID NO: 194571 - protein, 323 aa, Glycine max
  Coding DNA Sequence Number=SeqID_77793
  Gene Ontology: Mol. function=oxidoreductase activity; Cellular component=vacuole; Biological process=hydrogen peroxide catabolic process
  Homolog annotation: Hit_ID=Q02200; Match level="QueryCoverage=95%, HitCoverage=95%, E-value=1e-118, Identity=70%"; Hit description =Lignin-forming anionic peroxidase precursor
  Pfam annotation: Domain name=peroxidase; Domain location=43-287; Score=456.5; E_value=3.4e-134; Accession=PF00141.13; Description =Peroxidase
MAYRTLSITSFVIFILVLLGTICDAKLSSTFYDNTCPDALSTIRTVIRRAVSKERRMAASLIRLHFHDCFVQGCDASILLDDSTSIESEKTALQNVNSVRGFNVIDQAKTEVEKVCSGVVSCADIMAVAARDASFAVGGPSWTVKLGRRDSTTASKSLASSDLPLFTDDLDTLISRFNSKGLTARDMVTLSGAHTIGQAQCFTFRGRIYNNASDIDAGFASTRRRGCPSLNNNDNNKKLAALDLVTPNSFDNNYFKNLIQKKGLLQSDQVLYSGGSTDSIVSEYSKNPTTFKSDFAAAMIKMGDIEPLTGSAGMIRKICSSIN

SEQ ID NO: 194572 - protein, 330 aa, Glycine max
  Coding DNA Sequence Number=SeqID_77794
  Gene Ontology: Mol. function=enoyl-[acyl-carrier-protein] reductase (NADH) activity; Cellular component=chloroplast; Biological process =metabolic process
  Homolog annotation: Hit_ID=O04945; Match level="QueryCoverage=88%, HitCoverage=78%, E-value=1e-103, Identity=64%"; Hit description =Enoyl-ACP reductase precursor
  Subcellular localization annotation: CTP_CleavageSite=73; ConfidenceScore=5.22e-01
MTTTSFSGLQFAMSRSCIPSSQKIADAGAVVLGGKSKIGSWNKLASACHIASVQPFGRGFTSSSIKSVKSVTKAMTESSAQSAVSGLPINLKGKRAFIAGVADDNGYGWAIAKSLAAAGAEILVGTWVPALNIFESSLRRGKFDESRVLPDGSLMEITKVYPLDAVFDNLDDVPEDIKANKRYAGSSKWTVQEVAESVKEDFGSIDILVHSLANGPEVTKPLLETSRKGYLAAISASSGSSISLTYIASERIIPGYGGGMSSAKAALESDTRVLAFEAGRKRKIRVNTISAGTGDLSLFQINKFLFSLSCYDFLMWKTWWRGQMFVLLCL

SEQ ID NO: 194573 - protein, 648 aa, Glycine max
  Coding DNA Sequence Number=SeqID_77795
  Gene Ontology: Mol. function=hydrolase activity, hydrolyzing O -glycosyl compounds; Cellular component=cellulose and pectin -containing cell wall; Biological process=polysaccharide catabolic process
  Homolog annotation: Hit_ID=Q9M995; Match level="QueryCoverage=94%, HitCoverage=97%, E-value=0.0, Identity=63%"; Hit description =Endoglucanase 5 precursor
  Pfam annotation: Domain name=Glyco_hydro_9; Domain location=48-511; Score=853.1; E_value=1.4e-253; Accession=PF00759.9; Description =Glycosyl hydrolase family 9
MHTRLKKIGQINIMHDRRFKLMRHISSLIEVHHALVLRLGGSAPSGFNYGDALDKSLMFFEAQRSGKLPLQQRVKWRGDSGLQDGFQQRVDLVGGYYDAGDHVKFGLPMAYSVTMLAWGAIEFNKEITDLNQMGHALWAIKWGTDYFIKAHTQPNVLWGQVGDGVSDHYCWERAEDMTTSRGAYKIDEQHPGSDLAGETAAALAAAAIAFRPYNSSYSNLLLVHAKQLFTFADRFRGLYDNSISSAQQFYTSSGYSDELLWAATWLHLATGNEYYIKYVVDNAVYMGGTGWAVKEFSWDNKYAGVQILLSKVLLEGKAGAYSATLKQYQAKAEYFTCACLQKNDDYNVQKTPGGLLYVREWNNMQYVSSAAFLLAVYSNYLSATKSQLNCPDGQTQPQELLNFVKSQADYILGKNPADVSYLVGYGAKYPLHVHHRGASIASVFALHYDVGCTQGFEMWYNRAEPNPNVICGGLVGGPDKNDDFSDERSNYEQTEPTISGSAPLVGIFAKLQSLYGNIGEGYNHNESPVPQQKTPSTNPGKTTMSKTSSESEGAPVEFLHSISSSWTVGGATYYHHRVIIKNTSSKPISDLKLVIKDLSGSLWGLSPTEEKDTYELPQWNKVLNPGSECIFVYVQGGPQATVSIKSLH

SEQ ID NO: 194574 - protein, 117 aa, Glycine max
  Coding DNA Sequence Number=SeqID_77796
  Gene Ontology: Mol. function=peptidase activity; Cellular component =anchored to membrane; Biological process=proteolysis
  Homolog annotation: Hit_ID=Q1S463; Match level="QueryCoverage=85%, HitCoverage=24%, E-value=8e-34, Identity=68%"; Hit description =Eukaryotic aspartyl protease
MMNRGNSTGYYVQDYLTYNHVNGNLRTAPQNSSIIFGCGAVQSVTFSSSSEEALDGIIGFGQSNSSVLSQLAASGKVKKIFSHCLDNIRGGGIFAIGEVVEPKVSNSIGTKIVCAVT

SEQ ID NO: 194575 - protein, 124 aa, Glycine max
  Coding DNA Sequence Number=SeqID_77797
MGSFNFKFKDLSTVKSLKSGSQWLIRNYRLQQVTAGVLKQYAKIGLQNSDPQNSDLQNRGDEQRRGRIAARTNLDGEKTRKEDQIRTRGRTQTKIVDRIKTVEGGGGGHFVFFLLIFFSIFEAH

SEQ ID NO: 194576 - protein, 705 aa, Glycine max
  Coding DNA Sequence Number=SeqID_77798
  Homolog annotation: Hit_ID=Q1RWV8; Match level="QueryCoverage=91%, HitCoverage=97%, E-value=1e-36, Identity=29%"; Hit description=IMP dehydrogenase/GMP reductase
  Pfam annotation: Domain name=Ank; Domain location=137-164; Score=4.3; E_value=7.5; Accession=PF00023.20; Description=Ankyrin repeat
  Pfam annotation: Domain name=Ank; Domain location=368-401; Score=4.2; E_value=7.8; Accession=PF00023.20; Description=Ankyrin repeat
  Pfam annotation: Domain name=Ank; Domain location=402-434; Score=2.7; E_value=13; Accession=PF00023.20; Description=Ankyrin repeat
  Pfam annotation: Domain name=Ank; Domain location=50-79; Score=6.5; E_ value=3.6; Accession=PF00023.20; Description=Ankyrin repeat
  Pfam module annotation: Pfam domain module=Ank::Ank::Ank::Ank; Domain location=137-164::368-401::402-434::50-79
MEKEEEREEMSMFDETTIRAQRAARSGNWRLFKRILEEDTKRLLEPFDLFGNTAIHIATRSNNPWLLHELLEVLPAKDRWHALRMGNCVNNTLLHETIFCTRVEMAGVVFKFEKEAPPEDAPEEKKGLPLVEIINDSGETPLFRAAKLGMLKMLKYMAKHAQGDIPRLFVRFDKHSILHASILGQFFDVAIWLLNMDEKLAQHRDMNGMTCLQLLSNMPLVFRSQATSMGAVKNLIYYLLPEEGYEIDDDEEEEENGSADFGQRSDLESGQQDKAKLPSSEFNGIGRIWQRKKQHKLAEHLAELLVQRDFSWQISFHENFQPLIVLPVLSSKSDRIKHIHHMKEMHKTISHSRSYKLITTATSIPHSKNYTPLLMAAGSGIVEIVEKIIDKFPEAICHVSQDEHNVLHMAVKHRQLKIFNMLKKHSAFKSLLFRITAEGRTLLHQISRMEFYVEQHLPGVAFQLQDELRWYERVRNIVPPHYLMHCDKDGLTAEDVLEMEHREMHKEAKGWIKETAQSCSTVAVLVATVVFAAAYTIPGGTDQNNGTPVFLGSRIFLFFTATDVVALVSSLASVVMFLSILTSPFELWDFRSSLPRKLSLGFASLFFSLVCTMLTFSATVLLTVRLENQLQQWASVLFFCAVFFPVAIFWRLQFPLYKMVQRLAKRLFKTLKQAVPTTEIPEWFDCVNEGGYPVFEARGKFPAVV

SEQ ID NO: 194577 - protein, 224 aa, Glycine max
  Coding DNA Sequence Number=SeqID_77799
  Homolog annotation: Hit_ID=Q9ASU7; Match level="QueryCoverage=45%, HitCoverage=29%, E-value=3e-41, Identity=81%"; Hit description=Peter Pan-like protein
  Pfam annotation: Domain name=Brix; Domain location=114-224; Score= -0.3; E_value=0.0002; Accession=PF04427.8; Description=Brix domain
LTEEFEEVPVQSRGFGILDVGYRSTDEAWAAGGSGILLRTTNGGKSWIRDKAADNIAANLYSVKDLYWGMMESCFATLDRVVMQHALASISKPLPSALSAAPKTLSAAAKTPSTPPNPNNGKLPAPLKQLQMDLRKLMLPYTALSLREKKRNNLRDFLNVAGPMGVTHFFILSKTATSPYLRVATTPQGPTLTFKIHEYSLAADIARSQLHPRCPKDLFKSSAL

SEQ ID NO: 194578 - protein, 1121 aa, Glycine max
  Coding DNA Sequence Number=SeqID_77800
  Gene Ontology: Mol. function=protein binding; Cellular component =membrane; Biological process=defense response
  Homolog annotation: Hit_ID=Q8GZF0; Match level="QueryCoverage=99%, HitCoverage=99%, E-value=0.0, Identity=80%"; Hit description =Resistance protein KR4
  Pfam annotation: Domain name=LRR_1; Domain location=1055-1075; Score =10.8; E_value=2.7; Accession=PF00560.23; Description=Leucine Rich Repeat
  Pfam annotation: Domain name=LRR_1; Domain location=1078-1111; Score =3.3; E_value=70; Accession=PF00560.23; Description=Leucine Rich Repeat
  Pfam annotation: Domain name=LRR_1; Domain location=510-532; Score =14.4; E_value=0.41; Accession=PF00560.23; Description=Leucine Rich Repeat
  Pfam annotation: Domain name=LRR_1; Domain location=534-555; Score =13.6; E_value=0.75; Accession=PF00560.23; Description=Leucine Rich Repeat
  Pfam annotation: Domain name=LRR_1; Domain location=557-579; Score =14.0; E_value=0.56; Accession=PF00560.23; Description=Leucine Rich Repeat
  Pfam annotation: Domain name=LRR_1; Domain location=581-602; Score =9.0; E_value=5.8; Accession=PF00560.23; Description=Leucine Rich Repeat
  Pfam annotation: Domain name=LRR_1; Domain location=716-737; Score =5.1; E_value=32; Accession=PF00560.23; Description=Leucine Rich Repeat
  Pfam annotation: Domain name=LRR_1; Domain location=739-761; Score =3.6; E_value=60; Accession=PF00560.23; Description=Leucine Rich Repeat
  Pfam annotation: Domain name=LRR_1; Domain location=794-817; Score =10.1; E_value=3.7; Accession=PF00560.23; Description=Leucine Rich Repeat
  Pfam annotation: Domain name=LRR_1; Domain location=938-957; Score =7.0; E_value=14; Accession=PF00560.23; Description=Leucine Rich Repeat
  Pfam annotation: Domain name=LRR_1; Domain location=958-981; Score =7.6; E_value=11; Accession=PF00560.23; Description=Leucine Rich Repeat
  Pfam annotation: Domain name=NB-ARC; Domain location=160-419; Score =213.1; E_value=6.3e-61; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::NB-ARC; Domain location=1055-1075::1078-1111::510-532::534-555::557-579::581 -602::716-737::739-761::...
  Pfam module annotation: Domain location=794-817::938-957::958 -981::160-419
MALECVGGAVLSSFLAALFQKLASPQVLDFFRGTKIDQNLRRDLENKLLSIQAVLDDAEQKQFGNMPVRDWLIELKVAMLDVEDVLEEIQHSRPQVQPQSESQTCTCKVPKFFKSCSFSSINKEINSSMKKILDDLDGLASRMDSLGLKKATDLVAGSGSGGNKLQSTSLVVESDICGRDGDKEMIINWLTSYTDEKLSNTFYRGHGRVGAILDTITDSTDHGRELEIVQRRLKEKLADKKFLLVLDDVWNESRPKWEAVQNALVYGAQGSKILVTTRSEEVASTMGSEQHKLEQLQEDYCWELFAKHAFRDDNLPRDPVCTDIGKKIVKKCKGLPLALKSMGSLLHNKPFAWEWESVFQSEIWELKDSIVPALALSYHHLPPHLKTCFAYCALFPKDYEFDKECLIQLWMAENFLNCHQCSTSPEEVGQQYFNDLLSRLRVDQAKCTQKTTRHFSVSMITERYFDEFGTSCDTKKLRTFMPTWWGMNEYYDRSWNCKMSIHELFSKFKFLRVLSLSHCSNIEELPDSVCNFKHLRSLDLSHTRIKKLPESTCSLYKLQILKLNHCRSLKELPSNLHELTNLHRLEFVNTNIIKVPPHLGKLKNLQVSMSSFDVGKSSEFTIQQLGELNLVHERLSFRELQNIENPSDALAADLKNKTRIVELEFEWNSHRNPDDSAKERDVIENLQPSKHLEELSIRNYGGKQFPNWLSDNSLSNVVSLKLHNCQSCERLPSLGLLPFLENLEISSLDGIVSIGADFHGNSTSSFPSLETLKFYSMEAWEKWECEAVIGAFPCLQYLSISKCPKLKGDLPEQLLPLKKLQISECKQLEASAPRALELKLELEQQDFGKLQLDWATLKKLSMGGHGMKASLLVKSDTLEELKIYCCPKEGMFCDCEMRDDGCDSQKTFPLDFFPALRTLELNGLRNLQMITQDQTHNHLEFLTIRRCPQLESLPGSTSLKGLTICDCPRVESFPEGGLPSNLKQMYLSYCSWGLMASLKGALGDNPSLETLSITELDAESFPDEGLLPLSLTCLTISDFPNLKKLDYKGLCQLSSLKKLILDDCPNLQQLPEEGLPKSISYLEIEDCPKLKQRCQNPGGEDWPKIAHIPTLNISQWCADDF

SEQ ID NO: 194579 - protein, 190 aa, Glycine max
  Coding DNA Sequence Number=SeqID_77801
  Gene Ontology: Mol. function=molecular_function; Cellular component =cellular_component; Biological process=multicellular organismal development
  Homolog annotation: Hit_ID=Q1S8P9; Match level="QueryCoverage=87%, HitCoverage=59%, E-value=1e-76, Identity=83%"; Hit description=Brix
  Pfam annotation: Domain name=Brix; Domain location=1-145; Score=6.2; E_value=6.1e-05; Accession=PF04427.8; Description=Brix domain
IVLSGFVSGDPPLQLTTNMFQNIFPTIDVKTVKLSTCQRIVLLNYNKDTKLIDFRHYSIRLQPVGVSRRIRKLVQSHQVPDLRNLLDVSNFVTKAGYGSESEADEEAATVTLSSDIGRVNRASTKSAVKLHEVGPRMTLQLVRIEKGLCSGEVLFSEYGKAGGKGKSDDEMQGEEDEEDQDGEHPEDSED

SEQ ID NO: 194580 - protein, 43 aa, Glycine max
  Coding DNA Sequence Number=SeqID_77802
KLKKAETLILVDFVECPKVEVVYGSSWKSGDLKMEDLDIDLME

SEQ ID NO: 194581 - protein, 155 aa, Glycine max
  Coding DNA Sequence Number=SeqID_77803
  Gene Ontology: Mol. function=isomerase activity; Cellular component =spliceosome; Biological process=protein folding
  Homolog annotation: Hit_ID=Q1S0T0; Match level="QueryCoverage=55%, HitCoverage=46%, E-value=5e-44, Identity=95%"; Hit description =Peptidyl-prolyl cis-trans isomerase, cyclophilin type
  Pfam annotation: Domain name=Pro_isomerase; Domain location=28-139; Score=35.5; E_value=8.2e-10; Accession=PF00160.11; Description =Cyclophilin type peptidyl-prolyl cis-
MAGSIGSGGNTSTGVEWHVRPPNPKNPIVFFDVTIGNIPAGRIKMELFADIAPKTAENFRQFCTGEYRKAGLPVGYKGCQFHRVIKDFMIQAGDFVKKYGVIPSLNHGVHHFQKLNYQNTNIPISKPNQTLLDYPSGKMSALAHFALHSSATQQY

SEQ ID NO: 194582 - protein, 266 aa, Glycine max
  Coding DNA Sequence Number=SeqID_77804
  Gene Ontology: Mol. function=protein binding; Cellular component =membrane; Biological process=defense response
  Homolog annotation: Hit_ID=Q6SQJ2; Match level="QueryCoverage=98%, HitCoverage=21%, E-value=1e-111, Identity=79%"; Hit description=NBS -LRR type disease resistance protein RPG1-B
MAVELIAGALLSSFLQVAFEKLASPQVLDFFHGKKLDETLLRKLKIKLQSIDALADDAERKQFADPRVRNWLLEVKDMVFDAEDLLDEIQHESSKWELEAESESQTCTSCTCKVPNFFKSSHASSFNREIKSRMEEILDRLELLSSQKDDLGLKNVSGVGVGSELGSAVPQISQSTSSVVESDIYGRDKDKKVIFDWLTSDNGNPNQPWILSIVGMGGMGKTTLAQHVFNDPRIQEARFDVKAWVCVSDDFDAFKGIKEQILEGHH

SEQ ID NO: 194583 - protein, 758 aa, Glycine max
  Coding DNA Sequence Number=SeqID_77805
  Gene Ontology: Mol. function=protein binding; Cellular component =membrane; Biological process=defense response
  Homolog annotation: Hit_ID=Q6R269; Match level="QueryCoverage=99%, HitCoverage=72%, E-value=0.0, Identity=59%"; Hit description=Disease resistance protein
  Pfam annotation: Domain name=LRR_1; Domain location=170-191; Score =9.8; E_value=4.1; Accession=PF00560.23; Description=Leucine Rich Repeat
  Pfam annotation: Domain name=LRR_1; Domain location=193-215; Score =15.2; E_value=0.24; Accession=PF00560.23; Description=Leucine Rich Repeat
  Pfam annotation: Domain name=LRR_1; Domain location=217-238; Score =4.8; E_value=35; Accession=PF00560.23; Description=Leucine Rich Repeat
  Pfam annotation: Domain name=LRR_1; Domain location=376-399; Score =2.8; E_value=86; Accession=PF00560.23; Description=Leucine Rich Repeat
  Pfam annotation: Domain name=LRR_1; Domain location=431-454; Score =11.6; E_value=1.9; Accession=PF00560.23; Description=Leucine Rich Repeat
  Pfam annotation: Domain name=LRR_1; Domain location=474-497; Score =3.5; E_value=63; Accession=PF00560.23; Description=Leucine Rich Repeat
  Pfam annotation: Domain name=LRR_1; Domain location=577-599; Score =12.6; E_value=1.2; Accession=PF00560.23; Description=Leucine Rich Repeat
  Pfam annotation: Domain name=LRR_1; Domain location=602-625; Score =4.7; E_value=38; Accession=PF00560.23; Description=Leucine Rich Repeat
  Pfam annotation: Domain name=LRR_1; Domain location=651-671; Score =3.9; E_value=54; Accession=PF00560.23; Description=Leucine Rich Repeat
  Pfam annotation: Domain name=LRR_1; Domain location=674-697; Score =6.0; E_value=22; Accession=PF00560.23; Description=Leucine Rich Repeat
  Pfam annotation: Domain name=LRR_1; Domain location=699-722; Score =13.3; E_value=0.89; Accession=PF00560.23; Description=Leucine Rich Repeat
  Pfam annotation: Domain name=NB-ARC; Domain location=1-139; Score= -100.1; E_value=0.00066; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::NB-ARC; Domain location=170-191::193-215::217-238::376-399::431-454::474-497::577 -599::602-625::...
  Pfam module annotation: Domain location=651-671::674-697::699-722::1 -139
MRSKEHLLEQLQEDHCWKLFAKHAFQDDNIQPNPDCKEIGTKIVKKCKGLPLALKTMGSLLHDKSSVTEWKSIWQSEIWEFSTERSDIVPALALSYHHLPSHLKRCFAYCALFPKDYVFDKECLIQLWMAEKFLQCSQQGKRPEEVGEQYFNDLLSSLREVPDSVGNLKYLHSLDLSNTDIEKLPESTCSLYNLQILKLNGCNKLKELPSNLHKLTDLHRLELIDTGVRKVPAHLGKLKYLQVSMSPFKVGKSREFSIQQLGELNLHGSLSIQNLQNVESPSDALAVDLKNKTHLVKLKLEWDSDWNPDDSTKERDEIVIENLQPPKHLEKLRMRNYGGKQFPRWLLNNSLLNEVSLTLENCQSCQRLPPLGLLPFLKELSIQGLAGIVSINADFFGSSSCSFTSLESLMFHSMKEWEEWECKGVTGAFPRLQRLSIEYCPKLKGHLPEQLCHLNYLKIYGCEQLVPSALSAPDIHQLSLGDCGKLQIAHPTTLKELTITGHNVEAALLEQIGRSYSCSNNNIPMHSCYDFLVRLVINGGCDSLTTIPLDIFPILRQLDIKKCPNLQRISQGQAHNHLQHLSIGECPQLESLPEGMHVLLPSLHDLWIVYCPKVEMFPEGGLPLNLKEMTLCGGSYKLISSLKSASRGNHSLEYLDIGGVDVECLPDEGVLPHSLVCLEIRNCPDLKRLDYKGLCHLSSLKTLFLTNCPRLQCLPEEGLPKSISTLRTYYCPLLNQRCREPGGEDWPKIADIENVYII

SEQ ID NO: 194584 - protein, 468 aa, Glycine max
  Coding DNA Sequence Number=SeqID_77806
  Gene Ontology: Mol. function=nucleic acid binding; Cellular component= cytoplasm; Biological process=DNA integration
  Homolog annotation: Hit_ID=O48771; Match level="QueryCoverage=99%, HitCoverage=50%, E-value=1e-160, Identity=61%"; Hit description =Argonaute (AGO1)-like protein
  Pfam annotation: Domain name=Piwi; Domain location=100-432; Score =392.9; E_value=4.8e-115; Accession=PF02171.8; Description=Piwi domain
LKVGKNDDCIPHNGRWNFNKKTLLQASHIDYWAVVNFSASCDTSYISRELIRCGMSKGINIERPYTLIEEEPQLRKSHPVARVERMFDLLASKLNREPKLILCVLPERKICDIYGPWKKKCLSEIGVVTQCIAPVKITNQYLTNVLLKINSKLGGINSLLAIEHSGHLPLIKDTPTMILGMDVSHNSLGRLDSPSIAAVVGSRHWPLISRYRASVRMQASKVEMIDALYKPLENGSDDGIIRELLLDFYDSSNGRKPTQFIVFRDGVSESQFEQVLTIELNQIIKAYQHLGEVNVPQFTVIVAQKKHHIKLFLPNGPENVPPGTVVDTTITHPRNYDFYMCAHAGMLGTSRPVHYHVLLDEIGFSADGLQNLIHSLSYVYAFFLFVYTKFHYPWLMHVYTYFRNQRSTIATSVVAPICYAHHAAAQMGQLLNFDDSSETGSSPASEGGIPIPELPRLHRNVRSSMFFC

SEQ ID NO: 194585 - protein, 102 aa, Glycine max
  Coding DNA Sequence Number=SeqID_77807
MVFHLRLVISSKQRKGNIGSKRLSKELIQGRLIWLEAYKNKMPKSSPNMHVKQEVSTRVKPRLLCKQSIGQNTPNKIDDDGSNSHQREKQGFEFTKCKETPI

SEQ ID NO: 194586 - protein, 435 aa, Glycine max
  Coding DNA Sequence Number=SeqID_77808
  Gene Ontology: Mol. function=translation initiation factor activity; Cellular component=cytoplasm; Biological process=stem cell maintenance
  Homolog annotation: Hit_ID=Q2LFC2; Match level="QueryCoverage=97%, HitCoverage=52%, E-value=3e-99, Identity=44%"; Hit description=AGO4-1
  Pfam annotation: Domain name=PAZ; Domain location=227-367; Score =135.9; E_value=1.1e-37; Accession=PF02170.12; Description=PAZ domain
MTEEVPGIVEAAEPPTSSQSPADVPHNLETEQMTPTKYSIISRNGVGTTGKHIPLLVNLFEVAVNVPDTVFFQYSDFQVAITFEDKQAVESKGIGRKVIDRLYQTYSSELGGKSSSAKSPGANGSLHEETKRSKHSFQSKTFMVEISFATKIPLQSIVISLKEVESDTNSQDALRVLDTILRQRAANCGCLLVRQSFFHDDSRNFNDVGAGVTAVSDVSTTIIIKPGPVIDFLLSNQQVKEPRYIDWEKAKKMLKNLRVQATHHNQEFKISGLSEKPCIQQLFSMKVKNDDNNSRGQTVDITVYEYFAKHCGIELTSSAYLPCLDVGKPKRPVYLPLELCSLVSLQRYTKVLSLMQRASLVEKSRQKPQDRIKILKSAVGKCYDDDPVLAACGISIEKQLNLIEGRVLETPKGLRGSGMVKKNWDFGRDLDLFNI

SEQ ID NO: 194587 - protein, 1211 aa, Glycine max
  Coding DNA Sequence Number=SeqID_77809
  Gene Ontology: Mol. function=protein binding; Cellular component =membrane; Biological process=defense response
  Homolog annotation: Hit_ID=Q6SQJ2; Match level="QueryCoverage=97%, HitCoverage=99%, E-value=0.0, Identity=59%"; Hit description=NBS-LRR type disease resistance protein RPG1-B
  Pfam annotation: Domain name=LRR_1; Domain location=1012-1035; Score =4.1; E_value=49; Accession=PF00560.23; Description=Leucine Rich Repeat
  Pfam annotation: Domain name=LRR_1; Domain location=1056-1079; Score =5.5; E_value=27; Accession=PF00560.23; Description=Leucine Rich Repeat
  Pfam annotation: Domain name=LRR_1; Domain location=1104-1126; Score =1.1; E_value=1.7e+02; Accession=PF00560.23; Description=Leucine Rich Repeat
  Pfam annotation: Domain name=LRR_1; Domain location=1127-1150; Score =9.8; E_value=4.2; Accession=PF00560.23; Description=Leucine Rich Repeat
  Pfam annotation: Domain name=LRR_1; Domain location=1151-1174; Score =8.9; E_value=6.3; Accession=PF00560.23; Description=Leucine Rich Repeat
  Pfam annotation: Domain name=LRR_1; Domain location=609-631; Score =4.4; E_value=44; Accession=PF00560.23; Description=Leucine Rich Repeat
  Pfam annotation: Domain name=LRR_1; Domain location=633-654; Score =13.5; E_value=0.77; Accession=PF00560.23; Description=Leucine Rich Repeat
  Pfam annotation: Domain name=LRR_1; Domain location=656-678; Score =13.1; E_value=0.99; Accession=PF00560.23; Description=Leucine Rich Repeat
  Pfam annotation: Domain name=LRR_1; Domain location=680-701; Score =3.9; E_value=54; Accession=PF00560.23; Description=Leucine Rich Repeat
  Pfam annotation: Domain name=LRR_1; Domain location=816-837; Score =4.5; E_value=41; Accession=PF00560.23; Description=Leucine Rich Repeat
  Pfam annotation: Domain name=LRR_1; Domain location=894-917; Score =6.1; E_value=20; Accession=PF00560.23; Description=Leucine Rich Repeat
  Pfam annotation: Domain name=LRR_1; Domain location=918-944; Score =1.5; E_value=1.5e+02; Accession=PF00560.23; Description=Leucine Rich Repeat
  Pfam annotation: Domain name=NACHT; Domain location=227-378; Score= -38.6; E_value=0.058; Accession=PF05729.3; Description=NACHT domain
  Pfam annotation: Domain name=NB-ARC; Domain location=186-486; Score =318.5; E_value=1.2e-92; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::NACHT::NB- ARC; Domain location=1012-1035::1056-1079::1104-1126::1127-1150::1151- 1174::...
  Pfam module annotation: Domain location=609-631::633-654::656 -678::680-701::816-837::894-917::918-944::227-378::186-486
  Subcellular localization annotation: CTP_CleavageSite=24; ConfidenceScore=5.10e-01
LQCMESLTSNYSFPFVHSNPFPTMALEFVGGAVLSSFLQVTFDRLGSHQVLDFFRGRKLDETLLSKLKVKLLSIDALADDAEQKQFRDSRVKAWLVAVKDAVHESEDVLDEIEYEHSKCQVEAEPESQTCTCKVPNFFKSSPLSSFNKEVKSRMEQLIGSLEFLSSQKGDLGLNNASGVGSGFGSEVSQKSPSTSLVVESVIYGRDNDKEMIINWLTSDSGNHSKLSILSIVGMGGMGKTTLAQHAYNDPRIDDVFDIKAWVCVSDDFTVFKVTRTILEAITKSTDDSRNLQMVHERLLVELKDKKFLLVLDDVWNEKLDEWVAVQTPLYFGAEGSRIIVTTRNKKVASSMRSKEHYLQQLQEDYCWQLFAEHAFQNANPQSNPDFMKIGMKIVEKCKGLPLALKTMGSLLHTKSILEWKGILESEIWELDNSDIVPALALSYHHIPSHLKRCFAYCALFPKGYLFDKECLIQFWMAQKLLQCHQQSKSPEEIGEQYFNDLLSRSFFQESSNIEGGRCFVMHDLLNDLAKYVSEDMCFRLEVDQAKTIPKATRHFSVVVNDYRYFEGFGTLYDTKRLHTFMSTTDCRDSHEYYWRCRMSIHELISKFKFLRFLSLSYWHRLTEVPDSIGNLKHLRSLDLSHTSIRKLPESTCSLYNLQILKLNDCKYLKELPSNLHKLTYLRYLEFMNTGVRKLPAHLGKQKNLLVLINSFDVGKSREFTIQQLGELNLHGRLSIGRLQNVENPSDASAVDLKNKTHLMQLELKWDYNGNLDDSSKERDEIVIENLEPSKHLERLSIRNYGGKHFPNWLLHNSLLNVVSLVLDRCQSCQRLPPLGLLPLLKNLEISGLDGIVSTGADFHGNSSSSFTSLEKLKFYNMREWEKWECQNVTSAFPSLQHLSIKECPKLKGNLPLSVPLVHLRTLTIQDCKNLLGNDGWLEFGGEQFTIRGQNMEATLLETSGHIISDTCLKKLYVYSCPEMNIPMSRCYDFLESLTICDGCNSLMTFSLDLFPTLRRLRLWECRNLQRISQKHAHNHVMYMTINECPQLELLHILLPSLEELLIKDCPKVLPFPDVGLPSNLNRLTLYNCSKFITSPEIALGAHPSLKTLEIGKLDLESFHAQDLLPHSLRYLCIYDCPSLQYLPEGLCHHSSLRELFLLSCPRLQCLPDEDLPKSISTLVIRYCPLLQPRCQRPEGEDCGKIAHIENLFIID

SEQ ID NO: 194588 - protein, 115 aa, Glycine max
  Coding DNA Sequence Number=SeqID_77810
MEASSREIVRGVPPLLGANTNLYIKDNPGGGKSLRSQSSQISDTWGWIIDSLFLRDMTLSFHDVNLAIPTNARHHQLARACHYTMMRVYFQESSNLKCVRPLSSRSFSGSRPVMS

SEQ ID NO: 194589 - protein, 279 aa, Glycine max
  Coding DNA Sequence Number=SeqID_77811
  Gene Ontology: Mol. function=protein binding; Cellular component =membrane; Biological process=defense response
  Homolog annotation: Hit_ID=Q8GZF0; Match level="QueryCoverage=99%, HitCoverage=40%, E-value=2e-43, Identity=63%"; Hit description =Resistance protein KR4
  Pfam annotation: Domain name=NB-ARC; Domain location=21-197; Score= -29.0; E_value=1.9e-08; Accession=PF00931.13; Description=NB-ARC domain
MNSLPLKKASDDGVGSGSGSKVPQSTSSVVESDICDRDDDKERIFEWLTSDTDKKLSILSIVSMGGLGKTTLAQLVYNDSRIDGTFDIKASVCVSEKFDVFNVSRSILDTIIDSTDHSRELEMVQRRLKENLADKRFLLTTRSEKVSSTIRTELSPPSSRLKTCFAYCGLFGKDYEFDKECLIQLWMAENFLHCHKSSKSPEEVEQQYFHDLLSSMSKIHDLFSKFKLLRVLSLSQCSDIEELPDSLSNRKHLRSFELSNTCIEKLPEPTRSLYNLQIL

SEQ ID NO: 194590 - protein, 51 aa, Glycine max
  Coding DNA Sequence Number=SeqID_77812
MQIQTRSMYDYNHSQMMMSSSASSPPTLGYIQHPISKLDTLAGIAIKYGVE

SEQ ID NO: 194591 - protein, 858 aa, Glycine max
  Coding DNA Sequence Number=SeqID_77813
  Homolog annotation: Hit_ID=Q1S8Q1; Match level="QueryCoverage=62%, HitCoverage=49%, E-value=0.0, Identity=68%"; Hit description=PWWP; Regulation of nuclear pre-mRNA protein
  Pfam annotation: Domain name=DUF618; Domain location=346-417; Score= -6.7; E_value=0.04; Accession=PF04818.4; Description=Protein of unknown function, DUF618
  Pfam annotation: Domain name=Extensin_2; Domain location=573-850; Score=-132.8; E_value=0.041; Accession=PF04554.4; Description =Extensin-like region
  Pfam module annotation: Pfam domain module=DUF618::Extensin_2; Domain location=346-417::573-850
LAQRNSSELEDTHLKEPSSQLHDDRLSIQQPLKEKDDEVIPVHVPYSPEKLDLKQFPSNVTKLSSVSPLKSPQLVPATKSNAERNKVSKVSLKVSSNATQKRAEHGSSKSSHNLSSSQNQVVTHKKKPAMSAEIFKTTSETLPQAVEVPATTVCSKDPDALHVDRLEVGTEEKNSIYTVSGTPESAKTMKHLIAAALAKRKQAHSQCLPSGFPNVQEGTPSPSTVQPFLPVSSNFVPADIQGVYEHTTLASPPTKELHSASHNQLDADDIEERRVGSVQRGLGGSLSGGTEAAVAREAFEGMIETLSRTKESIGRATRLAIDCAKYGIANEVVELLIRKLETETSFHRKVDLFFLVDSITQCSHNQKGIAGASYIPTVQAALPRLLGAAAPPGASARENRRQCLKVLRLWLERKIFPESVLRRYMDDIGVSNDDMTVSFSLRRPSRAERSVDDPIREMEGMLVDEYGSNATFQLPGFLSSHAFEEDEDEYEDAIPINLCKETCDASPADPPHTLGESETSTVTPNDKRHCILKDVDGELEMEDVSGYPKDERPIFFNSSDEIDLQHQDSDRNLDPTSNISEETSVTPEGSPPMPLDSPPPPPPLPSSPPPPPPPLSPSPPPPPPRPMLQPPPPPLPPSAPPVSLVPQSSGPARPLLSQSLMPSQSSHQSSPQLGYQQSVPHDFSGTTNGNQIVPMTGNSFPGGHNNAVVKNEVFPQPSAYAPTAGCSSQEPSGFNPSRQLEYGQNDMYLNAQVPQPNHQFQQGNPPFAQRHAHAAPPQNPPNPYSYSNPTVQQHLPHSFHPPFPLPSLPDGRRQFVADEQWRMSSSEFKTNSQHGVWRGRSPSCPGPPYGQEGESFVV

SEQ ID NO: 194592 - protein, 346 aa, Glycine max
  Coding DNA Sequence Number=SeqID_77814
  Homolog annotation: Hit_ID=Q1S8Q1; Match level="QueryCoverage=99%, HitCoverage=32%, E-value=1e-108, Identity=61%"; Hit description =PWWP; Regulation of nuclear pre-mRNA protein
  Pfam annotation: Domain name=PWWP; Domain location=17-89; Score=63.6; E_value=6.3e-16; Accession=PF00855.8; Description=PWWP domain
MAPGRRRGANKAKANGHLSLGDLVLAKVKGFPAWPAKISRPEDWDKVPDPKKYFVQFFGTKEIAFVAPADIQAFTSEAKNKLSARLQGKTKYFAQAVKEICAAFDEMQKQKASGLADDTDDSHIGSEAPSNDGVVGNLKDAADAVSNAEKDNIDMDNVCSNLEYCVPRIGENDSQDEKLSVSNHPNESSSVSSPVIKNKLAIGSETKKNANKSSFKGASNVNDFRQDANGHSDLTNGTKTRKLDNGSRKKSEAASGSNRNGGSSTGKFMKEGNCTGRGDLSRSGETLKAVKKRKNAFSVKSDSPDTLKPNDNGTTGEKDSNLMKVKTSHEVKNELQEISFDSEDAD

SEQ ID NO: 194593 - protein, 562 aa, Glycine max
  Coding DNA Sequence Number=SeqID_77815
  Gene Ontology: Mol. function=monooxygenase activity; Cellular component=membrane; Biological process=electron transport
  Homolog annotation: Hit_ID=Q1S8Q5; Match level="QueryCoverage=95%, HitCoverage=99%, E-value=0.0, Identity=79%"; Hit description=E-class P450, group I
  Pfam annotation: Domain name=p450; Domain location=68-545; Score =167.2; E_value=4.3e-47; Accession=PF00067.12; Description=Cytochrome P450
  Subcellular localization annotation: CTP_CleavageSite=27; ConfidenceScore=5.13e-01
MTNTTTSTILPFNQTNPMHSHIPFHSNTMTKPRNLNLTFLLQDIQILEIFLAVLVFIIIHSLRQKKHHGLAVWPVLGMVPSLVTGLRTNLYEWITEVLKRQNGTFRFKGPWFSNLNCIVTSDPRNLEHLLKTKFPLYPKGGYFRNTVRELLGDGIFNADDDTWQKQRKTASIEFHSTKFRQLTTESLFELVHYRLLPVLEASVKKSVAIDLQDILLRLTFDNVCMIAFGVDPGCLQLGLPEIPFAKAFEDATEATVFRFVTPTCLWKAMKFLNLGMERKLNKSIKGVDEFAESVIRTRKKELSLQCEDSKQRLDLLTVFMRLKDENGQAYSDKFLRDICVNFILAGRDTSSVALSWFFWLLEQNPQVEENILAEICKVVSQRKDIEREEFDNSLRFRPEEIKKMDYLHAALSEALRLYPSVPVDHKEVVEDDTFPDGTVLKKGTKVIYAIYAMGRMEGIWGKDCKEFKPERWLRDGRFMSESAYKFTAFNGGPRLCLGKDFAYYQMKYAAASIVYRYHVKVVENHPVEPKLALTMYMKHGLKVNLYQRDAAQIQKHLEDGLK

SEQ ID NO: 194594 - protein, 393 aa, Glycine max
  Coding DNA Sequence Number=SeqID_77816
  Gene Ontology: Cellular component=nucleus
  Homolog annotation: Hit_ID=Q9FMY0; Match level="QueryCoverage=97%, HitCoverage=90%, E-value=1e-102, Identity=51%"; Hit description =Arabidopsis thaliana genomic DNA, chromosome 5, P1 clone:MKD15
MAFLFQKFQEAVKTLAKNPAFARDPSQLQFEADINRLFLYTSYNLLGKNADEADAEEIIEIANKASFADQQMQVKENVHSQIKAFCTYMDEMLLPNEKRVNDPMELSQQENSSPHHSGLNSAKVVSKQRSYTQAEVSQKLKDQLGYKLNVKPSQISHKDSGQGLFLDGAADVGAVIAFYPGVVYSPAYYQYIPGYLDEQNPYLITRYDGTVIDAQPWGCGGEGPERFNGRKMLERKLDNEGAEKGSDRMSKPLEGSQVENDNENDDVERRNPLALAHFANHPAKGMLPNVMICPYDFPLTENNMRVYIPNILFGNAEVNIKRLGSFWFKSGVSRNSQSDVLTLKTVVLVATRSLQDEELLLNYRLSNSKKWPEWYAPVDEEEDIMTGKDESSQ

SEQ ID NO: 194595 - protein, 309 aa, Glycine max
  Coding DNA Sequence Number=SeqID_77817
  Gene Ontology: Mol. function=nucleic acid binding
  Homolog annotation: Hit_ID=Q1S8Q7; Match level="QueryCoverage=89%, HitCoverage=95%, E-value=5e-86, Identity=61%"; Hit description=Zinc finger, CCHC-type
  Pfam annotation: Domain name=Swi3; Domain location=74-158; Score =148.5; E_value=1.7e-41; Accession=PF07962.3; Description=Replication Fork Protection Component Swi3
  Pfam annotation: Domain name=zf-CCHC; Domain location=6-23; Score =32.2; E_value=1.8e-06; Accession=PF00098.13; Description=Zinc knuckle
  Pfam module annotation: Pfam domain module=Swi3::zf-CCHC; Domain location=74-158::6-23
  Subcellular localization annotation: CTP_CleavageSite=59; ConfidenceScore=5.41e-01
MEGTATGCYKCGRPGHWSRDCPFSAPNSNPNPNPNPNPNPATTPNPNTPNPSSSSFKSRSATEKPKKLPRTKPKLTPELLLSDDGLGYVLRYFPREFKYRGRGHEVRDLGNLLRLYTEWHSRLLPYYSFNQFVHKVEKVAATRRVKTCLRELRERVASGGDPTKLREPPVVHDIPSDEHGFSVSAEDGGATHQEADLFAEFENVNDIQEDMLNDIYDKATEEPSQSMHNVIGTSMASESNATEKTSEENGSSQSGKAEITEEQRARMEANRLKALERRAEITEEQRARMEANRLKALERRAALSQASQL

SEQ ID NO: 194596 - protein, 74 aa, Glycine max
  Coding DNA Sequence Number=SeqID_77818
MAYQSEAFINNGRWITVKDVNHCYGTWIIYCKVQETKTNSSGVIDSDDDEMDLDGNKRNNGHAVGCSNKFFVDL

SEQ ID NO: 194597 - protein, 420 aa, Glycine max
  Coding DNA Sequence Number=SeqID_77819
  Gene Ontology: Mol. function=DNA-directed RNA polymerase activity; Cellular component=nucleus; Biological process=transcription
  Homolog annotation: Hit_ID=Q9C8S4; Match level="QueryCoverage=99%, HitCoverage=36%, E-value=1e-163, Identity=69%"; Hit description=DNA -directed RNA polymerase subunit, putative; 8546-1198
  Pfam annotation: Domain name=RNA_pol_Rpa2_4; Domain location=37-94; Score=81.2; E_value=3.2e-21; Accession=PF06883.3; Description=RNA polymerase I, Rpa2 specific domain
  Pfam annotation: Domain name=RNA_pol_Rpb2_5; Domain location=95-145; Score=3.1; E_value=0.092; Accession=PF04567.7; Description=RNA polymerase Rpb2, domain 5
  Pfam annotation: Domain name=RNA_pol_Rpb2_6; Domain location=150-419; Score=239.5; E_value=7.4e-69; Accession=PF00562.18; Description=RNA polymerase Rpb2, domain 6
  Pfam module annotation: Pfam domain module=RNA_pol_Rpa2_4::RNA_pol _Rpb2_5::RNA_pol_Rpb2_6; Domain location=37-94::95-145::150-419
MSILNVLLEVGMTPSLPKIFLPGPPEALTVLLDGCVVGCIASSEVEKVVAHIRELKVSSVAVIPDDMEVGYVPLSMGGAYPGLYLCTSPSRFVRPVRNISIASDGSENIELIGPFEQVFMEIRCPDGGDGGRKSSFPATHEEIHPTVMLSVVANLTPWSDHNQSPRNMYQCQMAKQTMAFSSQTIQHRADQKLYHLQTPQTPIVRTSTYTKYNIDEFPTGTNAIVAVLAYTGYDMEDAMILNKSSVERGMFHGQIYQTETIDLTEQGGRSDRSSRMFRKSNIEKSACPSIDSDGLPHVGQMIRPDEPYCSIYNEVTSSIHTLKRKGSEAVYVDYVAADVKNKKHLQKVNIRFRHPRNPVIGDKFSSRHGQKGVCSQLWPDVDMPFSGTTGMRPDLIINPHAFPSRMTIAMLLESVAAKVL

SEQ ID NO: 194598 - protein, 452 aa, Glycine max
  Coding DNA Sequence Number=SeqID_77820
  Homolog annotation: Hit_ID=Q10F28; Match level="QueryCoverage=97%, HitCoverage=40%, E-value=1e-148, Identity=60%"; Hit description =Expressed protein
  Pfam annotation: Domain name=DUF810; Domain location=1-451; Score =170.7; E_value=3.6e-48; Accession=PF05664.2; Description=Protein of unknown function (DUF810)
MRQLMFGNHISESMDIRTRQGLLNALVGKVGKRMDTLLIPLELLCCISRSEFSDKKAFIRWQKRQLKVLEEGLVNHPAVGFGESGRKTNELRILLAKIEEAEFLPSSTGELQRTECLRSLREIAIPLAERPARGDLTGEICHWADGYHLNVRLYEKLLLSVFDMLDEGKLTEEVEEILELLKSTWRVLGITETIHQTCYAWVLFRQYVITREHGVLLHALEQLNKIPLMEQRGQQERLHLKSLHSKVEGERDMSFLQSFLTPIQRWTDKQLGDYHLHFNEGSATMEKIVAVAMITRRLLLEEPETSTQSLPISDRDQIEIYISSSIKNAFSRTVQVVDRVDMSHEHPLALLAEELKKFLKKESASFLPILSQRHPQATVVSASLVHKLYGHRLKPFLDSAEHLSEDVISVFPAAESLEQFIMALITSVCHEENAEILLKKLNLYQVRWINCF

SEQ ID NO: 194599 - protein, 232 aa, Glycine max
  Coding DNA Sequence Number=SeqID_77821
  Gene Ontology: Mol. function=DNA-directed RNA polymerase activity; Cellular component=nucleus; Biological process=transcription
  Homolog annotation: Hit_ID=Q9C8S4; Match level="QueryCoverage=82%, HitCoverage=16%, E-value=8e-66, Identity=64%"; Hit description=DNA -directed RNA polymerase subunit, putative; 8546-1198
MQSKLCNLRGADPQKLVSYKEEASEMGGYFILNGLERVVRLLILPKRNYQPMSMVRNSFSDRREGYTDKAVVIRCVRADQSSLSVRLYYLRNGSARLGFWLRGREYLLPVGIILKALIDTTDREIYVNLTSCYNEKYEKGKGAVGTQLVGERAKIILDELRDLSLFTRLQCLEYIGTSHGTLQGEHFQPVMNELKNDSYPINLGGTTPQKLAIVVVDHKALYTRNTKFSLSA

SEQ ID NO: 194600 - protein, 193 aa, Glycine max
  Coding DNA Sequence Number=SeqID_77822
MEFRVPEGASQFLWAQPSISRSGELKKSCSEWKGGCKIKASSLGTRRVFQIQNAVMYVAVYSWTNEEPPLITSQEGEEVKTMECGRRSRQWNVGRGQDMEITGIPEVKEMEHYCGGTSGHHTTTASSIELPITIEVEDAEGSAEREMDDKETIVEEKLSIKNTPTQRAQIGVQGVKPHDFARNQGCPAPMSDL

SEQ ID NO: 194601 - protein, 85 aa, Glycine max
  Coding DNA Sequence Number=SeqID_77823
MVAKPGSVPDFEALRELFKHHIESFDYMVDAGLDTMLGHIKPVEVFDDFTSTKLRNILFLMEKTLAVSAAEGADFEDNAGGFTSV

SEQ ID NO: 194602 - protein, 85 aa, Glycine max
  Coding DNA Sequence Number=SeqID_77824
MAFIIVGITALGRKGKAGHSIVVETSTFSILIIGIRVLILECRIVNGDEGECENGGTHGSHGESNRRESRSSGITVEFNLKDDTK

SEQ ID NO: 194603 - protein, 467 aa, Glycine max
  Coding DNA Sequence Number=SeqID_77825
  Gene Ontology: Mol. function=exonuclease activity; Cellular component= intracellular; Biological process=tRNA splicing
  Homolog annotation: Hit_ID=Q2R3D7; Match level="QueryCoverage=75%, HitCoverage=91%, E-value=2e-50, Identity=51%"; Hit description =Exonuclease family protein, expressed
  Pfam annotation: Domain name=Exonuc_X-T; Domain location=118-365; Score=65.3; E_value=1.9e-16; Accession=PF00929.14; Description =Exonuclease
  Pfam annotation: Domain name=zf-GRF; Domain location=421-467; Score =20.5; E_value=9.7e-05; Accession=PF06839.3; Description=GRF zinc finger
  Pfam module annotation: Pfam domain module=Exonuc_X-T::zf-GRF; Domain location=118-365::421-467
GKGFPCNFQSNGSSMEGFTELKNEPGTHPSGDVAEPNCHLGSEFLEPSNEFHTKPTYHQNYSTWTPCHFNSHKVQQCQMNAFESHYYPYPVENPLQYVPINMVAQGYPREQYQEFQYFVVIDFEATCDKDKNPHPQEIIEFPSVIVSSITGQLEACFQTYVRPTCNQLLSDFCKDLTGIQQIQAINFSYLDSTEYRTNNSQQLLFAKRADVIPLCMGSSNEGGKVGEFDGVGDENNGPEGLVHLIVAEEVPLVRAQDMVDRGVTLSEALLRHDKWLEKKGIKNSNFAVVTWSNWDCRVMLESECRFKKIRKPPYFNRWINLRIPFREVFGAVKCNLKEAVEIAGLAWQGRAHCGLDDAKNTARLLALLMHRGFKFSITNSIMWQTADRPLMWKQSPEQPIVFPHCPYKAKDITTPVVQYHPFCFCGVKSSRGMVRKPGPKQGSLFFGCGNWTATRGARCHYFEWASN

SEQ ID NO: 194604 - protein, 165 aa, Glycine max
  Coding DNA Sequence Number=SeqID_77826
  Gene Ontology: Mol. function=RNA-directed DNA polymerase activity; Cellular component=chromatin; Biological process=chromatin assembly or disassembly
MSRGNEDTVVHDDNRWRNLEMSIFDGEDPMDWLTKIERYFQLHVVREKDKLETIMVAMDGEALGWFQWWKSWNQNHSWDGFKIVVTQRFQASSQGNPFQVLLALKQEETMQGFIVKFEKCFGMVKGLVEPFLVEVFLKGLNEEISTKDPMDDKVEEPSIICHSRK

SEQ ID NO: 194605 - protein, 189 aa, Glycine max
  Coding DNA Sequence Number=SeqID_77827
  Homolog annotation: Hit_ID=Q9SLZ4; Match level="QueryCoverage=76%, HitCoverage=12%, E-value=5e-51, Identity=70%"; Hit description =Retinoblastoma-related protein
MAATKSSLASLSSASVFNGLFAVFDKVEWDYGNLTWEDIYCATLNGLALEEKSCKEATNLFGETKHILLSNFSSMGNGTSEEAERYWFAFILYSVKKLIQKNDEGEKEDTENTGLSLCRILRATKLKLFYYLLYAYLIFNSIADFFKELPQFVVKAGPTLSNLYGTDWENRLEAKEMHANAIHLKILSK

SEQ ID NO: 194606 - protein, 704 aa, Glycine max
  Coding DNA Sequence Number=SeqID_77828
  Gene Ontology: Mol. function=transcription coactivator activity; Cellular component=chromatin; Biological process=negative regulation of transcription from RNA polymerase II promoter
  Homolog annotation: Hit_ID=Q9SLZ4; Match level="QueryCoverage=99%, HitCoverage=72%, E-value=0.0, Identity=76%"; Hit description =Retinoblastoma-related protein
  Pfam annotation: Domain name=RB_A; Domain location=138-339; Score =387.8; E_value=1.6e-113; Accession=PF01858.7; Description =Retinoblastoma-associated protein A domain
  Pfam annotation: Domain name=RB_B; Domain location=455-551; Score =101.5; E_value=2.5e-27; Accession=PF01857.10; Description =Retinoblastoma-associated protein B domain
  Pfam module annotation: Pfam domain module=RB_A::RB_B; Domain location=138-339::455-551
MEKANNVIADILKKQPCLASECETENLENIDKDGLTYFKDLMEESSLPSSLSMLEKDYDYMIRNKSELDERLFINEDDSLLASVSLSGGSVSAGGVKRKFDSMASPAKTITSPLSPHRSPASHANGIPGSANSKMAATPVSTAMTTAKWLRTVISPLPSKPSPELERFLTSCDRDATSDVVRRAQIILQAIFPSSPLGERCVTGSLQSANLMDNIWAEQRRLEALKLYYRVLEAMCRAEAQVLHATNLTSLLTNERFHRCMLACSAELVLATHKTVTMLFPAVLERTGITAFDLSKVIESFIRHEESLPRELRRHLNSLEERLLESMVWEKGSSMYNSLAVARPSLSAEINRLGLLAEPMPSLDEIAMHINFSCGGLPPVPTLPKLESSSNQNGDIRSPKRNVLMERNSFTSPVKDRLLPFNSLKSKLPPPPLQSAFASPTKPNPGGGGETCAETGINIFFGKIIKLGAVRISGMVERLQLSQQIRENISQLNLTFKEIVYNYRKQPHCKPQVFRSVFVDWSLARRNGRTGQEHIDIITFYNEIFIPSVKPLLVELGPAGPTTKSDRIPEINKNDGHLAQCPGSPKISPFPTLPDMSPKKVSATHNVYVSPLRSSKMEALISHSSKSYYACVGESTHAYQSPSKDLTAINNRLNGNRKVRGPLNFDDVDIGLVSDSMVANSLYLQNGSCASSSGAPLKSEQPDS

SEQ ID NO: 194607 - protein, 155 aa, Glycine max
  Coding DNA Sequence Number=SeqID_77829
MSYRMSRHHASEHADCMCPYEQINQVNNTRELLTQFGAPHLHLGATKPGRKSTLNSVSSRSNNPCLQPSHLTTTHITDLYVQYYRARCQDIVSDILDPAASMLHLTFILHCTALPVFSSRMSGHCIRHRGSFNFNSSLDTLSCLVHYAARSYSLT

SEQ ID NO: 194608 - protein, 1232 aa, Glycine max
  Coding DNA Sequence Number=SeqID_77830
  Gene Ontology: Mol. function=protein binding; Cellular component =membrane; Biological process=defense response
  Homolog annotation: Hit_ID=Q6SQJ2; Match level="QueryCoverage=99%, HitCoverage=97%, E-value=0.0, Identity=61%"; Hit description=NBS-LRR type disease resistance protein RPG1-B
  Pfam annotation: Domain name=LRR_1; Domain location=1006-1024; Score =5.9; E_value=23; Accession=PF00560.23; Description=Leucine Rich Repeat
  Pfam annotation: Domain name=LRR_1; Domain location=1028-1051; Score =10.8; E_value=2.7; Accession=PF00560.23; Description=Leucine Rich Repeat
  Pfam annotation: Domain name=LRR_1; Domain location=1077-1097; Score =1.0; E_value=1.8e+02; Accession=PF00560.23; Description=Leucine Rich Repeat
  Pfam annotation: Domain name=LRR_1; Domain location=1100-1123; Score =5.4; E_value=27; Accession=PF00560.23; Description=Leucine Rich Repeat
  Pfam annotation: Domain name=LRR_1; Domain location=1125-1147; Score =2.1; E_value=1.2e+02; Accession=PF00560.23; Description=Leucine Rich Repeat
  Pfam annotation: Domain name=LRR_1; Domain location=1148-1171; Score =10.6; E_value=3; Accession=PF00560.23; Description=Leucine Rich Repeat
  Pfam annotation: Domain name=LRR_1; Domain location=1173-1196; Score =7.8; E_value=9.9; Accession=PF00560.23; Description=Leucine Rich Repeat
  Pfam annotation: Domain name=LRR_1; Domain location=588-610; Score =11.6; E_value=1.9; Accession=PF00560.23; Description=Leucine Rich Repeat
  Pfam annotation: Domain name=LRR_1; Domain location=612-633; Score =15.9; E_value=0.15; Accession=PF00560.23; Description=Leucine Rich Repeat
  Pfam annotation: Domain name=LRR_1; Domain location=635-657; Score =11.0; E_value=2.4; Accession=PF00560.23; Description=Leucine Rich Repeat
  Pfam annotation: Domain name=LRR_1; Domain location=659-680; Score =6.7; E_value=16; Accession=PF00560.23; Description=Leucine Rich Repeat
  Pfam annotation: Domain name=LRR_1; Domain location=793-814; Score =1.3; E_value=1.6e+02; Accession=PF00560.23; Description=Leucine Rich Repeat
  Pfam annotation: Domain name=LRR_1; Domain location=816-838; Score =0.4; E_value=2.4e+02; Accession=PF00560.23; Description=Leucine Rich Repeat
  Pfam annotation: Domain name=LRR_1; Domain location=871-894; Score =11.5; E_value=2; Accession=PF00560.23; Description=Leucine Rich Repeat
  Pfam annotation: Domain name=LRR_1; Domain location=914-931; Score =1.7; E_value=1.4e+02; Accession=PF00560.23; Description=Leucine Rich Repeat
  Pfam annotation: Domain name=LRR_1; Domain location=961-983; Score =3.3; E_value=70; Accession=PF00560.23; Description=Leucine Rich Repeat
  Pfam annotation: Domain name=NACHT; Domain location=206-358; Score= -37.8; E_value=0.051; Accession=PF05729.3; Description=NACHT domain
  Pfam annotation: Domain name=NB-ARC; Domain location=165-469; Score =345.9; E_value=6.6e-101; Accession=PF00931.13; Description=NB-ARC domain
  Pfam annotation: Domain name=VirE; Domain location=178-309; Score= -100.8; E_value=0.092; Accession=PF05272.2; Description=Virulence -associated protein E
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::NACHT::NB-ARC::VirE; Domain location=1006 -1024::1028-1051::...
  Pfam module annotation: Domain location=1077-1097::1100-1123::1125 -1147::1148-1171::1173-1196::588-610::612-633::635-657::659-680::793 -814::816-838::871-894::914-931::961-983::206-358::165-469::178-309
MAETLVGGALLSAFLQVVFDKLASRQVLNFFHGRKLDEMLLSNLNVKLLSIDALAADAEQKQFRDPRVRAWLVDVKDVVLDAEDVLDEIDYELSKFEVETELESQSLTCTCKVPNLFNACFSSLNKGKIESRMREVLQKLEYLSSQKGDLGLKEGSGGGVGSGRKMPHKLPSTSLLSESVIYGRDDDREMVINWLISDNENCNQLSILSIVGMGGLGKTTLAQHVFNDPKMEDQFSIQAWVCVSDELDVFKVTRTILEAITKSTDDSRDLEMVQGRLKDKLAGKRFLLVLDDIWNENRENWEAVQTPLKYGAQGSRILVTTRSKKVASIMRSNKVHHLNQLQEDHCWQVFGKHAFQDDNSLLNPELKEIGIKIVEKCKGLPLALKTIGSLLHTKSSVSEWGSVLTSKIWDLPKEDSEIIPALLLSYNHLPSHLKRCFAYCSLFPKDYKFDKEHLILLWMAENFLHCLNQSQSPEEVGEQYFDDLLSRSFFQQSSRFPTCFVMHDLLNDLAKYVCGDICFRLGVDRAKSTPKTTRHFSVAINHVQYFDGFGASYDTKRLRTFMPTSGGMNFLCGWHCNMSIHEFSRFKFLHVLSLSYCSGLTDVPDSVDDLKHLRSLDLSGTRIKKLPDSICSLYNLQILKVGFCRNLEELPYNLHKLINLRHLEFIGTKVRKVPMHLGKLKNLHVWMSWFDVGNSSEFSIQMLGELNLHGSLSIGELQNIVNPSDALAVNMKNKIHIVELEFEWNWNWNPEDSRKEREVLENLQPYKHLEKLSIRNYGGTQFPRWLFDNSSLNVLSLKLDCCKYCSCLPPLGLLPSLKHLTVAGLDGIVGINADFYGSSSSSFKSLETLHFSDMEEWEEWECNSVTGAFPRLQHLSIEQCPKLKGNLPEQLLHLKNLVICDCKKLVASAPRALQIRELELRDCGNVQFDYHPSTLKWLTITGHNIEASSLEKIGHIISDTSLEFLHIYYCPNMKIPTSHCYDFLVTLKISGGCDSLITFPLDFFPKLSSLDLRCCNLKTISQGQPHNHLKDLKISGCPQFESFPREGLSAPWLERFSIEGLESMKSLPERMHFLLPSLTSISILDCPQVESFSDGGFPSNLKKMDLSNCSKLIASLEGALGANTSLETLSIRKVDVESFPDEGLLPPSLTSLWIYNCPNLKKLDYKGLCHLSFLEILLLYYCGSLQCLPEEGLPKSISTLEIFGCPLLKQRCQQPEGEDWGKIAHIKNIRLW

SEQ ID NO: 194609 - protein, 209 aa, Glycine max
  Coding DNA Sequence Number=SeqID_77831
MVDSLFKETCYLDCTLHRSFVGRISGAGEYNGDYSFDSHEKVIYKVIGYRSKTAGNSHLRDNSSITRCVEHQECQLSSKIRIFREASLYRIYLYYLVVVLIIPLCSVLPTQQDAFSMCYLFLRDWIFEDLVALIRLRGDDSDFTTVSLVFLWRVRNGMCSGVNMNFTRTDTWHKTYSHQRILEKDSLCGFERSKLASIIGIWSIKFTEN

SEQ ID NO: 194610 - protein, 938 aa, Glycine max
  Coding DNA Sequence Number=SeqID_77832
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q9LIK7; Match level="QueryCoverage=97%, HitCoverage=89%, E-value=0.0, Identity=58%"; Hit description =Putative calcium-transporting ATPase 13, plasma membrane-type (EC 3.6.3.8) (Ca(2+)-ATPase isoform 13)
  Pfam annotation: Domain name=Cation_ATPase_C; Domain location=780 -922; Score=51.9; E_value=2.2e-12; Accession=PF00689.11; Description =Cation transporting ATPase, C-terminus
  Pfam annotation: Domain name=Cation_ATPase_N; Domain location=5-85; Score=37.1; E_value=6e-08; Accession=PF00690.16; Description=Cation transporterATPase, N-terminus
  Pfam annotation: Domain name=E1-E2_ATPase; Domain location=99-344; Score=180.8; E_value=3.3e-51; Accession=PF00122.10; Description=E1 -E2 ATPase
  Pfam annotation: Domain name=Hydrolase; Domain location=348-684; Score=71.9; E_value=2e-18; Accession=PF00702.16; Description =haloacid dehalogenase-like hydrolase
  Pfam module annotation: Pfam domain module=Cation_ATPase_C::Cation _ATPase_N::E1-E2_ATPase::Hydrolase; Domain location=780-922::5-85::99- 344::348-684
MMIDQSLTQVVGGIKELAQLLETDLKHGIGDNNKDDIDHRKRVFGVNMLTKPPSKCFLSFVLESFNDTTIIILLVCSLLSLFFGIKQHGWKEGWYDGGSIILAVILVIAVSSVSNFNQSKQFQKLSAKSNNMGGVEVVRGGRRQSISTFDVVVGDIVCLKVGDQVPADGVFLEGHSLKVDESRMTGESDHVHVHANGTKVTDGFARMLVTSVGMNTAWGTMMGFITNKEVNNEETPLQVRLNKLTSAIGKVGLLVAALVLVVSMARYFAGCTRDDFGNREFVRGRTESDDVVNAVVAIVAAAVTIVVVAIPEGLPLAVTLSLAFSMKKMMRDNAMVRRISACETMGSATTICTDKTGTLTLNEMKVTEVWVGKRKIKADQEEDLAPSLVQLLKEGIGLNTTGSVYFHPHQTSSSLPEISGSPTEKALLSWAVEDLGMGDIDEVKQHCEIIHVETFNSEKKRSGILMREKRGRSNSSNNRVHTHWKGAAEMILRMCSTYYDHTGQIIIIDDEERAQIENIVECMATKSLRCIAFAQKSLLCEKLELEETELTLLGILGLKDPCRPGVGAAVESCKNAGVKIKMITGDNAHTARAIASECGILDDELDDDQAAVVEGFQFRNFSHEERMDKIDRIKVMARSSPSDKLLMVQCLKQKGHVVAVTGDGTNDAPALKEADIGLSMGIQGTDVAKESSDIVILDDNFSSVVTVLERGRCVYANIQKFIQFQLTVNVAALAINFVAAVSSGKVSLSAVQLLWVNLVMDTLGALALATEQPTNDLMNMPPVGRVDPLITRVMWRNLISQAVYQVLVLLTLQFEGRSSIFGGVNEKVKNTMIFNAFVLCQVFNEFNARKLETKNIFEGLGKNKLFMVIVGLTVVLQLVMVEFLNKFANTERLTWEQWCVCVAIGVLSWPIGLLVKCLPVRNKCLPIVTDLRSIARRK

SEQ ID NO: 194611 - protein, 440 aa, Glycine max
  Coding DNA Sequence Number=SeqID_77833
  Gene Ontology: Mol. function=binding
  Homolog annotation: Hit_ID=Q1T1J1; Match level="QueryCoverage=45%, HitCoverage=44%, E-value=6e-76, Identity=71%"; Hit description=TPR repeat
  Pfam annotation: Domain name=TPR_2; Domain location=25-58; Score =20.3; E_value=0.0067; Accession=PF07719.7; Description =Tetratricopeptide repeat
  Pfam annotation: Domain name=TPR_2; Domain location=271-304; Score =5.6; E_value=7.3; Accession=PF07719.7; Description=Tetratricopeptide repeat
  Pfam annotation: Domain name=TPR_2; Domain location=59-92; Score=0.8; E_value=27; Accession=PF07719.7; Description=Tetratricopeptide repeat
  Pfam annotation: Domain name=TPR_2; Domain location=95-128; Score =7.1; E_value=4.9; Accession=PF07719.7; Description=Tetratricopeptide repeat
  Pfam module annotation: Pfam domain module=TPR_2::TPR_2::TPR_2::TPR _2; Domain location=25-58::271-304::59-92::95-128
MLEQGYVDQAGYCLLKAIKADPKDVTLRCHLARLYAELGHYQKAAVTYEQVHKLCCENIDALKAAAKFYKKCGQVEYSVRILEDYIKSQPDVANASVVDLLGTILMETKAHDRALQHIEHAQAVNARKELPLNLKIKAGICHAHLGNLEMAQVLFNDLKPENASKHIDLVTGVADSLMGLEHYNPALNYYLMLEGNVEKENVWLFFREFYKDHLVIIVLTPHIKRIDGQCYVTQLLRSIGKNPSPTLPRNSAKIEYISGGQSSPYELAFGGLLYLKIARCYMSLKERSQAILFYSKGKNWDFRIEFSSLETLQDDVDARITLASLLLEEGKEDEAIFLLSPPKDSDFGEAPSGKSNRWWFDIRIKLKLCNIYWNRGTLDDFVDTIFPLIRESLYVATCRQKIMSYKERGLYLGGKINCEPQTWTQTLDNGHYMDTDAVDV

SEQ ID NO: 194612 - protein, 243 aa, Glycine max
  Coding DNA Sequence Number=SeqID_77834
  Gene Ontology: Mol. function=GTP binding; Cellular component =intracellular
  Homolog annotation: Hit_ID=Q69NK1; Match level="QueryCoverage=72%, HitCoverage=30%, E-value=1e-27, Identity=41%"; Hit description=GTP -binding protein-like
MERIICVCVEEKMITESTTISLQRASSSDSTPRFVKLKTKSGFELAREIIHNSTEKQNLPLSREGNYDEVNSQSLHVCPGCGVYMQDSNPKHPGYFIKPSEKDLSYRLYNNLEPVAQEPEFSNTVKRGIVIEPEKLDDDDANLIRKPEKPVVCARCHSLRHYGKVKDPTVENLLPDFDFDHTVGRKLASASGTRSVVLMVVDVVDFDGSFPRKVAKLVSKTIEDHSAAWKQGKSGMCLEWCLW

SEQ ID NO: 194613 - protein, 284 aa, Glycine max
  Coding DNA Sequence Number=SeqID_77835
  Gene Ontology: Mol. function=GTP binding; Cellular component =intracellular; Biological process=electron transport
  Homolog annotation: Hit_ID=Q69NK1; Match level="QueryCoverage=94%, HitCoverage=45%, E-value=9e-98, Identity=64%"; Hit description=GTP -binding protein-like
  Pfam annotation: Domain name=MMR_HSR1; Domain location=8-122; Score =24.2; E_value=6.1e-06; Accession=PF01926.13; Description=GTPase of unknown function
VDLAGPRGNVWAVGAQNAGKSTLINSIGKYAGGKITHLTEAPVPGTTLGIVRVEGVFSSQAKLFDTPGLLHPYQITTRLMREEQKLVHVGKELKPRTYRIKAGHSIHIAGLVRLDIEETPLDSIYVTVWASPYLPLHMGKIENACKMFQDHFGCQLQPPIGEKRVQELGNWVRREFHVSGNSWESSSVDIAVAGLGWFAFGLKGDAVLGVWTYEGVDAVLRNALIPYRSNTFEIAGFTVSKIVSQSDQALNKSKQRNDKKAKGIDSKAPTSFVESPLLTSGGDI

SEQ ID NO: 194614 - protein, 118 aa, Glycine max
  Coding DNA Sequence Number=SeqID_77836
  Gene Ontology: Mol. function=protein serine/threonine kinase activity; Cellular component=intracellular; Biological process =protein amino acid phosphorylation
  Homolog annotation: Hit_ID=Q9LJD8; Match level="QueryCoverage=94%, HitCoverage=9%, E-value=2e-40, Identity=66%"; Hit description=MAP3K epsilon protein kinase
  Pfam annotation: Domain name=Pkinase; Domain location=3-118; Score= -110.6; E_value=0.057; Accession=PF00069.15; Description=Protein kinase domain
MPRCFQQEIDLLKLSWYYLLHFFQVYIVHNLNHKNIVKYLGSSKTKSHLHIVLEYVENGSLANIIKPNKFGPFPESLVAVYIAQGLVKLADFGVATKLTEADVNTHSVVGTPYWMAPE

SEQ ID NO: 194615 - protein, 282 aa, Glycine max
  Coding DNA Sequence Number=SeqID_77837
MDWYYGCESSDFLVPKDQEDLLERHPSPENWSEWGINAPEGFNSPQEYLIMDTDETEVEFNFIDESFKNEIEFDPCLYDKDQSSSSSACGGLPEQSFQQTELSCDHQLQDQSTLEQKDDIFLDSVLEDFPCVESLRKSFFYPENQCSNTTGENYILVSEQVISKRSIIWMYKITNLFFPSGGVQKDIAASGTNFHTNSNCKVLDPFEQFNEDDIMVEQLSLEEFTLQGFEMLIAQFTEKTRICFRDALYRLARNTKQHVVEDLDGDLNMHQEMPDSVYNDTM

SEQ ID NO: 194616 - protein, 69 aa, Glycine max
  Coding DNA Sequence Number=SeqID_77838
MEVRTLKAEEGKGSILPTLETAQPEVGSSGWKSTARRVVSGAPPAALENPEDRVPPTPGRTHNRIRSPR

SEQ ID NO: 194617 - protein, 88 aa, Glycine max
  Coding DNA Sequence Number=SeqID_77839
  Subcellular localization annotation: CTP_CleavageSite=41; ConfidenceScore=5.22e-01
MRTLGPSSAALAQSSWSLLLMVLVIGPFLGRIASARTKKTRQMTSKAAKEIADKIDSLENQASQGSFIAHGRQDVLTAAIGRPKHPGH

SEQ ID NO: 194618 - protein, 178 aa, Glycine max
  Coding DNA Sequence Number=SeqID_77840
  Homolog annotation: Hit_ID=Q3BVK1; Match level="QueryCoverage=84%, HitCoverage=43%, E-value=1e-16, Identity=31%"; Hit description =Putative secreted protein precursor
VVGAAANGGGHAPGGGGGGIVLAVVQADLEGGVLQAGQRQGGGLVDVGRNAAGDVAEIHVGGDVSAALRQHVGGSGETEGRTRAVGTGGTAVAGGGDGGATGQHLVPGPGQHHAGTAESAAVRAGGEDLVGLESDRTAAQSAHHCAPVSSGTVVAHGQLLRWLVCRAGPVPLTWPKLA

SEQ ID NO: 194619 - protein, 291 aa, Glycine max
  Coding DNA Sequence Number=SeqID_77841
MAAKVERGWARAISPLALARCSLLTGAASPSGGIGAVHFGVQRHMHCFVVMLFLFMMRLNIRSEIGFKASCRCSQVAHALLVHDETKHKNTCNDIEYLQNFIVKESKKLKRGRKRYIMNSIITVLYFNGRVYEDNDGVIFEGSKKAIQIKRGISFNALKKKLEIRFLVSGKYVALQICDDEDVETMIESFQQQQQMSVLELYVEKDVAGGSMFHAANSVTSCGRNVSHYESELPKNISNLHVDEDDDDDDDDDDYLASNSYVEESFDEDDSDDGISHTDDEVTDIVEPVRG

SEQ ID NO: 194620 - protein, 57 aa, Glycine max
  Coding DNA Sequence Number=SeqID_77842
MHEMAPKKLSVKRSRRNAAAEGTSAALEFDNHRFRSAMHQQRFEAIKGWSFHRERRV

SEQ ID NO: 194621 - protein, 90 aa, Glycine max
  Coding DNA Sequence Number=SeqID_77843
  Gene Ontology: Mol. function=nucleotide binding; Cellular component =chloroplast; Biological process=protein folding
  Homolog annotation: Hit_ID=Q9C7X7; Match level="QueryCoverage=78%, HitCoverage=11%, E-value=5e-34, Identity=97%"; Hit description=Heat shock protein, putative
MAGKGDGPAIGIDLGTTYSCVGVWQHDRVEIIANDQGNRTTPSYVAFTDSERLIGDAAENQVAMNPVNTVFGKIPNRLFALSRSALFLDF

SEQ ID NO: 194622 - protein, 593 aa, Glycine max
  Coding DNA Sequence Number=SeqID_77844
  Homolog annotation: Hit_ID=Q9LHK2; Match level="QueryCoverage=95%, HitCoverage=47%, E-value=0.0, Identity=59%"; Hit description =Arabidopsis thaliana genomic DNA, chromosome 3, P1 clone: MMF12
MGIRMEGGIQKLMKFVRGNPEQQPLRLNPAEVQDVIAAVCSEAYSPNTNATTASTRLSNNSGKPSTDVAYGSLDNVLLIHCCMKALPRYGYVDMLSSSKTACRVRAFDLILNLAVHAHLLEPIIADDASTIEEEYSQESYYDSDTQVMVQGSSKGSPQNKSDTGSAIDKFESWILNILYEILLLLVQSEEKDESVWASALSCLLYFVCDRGKIKRNRLRGLDIRVLKALVKSSRENSWAELVHCKLISMLTNMFYEVAESVPGKPKFLVDQLDLIGGVQFIFIEYSLANSREERKNLYLVLFDYILHQINETCIASGVNEYNDDEIQPLAALLAQTNAPEAFYISVKLGVEGIGEILRRSIASALSRYPNSERLNMLLEVVAEKFDSVISTFTHLDKEFSHMNQITKSLKFLENMEGVIMRNGIGLQAKHSWATLHSLLHSERISYRQNGYIWLGDLLIAEINGERDGNIWSSITYFLQKIAQAGTQDSSNTSDVPLPILLMCGLLKSKYCYIRWGFLFVLERLLMRCKFLLDEHEMQQSSTRDLGHGKKDWHLEKANAMIDIMSGALSLVFQINETDRINILKVIVSELNAF

SEQ ID NO: 194623 - protein, 1097 aa, Glycine max
  Coding DNA Sequence Number=SeqID_77845
  Gene Ontology: Mol. function=phospholipase D activity; Cellular component=membrane; Biological process=phosphatidylcholine metabolic process
  Homolog annotation: Hit_ID=P93733; Match level="QueryCoverage=88%, HitCoverage=98%, E-value=0.0, Identity=70%"; Hit description =Phospholipase D beta 1
  Pfam annotation: Domain name=C2; Domain location=285-391; Score=70.4; E_value=5.6e-18; Accession=PF00168.20; Description=C2 domain
  Pfam annotation: Domain name=PLDc; Domain location=608-643; Score =42.3; E_value=1.6e-09; Accession=PF00614.12; Description =Phospholipase D. Active site motif
  Pfam annotation: Domain name=PLDc; Domain location=943-970; Score =39.5; E_value=1.2e-08; Accession=PF00614.12; Description =Phospholipase D. Active site motif
  Pfam module annotation: Pfam domain module=C2::PLDc::PLDc; Domain location=285-391::608-643::943-970
MDNYGSSSPYRYPNQYMYPPNPHQPYPPPPGSAPDPYAQHVPYQPYPYLSSHSFNYSYPPPPRSSSHSGHFEYSYPPPHPPPSYANPPYPYPYHVPPPNHDPPKPSLSHHASFQHEPSHYYYQQPNDAYSASAPQVHPDVHLRTNSFSGPYWHENTSTAGDEVSQTSDNSKPSQGSAYPSLDDLMSNVRLSDDQPTAPASPPAPAGQPFMHSISVPKLQQKREEFYGYSNNSFSGWGSSYHSRVDSSRLSDFSGSFNESVHSQSLQIVPVQNKGSLRVLLLHGNLDIWVHEAKNLPNMDMFHKTLGDMFGKLPGSVGNKIEGTMNKKITSDPYVSISVSNAVIGRTYVISNSENPVWLQHFYVPVAYHAAEVHFLVKDSDIVGSQLIGIVAIPVEKIYSGEVVEGTFPILNNNGKPCKQGAVLTLSIQYIPMEKLSIYHQGVGAGPEYIGVPGTYFPLRRGGTVTLYQDAHVPDGSLPNVLLDSGMYYVNGKCWQDIFDSISQARRLIYITGWSVWHKVRLVRDAAGYASDYTLGDLLRSKSQEGVRVLLLIWDDPTSRSILGYKTDGVMATHDEETRRFFKHSSVQVLLCPRSGKRHSWIKQKEVGTIYTHHQKTVIVDADAGNNRRKIIAFVGGLDLCDGRYDTPHHPLFRTLNTIHKDDYHNPTFTGNAGGCPREPWHDLHSKIDGPAAYDVLTNFEERWLKASKPHGIKKLKISDDDALLRLERIPDVIGINDAPSVGEDDPEVWHAQIFRSIDSNSVKRFPKDPKDATSKNLVCGKNVLIDMSIHTAYVKTIRAAQHYIYIENQYFIGSSYNWSQHKDLGANNLIPMEIALKIAEKIKANERFAVYVVIPMWPEGVPTGAATQRILFWQNKTMQMMYETIYKALVEAGLEAAFSPQDYLNFFCLGNREAGNLYDNVSMTGAPPPANSPQAASRNSQRFMIYVHSKGMIVDDEYVILGSANINQRSMEGTRDSEIAMGAYQPHHTWARKQSYPHGQIHGYRMSLWAEHTGTIEECFLKPESLECVRRVRAMGEMNWKQFSANEATEMKGHLMKYPVEVDRKGKVRPLQDCEEFPDVGGKIVGSFLAMKENLTI

SEQ ID NO: 194624 - protein, 80 aa, Glycine max
  Coding DNA Sequence Number=SeqID_77846
  Subcellular localization annotation: CTP_CleavageSite=21; ConfidenceScore=5.59e-01
MSSSFSSSRPLQQLIAVSRLKSSTVKKLPEPLRRAVADCLSSPLSPSNEPSRTLQEVISPCGWLGKRVGSSKLSFSYALS

SEQ ID NO: 194625 - protein, 754 aa, Glycine max
  Coding DNA Sequence Number=SeqID_77847
  Gene Ontology: Mol. function=identical protein binding; Cellular component=cytoplasm; Biological process=negative regulation of enzyme activity
  Homolog annotation: Hit_ID=Q84WS0; Match level="QueryCoverage=94%, HitCoverage=90%, E-value=0.0, Identity=54%"; Hit description =Putative subtilisin-like serine protease
  Pfam annotation: Domain name=PA; Domain location=355-454; Score=81.8; E_value=2.1e-21; Accession=PF02225.12; Description=PA domain
  Pfam annotation: Domain name=Peptidase_S8; Domain location=104-596; Score=60.7; E_value=4.9e-15; Accession=PF00082.12; Description =Subtilase family
  Pfam annotation: Domain name=Subtilisin_N; Domain location=12-101; Score=27.8; E_value=3.7e-05; Accession=PF05922.7; Description =Subtilisin N-terminal Region
  Pfam module annotation: Pfam domain module=PA::Peptidase _S8::Subtilisin_N; Domain location=355-454::104-596::12-101
MVTNSIAFSDQQTYIVHMDQTKIKASNQDSTKPWYESIIDFISESSMQEDDEEDILAPQLLYTYETSMFGFAVHLSKKHLKYLNQVDGFLSAIPDELSTLHTTYSPHFLGLRNGRSLWSASNLATDVIIGVLDSGIWPEHISFQDSGMSPVPSHWKGVCEKGTKFSSSNCNKKLIGARTYYKGYEKFFGKKINETVDYLSPRDSEGHGTHTASTAAGRVVKNANLFGQARGTASGMRYTSRIAVYKVCWSSGCTNADVLAAMDQAVSDGVDVLSLSLGSIPKPFYSDSIAIASFGATKKGVFVACSAGNSGPFPSTVGNGAPWITTVAASSTDRSFPTKVKLGNGKTFEGSSLYQGKKTNQLPLVYGKSAGAKKEAQYCIGGSLDPKLVHGKIVACERGINGRTEKGEEVKVAGGAGMILLNNEYQGEELFADPHILPATSLGASASKTIRSYSQSVKKPTASISFMGTRFGDPAPVMAAFSSRGPSLVGPDVIKPDVTAPGVNILAAWPSKISPSFLMSDKRKVLFNILSGTSMSCPHVSGIAALLKSFHKDWSPAAIKSALMTTAYTLNNKGAPISDMASDNSPFATPFAFGSGHVNPVNASDPGLVYDISTKDYLNYLCSINYTSSQIALLSRGKFVCSKKTLLQAGNLNYPSFSVLFGRSASNASVTYRRVVTNVGNPQSAYAVKLEQPNGVSVTVEPRKLKFEKVGQKLSYKVTFLSIGGARVAGFVFLIKCPPIFKYELIPFLALRDC

SEQ ID NO: 194626 - protein, 757 aa, Glycine max
  Coding DNA Sequence Number=SeqID_77848
  Gene Ontology: Mol. function=identical protein binding; Cellular component=cytoplasm; Biological process=negative regulation of enzyme activity
  Homolog annotation: Hit_ID=Q84WS0; Match level="QueryCoverage=98%, HitCoverage=94%, E-value=0.0, Identity=53%"; Hit description =Putative subtilisin-like serine protease
  Pfam annotation: Domain name=PA; Domain location=357-456; Score=81.4; E_value=2.8e-21; Accession=PF02225.12; Description=PA domain
  Pfam annotation: Domain name=Peptidase_S8; Domain location=107-598; Score=50.1; E_value=7.2e-12; Accession=PF00082.12; Description =Subtilase family
  Pfam annotation: Domain name=Subtilisin_N; Domain location=12-104; Score=27.2; E_value=5.7e-05; Accession=PF05922.7; Description =Subtilisin N-terminal Region
  Pfam module annotation: Pfam domain module=PA::Peptidase _S8::Subtilisin_N; Domain location=357-456::107-598::12-104
MATNSIAVADQQTYIVHMDKTKLKVSIHSHDRSKPWSESIIYFISEASMQEEEEKEEILAPQLLYTYETTMFGFAAQLSKKHLKYLNQVDGFLSAIPDELSTLHTTYTPHFLGLDNGSALWSASNLASDMIIGVIDSGIWPEHISFQDSGLSPVPSHWKGVCEQGTNFSASDCNKKLIGARTYFKGYEKVFGKLNETVSYLSPRDSEGHGTHTASTAAGNVVKNANLYGQAGGTASGMRYTSRIAVYKVCWPKGCANSDILAAVDQAVSDGVDVLSLSLGSDPKPFYDDLIAVASFGATKKGVFVACSAGNKGPSPSTVSNGAPWIMTVAASSTDRSFPTEVMLGNGKFFKGTSLYQGNLTNQLPLVFGKSAGTKKEAQHCSEGSLDPKLVHGKIVVCERGKNGRTEMGEVVKVAGGAGMIVLNAENQGEEIYADLHILPATSLGASEGKTIETYIQSDKKPTASISFMGTKFGDPAPVMGAFSSRGPSIVGPDVIKPDVTAPGVNILAAWPPKTSPSFIMNDKREVLFNILWGTSMSCPHVSGIAALLKSLHKDWSPAAIKSALMTTAYTLNNKGAPISDMASDNKAFATPFAFGSGHVNPVSAFDPGLVYDIGTEDYLNYLCSLNYTSSQIALLSRGKFACSKKAVLQAGDLNYPSFAVLFDRSALNANVTYTRVVTNVGKPQSAYAVKVKQPDGVSVTVEPRVLKFEKVGQKLSYKVTFLAVGKARVAGTSSFGSLIWVSGRYQVRSPIALTWK

SEQ ID NO: 194627 - protein, 1259 aa, Glycine max
  Coding DNA Sequence Number=SeqID_77849
  Gene Ontology: Mol. function=ATPase activity, coupled to transmembrane movement of substances; Cellular component=integral to membrane; Biological process=transport
  Homolog annotation: Hit_ID=Q2HRY7; Match level="QueryCoverage=96%, HitCoverage=98%, E-value=0.0, Identity=66%"; Hit description=Cyclic peptide transporter
  Pfam annotation: Domain name=ABC_membrane; Domain location=38-320; Score=132.1; E_value=1.5e-36; Accession=PF00664.13; Description=ABC transporter transmembrane region
  Pfam annotation: Domain name=ABC_membrane; Domain location=672-948; Score=147.4; E_value=3.9e-41; Accession=PF00664.13; Description=ABC transporter transmembrane region
  Pfam annotation: Domain name=ABC_tran; Domain location=1023-1210; Score=192.8; E_value=8.4e-55; Accession=PF00005.17; Description=ABC transporter
  Pfam annotation: Domain name=ABC_tran; Domain location=395-579; Score= 211.4; E_value=2.1e-60; Accession=PF00005.17; Description=ABC transporter
  Pfam module annotation: Pfam domain module=ABC_membrane::ABC _membrane::ABC_tran::ABC_tran; Domain location=38-320::672-948::1023 -1210::395-579
MGRDQKSVVAMVGQERKTNKKNGSLGFRSIFMHADGKDLFLMVLGTIGAVGEGLTTPLVLYISSRMMNNIGSSSNMDGNTFIHSINKNAVSWLYLAGASFAVCFLEGYCWTRTSERQAARMRCRYLKAVLRQDVEYFDLHVTSTSEIITSVSSDSLVIQDVLSEKVPNFLMNMSLFVGSYIAAFAMLWRLAIVGFPFVVLLVIPGLIYGKTLIGLSSKLREEYNQAGTVAEQTISSIRTVFSFVGESKTMNAFSNALQGTVKLGLKQGLAKGLAVGSNGVVFGIWSFMCYYGSRLVIYHGVKGGTVFAVGAAIAVGGLALGAGLSNVRYFSEAGAAAERIKEVIKRVPKIDSDNKEGEILENIYGEVEFDRVEFAYPSRPESAILKGLNLRVPAGKRVALVGESGSGKSTVIALLQRFYDPCGGEVRVDGVGIQKLQLKWLRSCMGLVSQEPALFATSIKDNILFGKEDATQDQVVEAAKAAHAHNFISLLPHGYHTQVGERGIQMSGGQKQRIAIARAIIKKPRILLLDEATSALDSESERLVQEALDNAAVGCTTIIIAHRLSTIQNADLIAVVGGGKIIEMGSHDELIKNDTGAYASAFRLQQQMGKDKVEESTEKTVIPGTVLSTTETQDMGLTSVGPTISGGCDDNMATAPSFWRLMALSYPEWKHGVFGCLNAMVFGAVQPVYAFTMGSTILLYFNSDHEEIMRRTRFYSFTFLGLFVVSLLSNIGQHYCFGYMGEYLTKRVRETVLAKILTFEVGWFDLDQNSTASICSRLAKDASVVRSLVGDRMALLVQTFSAVITAYTMGLIISWRLSIVMIAVQPIIIACFYTRRVLLKSMSNKSMKAQQQSSNIASEAVSNLRTVTAFSSQDRILKMLEEAQQRPSLENIRQSWFAGIGLGCSQGLASCIWALDFWYGGKLISYGYITTKTFFESFMVLVSTGRIIADAGSMTTDLARGADVVGDIFGIIDRCTKIEPDDPNGYIPERLIGEIEFHEVHFAYPARPNVAIFENFSMKIEAGKSTAMVGQSGSGKSTIIGLIERFYDPLKGMVTIDGMDIKSYNLKSLRKHIALVSQEPTLFGGTIRENIAYGRCESERVDESEIIEAARAANAHDFIASLKEGYETWCGDKGVQLSGGQKQRIAIARAILKNPKVLLLDEATSALDGPSEKVVQDTLMRVMRGRTGVVVAHRLSTIHNCDVIGVLEKGRVVEIGTHSSLLAKGSCGAYYSLVSLQTRHATTPNNTSCTKAGSTHSIN

SEQ ID NO: 194628 - protein, 184 aa, Glycine max
  Coding DNA Sequence Number=SeqID_77850
  Gene Ontology: Mol. function=nucleic acid binding
  Homolog annotation: Hit_ID=Q68VB6; Match level="QueryCoverage=63%, HitCoverage=48%, E-value=3e-18, Identity=42%"; Hit description=ALY protein
MTTLSFFWFMNSKSGHISVFSPSSVEVNHYDQSGRSKGTAEVVFVRYHDALAAIKKYNNMRLDGKPLQIELAGTSSATPAVTPLCQNNLMGRPNDHMRKGWRYWVPQCFAQGHLPRGRGEEKDHIRKVSSGYLDHSFERFHRTQTQRPRKNLDDDLERYHLEALSGLKSKMESEITTDSFNDSF

SEQ ID NO: 194629 - protein, 210 aa, Glycine max
  Coding DNA Sequence Number=SeqID_77851
  Homolog annotation: Hit_ID=Q9LHK2; Match level="QueryCoverage=97%, HitCoverage=18%, E-value=2e-60, Identity=58%"; Hit description =Arabidopsis thaliana genomic DNA, chromosome 3, P1 clone: MMF12
MCDILFSQLCLRVPPAAALTFGDDVQHGRNSNHTNVSKRFDGDNHVKQDTFHWDGHMEEANRRSGYHNNYHLDHETASMAALFQGRAVVPMQLIARVPAAILYWPLIQLAGAATDDIALGVAVGSKGRGNLPGATSDIRATLLLLLIGKCTADPVAFQERMMTENPEKYQHMLQNLVVKAQQSNNEKLLENPYLQMCGILQLANDLGIDL

SEQ ID NO: 194630 - protein, 300 aa, Glycine max
  Coding DNA Sequence Number=SeqID_77852
  Homolog annotation: Hit_ID=Q2QNG5; Match level="QueryCoverage=73%, HitCoverage=11%, E-value=3e-15, Identity=26%"; Hit description =Expressed protein
MIRGLSNLEVEYILVQDVEVQCIESPERSIFVDLRDIQSQQNIGGNSLNVNYSIGSRDMPCLTNKVNIPLLIFRSAFSDLREMFPFNSNQLQSKNMFIHANDGQNENATSLSSDETKSSDVLAISMPVTVGNLISDDSSYSCSTSVDPFWPLCMYELRGKCNNDECPWQHAKDYGDKNIQHAGSKNEDCQGRLPLPLQNANGVAKVPKCYKATILPTYLVGLDTLKADQFAYKPVVVHRNAQCWQKHFTLTLATSNLLGNGLPADGPLLHGGDERIEVHGACNTQLSSFHWRTGAGVCCF

SEQ ID NO: 194631 - protein, 885 aa, Glycine max
  Coding DNA Sequence Number=SeqID_77853
  Gene Ontology: Mol. function=hydrolase activity; Cellular component =nucleus; Biological process=metabolic process
  Homolog annotation: Hit_ID=Q1SWW5; Match level="QueryCoverage=93%, HitCoverage=95%, E-value=0.0, Identity=74%"; Hit description=Asp/Glu racemase; Tetratricopeptide-like helical
  Pfam annotation: Domain name=PPR; Domain location=126-160; Score=8.1; E_value=0.82; Accession=PF01535.11; Description=PPR repeat
  Pfam annotation: Domain name=PPR; Domain location=192-226; Score =24.9; E_value=0.00028; Accession=PF01535.11; Description=PPR repeat
  Pfam annotation: Domain name=PPR; Domain location=292-326; Score =37.1; E_value=6.1e-08; Accession=PF01535.11; Description=PPR repeat
  Pfam annotation: Domain name=PPR; Domain location=393-427; Score =39.9; E_value=8.8e-09; Accession=PF01535.11; Description=PPR repeat
  Pfam annotation: Domain name=PPR; Domain location=494-528; Score =41.8; E_value=2.3e-09; Accession=PF01535.11; Description=PPR repeat
  Pfam annotation: Domain name=PPR; Domain location=596-630; Score =42.5; E_value=1.4e-09; Accession=PF01535.11; Description=PPR repeat
  Pfam annotation: Domain name=PPR; Domain location=697-731; Score =36.5; E_value=9.1e-08; Accession=PF01535.11; Description=PPR repeat
  Pfam annotation: Domain name=PPR; Domain location=732-766; Score =13.1; E_value=0.21; Accession=PF01535.11; Description=PPR repeat
  Pfam annotation: Domain name=PPR; Domain location=768-801; Score=3.8; E_value=2.6; Accession=PF01535.11; Description=PPR repeat
  Pfam annotation: Domain name=PPR; Domain location=834-868; Score =13.0; E_value=0.22; Accession=PF01535.11; Description=PPR repeat
  Pfam annotation: Domain name=PPR; Domain location=91-125; Score=30.2; E_value=7.3e-06; Accession=PF01535.11; Description=PPR repeat
  Pfam module annotation: Pfam domain module=PPR::PPR::PPR::PPR::PPR::PP R::PPR::PPR::PPR::PPR::PPR; Domain location=126-160::192-226::292 -326::393-427::494-528::596-630::697-731::732-766::768-801::834 -868::91-125
MRLRIRTITARHSLHNIHNNRYDHSHYVHSDARAISRTTNTIPHHCNHNHHYYLHLLRSCKYLNPLLQIHARLIVQQCTLAPNSITNPSLILWNSLIRAYSRLHLFQEAIKSYQTMSYMGLEPDKYTFTFVLKACTGALDFHEGVAIHQDIASRELECDVFIGTGLVDMYCKMGHLDNARKVFDKMPGKDVASWNAMISGLSQSSNPCEALEIFQRMQMEEGVEPDSVSILNLAPAVSRLEDVDSCKSIHGYVVRRCVFGVVSNSLIDMYSKCGEVKLAHQIFDQMWVKDDISWATMMAGYVHHGCYFEVLQLLDEMKRKHIKMNKISVVNSVLAATETRDLEKGKEVHNYALQLGMTSDIVVATPIVSMYAKCGELKKAKEFFLSLEGRDLVVWSAFLSALVQAGYPGEALSIFQEMQHEGLKPDKTILSSLVSACAEISSSRLGKMMHCYVIKADMGSDISVATTLVSMYTRCKSFMYAMTLFNRMHYKDVVAWNTLINGFTKCGDPRLALEMFLRLQLSGVQPDSGTMVSLLSACALLDDLYLGICFHGNIIKNGIESEMHVKVALIDMYAKCGSLCTAENLFHLNKHVKDEVSWNVMIAGYLHNGCANEAISTFNQMKLESVRPNLVTFVTILPAVSYLSILREAMAFHACIIRMGFISSTLIGNSLIDMYAKSGQLSYSEKCFHEMENKGTISWNAMLSGYAMHGQGEVALALFSLMQETHVPVDSVSYISVLSACRHAGLIQEGRNIFQSMTEKHNLEPSMEHYACMVDLLGCAGLFDEVLCLIDKMPTEPDAQVWGALLGACKMHSNVKLGEIALHHLLKLEPRNAVHYIVLSDIYAQCGRWIDARRTRSNMTDHGLKKNPGYSWVGAHKQGLSLSGK

SEQ ID NO: 194632 - protein, 72 aa, Glycine max
  Coding DNA Sequence Number=SeqID_77854
MLERVRANGGTAQMPSQHVPPRQFEWRYGPCPAAVNGGIHGFAPSAVSQEHKIVVCFIIEAECECILEDDDA

SEQ ID NO: 194633 - protein, 288 aa, Glycine max
  Coding DNA Sequence Number=SeqID_77855
  Gene Ontology: Mol. function=DNA-dependent ATPase activity; Cellular component=nucleus; Biological process=response to DNA damage stimulus
  Homolog annotation: Hit_ID=Q9FKM5; Match level="QueryCoverage=95%, HitCoverage=98%, E-value=1e-72, Identity=48%"; Hit description=DNA -repair protein XRCC3 homolog
  Pfam annotation: Domain name=ABC_tran; Domain location=34-193; Score=- 62.1; E_value=0.054; Accession=PF00005.17; Description=ABC transporter
  Pfam annotation: Domain name=Rad51; Domain location=1-277; Score =49.6; E_value=2e-12; Accession=PF08423.2; Description=Rad51
  Pfam module annotation: Pfam domain module=ABC_tran::Rad51; Domain location=34-193::1-277
MRAENLLQLQHRTQKCTLGCPVLDRCLAGGVPCASVTEFVGESGCGKTQLCLQLALSAQLPPSHGGLSASSIFIHTEFPFPFRRLRHLSRAFRASHPDLPCSDPCDRVFLRAVHSAHELLNLIPTIETFLLHSKSPWRPVRIIVIDSIAALFRSDFENTGSDLRRRSSLFFGISGGLRQLAKRFGIAVVVTNQVVDLIGDGDVSFGSLGNGLYSSGRRVCPALGLAWAHCVNSRLFLSKDEDEPPVKTRKMRVVFAPHLPHSSCEYVIKGEGVFGVEMMQHREEEINL

SEQ ID NO: 194634 - protein, 623 aa, Glycine max
  Coding DNA Sequence Number=SeqID_77856
  Gene Ontology: Mol. function=nucleotide binding; Cellular component =chloroplast; Biological process=response to heat
  Homolog annotation: Hit_ID=P09189; Match level="QueryCoverage=90%, HitCoverage=87%, E-value=0.0, Identity=65%"; Hit description=Heat shock cognate 70 kDa protein
  Pfam annotation: Domain name=HSP70; Domain location=7-567; Score =796.6; E_value=1.4e-236; Accession=PF00012.10; Description=Hsp70 protein
  Pfam annotation: Domain name=MreB_Mbl; Domain location=47-338; Score=- 263.9; E_value=0.1; Accession=PF06723.3; Description=MreBMbl protein
  Pfam module annotation: Pfam domain module=HSP70::MreB_Mbl; Domain location=7-567::47-338
MDDDASFSSFEVKSPYYKQTGHAKRLIGRRFSDQEVQSDMELWPFKVIADVNGKPMIAVDYNCEKKQFSAEEISSMVLAKMLDIAESFLGSTVKNAVITVPAYFNDSQRQATKDAGKIAGLNVLRILHEPTAAAIAYRLEMKNCNNDRRNVFVFDLGGGTLDVSLLVFEKDHIRVKATTGDTHLGGEDFDNNMVTYCVKEFKRKNKMDISGNKRALRRLRTACEKAKRILSCSTMTTIEVDSLYDGIDFHSSISRAKFEELNKDYLNKCIEFVGKCLIDAKMDKSSVHDVVLAGGSTRIPKLQQLLSDFFDGKDLCKCINADEAVAYGAAVHAYMLNGESSEKVQNASLWEVTPLSLGLQEDGGIMKVIIPRNTSIPTKMEDVLTTHFDNQTNILIHVYEGERKRTRDNNLLGKFVLEIPPVPRGVPQISVCFELDYDGILHVSAEEKSRGISKKLAITNDKGRLSKKEIERMISEAEKYKAEDEMYRNKVQSRHALEKYAYNMRDAINIKEISLKLSPEDKKNINDAIDSALEWLEVSMDANPNDFDNMRSTLSSVFNPVIVKMIKDEDNVAPPDTVASSGSNSVKNGLLSILANFALDAVYSAATGDIIGFASVIVDCLSI

SEQ ID NO: 194635 - protein, 668 aa, Glycine max
  Coding DNA Sequence Number=SeqID_77857
  Homolog annotation: Hit_ID=Q2QNG5; Match level="QueryCoverage=98%, HitCoverage=38%, E-value=1e-124, Identity=39%"; Hit description =Expressed protein
MADTEQVVEMALLILNQEINKLQGVRKALSVLSKALDNDPTSVVLWIVYLLIYYGNLKPNEKDDMFLCAVKLCEESYVLWLMYINSRGKLADRLVAYDTALSVLCQHAAASPKDIIHESPCILDLFLQMMHCLCMSGNVEKAIERSYGIFPTTTKSNEPHHLSLSEILNCLTVSDKCVFWVCCVYLVIYRRLPDAVVQKFESEKSLLDIEWPVVSLSEDDKEMAIKLVETAVESIDSFVYSESVKSEVNLRSAQLFALNHIRCMAALDNKECFRDLLDKYVKLYPSCIELVLASARIQKQDIDVDGFMGFEEAINRWPKEVPGIQCIWNQYIENAIHNRRIDLAKAITVRWFKCIWQVQNLPNGGKEITDDGNSCGSLGLDSKSVSDRFSSDHKQIDMMFGFLNLSLYNFLQNDKTEACIAFDKAKSTASFGGLEQCMKTYVMFLVYDAWSLKEDGSDGAIKRILELYADGSSQALLVPKVLTRKFVDNIKKPRVQHLIGNILSPVSFDCSLLNLILQSWFGSSLLPQTVSDPKHLVDFVEAIMEVVPHNFQLAIAVCKLLTKEYNSDSNSASLWFWACSNLLNAILDAMPIPPEYVWVEAGELLHNSMGIETICDRFYRRALSVYPFSIMLWKCFYKLYMTSGDAKDAVDAAKQMGIELLTKDLGTD

SEQ ID NO: 194636 - protein, 79 aa, Glycine max
  Coding DNA Sequence Number=SeqID_77858
  Gene Ontology: Mol. function=nucleotide binding; Cellular component =chloroplast; Biological process=protein folding
  Homolog annotation: Hit_ID=Q43532; Match level="QueryCoverage=88%, HitCoverage=10%, E-value=3e-27, Identity=81%"; Hit description=HSP70
MATNGKTPAIGIDLGTTYSCVAVWQRDRVEIIANDQGNRTTPSYVAFNNTQRMIGDAAKNQAATNPTNTVFGKILNPLA

SEQ ID NO: 194637 - protein, 509 aa, Glycine max
  Coding DNA Sequence Number=SeqID_77859
  Gene Ontology: Mol. function=nucleotide binding; Cellular component =chloroplast; Biological process=response to heat
  Homolog annotation: Hit_ID=P27322; Match level="QueryCoverage=88%, HitCoverage=70%, E-value=1e-168, Identity=65%"; Hit description=Heat shock cognate 70 kDa protein 2
  Pfam annotation: Domain name=HSP70; Domain location=1-453; Score =473.6; E_value=2.4e-139; Accession=PF00012.10; Description=Hsp70 protein
AGAIAGLNVLRIINEPTAAAIAYRLERKNCNNERRNVFVFDLGGGTLDVSLLVFEKDYIRVKATSGDTHLRGEDFDNNMVTYCVKEFQRKNKKDISGNERALRRLRTACEKAKRILSSTVMTTIEVDSLYDGIDFHSSISRAKFEELNMDYLNKCMEFVEKCLIDAKMDKSSVHDVVLAGGSTRIPKLQQLLSDFFDGKDLCKCINADEAVAYGAAVHASMLNGESSEKVQNTLPREVTPLSLGLEKEGGIMKVIIPRNTSIPTKMEDVFTTHLDNQINILIHVYEGERQRTRDNNLLGKFVLEIPPVPRGVPQIIVCFEVDDEGILHVSAKENSLGITKKVTIINDKGRLSEEEIKRMISEAERYKAEDEMYRKKVEARYALEKYAYNIRNAIKHKGISLKLSPEDKEKINDAVDRALEWLEVSVDAEKEDVDNFRGNLSSVFDTIMVKMIKGEDNGAPPGAVASSGSKSGKNRWLSILAKFGLQAVYSAVTGDIIGFVSVIVDCLAN

SEQ ID NO: 194638 - protein, 204 aa, Glycine max
  Coding DNA Sequence Number=SeqID_77860
  Homolog annotation: Hit_ID=Q9FI91; Match level="QueryCoverage=65%, HitCoverage=80%, E-value=1e-15, Identity=37%"; Hit description =Arabidopsis thaliana genomic DNA, chromosome 5, TAC clone:K18J17
  Subcellular localization annotation: CTP_CleavageSite=39; ConfidenceScore=5.28e-01
MVATACAAALLPHDSIPNRISMTLTMDRTRKRQPMTEPMAEPSMPSLRAFRLMWARKASSASLLLSRFSASFSPWATSDEKRKKLKETTSKTRSFLATSTPASQEERFSRLRWPGVVRERPTNTAIVKRELTFTRPSRAVTWTLVVEEDEETLLRDTRPWRINGCERKRKILRVKGNCLLRREGDAFVFYFARKRKDRTKTLEI

SEQ ID NO: 194639 - protein, 314 aa, Glycine max
  Coding DNA Sequence Number=SeqID_77861
  Gene Ontology: Mol. function=transcription factor activity; Biological process=regulation of transcription, DNA-dependent
  Homolog annotation: Hit_ID=Q3KIE0; Match level="QueryCoverage=96%, HitCoverage=84%, E-value=3e-17, Identity=33%"; Hit description =Transcriptional Regulator, RpiR family
  Pfam annotation: Domain name=HTH_6; Domain location=78-179; Score =31.2; E_value=1.8e-06; Accession=PF01418.8; Description=Helix-turn -helix domain, rpiR family
  Pfam annotation: Domain name=LacI; Domain location=112-137; Score =10.3; E_value=0.35; Accession=PF00356.11; Description=Bacterial regulatory proteins, lacI f
  Pfam annotation: Domain name=LacI; Domain location=35-60; Score=5.3; E_value=1.6; Accession=PF00356.11; Description=Bacterial regulatory proteins, lacI f
  Pfam module annotation: Pfam domain module=HTH_6::LacI::LacI; Domain location=78-179::112-137::35-60
MDIVWQLQQQSARFDAQESKLARFILDNLHASAQATMESLAAQAGVSPAVLQRFAASAGYRDLDDFLHQVRQAGQQESAFMTVIRQRQASLSQQEQRVARAILRDAAFAASATIEQLASRAEVSAATITRFARSVGCDDIRDLRMRLARASAEPASASHGAVPQLVSLHQALTRQWQLLDDSRWQQAAQALRQARSVLLIGAAGQHTPLVAEVQQRLSEAGLALAWIQDDNLLRLTLSRLQPDDLLLILAPDTINSSVLSAVHHAHIQQTPVMALCPAALDLASQANYWLPLPDAAPARRYGILLALDRLAAAL

SEQ ID NO: 194640 - protein, 113 aa, Glycine max
  Coding DNA Sequence Number=SeqID_77862
  Gene Ontology: Mol. function=sugar porter activity; Biological process=phosphoenolpyruvate-dependent sugar phosphotransferase system
  Homolog annotation: Hit_ID=Q7N3G3; Match level="QueryCoverage=70%, HitCoverage=79%, E-value=8e-18, Identity=55%"; Hit description=PTS system, cellobiose-specific IIB component
  Pfam annotation: Domain name=PTS_IIB; Domain location=1-87; Score =77.9; E_value=3.1e-20; Accession=PF02302.8; Description=PTS system, LactoseCellobiose specific IIB subunit
MSTSMLVNKMQHAAQARGLAINIQAVPVADFERILPDADVVLLGPQVQFEAARLTAIAAPQGKAVAVIDMMDYGMMRGEQAGAARSAALSALRLARAGQFEAAQQQLAAAREN

SEQ ID NO: 194641 - protein, 194 aa, Glycine max
  Coding DNA Sequence Number=SeqID_77863
  Gene Ontology: Mol. function=oxidoreductase activity, acting on the CH-OH group of donors, NAD or NADP as acceptor; Cellular component =cytoplasm; Biological process=metabolic process
  Homolog annotation: Hit_ID=Q44471; Match level="QueryCoverage=94%, HitCoverage=50%, E-value=2e-74, Identity=77%"; Hit description =Probable tartrate dehydrogenase/decarboxylase ttuC
  Pfam annotation: Domain name=Iso_dh; Domain location=1-180; Score= -44.5; E_value=2.2e-10; Accession=PF00180.10; Description =Isocitrateisopropylmalate dehydrogenase
MRYAFKLAQSRPRKLLTVVTKSNAQRHGMVMWDEIAAEVAQEFPDVQWDKMLVDAMTHRMTLHPQSLDTIVATNLHADILSDLAGALAGSLGVAPTANIDPERRFPSMFEPIHGSAFDITGKGIANPIATFWTAVQMLEHLGERNAAALIMQGIEHVCAAGILTPDVGGSATTADVTRALVQFIEAKSQVAATA

SEQ ID NO: 194642 - protein, 79 aa, Glycine max
  Coding DNA Sequence Number=SeqID_77864
  Gene Ontology: Mol. function=nucleotide binding; Cellular component =chloroplast; Biological process=protein folding
  Homolog annotation: Hit_ID=Q43532; Match level="QueryCoverage=88%, HitCoverage=10%, E-value=3e-27, Identity=80%"; Hit description=HSP70
MATNGKTPAIGIDLGTTYSCVAVWRHDRVEIIVNDQGNRTTPSYVAFNNTQRMIGDAAKNQAATNPTNTVFGKILNPLA

SEQ ID NO: 194643 - protein, 1776 aa, Glycine max
  Coding DNA Sequence Number=SeqID_77865
  Gene Ontology: Mol. function=oxidoreductase activity, acting on the aldehyde or oxo group of donors, disulfide as acceptor; Cellular component=mitochondrion; Biological process=metabolic process
  Homolog annotation: Hit_ID=Q9ZRQ2; Match level="QueryCoverage=56%, HitCoverage=99%, E-value=0.0, Identity=81%"; Hit description=2 -oxoglutarate dehydrogenase, E1 subunit
  Pfam annotation: Domain name=E1_dh; Domain location=1005-1334; Score =245.4; E_value=1.2e-70; Accession=PF00676.10; Description =Dehydrogenase E1 component
  Pfam annotation: Domain name=PPR; Domain location=120-154; Score =24.7; E_value=0.00033; Accession=PF01535.11; Description=PPR repeat
  Pfam annotation: Domain name=PPR; Domain location=221-255; Score =53.0; E_value=1e-12; Accession=PF01535.11; Description=PPR repeat
  Pfam annotation: Domain name=PPR; Domain location=322-356; Score =53.8; E_value=5.5e-13; Accession=PF01535.11; Description=PPR repeat
  Pfam annotation: Domain name=PPR; Domain location=423-457; Score =41.1; E_value=3.9e-09; Accession=PF01535.11; Description=PPR repeat
  Pfam annotation: Domain name=PPR; Domain location=458-492; Score =22.6; E_value=0.0015; Accession=PF01535.11; Description=PPR repeat
  Pfam annotation: Domain name=Ras; Domain location=636-742; Score= -94.6; E_value=0.035; Accession=PF00071.12; Description=Ras family
  Pfam annotation: Domain name=Transket_pyr; Domain location=1398-1614; Score=235.5; E_value=1.2e-67; Accession=PF02779.14; Description =Transketolase, pyrimidine binding dom
  Pfam module annotation: Pfam domain module=E1_dh::PPR::PPR::PPR::PPR:: PPR::Ras::Transket_pyr; Domain location=1005-1334::120-154::221 -255::322-356::423-457::458-492::636-742::1398-1614
MASKLLSISPLATKNQKVTTPQIPRCFVLKFVKYLCFSSALHPEHFVNHDHCFNSDSFYASLIDNSTHKRHLDQIHNRLVISGLQHNGFLMTKLVNGSSNLGQICYARKLFDEFCYPDVFMWNAIIRSYSRNNMYRDTVEMYRWMRWTGVHPDGFTFPYVLKACTELLDFGLSCIIHGQIIKYGFGSDVFVQNGLVALYAKCGHIGVAKVVFDGLYHRTIVSWTSIISGYAQNGKAVEALRMFSQMRNNGVKPDWIALVSILRAYTDVDDLEQGRSIHGFVIKMGLEDEPALLISLTAFYAKCGLVTVAKSFFDQMKTTNVIMWNAMISGYAKNGHAEEAVNLFHYMISRNIKPDSVTVRSAVLASAQVGSLELAQWMDDYVSKSNYGSDIFVNTSLIDMYAKCGSVEFARRVFDRNSDKDVVMWSAMIMGYGLHGQGWEAINLYHVMKQAGVFPNDVTFIGLLTACNHSGLVKEGWELFHCMKDFEIVPRNEHYSCVVDLLGRAGYLGEACAFIMKIPIEPGVSVWGALLSACKIYRCVTLGEYAANKLFSLDPYNTGHYVQLSNLYASSCLWDCVAHVRVLMREKGLNKDLGYSVIEINGKLQAFHVGDKSHPMAKEIFDELQRLERRLKEVGFVPYTESVLHDLNYEEKEENLSFHSERIAVAYGLISTAPGTTLRITKNLRACVNCHSAIKLISKLVEREIIAVPTSKGQALADEYGVKFFETSAKTNMNVEKSQIIKINQPDQAATGASSSSSSIMAWFRAGASIAKHAIRRTLSKGGSTHLVSRARVLPSIPSSHSRSFHSSVFKEQAAPVPRAVPLSKLTDSFLDGTSSVYLEELQRAWEADPNSVDESWDNFFRNFVGQATTSPGISGQTIHESMRLLLLVRAYQVNGHMKAKLDPLNLEPREIPEDLDPALYGFTEADLDREFFLGVWRMAGFLSENRPVQTLRSILTRLEQAYCGSIGYEYMHIADRHKCNWLRDRIETPTPTQFNRERREAIFDRLAWSSLFENFLATKWTSAKRFGLEGGETLIPGMKEMFDRASDLGVESIVIGMAHRGRLNVLGNVVRKPLRQIFCEFSGGLQPEGEVGLYTGTGDVKYHLGTSYDRPTRGGKRIHLSLVANPSHLEAVNPVVVGKTRAKQYYSNDVDRTKNMGVLIHGDGSFAGQGVVYETLHLSALPNYTTGGTIHIVFNNQVAFTTDPTSGRSSQYCTDVAKALDAPIFHVNGDDVEAVVHACELAAEWRQTFHSDVVVDLVCYRRFGHNEIDEPSFTQPKMYKVIRSHPSTLEIYEKKLLESGELTQEEIDRIHKKVTSILNEEFLASKEYIPKRRDWLSAYWLGFKSPEQLSRIRNTGVKPEILKNVGKAITTIPENFTPHRAVKRIYEQRAQMIETGEDIDWGFAEALAYATLLIEGNHVRLSGQDVERGTFSHRHAVVHDQTTGEKYCPLDNVIMNQDEEMFTVSNSSLSEFGVLGFELGYSMENPNSLIIWEAQFGDFANGAHVIFDNFLASGEAKWLRQTGLVVLLPHGYDGQGPEHSSARLERFLQMADDNPHVIPEMDPTLRKQIQECNLQIVNVTTPANFFHVLRRQVHREFRKPLIVMSPKNLLRSKACRSNLSEFDDVQGHPGFDKQGTRFKRLIKDQNEHKDVEEGIRRLVLCSGKVYYELDEHRTKVDAKDVAICRVEQLCPFPYDLVQRELKRYPKPMNMGGYTYILPRLISSMKAVNRGGYDDVKYVGRAPSAATATGFLKVHQKEQTEIAEKALQQEPIDFPF

SEQ ID NO: 194644 - protein, 63 aa, Glycine max
  Coding DNA Sequence Number=SeqID_77866
MDNHEHANHRDTVQARIKNKGIRQHKVNDQAQNIDCCVSVSSPENQNYMSSANDPAINREGND

SEQ ID NO: 194645 - protein, 107 aa, Glycine max
  Coding DNA Sequence Number=SeqID_77867
  Gene Ontology: Mol. function=catalytic activity; Cellular component =cellular_component; Biological process=metabolic process
  Homolog annotation: Hit_ID=Q1ERD4; Match level="QueryCoverage=99%, HitCoverage=12%, E-value=1e-39, Identity=72%"; Hit description =Oxidosqualene cyclase
MVCCWLENPNSQAFKRHISRIKDDLWVAEDGMKMQLQILMNAIQCQSYGGSQLWDTVLSIQAILATNLKDEYGSMLKKANNFIKFSQITTNSSGTPSDWYRHISKGG

SEQ ID NO: 194646 - protein, 124 aa, Glycine max
  Coding DNA Sequence Number=SeqID_77868
EGITGMMRQAVHRNLYRSFLVGKKKEPINILQYADDTVFVGEAVWENIHVIKAWKVGSGENIKFWTDNWLGEQHTLQQKYNKLFLISREQKDHISQMGHFNHNSWRWDMRWRRNLFDHESHLAV

SEQ ID NO: 194647 - protein, 68 aa, Glycine max
  Coding DNA Sequence Number=SeqID_77869
  Gene Ontology: Mol. function=catalytic activity; Biological process =metabolic process
  Homolog annotation: Hit_ID=Q1ERD4; Match level="QueryCoverage=73%, HitCoverage=6%, E-value=4e-18, Identity=84%"; Hit description =Oxidosqualene cyclase
MEGNKSNVVNTAWAMLALIEAGQAERDPAPLHHAAKVLIDLQLENGEFPQQGSNERVRRINLSHKIKL

SEQ ID NO: 194648 - protein, 686 aa, Glycine max
  Coding DNA Sequence Number=SeqID_77870
  Gene Ontology: Mol. function=iron-sulfur cluster binding; Biological process=electron transport
  Homolog annotation: Hit_ID=Q13LL1; Match level="QueryCoverage=96%, HitCoverage=96%, E-value=0.0, Identity=56%"; Hit description =Putative oxidoreductase
  Pfam annotation: Domain name=FAD_binding_6; Domain location=334-432; Score=60.9; E_value=4.2e-15; Accession=PF00970.14; Description =Oxidoreductase FAD-binding domain
  Pfam annotation: Domain name=FAD_binding_9; Domain location=336-430; Score=-23.0; E_value=0.0058; Accession=PF08021.2; Description =Siderophore-interacting FAD-binding do
  Pfam annotation: Domain name=Fer2; Domain location=602-674; Score =37.3; E_value=5.4e-08; Accession=PF00111.17; Description=2Fe-2S iron- sulfur cluster binding domain
  Pfam annotation: Domain name=NAD_binding_1; Domain location=441-555; Score=48.0; E_value=3.2e-11; Accession=PF00175.11; Description =Oxidoreductase NAD-binding domain
  Pfam annotation: Domain name=Pyridox_oxidase; Domain location=173 -269; Score=63.6; E_value=6.4e-16; Accession=PF01243.10; Description =Pyridoxamine 5'-phosphate oxidase
  Pfam annotation: Domain name=Pyridox_oxidase; Domain location=40-133; Score=23.6; E_value=0.00063; Accession=PF01243.10; Description =Pyridoxamine 5'-phosphate oxidase
  Pfam module annotation: Pfam domain module=FAD_binding_6::FAD_binding_ 9::Fer2::NAD_binding_1::Pyridox_oxidase::Pyridox_oxidase; Domain location=334-432::336-430::602-674::441-555::173-269::40-133
MGEKLIKLPVWHDGEIALQQQAGVAERMADVGQRVIRDYMPDQHRDFYAQLPFIVASSVDAQGDAWATLLEGQPGFIFSPNATTLDIAARPDVSDPAAAGMTDGAPVGLLGIELHTRRRNRMNGVLTAIGGGLRVQVDQSFGNCPRYIQLRDFRFDHAPGRAYQGEVETLSALDDAARAAIRQADTFYVTTYADQARRQVDVSHRGGKAGFVRIAADDVLTIPDFNGNLFFSTLGNIVLNGKAGLLFIDYASGDVLQMSGDATVITDSAEIVAFQGAERLWRFSARRIVRRRAALALRWADQPDGVSPASLMTGDWPSASKRLQAQQLAAQWRPFRITRIVEESAQIRSFHLMPDDGAGVLPHLAGQHLPIRLTLPGSTKPLIRQYTLSVAPSDGYYRISVKREGAVSQYLHDALRVGDRLEVRAPAGDFTIDAHETRPAVLLAAGVGITPLLAMLRHLFYEGRRKRRMRPVYLLQSARNLAERPFAREIDALLAASEGALKLVRVLSQPGAAEAGVDYDVAGRIDMALLSQVLPFNDYDFYLCGPPSFTQAMYDGLRGLNIADARIHAEAFGPSSLQRQQEDVPEPAVLPPVATEAVPVVFTESLKEARWTPQSGTLLELAEARGLSPAYSCRAGHCGSCKTKLVKGAVTYTTRPGITLAQDEVLICCAVPAQVEDGDAAVQLAL

SEQ ID NO: 194649 - protein, 151 aa, Glycine max
  Coding DNA Sequence Number=SeqID_77871
MAESGRYIPVNILEKAIRYGSRSPDAQKMPGMFLYRIKMTRLKKIVEHDKISINLQCQCELTIFDLESLKEMLSEFYASLYKNGRPKPVNFAPRMKAFTCEFNAVEGSDLIGFNFTATPAIYDSWQLTGGIAIDQSYFPALIQGIESILTN

SEQ ID NO: 194650 - protein, 69 aa, Glycine max
  Coding DNA Sequence Number=SeqID_77872
MAIARWALKHPVYGIVILRLGIYTDRPHVSKLCSFISSMNSSIFISVHSRKYTLSISPLFPEDTFALYE

SEQ ID NO: 194651 - protein, 59 aa, Glycine max
  Coding DNA Sequence Number=SeqID_77873
MPKHYTAPPTMETQTTGREKRAYLDNADELKKKTPRDDAAMLKNEKEAEEEGSCDAEEE

SEQ ID NO: 194652 - protein, 81 aa, Glycine max
  Coding DNA Sequence Number=SeqID_77874
MFSPSGILGSRKISEENCFREENLSRGASVTFPWVISRRFSTILRRSSSFFDLQPISKRPKSICNFVTSFKNKEIINGPMP

SEQ ID NO: 194653 - protein, 119 aa, Glycine max
  Coding DNA Sequence Number=SeqID_77875
MDWFFVISHPLTITAQPSDLPQDPPATHDASFIEPYIPQVPELVATSIHARSNVDEPRHAVEACHAIPERLERHFNLRIVTPGTKTHEVMEQCLRIVRGVTEDRIVYVRSRRRWRTDQL

SEQ ID NO: 194654 - protein, 215 aa, Glycine max
  Coding DNA Sequence Number=SeqID_77876
  Homolog annotation: Hit_ID=Q6CQF3; Match level="QueryCoverage=25%, HitCoverage=57%, E-value=1e-07, Identity=71%"; Hit description =Kluyveromyces lactis strain NRRL Y-1140 chromosome D of strain NRRL Y- 1140 of Kluyveromyces lactis
MPERGEARGNSVSLRIAGARGRVLSGRCGCSVEPRHGIESSKWAIFGKQNWRCGMNRKLGYGAQLRANLDPTKGVGRLRQQDGGHGSRNPLKECVTTHPAESTSPEKWMALKRATYTRPSGQRTKPPMSRRARRSLQKPRARARAERSSVQIFGGSSKIFKMRTLKAEEGKGTGEARLIALCARTPKGNRPAHPGNGSAGGRVQRLEEHRTSRGV

SEQ ID NO: 194655 - protein, 54 aa, Glycine max
  Coding DNA Sequence Number=SeqID_77877
VSGVGSNGQIGSKNAISRAHRRPAYKPQVFINKETEAAAEPHRIGEGRREKDEK

SEQ ID NO: 194656 - protein, 65 aa, Glycine max
  Coding DNA Sequence Number=SeqID_77878
MMGYIEADEEGGGWIEKLKEGEGTTAIEEKPMSFFELMMMAKMDELMRMHKEDYRDLKECFETIS

SEQ ID NO: 194657 - protein, 114 aa, Glycine max
  Coding DNA Sequence Number=SeqID_77879
MENCTRQSLRMAPNSLVEESIGKITKTTFPNQEGPHLTAITTHGSKLVGGGIKRENNKDHISQSRGSALDGGGHMNSARQSIHGAPNKRREWRIALGNYYAWLQTRWWRNQMGK

SEQ ID NO: 194658 - protein, 243 aa, Glycine max
  Coding DNA Sequence Number=SeqID_77880
  Pfam annotation: Domain name=G-patch; Domain location=92-136; Score =17.5; E_value=0.0014; Accession=PF01585.13; Description=G-patch domain
MPVKGKGHNKALHVSFKCMDHIVAKAKLHGGESFDGQLIIVFGEEDKLVSCPSATPYVEVVEESLETTFQTLKVVDNAYVESFLIQPRMSNASMMVARIMLRDRYEPKMGLGRNGDGMVTLLEVAENRGRFGLGYKPTNIDKRRIALERKEKCLACLQGHEPRVERVPIFHISKSFRSARWMYAGQVAMLKEEDMPGFSLEIVQHRLPLNLECSPAVARYPEWVANIVSVPKKDGKVQMCMDY

SEQ ID NO: 194659 - protein, 101 aa, Glycine max
  Coding DNA Sequence Number=SeqID_77881
MDDEIVKPQPQQWHPAIKTFKKRSWEDGYIAHAPKKLTCKRARKTTAREGSSIALLVEIEFDGHHFRKIARRCWTQLAEPMPKYDPEIVMEFYVNAWPTEE

SEQ ID NO: 194660 - protein, 914 aa, Glycine max
  Coding DNA Sequence Number=SeqID_77882
  Gene Ontology: Mol. function=protein binding; Cellular component =membrane; Biological process=defense response
  Homolog annotation: Hit_ID=Q19PK7; Match level="QueryCoverage=81%, HitCoverage=78%, E-value=4e-83, Identity=31%"; Hit description=NBS -LRR type disease resistance protein
  Pfam annotation: Domain name=LRR_1; Domain location=591-612; Score =7.0; E_value=14; Accession=PF00560.23; Description=Leucine Rich Repeat
  Pfam annotation: Domain name=LRR_1; Domain location=614-635; Score =8.1; E_value=8.9; Accession=PF00560.23; Description=Leucine Rich Repeat
  Pfam annotation: Domain name=LRR_1; Domain location=637-658; Score =12.7; E_value=1.2; Accession=PF00560.23; Description=Leucine Rich Repeat
  Pfam annotation: Domain name=LRR_1; Domain location=836-858; Score =5.2; E_value=30; Accession=PF00560.23; Description=Leucine Rich Repeat
  Pfam annotation: Domain name=NB-ARC; Domain location=149-458; Score =278.5; E_value=1.3e-80; Accession=PF00931.13; Description=NB-ARC domain
  Pfam module annotation: Pfam domain module=LRR_1::LRR_1::LRR_1::LRR _1::NB-ARC; Domain location=591-612::614-635::637-658::836-858::149 -458
MADAIVNFLAEKLTRLLEEEAKLLTEVHDNVTSLHDELKILNLFLKETQGTKQREHGLVAEMVGQIRDAAYQAEDIIDTYVADMIRRRKMNRLEKVVIGSVNHALMLHKVAVKIGDIKTRIDNRFGNIEKYGVRLISAKGEKSNGEEEETERVRKQRSEVEEDKVAGFESYSRAVIEKLTARVRDRDSRLNVVSITGVGGLGKTTLARKTYNNVRVKDTFSCRAWGYVSNDYRPREFFLSLLKCLQPGEYSDMSERRESDEELKMKVRECLNKSGKYLVVVDDVWETQVWDEIKSAFPDANNGSRILITSRSTKVASYAGTTPPYSLPFLNKQKSWELLFKKLFKGRRKCPPELVELGKSIAERCDGLPLAIIFMAGILANKELHKEWSDIKDHMDWHLGSDNDNILMDILRLSYDTLPSRLKPCFLYFGMFPQGYNIPVKQLIRLWTSEGLLTTHDSSSGSRTNAPEPEYIAEQYLAELVERSLVQVIHRTSYGSAKTCRVHLVLRHFCISEARKDKFFQVGGIINDSSQMHSRRLSLQGTLFHKSSVSSTSLSNNSSVSGTRSLLCFGKEEVSDVKKDQWEWLFKSFKLARVLDLGQMNVTSLPSGLKKLIHLRYLSIHSHNLETIPDSICNLWNLETLDLRGSPIKSFSAELWQLKHLRNLLLLGPVVLPESETMPNLQTLSTVALDPRTASLLENGRFPELKKLGLHYEKRDDTMYECDPRVLLQSCLHRLSYLRKLKLIGTTEIPQNAANVCVFPSTITKITLTKFGFFNSSAMNTLGKLPNLLVLKLSSQKSDASFDLHCAAGGFSKLQVFVMVEIMVKSWRVVKGSMPSVQRVVVRNCEYLTELPEEIWSLTALCQVNVSCPSRKLAKTLQNLEGPFKDATYAAILNEEVEGIVGLTLLKMTTRFFA

SEQ ID NO: 194661 - protein, 164 aa, Glycine max
  Coding DNA Sequence Number=SeqID_77883
MVAEIVGQIREAAYEAEDIIDTYVADMIRRRKMNLLEKVVIEAMLDFNLSDAMLDFRLGLSCRGLKAKDFDATLLTIKNFEVLTLCKWTFENDPESYLAGGSNSCVVKGTKCTGMEHLKVIKFMGFSSRRDEVSLAKCLIHMIKGKPPKIKTSDGNCLDAMFVE

SEQ ID NO: 194662 - protein, 445 aa, Glycine max
  Coding DNA Sequence Number=SeqID_77884
  Gene Ontology: Mol. function=ATP binding; Cellular component =membrane; Biological process=defense response
  Homolog annotation: Hit_ID=A0FD16; Match level="QueryCoverage=97%, HitCoverage=52%, E-value=5e-35, Identity=26%"; Hit description=NBS -LRR type resistance protein
  Pfam annotation: Domain name=LRR_1; Domain location=156-177; Score =5.8; E_value=24; Accession=PF00560.23; Description=Leucine Rich Repeat
  Pfam annotation: Domain name=LRR_1; Domain location=184-205; Score =12.7; E_value=1.2; Accession=PF00560.23; Description=Leucine Rich Repeat
  Pfam annotation: Domain name=LRR_1; Domain location=379-401; Score =11.5; E_value=2; Accession=PF00560.23; Description=Leucine Rich Repeat
  Pfam module annotation: Pfam domain module=LRR_1::LRR_1::LRR_1; Domain location=156-177::184-205::379-401
MYPEDYKIPVKQLIQLWISEGLLTQETCGSSTNIPEPEYIAEEYLDELVDRSLIQVVSRTSDGGVKTCRIHDLLRDLCISESKEDKFFEVCGEVDFQIRDSCPRKLSLHGTLFHFSSSSAVSDYSITGTRSLLCFGQEVYKVKPNHWRWLLKSFRLARVLDLGRMNVNSIPNDLEKLIHLRLWNLETLDLRGSPIKSFSGDLWQLKQLRHLLMFGPVGLPDMPSESKTMQNLQTLSTVALDPRTTSLLDSRRFPRLTKLGIHHERRDKCNARIQLQSLNRLSHLRKLKVIGTTEIPQNANVFPSNITKISLTKFGCFNSNAMHILGKLPSLQVLKLSSQTNDTRFDLHCATGGFLQLQVFEMIAIKVKNWRLDKGSMPRIRRLDVRSCKSLTELPKELWSLTSLREVQVLWPCTELVKRLQNLVVNNGCKLVVYPLSTNDELDFL

SEQ ID NO: 194663 - protein, 303 aa, Glycine max
  Coding DNA Sequence Number=SeqID_77885
WRDLWNEALVKHGTQEDIIGVVADFITNFEEFDPLKHPRKLQFHFAEESVVSVTVANNSKLMLDFSPWKEEIPIGYELEFKLSKQHIATYQSFPSTFSVKTLHLKSVSCFTSEVAASIVSNLEHLENLVVIDCKGLESLSVDSTSELHKLTILDCLELKTLRLKTSKLKSFRYRGPLPLIRPEYHFNLSNAMLDFRLGLSCSGLKAKDFDATLLTIKNSEVLTLCKWTFENDPESYLAGGSNSYVVKGTKCTGMEHLKLIKFMGFSSRRDEISLAKCLIHLIKGKPPKIKTSDGNSLDAMFVE

SEQ ID NO: 194664 - protein, 582 aa, Glycine max
  Coding DNA Sequence Number=SeqID_77886
  Gene Ontology: Mol. function=enzyme inhibitor activity; Cellular component=cell wall; Biological process=cell wall modification
  Homolog annotation: Hit_ID=Q1STF3; Match level="QueryCoverage=99%, HitCoverage=100%, E-value=0.0, Identity=69%"; Hit description =Pectinesterase; Pectinesterase inhibitor
  Pfam annotation: Domain name=PMEI; Domain location=53-206; Score =133.1; E_value=7.8e-37; Accession=PF04043.6; Description=Plant invertasepectin methylesterase inhibitor
  Pfam annotation: Domain name=Pectinesterase; Domain location=255-555; Score=639.1; E_value=3.7e-189; Accession=PF01095.10; Description =Pectinesterase
  Pfam module annotation: Pfam domain module=PMEI::Pectinesterase; Domain location=53-206::255-555
MSEGNAGKGKRIAIIGVSALLLVAMVVAITVGVNLNENGSNNDTEDNKKNHVVSSIKAVQTLCHPTNYKKECEESLIAGAGNTTDPKELIKIFFNITITKIGDKLKETNILHEVEEEPRAKMALETCKQLMDLSIGELTRSLDGIGEFNLINVDKILMNLKVWLSGAVTYQDTCLDGFENTTSDAGKKMKDLLTIGMHMSSNALAIVTDLADTVNDWNITKSFGRRLLQDSELPSWVDQHRLLNENASPLKRKPNVTVAIDGSGDFKSINEALKQVPEKNRKPFVIYIKEGVYQEYVEVTKKMTHVVFIGEGGKKTRISGNKNFIDGTNTYRTATVAIQGDHFVAINMGFENSAGPHKHQAVALRVQADKSIFYNCSMDGYQDTLYAHTMRQFYRDCTISGTIDFVFGNALAVFQNCTFVVRKPLENQQCIVTAQGRKERQQPSGIVIQGGSIVSDPEFYSVRFENKAYLARPWKNYSRTIIMDTYIDDLIDADGYLPWQGLEGPSGMDTCFYAEYHNIGPGSDKSKRVKWAGIWNLNSKAARWFSPSKFFHGTDWIEVTGIPCFPGVPKHHRHKKTILNWQ

SEQ ID NO: 194665 - protein, 124 aa, Glycine max
  Coding DNA Sequence Number=SeqID_77887
MTREGHVAYRHCHWRHSQWLSPFPLTTPAWTEAAGLIDEFGGSKVQGAQGLQPLREGVVIAAGRTGSKIAIERYTFSRATLRLLAWGNLLQDAIHYLTGFLVTGKIKLEPENLPYKGITAGAGK

SEQ ID NO: 194666 - protein, 1419 aa, Glycine max
  Coding DNA Sequence Number=SeqID_77888
  Gene Ontology: Mol. function=ATPase activity, coupled to transmembrane movement of substances; Cellular component=integral to membrane; Biological process=transport
  Homolog annotation: Hit_ID=Q9M3B9; Match level="QueryCoverage=98%, HitCoverage=99%, E-value=0.0, Identity=63%"; Hit description =Multidrug resistance protein 14
  Pfam annotation: Domain name=ABC_membrane; Domain location=817-1097; Score=124.3; E_value=3.3e-34; Accession=PF00664.13; Description=ABC transporter transmembrane region
  Pfam annotation: Domain name=ABC_membrane; Domain location=83-356; Score=72.7; E_value=1.2e-18; Accession=PF00664.13; Description=ABC transporter transmembrane region
  Pfam annotation: Domain name=ABC_tran; Domain location=1172-1357; Score=198.8; E_value=1.3e-56; Accession=PF00005.17; Description=ABC transporter
  Pfam annotation: Domain name=ABC_tran; Domain location=426-609; Score= 135.9; E_value=1.1e-37; Accession=PF00005.17; Description=ABC transporter
  Pfam annotation: Domain name=Viral_helicase1; Domain location=1175 -1355; Score=-59.2; E_value=0.066; Accession=PF01443.9; Description =Viral (Superfamily 1) RNA helicase
  Pfam module annotation: Pfam domain module=ABC_membrane::ABC _membrane::ABC_tran::ABC_tran::Viral_helicase1; Domain location=817 -1097::83-356::1172-1357::426-609::1175-1355
MMVSRGLFGWSPPHVQPLTPVSEVSEPPESPSPYLDPGAETSASQQVEAEEEMEEPEEIEPPPAAVPFSQLFACADRFDWFLMAIGSVAAAAHGTALVVYLHYFAKIIHVLRLDPPNGTSQEQFDRFTELALTIVYIAAGVFVAGWIERQTAVIRSNYVQVLLNQDMSFFDTYGNNGDIVSQVLSDVLLIQSALSEKVGNYIHNMATFFSGLVIGLVNCWQIALITLATGPFIVAAGGISNIFLHRLAENIQDAYAEAASIAEQAVSYIRTLYAFSNETLAKYSYATSLQATLRYGILISLVQGLGLGFTYGLAICSCALQLWVGRFLVIHGKAHGGEIITALFAVILSGLGLNQAATNFYSFDQGRIAAYRLFEMISRSSSSVNHDGTSPDSVLGNIEFRNVYFSYLSRPEIPILSGFYLTVPAKKAVALVGRNGSGKSSIIPLMERFYDPTLGEVLLDGENIKNLKLEWLRSQIGLVTQEPALLSLSITDNIAYGRDATMDQIEEAAKIAHAHTFISSLEKGYDTQVGRACLALTEEQKIKLSIARAVLLNPSILLLDEVTGGLDFEAERAVQGALDLLMLGRSTIIIARRLSLIKNADYIAVMEEGQLVEMGTHDELLTLDGLYAELHRCEEAAKLPKRMPVRNYKETSAFQIEKDSSSHSFKEPSSPKMMKSPSLQRVSNVSRPPDGVFNLLESPQVRSPPPEKMLENGLALDVADKEPSIRRQDSFEMRLPELPKIDVHSVQRHMSNDSDPESPISPLLTSDPKSERSHSQTFSRPHSHSDDVSVIMRETKGARHRKPPSLQKLAELSFAEWLYAVLGSIGAAIFGSFNPLLAYVIGLVVTAYYRIDDTHHLEREVDRWCLIIGCMGIVTLVANFLQHFYFGIMGEKMTERVRRMMFSAMLRNEVGWFDDEENSADNLSMRLANDATFVRAAFSNRLSIFIQDSAAVIVGLLIGALLHWRLALVAFATLPILSVSAIAQKFWLAGFSRGIQEMHKKASLVLEDAVRNIYTVVAFCAGNKVMELYRLQLKKIFKQSFLHGMAIGFAFGFSQFLLFACNALLLWYTAICIKRGYMDPPTALKEYMVFSFATFALVEPFGLAPYILKRRKSLISVFDIIDRVPKIDPDDTSALKPPNVYGSLELKNVDFCYPSRPEVLVLSNFSLKVTGGQTVAIVGVSGSGKSTIISLIERFYDPVAGQVFLDGRDLKEYNLRWLRSHLGLVQQEPIIFSTTIRENIIYARHNATEAEMKEAARIANAHHFISSLPHGYDTHVGMRGVDLTPGQKQRIAIARVVLKNAPILLLDEASSAIESESSRVVQEALDTLIMGNKTTILIAHRAAMMRHVDNIVVLNGGRIVEEGSHDTLVAKNGLYVRLMQPHFVESLVTSAPEGFFQECQVKIVGGNGNDGTWISTWHL

SEQ ID NO: 194667 - protein, 200 aa, Glycine max
  Coding DNA Sequence Number=SeqID_77889
  Gene Ontology: Mol. function=structural constituent of ribosome; Cellular component=ribonucleoprotein complex; Biological process =translation
  Homolog annotation: Hit_ID=O22644; Match level="QueryCoverage=68%, HitCoverage=88%, E-value=3e-58, Identity=82%"; Hit description=60S ribosomal protein L23A
  Pfam annotation: Domain name=Ribosomal_L23; Domain location=118-197; Score=104.8; E_value=2.6e-28; Accession=PF00276.10; Description =Ribosomal protein L23
  Pfam annotation: Domain name=Ribosomal_L23eN; Domain location=57-112; Score=75.0; E_value=2.3e-19; Accession=PF03939.4; Description =Ribosomal protein L23, N-terminal domain
  Pfam module annotation: Pfam domain module=Ribosomal_L23::Ribosomal _L23eN; Domain location=118-197::57-112
MAPAKGVHVSVSVSCPVLVLVSVSVLHSLLWLMHCFIDIGGKCSKQYWFPADNAKKADPKAQALKTAKAVKSGGQVFKKKAKKIRTSVTFHRPRTLKKERNPKYPRISAPPRNKLDHYQILKFPLTTESAMKKIEDNNTLVFIVDLRADKKKIKDAVKKMYDIQAKKVNTLIRPDGTKKAYVRLTPDYDALDVANKIGII

SEQ ID NO: 194668 - protein, 141 aa, Glycine max
  Coding DNA Sequence Number=SeqID_77890
  Gene Ontology: Mol. function=calcium ion binding; Cellular component =oxygen evolving complex; Biological process=photosynthesis
  Homolog annotation: Hit_ID=Q6ZDL1; Match level="QueryCoverage=69%, HitCoverage=38%, E-value=2e-36, Identity=73%"; Hit description =Oxygen evolving complex protein-like
  Pfam annotation: Domain name=PsbP; Domain location=28-141; Score= -42.8; E_value=0.013; Accession=PF01789.7; Description=PsbP
  Subcellular localization annotation: CTP_CleavageSite=38; ConfidenceScore=5.37e-01
MTSLQNSPTLHRTMLHNSFPQKHATRSSRRDAISFIVKAAQEPSASLASQENKKGFLPVLDKKDGYSFLYPFGWQEVVIEGQDKVFKDVIEPLENVSVNVIPTGKQDITEFGSPQEVAETLIKKVLAPPNQKTKIVEAKEV

SEQ ID NO: 194669 - protein, 131 aa, Glycine max
  Coding DNA Sequence Number=SeqID_77891
  Gene Ontology: Mol. function=transporter activity; Cellular component= integral to membrane; Biological process=transport
  Homolog annotation: Hit_ID=Q6J1S8; Match level="QueryCoverage=64%, HitCoverage=27%, E-value=1e-25, Identity=69%"; Hit description =Nodulin 26-like protein
MTTETNASYSAVMHRKKRWPRWIRKNNRRHIECFHLLMISSSVIENVKIRGFAVMIIIFSIGNISETHLNPIVTISFAALKHFPGKNVPVYIGAQVLASVSAAFALKALFHPYMSGGVTVPSMGDMGKLSL

SEQ ID NO: 194670 - protein, 571 aa, Glycine max
  Coding DNA Sequence Number=SeqID_77892
  Gene Ontology: Mol. function=protein tyrosine/serine/threonine phosphatase activity; Biological process=protein amino acid dephosphorylation
  Homolog annotation: Hit_ID=Q9M3C4; Match level="QueryCoverage=99%, HitCoverage=68%, E-value=1e-103, Identity=42%"; Hit description =Phosphatase-like protein
  Pfam annotation: Domain name=Gelsolin; Domain location=77-151; Score =12.8; E_value=0.036; Accession=PF00626.12; Description=Gelsolin repeat
VSRSTSLVIAYLMWREGQSFDDAFQFVKAARGIADPNMGFACQLLQCQKRVHAVPLSPSSLLRMYRIAPHSPYDPLHLVPKMLVDPSLAALDSRGAFIVHIPSAIYVWVGKNCEATMERDARGAVGQIVRYEKVQGPIVMIKEGEEPVYFWDAFSDFLPLMDKSGKSGSRIEDGKLFVLPGKRRVDAYNVDYEVFTKAITGGFVPPFGSSGEHETHLPARESSWSVRRKVSHGNMKEVVSVPHGNMKEVVSVPRLSFPRVYSDSMLCLRTSANAILSPSSSLSSSSSSISSSSSPSFVSPDSITSDSSIHSKFLLEVSPDSSSLSNFSSLSITSNSTSHNFSSLSITSNSTSQPVSHSTDILGVKLSHPLFQSASLPLKKPSTSLAERRGSLSKILMLPLMNDKTQVTDKSTTSHASQESDILVNDNVSYQQQSDSKDYFCGSNNHAKDGGVNSIQKCEPSIADSMHLKESSLSQSTTLKGTNDSGLLQYNVAQTSVYHWPSIEKIETFGASHLDSKSAFVIFSPRRSFSCDASQVHLDIDKQSDVGAVDWNQIGCDLLARFSLPKNSVIK

SEQ ID NO: 194671 - protein, 177 aa, Glycine max
  Coding DNA Sequence Number=SeqID_77893
  Homolog annotation: Hit_ID=Q9M3C4; Match level="QueryCoverage=48%, HitCoverage=10%, E-value=2e-24, Identity=65%"; Hit description =Phosphatase-like protein
  Subcellular localization annotation: CTP_CleavageSite=36; ConfidenceScore=5.29e-01
PSTRTVSALPRKPRCLGLFKSFVGFAQNSNFPILLQVGMVGNDDAGHLSASRKMFWRSASWSSSRTAAGNASSGETEKGFADSGAADGTHGQNRRFGPPPLTPRSQQNCKARSCLPPLQPLSIARRSLDEWPKAGSDDIGEWPQPPTTPGGRGNGSNGERLKLDLSSILHNNPDHSR

SEQ ID NO: 194672 - protein, 80 aa, Glycine max
  Coding DNA Sequence Number=SeqID_77894
IWDEDTKSEERSVRCEKDTLVETDVGCGEFGKLMAVRYKGKEELSVNLYVECDKCNMEFEKEAFNVRHQSLVQTYSQLIA

SEQ ID NO: 194673 - protein, 152 aa, Glycine max
  Coding DNA Sequence Number=SeqID_77895
YQIAVEGKGKLIKGEMMALDIDGNLRIGGGVHSMEVQILHHTGLDEVVDAPTIHKDHDTMAMNVAINMEGMVYNDGPGPTCHHNGSTTVVPQWDKIKHRDNDPKVCIPADSNMNPVGDWPISRGRNLNNLGKYCKRIAARRRFLAKFAPDIP

SEQ ID NO: 194674 - protein, 103 aa, Glycine max
  Coding DNA Sequence Number=SeqID_77896
MVYNDGPGPTCHHNGSTTVVPQVRIEEKWWCKAYDSIGKPLKLREIIIHESTLLEFEKSVVRIVLKGWGETRLQGMKHCRPCGEEAIPGHPSVPAEGWTFHVE

SEQ ID NO: 194675 - protein, 60 aa, Glycine max
  Coding DNA Sequence Number=SeqID_77897
  Homolog annotation: Hit_ID=Q9XET0; Match level="QueryCoverage=63%, HitCoverage=27%, E-value=2e-09, Identity=74%"; Hit description=Seed maturation protein PM30
MNRARRPEPLLYLKLVPSSKHSNKTIREGKDNTKGFLQQTGEKVKGTAQGATETVKQTLG

SEQ ID NO: 194676 - protein, 142 aa, Glycine max
  Coding DNA Sequence Number=SeqID_77898
  Homolog annotation: Hit_ID=Q1S1E2; Match level="QueryCoverage=32%, HitCoverage=5%, E-value=4e-20, Identity=97%"; Hit description=Zinc finger, CCHC-type; Putative 5-3 exonuclease
MALQEAECEVAPLIEGVLHSLHVVRLCDTVATKALWTMWFNTTEKETRFDNSERGRFGVNLVTRFFLYGPPGCGKTLIAKAVANEARADFIHIKIKLGEPGWKERYYEEKFSAKTPEELEAIRKDVVLKYTEGLCWVMHMEI

SEQ ID NO: 194677 - protein, 157 aa, Glycine max
  Coding DNA Sequence Number=SeqID_77899
  Subcellular localization annotation: CTP_CleavageSite=50; ConfidenceScore=5.21e-01
MPQLELLPHHSNPQFNSPNPKPLPSSWLHYIRVPPMAASGGCNSFLTLLCAGAVQNQHVSHPTAFLGVPKNNQRKMKTPHRLVVVAVTQGSTESSKSDEKIPSWAKPNFDEPPPWAQDEPNNNSSQQEGFEIPFYAYLLASAITAIATVTNRHLITN

SEQ ID NO: 194678 - protein, 57 aa, Glycine max
  Coding DNA Sequence Number=SeqID_77900
  Gene Ontology: Mol. function=carboxypeptidase activity
  Homolog annotation: Hit_ID=Q1S9V0; Match level="QueryCoverage=89%, HitCoverage=13%, E-value=2e-09, Identity=63%"; Hit description =Carboxypeptidase regulatory region
MPIHLNFLPPNQWGTVTGRLLVLDGGKRAQPANNAYVGLALPRDEGSWLRESKVHLV

SEQ ID NO: 194679 - protein, 106 aa, Glycine max
  Coding DNA Sequence Number=SeqID_77901
MFTIRGGNPSTFFHIQAVDLLIIRHMSTVLVRKLKLKVVSGVHLRWMSIVMCFGDGSQAAVGSPIDAEKHKVFKGGCKDPRDTGAGVQSYYAIYQTKSANQLVRVQ

SEQ ID NO: 194680 - protein, 270 aa, Glycine max
  Coding DNA Sequence Number=SeqID_77902
MTTNQAQTFMDYLTLALWDIHPILLPELPEGVTFDFKHGFLQMSKNILFSGVAHEDPMRHLRKFIKLNNTMRQNRELVEYIRLYAFPFFLNGKAWDRLGNKRVYLKPGKVPRDDQKLSTSSFLPTKANSHFPWIMKKGTNQVEKNDSQTELGKQMQALTLKIETLMRSQAQVPITTPSFPTYDRCGIMHGPRKCIVDDKLAAAMDEINFVGEKKILTINTPTISIKDKASGKVKGCIDIKPYKIRGLDKRRVNLLFKRPCFNIWLRMIRE

SEQ ID NO: 194681 - protein, 166 aa, Glycine max
  Coding DNA Sequence Number=SeqID_77903
  Gene Ontology: Mol. function=nucleic acid binding; Biological process= DNA integration
MVHINIPIIEAIAQMQKYTKYLKEILSNKGNLDDFTTIGLNEECSTIVLRKLPLKLSDRGSFSVPCTIGNLQINRALCDLGTSINLMPYSVYKKLGHHNKMNTIMAIPHPSVGKEYPPRKKVIPKDPGWSKKKKEDSIIVQALSYGVDDYTGGSTQKGKITLFRSG

SEQ ID NO: 194682 - protein, 94 aa, Glycine max
  Coding DNA Sequence Number=SeqID_77904
MYQNAQNKTPSVVQRQPDNLPSQHEPNPKREDVNVVMTRSKRIQEDSEKKEIFFPKVADGILTKKDKASRKVEVPTDENPVANKEGEKEVVTLP

SEQ ID NO: 194683 - protein, 1107 aa, Glycine max
  Coding DNA Sequence Number=SeqID_77905
  Gene Ontology: Mol. function=RNA-directed DNA polymerase activity; Cellular component=chromatin; Biological process=chromatin assembly or disassembly
  Pfam annotation: Domain name=Chromo; Domain location=1044-1092; Score= 11.5; E_value=0.043; Accession=PF00385.14; Description='chromo' (CHRromatin Organisation MOdifier
  Pfam annotation: Domain name=rve; Domain location=801-925; Score =25.1; E_value=4.8e-05; Accession=PF00665.16; Description=Integrase core domain
  Pfam annotation: Domain name=zf-H2C2; Domain location=742-783; Score =16.4; E_value=0.0024; Accession=PF09337.1; Description=His(2)-Cys(2) zinc finger
  Pfam module annotation: Pfam domain module=Chromo::RVT_1::Retrotrans _gag::rve::zf-H2C2; Domain location=1044-1092::341-504::79-169::801 -925::742-783
MADHTTRKTITDRLEDAIARLSTSQSTLIDKHEDLVDKYLELFGKLDISRFDGRDPMDWIFKISQLFEYQNTSEEERITVALFYLDGATLSWYQWMFRNGFITSWSGFLQSLESRFAPSYYDDPKGALFKLTQRSTMNEYLTEFERLANRVIGLPSPFLLSCFISGLTPDIRREVLALQPISLPQAMALAKLQEDKLNPHTFNELPTRLPYNARKDYAIIVMRSGALLIVARGVLGHGHKPPPHKPSRPLRSPFFRNLSPQWHHQPHQPYHSLDSDSTHNFLQPRIAQFLHLKTQSTSPLHVLVGNGSVLDCNQTPSSLPPPRQIVHHINLLPNTAPINVRPYRYPQFQKSEIEKQDGTWRMCVDYRALNSATVCDRFPISTIDELLDELGHASWFSKLDLRQGFHQILMHAPDVEKTTFRTHQGHYEYQVMPFQAAMNSLLTPFLRRFAAVFFDDILVYNKSLSSHLQHLESIFQTLVQGQFYLKRSKCLFAQNQVEYLGHVVSGRGVEPEPSKIHAMVQWPTPASSKDLKAFLGLTGFYRKFVKNYATITAPLTSLLGKDAFEWSLTAQSAFEQLKNAMTSAPVLALPDFNEPFIIETDASGIGMGVVLMQKDLKSLRELMSQVVQTPEQHYYLSKLLGFDYTIQYKVGSSNAVVDALSRTNSSPSGELLLLSVPNPDFMDDLRRTLHSNAEFQTQISKVRAQPGDYSDYRIHNELLLFKNHIWLYDDNPYIPNLMLEFHATPLGGHFGVAKTTHRIESSFYWSSLRRDIKRFIRECTACQQTKTSTQRPAGLLQPLPTPSGVWEDMSVDFITHLPQSHGYTVILVVVDRYSKGVHLGALPTNHSAFKRELFRLSGARLRMSTAYHPQSDGQTEVMSRILEQYLRAFVHAQPTNWYRYLTLSEWIYNTSLHSSSGLTPFQIIYGKPPPTLPHYLQGMSSNEAVDSLITSRQEIHQKLQRRFTKTQDTMKRLADAKRRDVTYTIGQWVYVIERIGQVSNRLQLPEEARIHPVFHCSLLRKHQGPPPASLDTSPLKFIAQRPVHHPLCILNSKLDTSMSPPTRLVLIQWEGQSPEDTTWEKWSKVRNSYHLEDKVVFPGEGIDSSSL

SEQ ID NO: 194684 - protein, 186 aa, Glycine max
  Coding DNA Sequence Number=SeqID_77906
  Gene Ontology: Mol. function=oxidoreductase activity; Cellular component=membrane; Biological process=electron transport
  Homolog annotation: Hit_ID=O64631; Match level="QueryCoverage=77%, HitCoverage=29%, E-value=5e-45, Identity=60%"; Hit description =Putative cytochrome P450
DPDYAPVKGTVFNQLLHFNTLHDYQAQVAKTNPTFRLLAPDQSELYTADPRNVEHILKTNFGKYSKGKYNQDIVTDLFGEGIFAVDGDKWRQQRKLASFEFSTRVLRDFSCSVFRRNAAKLVRVISEFLHQGQEALIWFRLDKFFHKHLSDKRMRSLAVRAEVGIKGVREIKREKMGLASREGNLL

SEQ ID NO: 194685 - protein, 255 aa, Glycine max
  Coding DNA Sequence Number=SeqID_77907
  Gene Ontology: Mol. function=oxidoreductase activity; Cellular component=membrane; Biological process=electron transport
  Homolog annotation: Hit_ID=O64631; Match level="QueryCoverage=93%, HitCoverage=46%, E-value=1e-95, Identity=68%"; Hit description =Putative cytochrome P450
  Pfam annotation: Domain name=p450; Domain location=1-251; Score= -188.1; E_value=0.021; Accession=PF00067.12; Description=Cytochrome P450
MDDWCPSNDCFDFQNVKEDILSRFLIESKKDQKTMTDQYLRDIILNFMIAGKDTSANTLSWFFYMLCKNPLIEEKIVQEVRDVTCSCSHQSEPNIEEFVAKITDDTLDKMHYLHAALTETLRLYPAVPADGRTAEAHDILPDGHKLKKGDGVYYLAYGMGRMCSIWGEDAKEFRPEGWLNNGIFQPESPFKFVAFHAGPRICLGKDFAYRQMKIVATALVGFFRFKLANGTQSVTYKVMFTLHMDKGLPLCAIPR

SEQ ID NO: 194686 - protein, 51 aa, Glycine max
  Coding DNA Sequence Number=SeqID_77908
  Homolog annotation: Hit_ID=Q9M3C5; Match level="QueryCoverage=88%, HitCoverage=8%, E-value=1e-18, Identity=91%"; Hit description=Beta-N- acetylhexosaminidase-like protein
MRGINVMAEVDVPGHAESWGAGYPDLWPSPYCREPLDVSKNFTFDVISDSA

SEQ ID NO: 194687 - protein, 113 aa, Glycine max
  Coding DNA Sequence Number=SeqID_77909
  Subcellular localization annotation: CTP_CleavageSite=56; ConfidenceScore=5.39e-01
MPISPYGSISWSVPSRHKDRTRKTPSGPGGAQQGPGVSGSGYGPLDRACKTPSGPEEASVSSTECLSPPARSSGPLLIELSSRSTAPPGRRRAKHHSSLGMAGSGQQMHRHHL

SEQ ID NO: 194688 - protein, 151 aa, Glycine max
  Coding DNA Sequence Number=SeqID_77910
  Pfam annotation: Domain name=DUF1723; Domain location=59-99; Score =9.6; E_value=0.037; Accession=PF08330.1; Description=Protein of unknown function (DUF1723)
MKLPSGKGPQHLHVGNGKLPLLLRMFITWMMQLKRSSNNLKKEERLELKLSFHGKKVQKSGRPAVKIEGFHIPVGEVTITLDDVASLLHLPITGTFHSFETLHVDEAVLMLVELLEVSVDEAKAETVQCHGTYVQLSWLRDIYRSKCDVEH

SEQ ID NO: 194689 - protein, 140 aa, Glycine max
  Coding DNA Sequence Number=SeqID_77911
MVELEGNLVLHWIIVALGSLCPRKKPLITTTTIINNLIASQGAEKKHQLKGFLHDFLRKTGEGKVNVGDGGGLAHVALARGDNSDTGDGAKELGLAVPLEGGGGGRMEEEECGVGGSDSAREKVEKEHWEGERGRKRRRR

SEQ ID NO: 194690 - protein, 128 aa, Glycine max
  Coding DNA Sequence Number=SeqID_77912
  Gene Ontology: Cellular component=mitochondrion
DLGVTISLPKSLVSDVGGAEFAKKFRLLCKLNHTKSSTVLRLKAIWLKAKLPFELWLGQCCPVDPYLKGRLIWKLQQAFRPKDLVVPPTSTYKSETFEYLEDMTLLRSWTEAWLKYVRWYYATALSPD

SEQ ID NO: 194691 - protein, 146 aa, Glycine max
  Coding DNA Sequence Number=SeqID_77913
  Gene Ontology: Mol. function=glycerophosphodiester phosphodiesterase activity; Biological process=glycerol metabolic process
  Homolog annotation: Hit_ID=Q7N7C1; Match level="QueryCoverage=91%, HitCoverage=45%, E-value=6e-39, Identity=57%"; Hit description =Similar to putative exported protein
MGERLLEVLKNTHSLDRVRVYSTEDRYIAALPQPIPRFVSRSETRTRLANVSLSHQCQQDSQRDGDKWYGLELKRKVEVVEKFTLGEGVSPATLTWDKEAMDCFRSQGQAHIIFFGINSAEDYRTAKELGADGVMVDSPAQAKNWQ

SEQ ID NO: 194692 - protein, 138 aa, Glycine max
  Coding DNA Sequence Number=SeqID_77914
MDDIDSNGDAVAFATRDGPLALVIDGDGGMKANLTPISQIKFLELETEFALHAHAHTLCLLTTRTSAQHHHPYPRLHAKVQSVEGEEGRRKRERRHHFKEKMSLEEAHHHMRPWIRAWRKKEMNKGRGREEHEILCSK

SEQ ID NO: 194693 - protein, 111 aa, Glycine max
  Coding DNA Sequence Number=SeqID_77915
MESKVKPSLYTHQVAPPLKNAWLVIPIALSPPLSQPQNKTTVACMGRIFPECPERQRISWKQRRYRDCYHQRFLDYPMTGAGPGGVEDPPPPVLNHVIKFNFSGTMLSNIG

SEQ ID NO: 194694 - protein, 207 aa, Glycine max
  Coding DNA Sequence Number=SeqID_77916
  Gene Ontology: Mol. function=oxidoreductase activity, acting on NADH or NADPH, quinone or similar compound as acceptor; Biological process=sodium ion transport
  Homolog annotation: Hit_ID=Q8ZBZ0; Match level="QueryCoverage=98%, HitCoverage=45%, E-value=9e-71, Identity=67%"; Hit description=Na(+)- translocating NADH-quinone reductase subunit A (EC 1.6.5.-) (Na(+) -translocating ...
  Homolog annotation: Hit description=NQR subunit A) (Na(+)-NQR subunit A)
  Pfam annotation: Domain name=Biotin_lipoyl; Domain location=25-94; Score=-7.7; E_value=0.0053; Accession=PF00364.12; Description=Biotin- requiring enzyme
  Pfam annotation: Domain name=NQRA; Domain location=1-207; Score=29.9; E_value=9.5e-19; Accession=PF05896.2; Description=Na(+)-translocating NADH-quinone reductase subunit A (NQRA)
  Pfam module annotation: Pfam domain module=Biotin_lipoyl::NQRA; Domain location=25-94::1-207
MIKITKGLDLPIAGMPLQQISPRPAVKRVALLGEEYVGMRPSMAVSEGDRVQKGQVLFEDKKNAGVRFTAPASGVVSAIHRGERRVLQSVVIDIDGSNEAVSFTRYALEDLNDLPREAVQQQLLESGQWTAFRTRPFSKIPAPGSVPAAIFVTAIDTNPLAAEPQPIILAQREAFDAGLTVLTHLTDGKVHVCQASGGKLGGHPAGQ

SEQ ID NO: 194695 - protein, 99 aa, Glycine max
  Coding DNA Sequence Number=SeqID_77917
  Homolog annotation: Hit_ID=Q10N71; Match level="QueryCoverage=47%, HitCoverage=60%, E-value=2e-13, Identity=72%"; Hit description =Uncharacterized plant-specific domain TIGR01589 family protein, expressed
MGESSNSSSASYIHMVHHLIEKCLTFHMSKEECMEALSKHANIKPVITSTVWNELEKENKEFFEEYAKGKSKEDRMSEEETTQMLQKMISDSSKGAAKD

SEQ ID NO: 194696 - protein, 67 aa, Glycine max
  Coding DNA Sequence Number=SeqID_77918
MWNGKEGLNDNIFGVVNDDLVVIGEEMVDGVLGAGEKGGGGEFKPREEGELYLSRLIDVNIPGGYHP

SEQ ID NO: 194697 - protein, 206 aa, Glycine max
  Coding DNA Sequence Number=SeqID_77919
  Gene Ontology: Mol. function=zinc ion binding; Cellular component =nucleus; Biological process=chromatin modification
  Homolog annotation: Hit_ID=Q1SJ15; Match level="QueryCoverage=85%, HitCoverage=55%, E-value=3e-66, Identity=66%"; Hit description =Nuclear protein SET; Zinc finger, RING-type; Zinc finger, FYVE/PHD- type
  Pfam annotation: Domain name=PHD; Domain location=24-72; Score=56.6; E_value=8.1e-14; Accession=PF00628.19; Description=PHD-finger
MASSLGRRRTHAPKSSSTLNDDVSCEECGGGHSPSKLLLCDKCDRGYHLFCLRPILPSVPKGSWFCPSCSNHKPKCFPLVQTKIIDFFRIQRSPEALANQDTRKKRKRGGGLVVSKKKRKLLAFVPSEDPKRRLEQMASLATALIATETEFSNELTYMPAMAPRSANRPALERGGMQETPLKVASQVFGQKSVINKTGEYFAPTSR

SEQ ID NO: 194698 - protein, 333 aa, Glycine max
  Coding DNA Sequence Number=SeqID_77920
  Gene Ontology: Mol. function=protein serine/threonine kinase activity; Biological process=beta-lactam antibiotic catabolic process
MVIGWWGHASGKKFQEILEEAIVRPLHIEGELYVGIPPGVESRLAALTVDTADLSKVSALANRPDLPSTFQPQQIAQLATSLPVAFNTLNVRRAIIPAANGHVSARALARYYAALADGGKIPPPHSSASKPVLGSHPHIPKLSSSPKPPKTRKCIGRRKQATSTSVSTTNSYEKVSSYDDSEANKGRNTNSESSSGDDASSSRISNNLRSHVAGKVYKNPRIIDEFLGTGEYTNLALPGEGFGLGFKRFTSKDGSSIAFGHSGMGGSTGFCDVTNNFSIAVTLNKMSFGGVTGKIVQLVCSELNIPVPDDFLRFAVEQSGPDEQLSMGRPIIN

SEQ ID NO: 194699 - protein, 142 aa, Glycine max
  Coding DNA Sequence Number=SeqID_77921
  Gene Ontology: Mol. function=protein disulfide oxidoreductase activity; Cellular component=chloroplast; Biological process=cell redox homeostasis
  Homolog annotation: Hit_ID=Q6K609; Match level="QueryCoverage=91%, HitCoverage=94%, E-value=2e-39, Identity=62%"; Hit description =Glutaredoxin-like
  Pfam annotation: Domain name=Glutaredoxin; Domain location=42-115; Score=62.9; E_value=1e-15; Accession=PF00462.14; Description =Glutaredoxin
MRQENIMHYQVEPAWSYYMRVRRSMEEDQMERVARLASQSAVVIFSVSSCCMCHAMKRLFCGMGVNPTVHELDQDPKGKDMESALMRLLGIGIGNGINSTASAAVPVVFIGGKLVGSMDRVLAFHISGTLVPLLKQAGALWL

SEQ ID NO: 194700 - protein, 724 aa, Glycine max
  Coding DNA Sequence Number=SeqID_77922
  Homolog annotation: Hit_ID=Q10N06; Match level="QueryCoverage=31%, HitCoverage=29%, E-value=4e-16, Identity=31%"; Hit description =Expressed protein
MESKQEASSVILNLMGLDKVPTQHPVRDKQKVLSENYLQKVASIGVRKKRSSYQHHSSGMNTNEKDESEDVLKVVKALRRGKQHNPSKGNGKENPSSCKNSHFPDGLLQEMFYPKSMKPYPEMRERKKISYHMNSDKQSSRPLSKVSEEISMPSGNVANGVLGTASSSFFRGNEAFSNDNMLKPASNISVNEIQCNSPFLCSDTRTNTLAQGDATEKLQELGRCGQDCIHNQLPMISEHGNRAGNLNRRSGYSYDKIIRNIRFKAGVNYSFSRRVAIPLCTASVIADNCGTMNQDILFQRYWGLRKNASANRLSWKSKNQNVNQKECLEDVNLSPGHEKFPSLSSYFNSNHTEENSTGHTSEKRRYGSNLSDKVTMPPQLSSSSPSSALIDCQILQERCSANDEVRNKTYEDSSMSKQHVVSPDSSVEFLASDATNEVVGRSHNNPTKRQYKSAAFILSQEIDSLSHTYASKKQDTSDFQEDSVHSLCSEADPDSIGSFEEAYEPSPISVLDPLFGEDSSKCGNHVYDSSEVDDEEYGLNVSSDEDCENESVGDSEEKKDVAGLFRAEESRDFSYIVEVLTEAGISNRSLFTDFSTWHSAECPISPSVFKILEKKFGEQQLWKRSERKLLFDCINLGLLEILQPYLYIPVWEKPMSRRLNTEPSQDMIEEEMWGLLVAQEKKASKGLADSMLEGEIRWIELVEDVEDIVREIVKLLIEELTNEI

SEQ ID NO: 194701 - protein, 110 aa, Glycine max
  Coding DNA Sequence Number=SeqID_77923
  Gene Ontology: Mol. function=transporter activity; Cellular component= integral to membrane; Biological process=transport
  Homolog annotation: Hit_ID=Q4ZP93; Match level="QueryCoverage=51%, HitCoverage=18%, E-value=7e-14, Identity=76%"; Hit description =General substrate transporter:Major facilitator superfamily
PSVIALYLRANLHETEAFENKKEMSEKKKGTIKELLKHPKALLTVVGLTLGGTQNRKKTFASGIWNFRNSLHSTFAYSIKHDDLNAELFPSEVRALGVGLPYALTVAIFG

SEQ ID NO: 194702 - protein, 78 aa, Glycine max
  Coding DNA Sequence Number=SeqID_77924
MATAEALERETKKARKEEHDQSKVDSLHQEATMWTDRFALTLNRSQELPRLLAQGQSNGGHLLRPQEDPTNFSAIVNI

SEQ ID NO: 194703 - protein, 73 aa, Glycine max
  Coding DNA Sequence Number=SeqID_77925
MASMMDAMLGMKQLMESNVATATHYLPTAAHYPIPNMSYVMMRVTFLPSSLKGSLLDILTRSTRIIESLLRET

SEQ ID NO: 194704 - protein, 335 aa, Glycine max
  Coding DNA Sequence Number=SeqID_77926
  Gene Ontology: Mol. function=beta-lactamase activity; Cellular component=integral to membrane; Biological process=beta-lactam antibiotic catabolic process
  Homolog annotation: Hit_ID=Q5Z8Y3; Match level="QueryCoverage=99%, HitCoverage=52%, E-value=1e-148, Identity=74%"; Hit description=ABC transporter-like
  Pfam annotation: Domain name=ABC1; Domain location=108-228; Score =116.7; E_value=6.5e-32; Accession=PF03109.7; Description=ABC1 family
MGWGDIYKRRVRVFTMAVIIYLDYKSVQQREKWTSKSRQASLWEKAHERNAKRVLNLIIEMEGLWVKLGQYMSTRADVLPAAYIRLLKQLQDSLPPRPLEEVYGTIQKELGKSMDELFADFVNKPLATASIAQVHRATLLNGHEVVVKVQHDGIKTIILEDLKNAKSIVDWIAWAEPQYNFNPMIDEWCKEAPKELDFNHEAENTRTVAKNLGCRNQYDGNMRANRVDVLIPDVIQSTEKVLVLEYMDGIRLNDLESLEAYGVDKQKLVEEITRAYAHQIYIDGFFNGDPHPGNFLVSKESPHRPILLDFGLTKKLSSTIKQALAKMFLASAEWL

SEQ ID NO: 194705 - protein, 218 aa, Glycine max
  Coding DNA Sequence Number=SeqID_77927
  Gene Ontology: Mol. function=protein serine/threonine kinase activity; Biological process=beta-lactam antibiotic catabolic process
  Homolog annotation: Hit_ID=Q5Z8Y3; Match level="QueryCoverage=74%, HitCoverage=25%, E-value=2e-52, Identity=61%"; Hit description=ABC transporter-like
MTEYLRLDIPEQAMEVTAVFFRATTPANEYHKTMKSLADQRDRNMKVIQEKMNLDKKEMKRFNPVDAFPGDIVIFGRVLNLLRGLSSTMNVQIVYMDIMRPFAESVLRGYISKGPSVNDRWIFDSPVHSDVESMLRQLLIEMGNNDKILGIQECDFIGSFMLQTQSGIAAAVLIDCNTKTRSEQHLCRNTSLLWHAPPLSQPLWLLLTTLIRRQIPQS

SEQ ID NO: 194706 - protein, 121 aa, Glycine max
  Coding DNA Sequence Number=SeqID_77928
  Homolog annotation: Hit_ID=Q5Z8Y3; Match level="QueryCoverage=46%, HitCoverage=9%, E-value=2e-23, Identity=87%"; Hit description=ABC transporter-like
MAPLKLLWFMFFLSIIVVVVALMSRANQIAQVCAYKDGEVIIDTAAGVLGKYDPRPVKPDSLFPVFSVTKGITAGMIHWLVDNGFIKCVIHRVIHAPSQKLLGVRGCIGKNPSPTSIRDSA

SEQ ID NO: 194707 - protein, 327 aa, Glycine max
  Coding DNA Sequence Number=SeqID_77929
  Gene Ontology: Mol. function=RNA-directed DNA polymerase activity; Cellular component=chromatin; Biological process=chromatin assembly or disassembly
  Pfam annotation: Domain name=Chromo; Domain location=259-307; Score =34.5; E_value=3.8e-07; Accession=PF00385.14; Description='chromo' (CHRromatin Organisation MOdifier
MEFDFSIEYKQGHDIVAVDALSRVEPVACQALAVHQKCSVCQKCKYETKASPGLLQPLPIPDLIWQHITMDFIEGMPSSFDSITSDRDSIFLNQFWQNLMAFQGVQVQLSTAYHPQTDDQTEIVNRCLETYLMSTPYEVVYGQPPPVNLPYLAEASKTELVDRSLLRREEMLKLIKFHMKRAQDRMKQLADKHRSERQFSVGDMVYVKLHPYRKISVAARSNVKLSPKFYGPFQLKKHVGEAVTSLSLLSLVEGDPLFKEPEAILDRMTVKRRGRAVTKVLVKWKHSLPEDTTWEFFFDLKQRFGGRSFIGIPTLLCNSLSLILELP

SEQ ID NO: 194708 - protein, 270 aa, Glycine max
  Coding DNA Sequence Number=SeqID_77930
  Gene Ontology: Mol. function=RNA-directed DNA polymerase activity; Biological process=RNA-dependent DNA replication
  Homolog annotation: Hit_ID=Q1SKV6; Match level="QueryCoverage=60%, HitCoverage=48%, E-value=1e-14, Identity=27%"; Hit description=RNA -directed DNA polymerase
MLRGLLVDGCWIEELSRVKEEVIGQHQNDFLVVCFHEKEVKDVVWECGSSIYKIVAKLLARRLKRVMPDIIDEQQTAFIEGRHMLHSVVIANEVVEEAKRCNKSCMVFKVDYKKGLTGLMRVALRNNQFKALMENVRAIKVKRRSFELVSGILKKVVDKLVKLPWWFLWRGDSKQKKIDWDLIKFNYALLGKWRWNLFHHQGELWARVLDSKYGGWRNLDEEDGVPFMEKYPRLYLILNQKNQYIQQMGPFQMQHGSGTCIRGDSFSKLK

SEQ ID NO: 194709 - protein, 101 aa, Glycine max
  Coding DNA Sequence Number=SeqID_77931
MKLLEEATWSFLGKNAAQPSLTVGSSRNLGLQLHKTLVHDLTVGIFAKMSGLRKIVISSPFFLPKPFLTSQALSPSPTATISNQKPSLFSIETPHREEPFN

SEQ ID NO: 194710 - protein, 125 aa, Glycine max
  Coding DNA Sequence Number=SeqID_77932
MADATRNRVLEREIEDRVENRLSSKIDERFMEMEASMQQTLHDSLTQLLALSISQQMQDLLHNNSKGKTHSQTGGSPIRGERSSYSCGTRLARIDFPRFSGIDVKQWLIQCDTFFSIDNTPEEFK

SEQ ID NO: 194711 - protein, 130 aa, Glycine max
  Coding DNA Sequence Number=SeqID_77933
  Homolog annotation: Hit_ID=Q1T493; Match level="QueryCoverage=92%, HitCoverage=23%, E-value=2e-08, Identity=30%"; Hit description =Nucleic acid-binding, OB-fold, subgroup
  Pfam annotation: Domain name=DUF223; Domain location=2-90; Score=5.7; E_value=0.00086; Accession=PF02721.5; Description=Domain of unknown function DUF223
MWGTKFQLKVKNLDIEKWEQQLKEGKTYIAQNFEVESNKEDYKTTKHGYKLVFVKGTMLKEQDLLDIPHYVYDFTKFESIINKNVVADVLIEVIGEFVDLVQCSLETRPKKLVFTMRDEGYILNISLSPV

SEQ ID NO: 194712 - protein, 225 aa, Glycine max
  Coding DNA Sequence Number=SeqID_77934
RHRSHLRPYSHKREKERKPQEANINLSYFPGKDNVEACLDWEIRVEQQLKRKSTSKSYGSHSYPKKYQGQGILGVTPSKPKDDKGKTIEKQPPKASMQGKTNSINQDDATTSPSSNESEEAKREESSEEIYPQEEGQPLMVKEECKEVSVSSKRLAKKESHFAIKIKIKETSPLRQLLHLLLCKKTLVSTITPLGLEVIPQVKEMLGESLVRKNLNPYALLVPKI

SEQ ID NO: 194713 - protein, 154 aa, Glycine max
  Coding DNA Sequence Number=SeqID_77935
  Gene Ontology: Mol. function=protein binding; Biological process =apoptosis
  Homolog annotation: Hit_ID=UPI0000162D33; Match level="QueryCoverage =70%, HitCoverage=51%, E-value=3e-10, Identity=36%"; Hit description =protein binding
  Pfam annotation: Domain name=BAG; Domain location=64-143; Score=41.0; E_value=4.2e-09; Accession=PF02179.6; Description=BAG domain
  Pfam annotation: Domain name=IQ; Domain location=46-66; Score=18.7; E_ value=0.021; Accession=PF00612.17; Description=IQ calmodulin-binding motif
  Pfam module annotation: Pfam domain module=BAG::IQ; Domain location =64-143::46-66
  Subcellular localization annotation: CTP_CleavageSite=57; ConfidenceScore=5.32e-01
MQMKNTPLYRTTPWGGMPEPCFRKAPSKVVSIPVHFVGSERTRTNSDSATEIQRVLRGFLVRNTLRKITAMRVELERIESEISVEVMKLKREQRERVRVSETIMNLLLKLDSVRVLHYSGLRECRKSLINKAIALQEMLDQMAVTHSDEMEEKE

SEQ ID NO: 194714 - protein, 130 aa, Glycine max
  Coding DNA Sequence Number=SeqID_77936
MEITKSLVSNNNNKKNNCTPSRLVGPDGVGLLVLPRKVELKDDSSLLVATYQPLPAAFTKQSSCYTKANSFYITCSKLKYSNQNWRNSVGLGWKRMKERLRDRKMQRVQRPTKHEQEFGCWKLERAKCRE

SEQ ID NO: 194715 - protein, 155 aa, Glycine max
  Coding DNA Sequence Number=SeqID_77937
  Gene Ontology: Mol. function=ribonuclease P activity; Biological process=tRNA 5'-leader removal
  Homolog annotation: Hit_ID=Q2QZQ0; Match level="QueryCoverage=80%, HitCoverage=15%, E-value=3e-08, Identity=32%"; Hit description =Ribonucleases P/MRP protein subunit POP1 containing protein, expressed
  Pfam annotation: Domain name=POP1; Domain location=28-155; Score =33.0; E_value=6.3e-08; Accession=PF06978.2; Description =Ribonucleases PMRP protein subunit PO
MVTAGTKKPQVSVPTPPPPPWKINLQKYAESRALELHSLQSIIENRVNNDYRSQKNKRRRTIVFDNQIARKGCRRKRQKLGIIDKALAKSGLEENHQKKLPRCVHRRYELKKNLENGFCTSRDVTKRLRTHVWHAKWGKGSRALLKKAQTRGACT

SEQ ID NO: 194716 - protein, 350 aa, Glycine max
  Coding DNA Sequence Number=SeqID_77938
  Gene Ontology: Mol. function=aminocarboxymuconate-semialdehyde decarboxylase activity; Biological process=metabolic process
  Homolog annotation: Hit_ID=Q682E0; Match level="QueryCoverage=98%, HitCoverage=98%, E-value=1e-120, Identity=61%"; Hit description=MRNA, complete cds, clone: RAFL21-86-C08
  Pfam annotation: Domain name=Amidohydro_2; Domain location=43-343; Score=94.2; E_value=4e-25; Accession=PF04909.4; Description =Amidohydrolase
  Subcellular localization annotation: CTP_CleavageSite=27; ConfidenceScore=5.44e-01
MALRLTTVVSSVGHSGKPRFRFRIRSVAATVRNMAFSATSKVIDSHLHVWASPQEAGRFPYSLGQEPTLPGNAEFLLQCMEEAGVDGALIVQPINHKFDHSYVTSVLQCWNCYGRKGIGYREKDRESVLNKYPTKFVGCCLANPADDGSGLRQFEDLVLKDGYRAVRFNPYLWPPGEKMTNKVGKEIFQRAGELNVPVGFMCMKGLDLHISEIEQLCTEFPSTVVLLDHLGFCKPPINDEEGLVFSQLLNLSRFPQVHVKFSALFRVSRAQFPYLDLSPLFSQVVSHFGANRVMWGSDFPFVVAECGYKGAKEAVHLIASEISLPLSDLEWIMGRTATQLFQNQLTPVNS

SEQ ID NO: 194717 - protein, 242 aa, Glycine max
  Coding DNA Sequence Number=SeqID_77939
  Gene Ontology: Mol. function=aminocarboxymuconate-semialdehyde decarboxylase activity; Biological process=metabolic process
  Homolog annotation: Hit_ID=Q682E0; Match level="QueryCoverage=72%, HitCoverage=48%, E-value=7e-41, Identity=47%"; Hit description=MRNA, complete cds, clone: RAFL21-86-C08
  Subcellular localization annotation: CTP_CleavageSite=48; ConfidenceScore=5.26e-01
MGVIPSSITVPRLEARKTNREMTVYITFSLNATFLSAVSTSGTKGTTKSSSLNPPPILHAIQTTTTQMTNEIGKAIFLVNGLGPYISEIVQLCTEFPSTVVLLDHLAFCKPPSNEEEGLVFSQFLNLSRFPQVPDSFLLRGACLNVFISKCFSLRNTKFRIFDRLSRGQFSHLDLSPLLSQVVSSFGANRLMWGTDFPYVVPECGYKEANEALHLLADQISLTSTDLEWMMGRTVTQLFPNQ

SEQ ID NO: 194718 - protein, 48 aa, Glycine max
  Coding DNA Sequence Number=SeqID_77940
MENWRTALRNNFAGLLTRREWRIGEQRYAITSRGSRLEGGGHMNSARQ

SEQ ID NO: 194719 - protein, 108 aa, Glycine max
  Coding DNA Sequence Number=SeqID_77941
MNQGQTTGISTANRALGGTSGFGLDEIISNAPYPSASSSKRSRAMLEYDVGGPVVNNALHQQERPSALAVPKVFPPFAGEFARDFQAPDQSSLLNVSQNTLHPELFYQ

SEQ ID NO: 194720 - protein, 246 aa, Glycine max
  Coding DNA Sequence Number=SeqID_77942
MEMEPNYGDYYFPVASPTAQGTITTGLGNGNYHLTAQLLGESSSTVQLPPTQESCPQVVKLQNPLGAANGAPPPFSPTTQWANNPNLQLPHSQLSTGLGPTPEMMQFRGLSSFSSGGRYSNGSQSNTQKQRGPKGNIHLIPKLREMGESSSSRSAKMKMTLPDNNQQSTELQLGTLLNPTTQRNGNPQPPRLMRNSLYDPIFEQMGLPIDPHLRMFVRRQEAYTMICVDRSNDFRFARELPYTTYC

SEQ ID NO: 194721 - protein, 104 aa, Glycine max
  Coding DNA Sequence Number=SeqID_77943
MLVVNRAPKQGRGRATTTKEAERRVVGVGMNETQVLMDDSIYRQAPNTNRMRIHFIFNALVVSSISTKLNLTLQTEPSPSSSVADSRYAIFAQTAPSHHAHCFS

SEQ ID NO: 194722 - protein, 262 aa, Glycine max
  Coding DNA Sequence Number=SeqID_77944
MAAESIYKERCVSVNDGPSWAKYMLISGSPDDEYDIITLQYTEEGLLSVDENREGRAAAFGDDIAIECLATEFKREIYVVQAHGSDAMVDEENCVFFLPHRPRSRITEPPFFLFMKGTGWCGAGADHYEPLIAHPSAFVSQEKVAVKDWIVKRALVEIECDGWNSALIEQLFCPRDVQAILKMPIFEPNLEDDRVWRKTVPMEALSGMLTYEDLINDVSSCTDFDQPIMGEEVKEAHAAERWSPPSVGSLTCNVDANLTGAG

SEQ ID NO: 194723 - protein, 365 aa, Glycine max
  Coding DNA Sequence Number=SeqID_77945
  Homolog annotation: Hit_ID=Q9FMU1; Match level="QueryCoverage=92%, HitCoverage=90%, E-value=2e-30, Identity=33%"; Hit description =Arabidopsis thaliana genomic DNA, chromosome 5, P1 clone:MUA22
MKLLGWMHRKLRQNSSEPFKDLVIGNSCNCLSGQAPLDDEQVYQKPNLGIRLSKHAQKGHNNLRNSFAGLEAARVDEDYEGEYFPGFLAIGTLGSERVSDPSTTPSFPISVESITEKEDEVTENDLKLINDELEKVLGAETKDDVSIDSSRRTSHVSTGRSSHVSTGRSSHVSIITLSGKPIEGTEPNGNGAAICPLQGYLFGTAIELSETTAAAAKKEHRTSLGELFQRSKSAEENFSAKCEKEDKRAEKEVDKSAMNLMKEKLKKRMLHAYSKNSTSINGGPIDSASAETKLNKILHMFRKKVHPESSTAAQKSAKHHKNQKKKKTINDGGYNKSDLVHPEEDSSVNREYWIKTDADYLVLEL

SEQ ID NO: 194724 - protein, 154 aa, Glycine max
  Coding DNA Sequence Number=SeqID_77946
MTSDGKIDQTTPQWIKVKSHVQSGGYECDYYVMHWMWNIINRELKNDWTMVFGKVRILELLSLLSSLFVPHCPEALRYAKPKCVSSLVLESAMKWEALVTLGDVEHEPTISDKPFITTDLVVTGINATNGDPMAIASFHSQFQDHMWEMFEWTM

SEQ ID NO: 194725 - protein, 54 aa, Glycine max
  Coding DNA Sequence Number=SeqID_77947
MPLVSSPAIGGRDGEGCASVGGGEMSGGGTASGGAGGMSGVARVLTYFGPRKTP

SEQ ID NO: 194726 - protein, 378 aa, Glycine max
  Coding DNA Sequence Number=SeqID_77948
  Gene Ontology: Mol. function=aspartate-tRNA ligase activity; Cellular component=cytoplasm; Biological process=tRNA aminoacylation for protein translation
  Homolog annotation: Hit_ID=Q5H2B1; Match level="QueryCoverage=72%, HitCoverage=46%, E-value=1e-131, Identity=85%"; Hit description =Aspartyl-tRNA synthetase
  Pfam annotation: Domain name=GAD; Domain location=1-95; Score=114.1; E_value=3.9e-31; Accession=PF02938.5; Description=GAD domain
  Pfam annotation: Domain name=tRNA-synt_2; Domain location=2-248; Score=135.8; E_value=1.2e-37; Accession=PF00152.11; Description=tRNA synthetases class II (D, K and N)
  Pfam module annotation: Pfam domain module=GAD::tRNA-synt_2; Domain location=1-95::2-248
TGPANDAEGRVAALRIPGGAALSRKQIDEYAAHAAKYGAKGLAYIKIADNGEVSSPIQKFFSEESFAALVAHVGAGNGDIVFFGAGGYNKVSDFMGALRLKAGKDFGLVADGWAPLWVTDFPMFEWDEEEQRYVALHHPFTAPAVDDIADLRANARTAVSRGYDMVLNGNEIGGGSIRIHRPDMQSAVFELLGIGAEEARAKFGFLLDALNYGAPPHGGIAFGIDRIAALMAGTESIRDVIPFPKTTGAQDLMTDAPSPIVDAQLAEVHIQAMTEFAFSLEWEKLGNEGAEANLVTERARVFGGWLVRVGTNPAAMALTFVADGEGRWDGEDFGVEDYEDDEEEEYDEDEEGEEEEDEDEEEYEEEDEEEEAESPEKA

SEQ ID NO: 194727 - protein, 97 aa, Glycine max
  Coding DNA Sequence Number=SeqID_77949
  Gene Ontology: Mol. function=N-acetyltransferase activity; Biological process=metabolic process
  Homolog annotation: Hit_ID=Q5H2B0; Match level="QueryCoverage=95%, HitCoverage=26%, E-value=1e-36, Identity=75%"; Hit description =Acetyltransferase
ALEFAVTGLHVRVRQATGAGGGMADRLPVQLQQPHRVVGVGQDHALALDRVGLLKEGLQVLRRIQMAEGFGERAGSQRRQGRRVVHSGAADRIHAGS

SEQ ID NO: 194728 - protein, 150 aa, Glycine max
  Coding DNA Sequence Number=SeqID_77950
  Gene Ontology: Mol. function=transferase activity
  Homolog annotation: Hit_ID=Q1SE38; Match level="QueryCoverage=98%, HitCoverage=32%, E-value=3e-34, Identity=47%"; Hit description =Transferase
MVALHVVDMRKRMGEPFSKGAIGNLLWPALVLLEDVNKNTEIRDLVRVLKEGLGKLTKELFLKVQNDPRFLWSDECAQLMLEGIATKNPITFVFTSWVNMGFNEVDFGRGKPLWLAQRGGTKETIPNTVVLMETKEGIEAWVRMAEKHIA

SEQ ID NO: 194729 - protein, 133 aa, Glycine max
  Coding DNA Sequence Number=SeqID_77951
  Gene Ontology: Mol. function=transferase activity
  Homolog annotation: Hit_ID=Q1SE38; Match level="QueryCoverage=54%, HitCoverage=15%, E-value=1e-13, Identity=53%"; Hit description =Transferase
  Pfam annotation: Domain name=DUF1336; Domain location=21-133; Score= -100.5; E_value=0.014; Accession=PF07059.3; Description=Protein of unknown function (DUF1336)
MVFLGGKKEEAEMKSGHDDISSFDPLQMANQVFKKALQEYASKRMWRLHIPIAIPPHWKSLPGSIVQVPGSSLYSFGLYYMTKTPMEDNPSLHSFVHGDDAYRNSRFKLIPYFLSRISHQGPWIVKQGVGILV

SEQ ID NO: 194730 - protein, 340 aa, Glycine max
  Coding DNA Sequence Number=SeqID_77952
  Gene Ontology: Mol. function=beta-lactamase activity; Biological process=beta-lactam antibiotic catabolic process
  Homolog annotation: Hit_ID=P96465; Match level="QueryCoverage=55%, HitCoverage=62%, E-value=6e-70, Identity=75%"; Hit description=Beta -lactamase L2 precursor
VAFGEAVHFRLQPVAAADRITAGAQERGHRRRATDHAEQQVGGGVVAGDDRGPAQVAHGHILAGMTAGDRCVREQVGLAHRYAPVEQRGCALGLAEHGCGQHALEGAAHREALVLAMADAATACGIEQGHAQASCAGLFQRGEITGGVDGGVCGCVGGGLARCTCQQRQGKRRSNSGTTELQESATGEHAGVLLGTVRLLEPTARTTSAKIQHQPLDLLMSIASIPAISGLPCPGVRISHHPGSRLDDAASHPATERAARLRGRRPSPELHPRRAGAVCQPGRAEPPDPWAGGPARHPPVPPTASRRGAHRRRRGAVSGAQRIVRAHLRQHCALYRRAGP

SEQ ID NO: 194731 - protein, 164 aa, Glycine max
  Coding DNA Sequence Number=SeqID_77953
MDTEEFSFPRISDTCAHNIDSPPLWNLSPAASPNPYYQGNKRVENECFGAKLVAAEAHRKSFSYVENRKKRFGLEEDENRMDMLWEDFNEELYSTTGSATSSSREVVELRYAPALTVAKTNNSSLLPTKNNKPGMVVIVKVMKKLFSINNSRGGNWGFGCIKGV

SEQ ID NO: 194732 - protein, 135 aa, Glycine max
  Coding DNA Sequence Number=SeqID_77954
  Homolog annotation: Hit_ID=Q2HRE1; Match level="QueryCoverage=48%, HitCoverage=14%, E-value=2e-14, Identity=51%"; Hit description =Lipopolysaccharide-modifying protein
  Pfam annotation: Domain name=DUF821; Domain location=1-129; Score= -216.8; E_value=6.3e-08; Accession=PF05686.3; Description=Arabidopsis thaliana protein of unknown function (DUF821)
MFEFNHDRADIRCTLKVLLGQSVKNTFCHVTLPLYVYDYMFHLLNSYAKLFRYKPSISANATELCVESMVCGAEGSVKKFMVESLVKVPANTDPCTMPAPFDPPTLYATLQRKESSIQQVESWEKSYWDNQTITS

SEQ ID NO: 194733 - protein, 84 aa, Glycine max
  Coding DNA Sequence Number=SeqID_77955
  Subcellular localization annotation: CTP_CleavageSite=38; ConfidenceScore=5.28e-01
MVNKSSLLHLDPKSPEAQAFNQIGQKSNGGSISPSPTTSAEGSSQNGRNQGIDETATAKNSASYIGKRLLESLVAVAGLQIWLS

SEQ ID NO: 194734 - protein, 75 aa, Glycine max
  Coding DNA Sequence Number=SeqID_77956
  Gene Ontology: Mol. function=5'-3' exonuclease activity
  Homolog annotation: Hit_ID=Q5N8X0; Match level="QueryCoverage=92%, HitCoverage=20%, E-value=3e-22, Identity=75%"; Hit description =Putative DNA polymerase I 3'-5' exo domain
MATSGCIVGDEVDGVPGIQHLVPSFGRKTALKLIKKHGSLETLLNAAAIRTVGRPYAHDALKNHATYGEIMKCLP

SEQ ID NO: 194735 - protein, 47 aa, Glycine max
  Coding DNA Sequence Number=SeqID_77957
METLKDQVEHHDMADEVAATNPFPLATISSSGPTPQAYTYTPSTSSF

SEQ ID NO: 194736 - protein, 1198 aa, Glycine max
  Coding DNA Sequence Number=SeqID_77958
  Homolog annotation: Hit_ID=Q53P84; Match level="QueryCoverage=97%, HitCoverage=97%, E-value=4e-55, Identity=40%"; Hit description=FHA domain, putative
  Pfam annotation: Domain name=FHA; Domain location=50-118; Score=54.0; E_value=4.8e-13; Accession=PF00498.16; Description=FHA domain
MGSEKQSKAEEEEGEIPVLTVLKNNTILKNIFIVNKPPEEQARADHVDVLLVGRHPDCDLMLTHPSISRFHLQIRSKPSSRTFSLLDLSSVHGTWVSGRRIEPMVSVAMKEGETLRIGVSSRLYRLHWIPISRAYDLENPFVAQLDSVAEEEEEEEEEEEKMLNLNCCPAEMEEIESVDSVLEDLSSLFLNENVELTVTEEIPLEPWTLEDMVSLCCEEERKSPSKEEAIGIPSDPFGTETSYLPTISDDENNLCDSVSQVLSPPYVESLVQCDDTLTENLSETSCLPAVEAVLETKMLQFHTPPDTFTSPLSSGHENSFEKHYFSLPVNTAPSSLDEESAPEAVIVPKETECESEDDESIIDIFTVPESLHAAEDVITPNESESECTLRDDGSVTDAFIAGAGIFNSEDMFLAVEEVMPGTKVEQIKIVEKDMYRSLSQLLNDKFCQDQGHSLNEMVQDVRNKHTDSTSPTLHQIESVNLSVPEVVLNIMNEDQTLHSEMEILESCVKAVEKTSTNIWSRRGKATIAPQVRTSKSILKNAANVEVAMSSEKDIRNRTISKNLSSVLDGEIEEEEDEEIYTPDKENISPNTLHLQFLKKVKIEEIEHSKSQRSRRISGDTFNCDIHPNESINPTLCNMNKKDLFSVLDGGEVKEKEIFIPEEENFSPNALQLWLLKKKGKVEEIKSSKSQRSPLSKGTFNHDMYPNENIGSTLCNMNQKDSINRTISRDLFSDLDGEEEEEEIFTPDKENFSPNTLQLRLLKKKGKVEEIKHSKSQRSPLSKGTFNPDMYKNESIGPSLCKINQKDIINKTLSKDLLSNLDGEEEEEEIFTPDKENFSPNTLRLRLLKKKDNFCPNLYPDENMSHTSTKENQTLKGVQGQKLKRKPFSSHIKFAQEQDYKDRVERVPFQSLKNSGDKRRSGTFCPVSASKSLHFSNCGQILDQRINPSDISGVPKKSSWDMIVDTTSLVNKESRKAMQLLQGLKGTRYHSAMSVIGELERMKKQFTIFRRISEASLALEWIEECMVKSNWWIHIQSSVDEGRLIAPTPPASPQAQFSEESWTSLSPQKFSTEIASPTVEDHILDFALLYRRNKNDGQLVLLSEDVTLKIKCMAEGLLCEPVQEFRESLVNPFSERFLWDNSVPRGQTWSCQDDVVLREKYCRLRKPSKGVASGLKLILLHNSQYALSQWHSVEPAEQF

SEQ ID NO: 194737 - protein, 475 aa, Glycine max
  Coding DNA Sequence Number=SeqID_77959
  Gene Ontology: Mol. function=transcription factor activity; Cellular component=nucleus; Biological process=regulation of transcription, DNA-dependent
  Homolog annotation: Hit_ID=Q2R3Q8; Match level="QueryCoverage=77%, HitCoverage=45%, E-value=5e-47, Identity=35%"; Hit description=GRAS family transcription factor containing protein
  Pfam annotation: Domain name=GRAS; Domain location=64-366; Score =254.5; E_value=2.2e-73; Accession=PF03514.5; Description=GRAS family transcription factor
MEDSEEEELLNLTLSVDAGRERRIKKGRTRDNNNNTNSVIIPMKSNDGYEGKIFRLLQMRELMLRQDHRRKGVLLEDVNNNNNNGLPLIHLLLSTATAVDDDQRNYCAALENLIDLYQTVSLTGDSVQRVVAYFADGLAARLLTKKSPFYDMLMEEPTSEEEFLAFTDLYRVSPYYQFAHFTANQAILEAYEEEEERNNKALHVIDFDISYGFQWPSLIQSLSQKATSGKRIFLRITGFGNNLKELQETEARLVSFSKGFGNHLVFEFQGILRGSSRAFNLRKRKNEIVAVNLVSYLNTLSSFMKVSHTLGFVHSLSPSIVVLVKQEGSCRSLKTFLSRFTESLHYFAAMFDSLDDCLPLESTERLRIEKQLLGKEIKSMLNYDMDDGVEYYCPKYERMETWKGRMENHGFVGRKISSKCVIQAKLLLKMRTHYYPLQFEEEGGGGFRVSERDEGRVISLGWQNRFLLTVSAWQP

SEQ ID NO: 194738 - protein, 157 aa, Glycine max
  Coding DNA Sequence Number=SeqID_77960
  Subcellular localization annotation: CTP_CleavageSite=28; ConfidenceScore=5.60e-01
YLALDGIYRPIGAAFPNNPTRRQRLVVRQGPGTTGLSPSLAPPSRGLGPGPPLRTLLQTTIRTPRATDFHGGLFPRVAPPDLRSRWERACTQRVVDGSRTDRLARDWSRAWLIHHFITAKSAMNPDFNQPRGGVLAGGQHTPRAATLLHVCVGGNDV

SEQ ID NO: 194739 - protein, 101 aa, Glycine max
  Coding DNA Sequence Number=SeqID_77961
MMKLTVVIEDLDRFLVEKMIRIGESWILKFMDKVNQHILRMTIVTRSITMKQKNIQNMNLRATMTIKNVKVVKALGEAKSHQNKIFSLLLLQNLQRLLLDE

SEQ ID NO: 194740 - protein, 87 aa, Glycine max
  Coding DNA Sequence Number=SeqID_77962
  Gene Ontology: Mol. function=sucrose transporter activity; Cellular component=integral to plasma membrane; Biological process=sucrose transport
  Homolog annotation: Hit_ID=Q9SM24; Match level="QueryCoverage=85%, HitCoverage=14%, E-value=7e-17, Identity=59%"; Hit description =Sucrose-proton symporter
MSLAVEPLGRLVGGVKWLWGIVNVILAVCMAMTVLITKAAEHERLNAVSLVGYPSLGVKAAALTFFSVLGVPLAVEDPSIMRFTTDR

SEQ ID NO: 194741 - protein, 54 aa, Glycine max
  Coding DNA Sequence Number=SeqID_77963
MVWWWHLPAFVLGAVAAAVSAVLAVVLLPKPKPADVAKFLPSLLGVSISIRPIK

SEQ ID NO: 194742 - protein, 341 aa, Glycine max
  Coding DNA Sequence Number=SeqID_77964
  Gene Ontology: Mol. function=sucrose transporter activity; Cellular component=integral to plasma membrane; Biological process=sucrose transport
  Homolog annotation: Hit_ID=Q7XA53; Match level="QueryCoverage=97%, HitCoverage=63%, E-value=1e-111, Identity=60%"; Hit description =Sucrose transporter
  Pfam annotation: Domain name=MFS_1; Domain location=28-340; Score= -16.9; E_value=0.0019; Accession=PF07690.6; Description=Major Facilitator Superfamily
MEQPPSSSLQVETAQQAGPSPLRKMIAVSSIAAGIQFGWALQLSLLTPYVQTLGVPHAWASFIWLCGPISGLLVQPIVGYSSDRCRSRFGRRRPFILAGAVAVAIAVFLIGYAADIGHAAGDDLAKKTRPRAVAIFVVGFWILDVANNMLQGPCRAFLGDLAAGDHRKTRTANAFFSFFMAIGNVLGYAAGSYDKLHRAFKFTQTEACDVFCANLKSCFFFSIVLLLVLCFVVLTCVEDPQFTPRGDEDNYENDGVSRSWFSCFGELCGAFRGLKRPMWLLMLVTAINWVAWFPYVLFDTDWMGREVYGGKVGDKAYDSGVHVGALGLMLNSVVLALMSLA

SEQ ID NO: 194743 - protein, 67 aa, Glycine max
  Coding DNA Sequence Number=SeqID_77965
MATGRVEVGFCLPHPCPRLPISLLAPETEWGSERVWGRVRGGFKAGINNPIPDPNPDPGQLRFSPSK

SEQ ID NO: 194744 - protein, 137 aa, Glycine max
  Coding DNA Sequence Number=SeqID_77966
MTIAEALKEGNSVSKELHQVAERQVEVAKRQVAVIEKQVEIAEKQLTVIQQTRPRHYSESDVWDLLEELRVTDPFRMKVYNHLCDNEHKKRKLFGVPPHMRGEALIQMMTDACAFTSSAIQVEVQQATGAIVQRCVY

SEQ ID NO: 194745 - protein, 754 aa, Glycine max
  Coding DNA Sequence Number=SeqID_77967
  Gene Ontology: Mol. function=identical protein binding; Cellular component=cellulose and pectin-containing cell wall; Biological process=negative regulation of enzyme activity
  Homolog annotation: Hit_ID=Q2HV71; Match level="QueryCoverage=99%, HitCoverage=98%, E-value=0.0, Identity=71%"; Hit description =Protease-associated PA; Proteinase inhibitor I9, subtilisin propeptide
  Pfam annotation: Domain name=PA; Domain location=372-464; Score=27.1; E_value=6.3e-05; Accession=PF02225.12; Description=PA domain
  Pfam annotation: Domain name=Peptidase_S8; Domain location=126-605; Score=76.6; E_value=7.7e-20; Accession=PF00082.12; Description =Subtilase family
  Pfam annotation: Domain name=Subtilisin_N; Domain location=33-120; Score=82.5; E_value=1.3e-21; Accession=PF05922.7; Description =Subtilisin N-terminal Region
  Pfam module annotation: Pfam domain module=PA::Peptidase _S8::Subtilisin_N; Domain location=372-464::126-605::33-120
MEPHFVVRLPLMFLITLWLSLSHHHANAETESSTYIVHMDKSLMPQVFASHHDWYESTIHSINLATADDPSEQQQSQKLVYTYDDAMHGFSAVLSPEELETLKNTQGFVTAYPDRSATIDTTHTFEFLSLDSSNGLWNASNLGEGVIVGMIDSGVWPESESFKDDGMSRNIPYKWKGTCEPGQDFNASMCNFKLIGARYFNKGVKAANPNITIRMNSARDTEGHGSHTSSTVAGNYVNGASFFGYAKGVARGIAPRARLAMYKVLWDEGRQGSDVLAGMDQAIADGVDVISISMGFDSVPLYEDPVAIAAFAAMEKGVLVSSSAGNEGPTLGTLHNGIPWVLTVAAGTIDRTFGSLTLGNGETIVGWTLFAANSIVENYPLIYNKTVSACDSVKLLTQVAAKGIVICDALDSVSVLTQIDSITAASVDGAVFISEDPELIETGRLFTPSIVISPSDAKSVIKYAKSVQIPFASIKFQQTFVGIKPAPAAAYYTSRGPSPSYPGILKPDVMAPGSNVLAAFVPNKPSARIGTNVFLSSDYNFLSGTSMACPHASGVAALLKAAHPDWSAAAIRSALVTTANPLDNTQNPIRDNGNPLQYASPLAMGAGEIDPNRALDPGLIYDATPQDYVNLLCALGYTHNQILTITRSKSYNCPANKPSSDLNYPSFIVLYSNKTKSATVREFRRTVTNVGDGAATYKVKVTQPKGSVVKVSPETLAFGYKNEKQSYSVIIKYTRNKKENISFGDIVWVGDGDA

SEQ ID NO: 194746 - protein, 180 aa, Glycine max
  Coding DNA Sequence Number=SeqID_77968
MEGPYPIPVLCCSLIQLAASFNINHRTTLRKRKSNQEWKGDEHIPAFGNWDFTNEFPITRYFECATQSRLHNKPRHLRNHIKQETRNKERRCRHVNGNANKGKVYDVREQQRKPNRISKHVQVQVQQHDTVPRTPKPVDEDLYKIPPELLHTTNKRKKLLGFISKCLVLLVCHEHSKLKQ

SEQ ID NO: 194747 - protein, 139 aa, Glycine max
  Coding DNA Sequence Number=SeqID_77969
  Gene Ontology: Mol. function=ubiquitin-protein ligase activity; Cellular component=ubiquitin ligase complex; Biological process =protein ubiquitination
  Homolog annotation: Hit_ID=Q1SAW5; Match level="QueryCoverage=92%, HitCoverage=27%, E-value=2e-23, Identity=48%"; Hit description=U box
MKDDASALSRLCYMHENKGRIVREGAVQVILKKIVDHALVDELLALLPLLSTHPKAVEALVNHDVVPFLLDILREKENTTSECVKENCVAILYIINFNNREKRREIREDEMVTDTFLSLHNAGIQGPKGKLALFLACST

SEQ ID NO: 194748 - protein, 629 aa, Glycine max
  Coding DNA Sequence Number=SeqID_77970
  Gene Ontology: Mol. function=protein serine/threonine kinase activity; Cellular component=membrane; Biological process=protein amino acid phosphorylation
  Homolog annotation: Hit_ID=Q1SAX1; Match level="QueryCoverage=54%, HitCoverage=57%, E-value=1e-133, Identity=69%"; Hit description =Protein kinase
  Pfam annotation: Domain name=Pkinase; Domain location=66-340; Score =105.0; E_value=2.2e-28; Accession=PF00069.15; Description=Protein kinase domain
  Pfam annotation: Domain name=Pkinase_Tyr; Domain location=66-340; Score=83.2; E_value=8e-22; Accession=PF07714.7; Description=Protein tyrosine kinase
  Pfam module annotation: Pfam domain module=Pkinase::Pkinase_Tyr; Domain location=66-340::66-340
MNCFPCCGPKKSNSKREHGSPPPELVTGKNPDMKKQKAEEQNQADPGNIQAQAFSFRELATATKNFRQECLIDEGGFGRIYKGIIPSTGQLVAVKQLDRNGIQSSKEFLAEVAELSLLHHENLVNLIGYCADGDQRLLVYELFASRTLENRLFEKKADESPLNWFERMKIVAAASKGLEYLHETSKPPVIYRDLKASSILVDSDLLAKLCDVGMAKLSGGDKMNNGPPRLMGTYGHCAPEYVKAGQLTLKSDVYSFGVVLLELITGRRAIDTSKPNEEQNLVSWATPLFRDPKRYPEMADPLLNKNFPEKDLNQVVAIASMCLQEEAEARPLISDVVTALGFLSAPPPPPAHAPVPKKSDVAESERESDSEGESESGSDAISRKGSRRSSLDKSQHDYCDSSHLPPVVSSKASRKSSTRSSKGKHSSESGDGVSVSSISSKSSRKSRGDLSQKSSRKSSVEDLSQQKSSKKSSVEDLSQHKSSRKSSSTKDLSQKSSRKSSVEDLSQHKSSRKSSSTKDLSQKSSRKSSIRKPSSRVLSHKSNVASEDGSISSSCRSSSVGSEDEGVRSERSSMRLSQGSYRSDPYGSRRTEDESMNILDRATSIGSDEDSGHPFDQTSSSGGSSVYSR

SEQ ID NO: 194749 - protein, 385 aa, Glycine max
  Coding DNA Sequence Number=SeqID_77971
  Gene Ontology: Mol. function=sphinganine-1-phosphate aldolase activity; Cellular component=endoplasmic reticulum; Biological process=carboxylic acid metabolic process
  Homolog annotation: Hit_ID=Q9C509; Match level="QueryCoverage=96%, HitCoverage=57%, E-value=1e-117, Identity=60%"; Hit description =Sphingosine-1-phosphate lyase
  Subcellular localization annotation: CTP_CleavageSite=10; ConfidenceScore=5.00e-01
MASISHFRTSANSFLSQYEPLSLLLAPLLSLLFAHALRSFFHLLSQNGLKATLLGFLINSLKLVPGVKGYIDAEKQKVRNFEMRELEPVYAILVTRPSYLELYYCITMSQSLNRRDKVVDKLQSDGKSKREGWKTELPSTGLGTSVLEKMREEKINDAVWQGKCSGTVYIGGSESDGHFSLINEACSMLIICFRSWEHPTAEYYYQIMFAHTNPLHLDVFKSVARFEAEVVAMTAALLGSKEKSSGRQICGNMTSGGTESILLAVKSSRDYMKSKKGITRPEMIIPESGHSAYDKAAQYFNIKLWRVPVNKNFQADVKAIRRHINKNTILIVGSAPGFPHGVIDPIEELGHLASSFGICFHVDLCLGGFVLPFARELGYIVGNLE

SEQ ID NO: 194750 - protein, 146 aa, Glycine max
  Coding DNA Sequence Number=SeqID_77972
  Gene Ontology: Mol. function=DNA binding; Cellular component=nucleus; Biological process=DNA repair
  Homolog annotation: Hit_ID=UPI000060E95A; Match level="QueryCoverage =76%, HitCoverage=10%, E-value=9e-15, Identity=40%"; Hit description =UPI000060E95A related cluster
  Pfam annotation: Domain name=VRR_NUC; Domain location=1-114; Score =105.6; E_value=1.5e-28; Accession=PF08774.1; Description=VRR-NUC domain
MAEEFLIKSWETHIGTACRGVNWGCHSLDELRAVVSCVGGTCLASLCKLLAQDYRSWSSGMPDLLLWRFHGEYSGEAKLVEVKGPRDRLSEQQRAWLLLLLDYGFTIETLKFIALANFSSREEIHFDVRYSFTSITLGKKRNCSIP

SEQ ID NO: 194751 - protein, 334 aa, Glycine max
  Coding DNA Sequence Number=SeqID_77973
  Gene Ontology: Mol. function=caspase activity; Cellular component =cytosol; Biological process=proteolysis
  Homolog annotation: Hit_ID=Q7F8T9; Match level="QueryCoverage=94%, HitCoverage=88%, E-value=5e-90, Identity=46%"; Hit description =Putative GAMYB-binding protein
  Pfam annotation: Domain name=WD40; Domain location=226-264; Score =40.8; E_value=4.8e-09; Accession=PF00400.22; Description=WD domain, G-beta repeat
  Pfam annotation: Domain name=WD40; Domain location=269-307; Score =4.6; E_value=11; Accession=PF00400.22; Description=WD domain, G-beta repeat
  Pfam module annotation: Pfam domain module=WD40::WD40; Domain location=226-264::269-307
MDEDDFFDEIDDQNHGRGVGDAALDEYEMLTKVTDTTAAQARKGKDIQGIPWESLNISRERYRLTRLEQYRNFENILKSGDAVDKECKQIEKGGNYYEFFYNTRMVKPTILHFQLRNLVWATSKHDVYLISNYSVNHWSSLSGNLSEIINFAGHVAPAPTERYAGNLLEGFSQTQISTLAVKDNLLVAGGFQGELTCKHTSISPDRKLMTVVGDNLDGLLVDPQNGKTVATFVGHRDYSFASAWHPDGRTFATGNQDKTCRVWDVRHLSSPTAILKNNLGATRSIRFSSDGQYMVVAEPADFVHVYSTKADYRKRQEIDFFGEISGVSLSPDDE

SEQ ID NO: 194752 - protein, 232 aa, Glycine max
  Coding DNA Sequence Number=SeqID_77974
  Gene Ontology: Mol. function=nutrient reservoir activity; Cellular component=apoplast; Biological process=auxin mediated signaling pathway
  Homolog annotation: Hit_ID=Q1SKM2; Match level="QueryCoverage=96%, HitCoverage=99%, E-value=2e-87, Identity=73%"; Hit description=Cupin region
  Pfam annotation: Domain name=Cupin_1; Domain location=64-215; Score =173.7; E_value=4.5e-49; Accession=PF00190.13; Description=Cupin
  Pfam annotation: Domain name=Cupin_2; Domain location=99-177; Score =31.5; E_value=2.9e-06; Accession=PF07883.2; Description=Cupin domain
  Pfam module annotation: Pfam domain module=Cupin_1::Cupin_2; Domain location=64-215::99-177
MKVVYLFVVLMALASSVAFAYDPSPLQDFCVAINDTKAGGLYGVFVNGKFCKDPKFAYADDFFFGGLGPGDTANAQGSKVTAVTVNEILGLNTLGISLARIDFAPKGLNPPHTHPRGTEILVVLEGTLYVGFVASNQNDNRLFTKVLYKGDVFVFPIGLIHFQQNVGYGNAVAIAALSSQNPGVITIANAVFGSKPPISDEVLAKAFQVDKNIVDYLQKQFGYNNKVNREHN

SEQ ID NO: 194753 - protein, 736 aa, Glycine max
  Coding DNA Sequence Number=SeqID_77975
MESQLLLPPIKIVYNKKIGCERSLKNNTSEGEGIEKGYNGKAYLARANKNNQCLSHMHAGGLPLVDWILEELVRRQSRFQGVRSSMNPSPSSSSLSSTLTSLNNLITLSNHVLSLTPSPPTLNSNLIQCPFNPHHLLPPPSLFLHHLRCPSSPRPLPDLNPSPSLTYPKTLHNSPSDQLSFYLDSLSNFFYRDSPAVVAFSHADSLTRTASLTLPSFLSLQCADTYTHSIPESASFHAPILPSQYFSIARELDCWNDFPATYSSSVLRAILGLGIANDRDLTDWMIANSPRYGVVIDTSMQHHIFLLCCMCLKSILREASVSVDNQNSLVDCPVTNQALTWLASQVSILYGAANGKAFVLNFVKKCILVGASVLLLFPLGDNAASKQESQNLGTESGDPKEAKPGAQCGEKKNWILNRKISVSQVAAAVAALHERSLLEQKIKGFWFSQQPSNYQLVAEYSYLSEKANEERTKRPDYRPLIDHDSIHLPQSSNQETSREKTREELLAEERDYKRRRMSYRGKKTNQSPLQVMRYMIEDFMDQIKQAGDFESHVKMSEKSGLFPSKPPDRDIPMEANNSRKICNNSPTVTISNLRCSEQQSDSNCCDQSKSLEDAFSRDYKQRKHEHHRSHYCREDQQNADQGKYHRDRHSISPERYSSYSRSREHSSHHNKQDYYPNRKKHNSSRIKDGWQKDTHRSHISDSFPNNAFSDRYDPSESLGICEDDISSDSKYIKSIR

SEQ ID NO: 194754 - protein, 429 aa, Glycine max
  Coding DNA Sequence Number=SeqID_77976
  Gene Ontology: Mol. function=transferase activity, transferring glycosyl groups; Cellular component=membrane
  Homolog annotation: Hit_ID=Q1S232; Match level="QueryCoverage=92%, HitCoverage=72%, E-value=1e-129, Identity=52%"; Hit description =Exostosin-like
  Pfam annotation: Domain name=Exostosin; Domain location=28-380; Score= 523.2; E_value=2.8e-154; Accession=PF03016.6; Description=Exostosin family
MPIVLENLIIPIKIVYQVGPPIYQGQYVYVYDLASRFNEDLLKGCHSLMKWDDMCPYMSNLGLGPKVIEKSKEKALLKESWYATNQFSLEVIFHNTMKNYKCLTNDSSLASAIYVPYYAGLDVGQYLWGGFNVSIRDASPKELVKWLAQQPEWKRMWGRDHFMVVGRVGWDFRRRTENNDDWGTKLMLLPEARNMSIMLIESGSKVNEFPIPYPTYFHPSKDKEVFQWQKKMIKVKRPYLFSFAGAPRPNSNSSSSIRNEIIKQCQSSRSCKLLSCNDGHNYCNDPVHVTKVFQSSVFCLQPPGDSFTRRSTFDSILAGCIPVFFHPESAYNQYLWHLPRNGSSYSVYIQERDVKEKRVMINEKLSRVPKSEVLAMRKEIVRLIPRIIYRYPSSRLETIEDAFDIAVKGILGRIEAARRNFTNVNYTIS

SEQ ID NO: 194755 - protein, 97 aa, Glycine max
  Coding DNA Sequence Number=SeqID_77977
MDKPWFGGFADWEVMETGLKDASWNLEECVQGSHFPNGSSPSPLFTVWEWFAWEIQVFKRFLMEIEVAVLDYSWRWRKDQSGNYIHSFVRSSIRFLY

SEQ ID NO: 194756 - protein, 74 aa, Glycine max
  Coding DNA Sequence Number=SeqID_77978
MTANLTIAWESCMHVGMIVVTGIVRVAMSKDGAGEEVLGEVEVVDGERLKAAMPPIVTSHMTTIQLHGVVSWWF

SEQ ID NO: 194757 - protein, 656 aa, Glycine max
  Coding DNA Sequence Number=SeqID_77979
  Gene Ontology: Mol. function=DNA binding; Biological process=DNA repair
  Homolog annotation: Hit_ID=UPI00005C1B1E; Match level="QueryCoverage =51%, HitCoverage=36%, E-value=2e-28, Identity=29%"; Hit description =PREDICTED: similar to C01G5.8 isoform 1
  Pfam annotation: Domain name=HIRAN; Domain location=180-281; Score =60.6; E_value=5e-15; Accession=PF08797.1; Description=HIRAN domain
MRMVLTGRESLIRLIGKRRRFLPNRHTILSDPNPNPNPNPNPIQAVEEPPQSDNNDDVQCPVCGRSLPGDNDHINSHLDACLSQPKPTTPSTKRKFSQRTLLQLNFTLSNSKPKFQNLTHDSNNSPVPLPQNDESEKEEEEEVPENHEAEFDSTIAATSLSSSSVNNDVPDDSKPEDVLGATFETFIVGRKYADNPEEMCAGAAISFLRDPQNVKDPNAIKVVSADSVCGKSLGFLPRELAQYLSPLIDNYGFGFQGHVTSVPKHSLDIVPIQIMCRRTSDGESKYANETFKCLWKNAQRVVEFASRNPPSSVNGVHGMKKQHLISSILSTDNSVPWPQLSTMILDRTGSCIRISSKAESLMWRTERLFFLNGEQDLSSFLLVDMGKIKYPAYNCIISEPIFSNRNNLLSYEEAIEVAQITDEALDANKIDVVLRCINIAESCVSTDFPIQCSTSESVSSIRHVFTSSWVYSKVVTVGISFLEREHRYIDAINLLQWLLNVFTCDVRRGYWTLRLSVDLEHLGYIDESLQVAENGLLDPWIRAGSRMALQRRVLRLGKPPRRWKVPSFSRSALRKIPEVFVQGRPLNSELGEKNRYYNEAGKQCGVEEIALHYYAGDGGGWQGVHAESGIWLTIFGLLMWDVIYADVPNVFYTRFQ

SEQ ID NO: 194758 - protein, 91 aa, Glycine max
  Coding DNA Sequence Number=SeqID_77980
MYQLSNTQVVDPYMNKERPELGLRHDASYSDGTIGANTRLEAVLQYPSSKKSFEDGFEVTPSSYSSNNKNCGDHDLVIGAYIGNKPTCGRE

SEQ ID NO: 194759 - protein, 336 aa, Glycine max
  Coding DNA Sequence Number=SeqID_77981
  Homolog annotation: Hit_ID=Q0GPH8; Match level="QueryCoverage=99%, HitCoverage=100%, E-value=1e-110, Identity=65%"; Hit description =BZIP transcription factor bZIP56
  Pfam annotation: Domain name=DUF1664; Domain location=104-227; Score =201.7; E_value=1.7e-57; Accession=PF07889.3; Description=Protein of unknown function (DUF1664)
MALSLGKLFILVGAGIAGSVIAKEGRLPDVSGLASGAFKERVYGMGGAISRPKVVLRQLKSDDPAPTVKKQPHNDALLAQVNSLRQELQLLARDRSITIVNASGTGGRKYATVIVIVVVGYGYVWWKGWKLPDLMFATRRGLSDACTSIGNQMGKLYESIGDTKKKLSARINGLDKNLEECAAITESTREDIYVIQRKADTISEDSKSFHVAVHVLESKIKEIEEKQASSSSSSRPALELPPVSPSSRGSQSGSARLSLEPPSVTPSSRTASLPPTLSTDPPSPSISGGSFQEPKVDKSNGSSSGLFGLISGVYGPLLTRTRSATDAVVQKTRSTS

SEQ ID NO: 194760 - protein, 202 aa, Glycine max
  Coding DNA Sequence Number=SeqID_77982
  Homolog annotation: Hit_ID=Q1RUD8; Match level="QueryCoverage=39%, HitCoverage=20%, E-value=4e-07, Identity=47%"; Hit description=IMP dehydrogenase/GMP reductase
MTPSTEDVKKAMQGLFAVLQLSRWGWFHTFFSKKAGPSIRYKEGRIKIPSSCEGCPNVPLMGTRGCINYNPVLAIRQLGYPMRGAPLDESITPFIARGFSDHNARDRELRGSSNGIIGGYHKWLRVRKQGLDWLPNLKTVRDDEVKASEESDEVQAQKAELERAWVVEEKFKAAIVSSNSEEVKGIITGQRHDLEGRAKGLP

SEQ ID NO: 194761 - protein, 531 aa, Glycine max
  Coding DNA Sequence Number=SeqID_77983
  Gene Ontology: Mol. function=transferase activity, transferring glycosyl groups; Cellular component=membrane
  Homolog annotation: Hit_ID=Q1S232; Match level="QueryCoverage=79%, HitCoverage=77%, E-value=1e-120, Identity=49%"; Hit description =Exostosin-like
  Pfam annotation: Domain name=Exostosin; Domain location=146-495; Score=496.7; E_value=2.8e-146; Accession=PF03016.6; Description =Exostosin family
MGKPPLRKYFDKIRFVFFTSFILCLSLLLLDYYMAVSGHGITFLFFNMNDAKQAHMPKPSNSSFNLNDTADCPRKSNHTNQNGVTSGASNIPRRIVENHTETIVPAAHGEVDKRVHMNSPPLDRDNVGVVTNVPTRNLDSCSGQYIYVYDLASRFNEDLLKGCHSLRKSIDMCLYMSNLGLGPKVIEKSKEKVLLKESWYATNQFSLEVIFHNTLKNYKCLTNDSSQASAIYVPYYAGLDVGQYLWGGFNVSIRDASPKELVKWLARQPEWKRMWGRDHFMVVGRIGWDFRRRTENNNDWGTKLMLLPEARNMSILLIESGSKDNEFPIPYPTYFHPSKDKEFFQWQKKMIKVSRPYLFSFAGASRHSSSSIRNEIIKQCQSSRSCKLLSCNDGHNYCNDPVHVTKVFQSSVFCLQPPGDSFTRRSTFDSILAGCIPVFFHPESAYNQYLWHLPRNGSSYSVYIPERDVREKRVMINEKLSKVPKSEVLEMRKEIISLIPRIIYRYPSSRSVTVEDAFGIAVKGILGRIEA

SEQ ID NO: 194762 - protein, 83 aa, Glycine max
  Coding DNA Sequence Number=SeqID_77984
MDPHIGFTFLVTTASSLALLLSAQQFALQIFLFSGCVWCGLGLLYAYLGMLYVFLFYYSHVKYGESEIKEGERKGGVEKGRVV

SEQ ID NO: 194763 - protein, 374 aa, Glycine max
  Coding DNA Sequence Number=SeqID_77985
  Pfam annotation: Domain name=Transposase_23; Domain location=164-234; Score=2.7; E_value=0.00057; Accession=PF03017.5; Description =TNP1ENSPM transposase
DVRKKTQAIQKQNTAPHVLSHRGYEYLQKKLMDEKTKKKLEEAAQSGSTDTLIDPLSPIRRHVKWKMARTKKTGQMTSKATKQIANKIDVLTAAIGRPEHPGHLRATGAGGGVDHRKSDSAANVMLQLDAVPVSVTDAIIGTYTASRVSTKESCVDPSRNDPDMGDLNKCRLYIEENHPRLVALGRVYEGSTTVHNIPLLHDQVKVAVEEVKDVDAPIPVPTEEVKLVGQTLNTFIAWPTHLVKPVGPVKPTDRPNHEVDDPLYLMTLTIPQLFLKPLQVMWDATVFRVFNEDFSLYIKHEDLSEISHDDNLLCLNNNRHMSEPSMRVGNSYVYGFLEPQSIQRSGQSQFESESYMKNWMQNSKQDVYLGTYLN

SEQ ID NO: 194764 - protein, 91 aa, Glycine max
  Coding DNA Sequence Number=SeqID_77986
  Pfam annotation: Domain name=DUF260; Domain location=6-57; Score= -38.7; E_value=0.07; Accession=PF03195.5; Description=Protein of unknown function DUF260
MSGSKFHHTYVNNLQILYFEAHCRIQGPIYGCAGIIFKLYEQINSAEIALAYIDIQTQTACHKLQAESNFDVLPAQSSITAKFQWKRLDLG

SEQ ID NO: 194765 - protein, 155 aa, Glycine max
  Coding DNA Sequence Number=SeqID_77987
  Gene Ontology: Mol. function=chitinase activity; Biological process =cell wall catabolic process
  Homolog annotation: Hit_ID=Q76KW5; Match level="QueryCoverage=67%, HitCoverage=35%, E-value=2e-48, Identity=82%"; Hit description =Class1 chitinase
METTAKRNAVVAPIAALLLVVLLAASVVVEAQENSDVKTLVKHMHGKKYCDKGWECKGWSIYCCNLTITDYFQTYQFENLFSKRNSPVAHAVGFWDYHSFIAAAALFEPQGFGTTGNKTMQMMEIAAFLGHVGSKTSFLSTSLRLRAREREVCLG

SEQ ID NO: 194766 - protein, 75 aa, Glycine max
  Coding DNA Sequence Number=SeqID_77988
MVFSKMNSCANISFSRDKSMVVELPTEAFMEVWRQLSTVFRSYDKHTVVSDKSEWRSTVGQCGLHDYRPKGCICS

SEQ ID NO: 194767 - protein, 302 aa, Glycine max
  Coding DNA Sequence Number=SeqID_77989
  Gene Ontology: Mol. function=transferase activity; Cellular component= mitochondrion; Biological process=aromatic amino acid family metabolic process
  Homolog annotation: Hit_ID=P77544; Match level="QueryCoverage=70%, HitCoverage=100%, E-value=5e-88, Identity=73%"; Hit description =Hypothetical GST-like protein yfcF
  Pfam annotation: Domain name=GST_N; Domain location=92-169; Score =45.6; E_value=1.6e-10; Accession=PF02798.10; Description=Glutathione S-transferase, N-terminal domain
  Subcellular localization annotation: CTP_CleavageSite=45; ConfidenceScore=5.25e-01
MGPSPLACQKSHCRVEQNFTGFKQAQRPAPVRRLVINNGRNFIVRRNSQKERAELIAFADIHANDPVIQFGLLEKKGDLVAVWANEDVMNQPVITLWSDANFFSPYVMSVYVALAEKGLTFTLKTVDLDGGEHLKPQWQGYDLTRRVPVLEIEGFALSESSAIDEYLEDRFSPPEWERIYPHDLQKRARARQIQAWLRSDLVPIRVERPTDVVFAGVKKPALSAEGQESAQKLIDTATLLLAHGNPNLFGEWCIADADLALMLNRLILNGDAVPQLLVDYAAFQWQRASVQRYVALSAKHAG

SEQ ID NO: 194768 - protein, 333 aa, Glycine max
  Coding DNA Sequence Number=SeqID_77990
  Gene Ontology: Mol. function=sequence-specific DNA binding; Cellular component=nucleus; Biological process=regulation of transcription, DNA-dependent
  Homolog annotation: Hit_ID=Q76DY3; Match level="QueryCoverage=96%, HitCoverage=94%, E-value=9e-84, Identity=54%"; Hit description=AG -motif binding protein-1
  Pfam annotation: Domain name=GATA; Domain location=239-274; Score =62.4; E_value=1.5e-15; Accession=PF00320.17; Description=GATA zinc finger
MIGNFIDDIDCGSFFDHIDDLLEFPDDNAAPVAPPANFWSAESDSLPASYTVFSDNSVTDLSAELSVSYDDIVQLEWLSNFVEDSFSGGSITMKKEEEPQCTTTTKEDIAHAQFQTASPVSVLESSSFCSGEKAASRGPEIYIPVPCGRVRSKRPRPATFNPHPVMQLISPASSTGENVQHNATTTSKAASSDSENFAESVIKGPKQASGEHKNKRKIKVTFSSGQEQQNAPSQAVRKCLHCEITKTPQWRAGPMGPKTLCNACGVRYKSGRLFPEYRPAASPTFCAAVHSNSHKKVIEMRNKTGTKSGFATDSAASPELIPNTNNSLTLEYM

SEQ ID NO: 194769 - protein, 140 aa, Glycine max
  Coding DNA Sequence Number=SeqID_77991
QFIEKVVWPGARPSFVGDNESFTTQAPQQHETEPENDDSSKATISGAIDFKKRRLETRSNEAAYPGPVPASADAPFPGVDPSSPQHAADSSTPVLEIHEGQTIPVLPLDTSPLATPVWHLTDERMFRYRTIRTSHSHFNS

SEQ ID NO: 194770 - protein, 109 aa, Glycine max
  Coding DNA Sequence Number=SeqID_77992
  Gene Ontology: Mol. function=N-acetyltransferase activity; Biological process=metabolic process
  Homolog annotation: Hit_ID=Q6K836; Match level="QueryCoverage=86%, HitCoverage=35%, E-value=2e-30, Identity=64%"; Hit description=GCN5 -related N-acetyltransferase (GNAT) family protein-like
  Pfam annotation: Domain name=Acetyltransf_1; Domain location=2-74; Score=47.3; E_value=5.3e-11; Accession=PF00583.14; Description =Acetyltransferase (GNAT) family
MRGCKCIPSFERRTGIAYISNVAVRENFRRKGIAKKLIAKAECHARSWGCRAIALHCDLNNPVATMLYKGQGYKCIMVPEGANWPQPRTSPDIRFNFMMKLLKNSLGRK

SEQ ID NO: 194771 - protein, 110 aa, Glycine max
  Coding DNA Sequence Number=SeqID_77993
MLMQFMETTKSTQQALQSVEIQVSELAEAVTQFMSRREKSFVEAEAQEKSPVKEHESREKDEEKDEEQAQQQWEKYSTVENQQENILQSNNLPHQLIDKKGRQGQHEETL

SEQ ID NO: 194772 - protein, 138 aa, Glycine max
  Coding DNA Sequence Number=SeqID_77994
  Gene Ontology: Mol. function=N-acetyltransferase activity; Biological process=metabolic process
  Homolog annotation: Hit_ID=Q6K836; Match level="QueryCoverage=85%, HitCoverage=42%, E-value=6e-22, Identity=47%"; Hit description=GCN5 -related N-acetyltransferase (GNAT) family protein-like
MEINLDYEIAWNHVIGICRASQVVDLFPTVSPEIIVREARLEDYWGVAETHCKCFFPEYSFPLDFVLRIDRLVVAMLAAMLAGFFRPRDCRRICLVAVIDSSLDESFSFESEGLKIGGFDGKFSLNKGYVAGILNSRQ

SEQ ID NO: 194773 - protein, 53 aa, Glycine max
  Coding DNA Sequence Number=SeqID_77995
KHRLSSVHEASIGCRHKGTRRTAPPIRGAVVAVYQAAEVFAGTEGLTMSYGVN

SEQ ID NO: 194774 - protein, 126 aa, Glycine max
  Coding DNA Sequence Number=SeqID_77996
  Gene Ontology: Mol. function=hydrolase activity; Cellular component =cytoplasmic mRNA processing body; Biological process=mRNA catabolic process, nonsense-mediated decay
  Homolog annotation: Hit_ID=Q9FNB6; Match level="QueryCoverage=93%, HitCoverage=33%, E-value=3e-53, Identity=81%"; Hit description =Arabidopsis thaliana genomic DNA, chromosome 5, P1 clone:MSH12
  Pfam annotation: Domain name=NUDIX; Domain location=2-122; Score =49.8; E_value=9.2e-12; Accession=PF00293.18; Description=NUDIX domain
MPAVDTGQCLLVKGWKGSSWSFPRGKKSKDEEDHACAIREVMEETGFDVSKLLNKDEYLEVIFGQQRVRLYIIAGVKDDTAFAPLTKKEISEIAWHRLDELQPASDEVISRSITGLKLYMVAPFLA

SEQ ID NO: 194775 - protein, 74 aa, Glycine max; identical to SEQ ID NO: 127836
  Coding DNA Sequence Number=SeqID_77997

SEQ ID NO: 194776 - protein, 100 aa, Glycine max
  Coding DNA Sequence Number=SeqID_77998
  Gene Ontology: Mol. function=protein binding; Cellular component =anaphase-promoting complex; Biological process=regulation of mitotic metaphase/anaphase transition
  Homolog annotation: Hit_ID=Q9ZPW2; Match level="QueryCoverage=55%, HitCoverage=29%, E-value=2e-17, Identity=76%"; Hit description =Anaphase-promoting complex subunit 10
  Pfam annotation: Domain name=APC10; Domain location=16-100; Score= -80.7; E_value=0.02; Accession=PF03256.7; Description=Anaphase -promoting complex, subunit 10 (APC10)
NLLSKKSRRKLYIAVGTVGRRKPYTALGIVVGAQSSKLSTLPVNKLIVLYVVFKLDESYTPSKVSILACGGFHNLKEIKTVELVRPTGWIYLSLSGAYPR

SEQ ID NO: 194777 - protein, 90 aa, Glycine max
  Coding DNA Sequence Number=SeqID_77999
MATARWALKHPVYGIVILRLGIYTDIPNVSKTTFLNEKFYAIPEFQQTLLTTTKRNDSNDITSFLNDHLEETLGPTKIGENHSKCINLTQ

SEQ ID NO: 194778 - protein, 210 aa, Glycine max
  Coding DNA Sequence Number=SeqID_78000
  Gene Ontology: Mol. function=glutathione-disulfide reductase activity; Cellular component=cytoplasm; Biological process =glutathione metabolic process
  Homolog annotation: Hit_ID=Q43621; Match level="QueryCoverage=80%, HitCoverage=34%, E-value=1e-79, Identity=86%"; Hit description =Glutathione reductase, cytosolic
  Pfam annotation: Domain name=Pyr_redox_dim; Domain location=75-179; Score=109.7; E_value=8.7e-30; Accession=PF02852.12; Description =Pyridine nucleotide-disulphide oxidored
APNSKRLNLEAVGVELDNTGAIKVDEYSCTSIPSIWAVGDVTNRMNLTPVALMEASYFAKTVFGGQKIKPDYNNIPYAVFSIPPLSVVGLSEEQAIEQTNGDLLVFTSIFNPMKNTISGRQEKTVMKLVVDAETDKVLGASMCGPDAPEIIQGIAIALQCGATKAQFDSTGNDIMTSGISFTYLKYLRKNVNICVLENAVCWKMQCAKYM

SEQ ID NO: 194779 - protein, 75 aa, Glycine max
  Coding DNA Sequence Number=SeqID_78001
MNAIYNRAYYRCIVGPPAFGMLKDGSPRREGECWKSCLNCGHPLARYSCGLFGGCLKCNLKGGGLVSYRLEIETS

SEQ ID NO: 194780 - protein, 1032 aa, Glycine max
  Coding DNA Sequence Number=SeqID_78002
  Gene Ontology: Mol. function=oxidoreductase activity; Biological process=electron transport
  Homolog annotation: Hit_ID=Q2WS25; Match level="QueryCoverage=63%, HitCoverage=88%, E-value=1e-107, Identity=34%"; Hit description =Hypothetical protein precursor
  Pfam annotation: Domain name=DAO; Domain location=204-589; Score= -39.8; E_value=0.0025; Accession=PF01266.14; Description=FAD dependent oxidoreductase
  Pfam annotation: Domain name=GIDA; Domain location=204-426; Score= -248.5; E_value=0.087; Accession=PF01134.12; Description=Glucose inhibited division protein A
  Pfam module annotation: Pfam domain module=DAO::GIDA; Domain location= 204-589::204-426
MPHQIIPGAFARQQRRNLRPLFVTEAWPQHLVTLRRQQRDANHRLPRGQHAESGQRLAGTGALAGLRVPDVDDLVLPQYTKRHHDIARRMRLQLRQCRSKQRRSTNGLRRQRMNARARQIAPVFILNRQADGRHGHQQTVYPRAVHPHLARQFTAADRFVTGDQILQAANSVNQALPSGGSNLMMQTFSSQAARAFPLQSLHADVLVAGGGLAGVCAALAAARAGQQVVLIQDRPVPGGNASSEVRLWANGATSHMGNNNRWAREGGIMGEIMEENLWRNKEGNPVLFDMVLLDIVQAQPRLTLLLNTIVSDIEKSAQRLQAVQAFNAINQTRYRVTADQFIDASGDGVLGYLAGAAHRVGAESPQEFGEKMAPGEQFGHKLGHSIYFYTKRSAQPVRFVPPSFALKEITAIPRYKRLSSDLNGCDLWWLEWGGRLDTVHESETIKWELWKIVWGVWDYIKNSGEFADADTLTIEWVGLIPGKRESRRFLGDTLLCQQDIIAQRDHYDAVAYGGWSIDLHPADGVYSAHDGCRQFHSKGTYTIPFRALYSQSLDNLLLTGRLISATHVAFGSARVMCTCGVLGEVVGRAAALCQQHNQTPRQLAQPEHIGQLQQQLLRHGAYIPRQQLAHPAGAAQVSASSTFALHALPADGGWHALTSRCALLLPLKAGERLPALTVRLRASSAQTLQVSLLTSDNPANTCGDRLLATHSLQISGEEAYSLPFDYRAECDRYLFIAFEENPAVEVALTRQRLPGIMMVFNSLNPRVAKRTRQINDGDYGVDEFDFWLPRRAPNQILIAFSLATPLRLWHCDYLLNGKLRPESHTNGWLPAADDRQPWVCWQWPDAQRASQITLLFDNDFDHAMETVQMGHAQAVTPHCTTHYRLWLDDRLLAEVSDNHHSLCHHALPPDTAFRQIRLELLASAGALPALYGLHLQGDKPHYAAHQQINDALRPYGAQARRQPGGQQRQTEKPQQRGAGGAESKPAARLRRRQLTAEAAEHHEGVEIDMRIEPGHRQHSGDNAPAPLLQRRL

SEQ ID NO: 194781 - protein, 58 aa, Glycine max
  Coding DNA Sequence Number=SeqID_78003
MVGNANCEEGRVIIRWGSMLEERGQITFLELTFDTFFEFEVFFLPMRCVTFGFRRIGI

SEQ ID NO: 194782 - protein, 70 aa, Glycine max
  Coding DNA Sequence Number=SeqID_78004
MQGDASSKTTIPEPFTLHPEAGEEQVRPETTATPERSLEGTSEPLTPVVDLSSPQPLGDPSTPLLDIPED

SEQ ID NO: 194783 - protein, 238 aa, Glycine max
  Coding DNA Sequence Number=SeqID_78005
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=99%, HitCoverage=35%, E-value=1e-117, Identity=86%"; Hit description =Photosystem I P700 chlorophyll a apoprotein A1
  Pfam annotation: Domain name=PsaA_PsaB; Domain location=1-238; Score=- 144.5; E_value=0.00037; Accession=PF00223.9; Description=Photosystem I psaApsaB protein
DPKEIPLPHEFILNRDLLAQLYPSFAEGATPFFTLNWSKYAEFLTFRGGLDPVTGGLWLTDIIHHHLAIAILFLIAGHMYRTNWGIGHSIKDILEAHKGPFTGQGHKGLYEILTTSWHAQLSINLAMLGSLTIVVAHHMYSMPPYPYLATDYGTQLSLFTHHMWIGGFLIVGAAAHAAIFMVRDYDPTIRYNDLLDRVLRHRDAIISHLNWIRLYNYNRSLLNGYKYPCFSTKAQQPQ

SEQ ID NO: 194784 - protein, 305 aa, Glycine max
  Coding DNA Sequence Number=SeqID_78006
  Gene Ontology: Mol. function=sugar porter activity; Cellular component=membrane; Biological process=transport
  Homolog annotation: Hit_ID=Q669F0; Match level="QueryCoverage=99%, HitCoverage=100%, E-value=1e-140, Identity=84%"; Hit description=ABC transporter, periplasmic sugar (Possibly sorbitol) binding protein precursor
  Pfam annotation: Domain name=Peripla_BP_1; Domain location=28-298; Score=-12.2; E_value=6.6e-06; Accession=PF00532.11; Description =Periplasmic binding proteins and sugar b
MFSLFKKTLPFIVAGGMLAASHGALAKQITIGMSFQEMNNDYFVTMKQALDQAAADIGAKVYVADARHDVAKQIGDVEDMLQKKVDILLINPTDSVGVQSAVISAHKAGAVVVAIDAQAEGPLDSFVGSENYDAGFQAGEYLAKALGGKGKVAILDGIPVVPILERVRGFEAAMKKYPDIKIVTKQNGKQERDTALTVTENMLQSAPDLAGIFSVNDVGALGALAAIESNGAKVKLVSVDGQPEAIKEILKPNSPFIATSAQFPRDQLRIALGIALARYWGATVPKTVPVKVKLIDRSNAAGFSW

SEQ ID NO: 194785 - protein, 109 aa, Glycine max
  Coding DNA Sequence Number=SeqID_78007
  Gene Ontology: Mol. function=RNA-directed DNA polymerase activity; Biological process=RNA-dependent DNA replication
  Homolog annotation: Hit_ID=Q1RZQ1; Match level="QueryCoverage=89%, HitCoverage=20%, E-value=5e-21, Identity=41%"; Hit description=IMP dehydrogenase/GMP reductase
MEHTLLEALIIVSWKKFLTHAISRLLEVGFTFGSSKFLQGSSILFGDSKDAVCQPANVCRRKVFNVPLNASFVPMKLKTLGTFLSLAIKHKKSGNMLDFWSRELPWSSV

SEQ ID NO: 194786 - protein, 977 aa, Glycine max
  Coding DNA Sequence Number=SeqID_78008
  Gene Ontology: Mol. function=DNA binding; Biological process=DNA integration
  Homolog annotation: Hit_ID=Q1SDN3; Match level="QueryCoverage=98%, HitCoverage=96%, E-value=1e-153, Identity=48%"; Hit description =Polynucleotidyl transferase, Ribonuclease H fold
LSVTMNETFNQTLDVHNPYYLHPSENPATALVSPVLDPTNYNSWSCSMLTALNAKNKLEFVDGTISEPQRNNSLHFAWCSILWMDKVVDVWKDLKSRYSQGDLMRISNLQHEAASIKQGDISVTDFFTKLRIIWDELESFRPNPLCFCSIQCSSGALLIHSLNGSVTSNKNDKLLVVLVSLVVSIMNPEIILQLILLAASSPQIADFVVVSVTLKMTGHTIDVCYRQHGYPLGHKFHNINSSVTGDMQVTAIDQQNQDTHAPSFTSQQYQALLALLQQASHGASSSTPRVNQIGTFSPCLDTSTSTNLGNLPHLFCNSVSNSTAPWILDSGATDHVSSSLANFSSYVSINPIVVKLPTGQEVLATHLSVDTITKRMIGTVDVVAGLYKLNASPILHFVNNIVSRNVTFYENFFPYVQPNNDFSHSSNTSFSNTFILSPLACVDVPFPSHDISSSSSIAPHNPTSQPSSSQPLIPLRRSTRPTQRPAFLRDYHTAFTSIGTVPSPEPTSYKESSQHDCWLKVMQEEISSLEANETWVLTHLPPHKSAIGCRWVYKIKHRADGSIERYKARLIAKGYTLMEGLDYLDTYSPIAKLTIVRLLLSLAAMHNWHLKQLDFNNAFLLGTLDEEIYMQLPSGLKSAKASQRSSDSAFTTLLVYADDIVLSQNCINEITSIIAQLDAAFRIKDLGDLRFFIGLEVARITKGINVCQRKYALDLFHDTGLLGAKLASTPFDYCTKLSQDSGDPLLNPFSYRRLIGRLIYITTTRPDIAFVFQHLSQFVNSPTIVHHQATFRIIHYLKHAPGSGLFFPSTNHAKLLAFSDSNWAGCTYTRRYGTGFSVYLGSFLVSWKSKKQATVSHSSIEYEYRALASTTCEIQWLAYLLEDFKVSFTKPALLYCDNKFAMDVAANPMFHERTKHIDIDCHIVREKIVTGLLKLLPISSTLHLAVIYTKALPPASFHTFLSKLGMSNIHSQLAGGS

SEQ ID NO: 194787 - protein, 445 aa, Glycine max
  Coding DNA Sequence Number=SeqID_78009
  Gene Ontology: Mol. function=signal transducer activity; Cellular component=membrane; Biological process=signal transduction
  Homolog annotation: Hit_ID=UPI00005F7523; Match level="QueryCoverage =58%, HitCoverage=39%, E-value=2e-71, Identity=50%"; Hit description =COG2200: FOG: EAL domain
  Pfam annotation: Domain name=EAL; Domain location=18-258; Score =311.2; E_value=1.9e-90; Accession=PF00563.11; Description=EAL domain
  Pfam annotation: Domain name=SDF; Domain location=302-445; Score= -153.5; E_value=0.00035; Accession=PF00375.9; Description =Sodium:dicarboxylate symporter family
  Pfam module annotation: Pfam domain module=EAL::SDF; Domain location =18-258::302-445
GKNQILFFDPALTERAQKRLTQEHDILQGLQDGQFALYLQPQINMATGELAGAEALLRMRMPDGSYGLSEEFIASAEEIGVISALGRWVFEEACRIIAGWQRHGINLPLSVNISAVQLRDASVVSHLQGLLERHRIAPGNFVLEITETAQIGDAEQAMALLRSLQQTGVAVALDDFGMGYSNLNYLHQFKALPVNKLKMDRSFVAALPDDDTMVRIVAAIADIIHLDVIAEGVETAEQRDWLLARGITIGQGYLYAEALPIAPLWGAEAFQFIAACRMRFSITMAVNAVYTWTPVMKLFKSLYFQVLVAIGIGVLLGHYYPELGAQMKPLGDGFVKLIKMIIAPVIFCTVVTGIAGMESMKAVGRTGAVALLYFEIVSTIALIIGLVVVNVIQPGAGMNVDPATLDAKAVAVYAQQAEQQGVIAFLLDVIPNSVVGAFASGNILQ

SEQ ID NO: 194788 - protein, 96 aa, Glycine max
  Coding DNA Sequence Number=SeqID_78010
MDIIERDKPLEGYSGHLWKDFLSNNQLLEVINLLQQQHSHHFRDMISTTTGITQTIGSRKYLGLPSIIGKSCFWFSQGPSMEAYQSLVILATLKSG

SEQ ID NO: 194789 - protein, 135 aa, Glycine max
  Coding DNA Sequence Number=SeqID_78011
MEEDKKKEKMLEDDKQQLAIEPAPEPVQPFYELIEEQEEEDEQMRETPIILSEKEINEKRKKKNEENEKEKERKEEKRKNKSECAREKKKEPSLAKGTEVPYPLVPSRKDKERHLARFVDIFKKLAITMPFGEAL

SEQ ID NO: 194790 - protein, 413 aa, Glycine max
  Coding DNA Sequence Number=SeqID_78012
  Gene Ontology: Mol. function=magnesium ion binding; Cellular component=membrane; Biological process=metabolic process
  Homolog annotation: Hit_ID=Q1SRU7; Match level="QueryCoverage=73%, HitCoverage=67%, E-value=3e-55, Identity=50%"; Hit description =Exostosin-like
  Pfam annotation: Domain name=Exostosin; Domain location=141-400; Score=71.4; E_value=2.9e-18; Accession=PF03016.6; Description =Exostosin family
MAIVLMVQYSELPSSKFLSSVTTKITMEGNNLHLDGSNSNSTHALEEKAISPQVPQFHNDRDSITSPAPEKAKGLDETDSRSPVASVTSAATSVKSDITGSVSKDGKSGSLQGSSNLTSNNGKPVTAKNSKKRPSKVVSISKMNLPLQHNHASSKLVKPARASAVDLEILHAKSEILNAPVIMNDPRLYPPLYRNASMFRRSYELMENMLKVCIYQDEDRPIFHEPLLDGIYASEGCTISQAPAETRGRMLSSIRALCNADIEVGFKIGKDVSLPETYIRRFARLCSPILLKHWENKEPDMKISGPLPHVRGNVNYIQFMKSSKFCIHARGHEVNSPRVVEAIFHECIPVIISDNFIPPFFEILNWESFAVFVTEEEIPNLRNILLSISEERYLEMHKRVKKVQEHFPWHAEP

SEQ ID NO: 194791 - protein, 628 aa, Glycine max
  Coding DNA Sequence Number=SeqID_78013
  Gene Ontology: Mol. function=transferase activity; Cellular component= membrane; Biological process=metabolic process
  Homolog annotation: Hit_ID=Q1SRU7; Match level="QueryCoverage=94%, HitCoverage=95%, E-value=1e-144, Identity=46%"; Hit description =Exostosin-like
  Pfam annotation: Domain name=Exostosin; Domain location=307-595; Score=300.4; E_value=3.4e-87; Accession=PF03016.6; Description =Exostosin family
MDQELSSIFQLETRRLLWLIGITVAMVLAFQYLELPYGGIQRIVFSANKIPTSDSIRFQAADLPSESERFNNMTFLNQANSTGESATVNETRTSEEKDNVSGTGLISELGRESSRSLGFNETEESSTVQSTRISNESTHAGNLGLSSYNDTISHSPSRAIIPTNLAPPLSPTKVSPNITPPMSSNDHEETDFAEDEKLRPVQDDVNILRHNSPINSVAPKKTKGSQKPLPEVTTISEMNELLLQNRASFHSERPRWSSIVDQELLQARSEIENAQIVNDDVNLYAPLFRNVSRFKRSYELMERTLKVYVYREGDKAIMHSPILSGLYASEGWFMKHMEASKQFVTTDPKNAHLFYLPFSSQRLVDALWVPKSSYGNLIQYLSNYVDMIAGKHHFWNRTGGADHFLVACHDWAPAETKQHMAKCLRALCNADVKQGFVFGKDMSLPETVVRSPRNPTRSIGGNQVSKRKTLAFFAGQMHGYVRPILLQHWENKDPDMKIFGRLPKSKGNRNYIQYMKSSKYCICAKGYEVNSPRVVEAILYECVPVILSDNFVPPFFEMLNWESFAVFVLEKDIPNLKNILLSIPRKRYLQMQMMVRKVQQHFLWHNKSPVNLHSNSCIVHFGDVAKVD

SEQ ID NO: 194792 - protein, 639 aa, Glycine max
  Coding DNA Sequence Number=SeqID_78014
  Gene Ontology: Mol. function=transferase activity; Cellular component= membrane; Biological process=metabolic process
  Homolog annotation: Hit_ID=Q1SRU7; Match level="QueryCoverage=60%, HitCoverage=64%, E-value=1e-156, Identity=65%"; Hit description =Exostosin-like
  Pfam annotation: Domain name=Exostosin; Domain location=311-600; Score=311.0; E_value=2.2e-90; Accession=PF03016.6; Description =Exostosin family
MGQELWSIFQLERKRLFWLIGITVAIILAFQYLELPYGGVQPIVFSAENTPTSDSIRFQAADLPSESETFNNMTFFNKANSTDENAFEIANETRTSEEKGTVSNTGLITEPGRESSRSLGFDETNESSTVESIEISNNGSATEQTGKFGLSIYNNTISSSPSHAIIPTNLAPPLSPTEVSPNITSPMSSNDYDETDFAEEERFKPSKDEFNIVGNNSSINSVPKETKGSQIPLPEVTTISEMNELLLQNRASYRSMRPRWSSAVDQELLQARLEIENAPIVNNVENLYAPLFRNISRFKRSYELMEKTLKVYVYREGDKPIMHSPYLLGIYASEGWFMRLMEASKQFVTKDPKKAHLFYLPFSSRMLEETLYVPNSHSSRNLIQYLKNYVDMIAGKHRFWNRTGGADHFLVACHDWAPTETRQHMARCLRALCNADVKEGFVLGKDISLPETYVRNAQKPTRNIGGNRVSKRKTLAFFAGGMHGYVRPILLQHWENKDPAMKIFGILPKSKGNRNYIQYMKSSKYCICAKGYEVNSPRVVEAILYECVPVILSDNFVPPFFEMLNWESFAVFVLEKDIPNLKNILLSIPQKRYLQMQMMVRKVQQHFLWHRSPVKYDIFHMGNNIRWGQTQNKTEVGNQ

SEQ ID NO: 194793 - protein, 132 aa, Glycine max
  Coding DNA Sequence Number=SeqID_78015
  Gene Ontology: Mol. function=oxidoreductase activity, acting on single donors with incorporation of molecular oxygen, incorporation of two atoms of oxygen
  Homolog annotation: Hit_ID=Q6Z251; Match level="QueryCoverage=82%, HitCoverage=15%, E-value=1e-15, Identity=41%"; Hit description =Putative Lignostilbene-alpha,beta-dioxygenase and related enzymes
MATLYKTFIVNCSIQKRPSHVSDNSRHYNLPLFPAFKPLKKVLPEVPLQIDDVKKTMSKTAAILLDAFVDSFFEFIDQPLLPSQSNFAPVVELGEAIVVTSIQGQIPDDFPEGVYIRNGGIPFNFVLTQHHF

SEQ ID NO: 194794 - protein, 381 aa, Glycine max
  Coding DNA Sequence Number=SeqID_78016
  Gene Ontology: Mol. function=oxidoreductase activity, acting on single donors with incorporation of molecular oxygen, incorporation of two atoms of oxygen; Cellular component=chloroplast; Biological process=abscisic ...
  Gene Ontology: Biological process=acid biosynthetic process
  Homolog annotation: Hit_ID=Q69ND5; Match level="QueryCoverage=97%, HitCoverage=72%, E-value=1e-118, Identity=54%"; Hit description =Crocetin dialdehyde-like
  Pfam annotation: Domain name=RPE65; Domain location=1-379; Score= -40.8; E_value=3.3e-14; Accession=PF03055.6; Description=Retinal pigment epithelial membrane protein
MEHTKIPSQLPSGPNPLFGGLQSTNSIFGRSSYIWVEGEGMLHAIYFKRWSPGIWTVLYNNKYVETDTYKVEKQRSKPLFLPAIEGDSPAILSAYLLNWLRFGKVNKYISNTNVFEHSGKFYSVAENHIPQEIDIFTLKTLRNWNVNGAWDRPFTSHPKKVPGTGELVTFGVAATKPFAVVGIISADGKKLVHKVDLKLNRYNVIMDFPLTIDLNRLLRGGPLMKYNKEEYARIGVMPHYGDANSIKWFEVEPNCTFHIINSFEDGHEASYLELEVVVRGCRSLDSLIPGPDPSLKEFEWLSRCHEWRLNMQTGEVKERGLCGANIVYMDFPMINGNFIGIRNRYAYTQVVDPIASSTQDVPKYGGLAKLYFEESCAKFSM

SEQ ID NO: 194795 - protein, 118 aa, Glycine max
  Coding DNA Sequence Number=SeqID_78017
MDFTELSCQFHLRHSRTTECKTTNASRSILVILLPSGKCKCIFGTEVLTPKNHRNQNCDGSRHMISGQAAAAGVLRDYCGNILYAYAADIGNHEVAHAKFGIFIACQRGFKEISVGSD

SEQ ID NO: 194796 - protein, 571 aa, Glycine max
  Coding DNA Sequence Number=SeqID_78018
  Gene Ontology: Mol. function=oxidoreductase activity, acting on single donors with incorporation of molecular oxygen, incorporation of two atoms of oxygen; Cellular component=chloroplast; Biological process=abscisic ...
  Gene Ontology: Biological process=acid biosynthetic process
  Homolog annotation: Hit_ID=Q69ND5; Match level="QueryCoverage=94%, HitCoverage=93%, E-value=1e-144, Identity=47%"; Hit description =Crocetin dialdehyde-like
  Pfam annotation: Domain name=RPE65; Domain location=71-569; Score =224.8; E_value=1.9e-64; Accession=PF03055.6; Description=Retinal pigment epithelial membrane protein
  Subcellular localization annotation: CTP_CleavageSite=61; ConfidenceScore=5.07e-01
MALATSYMTLAPKYCCVQKRSFIVTSGLSSAFKPILRALPQIPRQIDASKTFTDIKSKFLNAVVDSAFEFVDQLVLPSQNNFAPVEELGEPVAITYIEGDIPDHFPEGPNPLFGGLKSSKSILGRTNSVWVEGEGMLHALYFKRESDNGCCTIVYNNRYVETETYKLEKQSIKPLFLPAVKGDTFAVLSSMLLNGLRFGQLNKDYSNTNVFEHSGKFYSVSENHIPQEIDIFTLNTLKYWDVNGAWNRPFASHPKKVPGTGELVIFGVDATKPYLEIGIVSADGKELVHKEDIKLDRCSLCHDIGITSRYIVILDLPLIVDSNRLLKRGPLIKYEKEEYARIGIMPLYGDENSIQWFEVEPNSTFHIINSFEDGHEVVLWGCRALDSIIPGPEDGLNESKLFSRCYEWRLNMKSGEVKEKYLTGPEKFMDFPVINASFTGIKNRYGYTQVVDPAASYSADIPKYGALAKLYFGEPCSEFPVGETQQEELIRVEYHTFERNVFCTGSAFVPKEGGIEEDDGWIITFVHNEDTGISQVHIIDTKKFSGEAVAKITMPFRVPYGFHGAFMPISF

SEQ ID NO: 194797 - protein, 187 aa, Glycine max
  Coding DNA Sequence Number=SeqID_78019
  Homolog annotation: Hit_ID=Q7G8Y3; Match level="QueryCoverage=47%, HitCoverage=9%, E-value=5e-10, Identity=41%"; Hit description =Probable chromatin remodelling complex ATPase chain
MARPLKPHSSSHEALSNASSSSEEEEQVNEQISEEEDEEELEAVVRPASSDYDEDDDKVAGDNPPNSDEYSAAADDLDGDSVDPEISKQEKTRLKEIMQKVKKQKIQEILDAQNAAIDTDMLRRPSFAHFAKGDQSSSQKKSRGRGRHSSNFTEEEDEEYRKGEEDGLANTRLVTQPSSTDIISDSD

SEQ ID NO: 194798 - protein, 102 aa, Glycine max
  Coding DNA Sequence Number=SeqID_78020
  Subcellular localization annotation: CTP_CleavageSite=74; ConfidenceScore=5.42e-01
MLQSHHIKKPIPPAPMAGHVAIPPAPMAVPSPLSYSACPAIAAGGTPSLPLSPSQPVPLLRMAAPPIPPLSLAVQASRQCQWRHPRPEETPLAICFKRDPVP

SEQ ID NO: 194799 - protein, 457 aa, Glycine max
  Coding DNA Sequence Number=SeqID_78021
  Gene Ontology: Mol. function=ATP binding; Cellular component =contractile ring; Biological process=electron transport
  Homolog annotation: Hit_ID=Q10D64; Match level="QueryCoverage=70%, HitCoverage=70%, E-value=1e-68, Identity=45%"; Hit description =Transducin family protein, putative, expressed
  Pfam annotation: Domain name=WD40; Domain location=120-156; Score =9.1; E_value=3.1; Accession=PF00400.22; Description=WD domain, G -beta repeat
  Pfam annotation: Domain name=WD40; Domain location=181-219; Score =27.3; E_value=5.5e-05; Accession=PF00400.22; Description=WD domain, G-beta repeat
  Pfam annotation: Domain name=WD40; Domain location=223-261; Score =43.4; E_value=7.7e-10; Accession=PF00400.22; Description=WD domain, G-beta repeat
  Pfam annotation: Domain name=WD40; Domain location=269-309; Score =22.1; E_value=0.002; Accession=PF00400.22; Description=WD domain, G -beta repeat
  Pfam annotation: Domain name=WD40; Domain location=317-353; Score =32.1; E_value=2e-06; Accession=PF00400.22; Description=WD domain, G -beta repeat
  Pfam annotation: Domain name=WD40; Domain location=361-405; Score =32.0; E_value=2.1e-06; Accession=PF00400.22; Description=WD domain, G-beta repeat
  Pfam annotation: Domain name=WD40; Domain location=79-116; Score =22.7; E_value=0.0013; Accession=PF00400.22; Description=WD domain, G- beta repeat
  Pfam module annotation: Pfam domain module=WD40::WD40::WD40::WD40::WD4 0::WD40::WD40; Domain location=120-156::181-219::223-261::269 -309::317-353::361-405::79-116
MDHFYGKRTLLSLMDTEKPEPPQSPVHLRVQTHREINEQDVQFSPPRPSTTSDGMFPMMMPDSPWTLSPLPTPSPSLLYHCIASLHRHEGNIYAIAASTKGLVFTGSNSSRIRVWKQPDCMDRGYLKASSGEVRAILAYSNMLFSTHKDHKIRIWTFTVSDSFKSKKVGTLPRKTSILMFPSRGKNTPKHKDSVSCMAYYHSEGLLYTGSHDRTVKAWRVSDRKCVDSFVAHEDNVNAILVNQDDGCLFTGSSDGSVKIWRRVYTEDSHTLTMTLKFQPSPVNALALSCSFNHCFLYSGSSDGMINFWEKERLCYRFNHGGFLQGHRFAVLCLATVGNMLFSGSEDTTIRVWRREEGSCYHECLTVLDGHRGPVRCLAACLEMEKVVMGFLVYSASLDQTFKVWRIKVLPDEKMCMDYSQYSDQCEAATRVKIRDYDMSPVLSPSWVEKKLQGSYFQ

SEQ ID NO: 194800 - protein, 144 aa, Glycine max
  Coding DNA Sequence Number=SeqID_78022
  Gene Ontology: Mol. function=structural constituent of ribosome; Cellular component=ribonucleoprotein complex; Biological process =translation
  Homolog annotation: Hit_ID=Q2QD65; Match level="QueryCoverage=66%, HitCoverage=74%, E-value=7e-38, Identity=85%"; Hit description =Ribosomal protein S12
  Pfam annotation: Domain name=Ribosomal_S12; Domain location=27-143; Score=151.6; E_value=2.1e-42; Accession=PF00164.15; Description =Ribosomal protein S12
MDKLTLTRQFGIQFGSLGGIGKEFWNNGTKRIDREKDFLFLLEDRDWIHICLSGSKGDLSVNFSTITPKKPNSALRKVARVRLTSGFEITAYIPGIGHNLQEHSVVLVRGGRVKDLPGVRYHIVRGTLDAVGVKDRQQGRSSAL

SEQ ID NO: 194801 - protein, 60 aa, Glycine max
  Coding DNA Sequence Number=SeqID_78023
MFEQYFLKVQQSSILVEWYCSSKTRDGQRAVRLRNSNLLSEQDNQTQKVTPKHNLFDEEV

SEQ ID NO: 194802 - protein, 130 aa, Glycine max
  Coding DNA Sequence Number=SeqID_78024
  Gene Ontology: Mol. function=RNA-directed DNA polymerase activity; Biological process=RNA-dependent DNA replication
MYCRKMGAYAKDEKLLIHFFQESLTGIAVTWYTNLEPSRVHSWKDLMVAFIGQYQYNSDMAPNRMQLQNMCKKGHESFKEHAQRWRDLATQVVPSMTEKEMIRMIVDTLPMFYYEKWWVHTFKLSGFGLR

SEQ ID NO: 194803 - protein, 102 aa, Glycine max
  Coding DNA Sequence Number=SeqID_78025
MGPKSTLRIASVVTVVAIKVEAVVSSHWHKQYIHRHRLAELEGGGGGGSPLRRGFSIVGIRRASKEEDEDKECEMETETETEGYWWKKYDSFGEVWSSPATR

SEQ ID NO: 194804 - protein, 159 aa, Glycine max
  Coding DNA Sequence Number=SeqID_78026
MPISPAEVSVGLCRPDIGRDRVRKTPSGLGEVQQGPGVSSSGYGPLLVLQGARTPRQGIAPAGHPVDPKKFKRVLGFPALITGLCQFYGVPVTSSKVIRPPNNRAFIKKYCAPRHAEGETPQQPGGGQQQATNAPPPPQEPLSSSTKRLEYCLRHTADQ

SEQ ID NO: 194805 - protein, 79 aa, Glycine max
  Coding DNA Sequence Number=SeqID_78027
  Homolog annotation: Hit_ID=Q2HTV0; Match level="QueryCoverage=43%, HitCoverage=2%, E-value=1e-09, Identity=88%"; Hit description=Zinc finger, RING-type; Transcription factor jumonji, jmjC; Zinc finger, C2H2-type
MSYDAAIEVRNHVSPEPEVEDAGVASLWNPKYEVYLQLFYFCFMVLRKQADLINQLDTLGDILRGHKFQFLIITLHIYV

SEQ ID NO: 194806 - protein, 141 aa, Glycine max
  Coding DNA Sequence Number=SeqID_78028
MVQKTTFVIACYQLLSLTATKRMFIRITSWGISVCPITSRGAEHDVSLYMLSGVESYRQQKNFYTDNQLGYFRLLPNLMGSLHRRRRKSPRVNGLACVWLTKGAEHDVVCVEDNALSLRDSKIMFIRITTWGISACPLTSR

SEQ ID NO: 194807 - protein, 95 aa, Glycine max
  Coding DNA Sequence Number=SeqID_78029
  Subcellular localization annotation: CTP_CleavageSite=31; ConfidenceScore=5.13e-01
MFIPDNHLGYFRLPPNLTRGSLRGRRRKSPRANGLACLRLTKGVEDDVSLYMKTMLVFASYQALCLTDSKRMFIWITSWGISDYPLSSRVSGCQR

SEQ ID NO: 194808 - protein, 212 aa, Glycine max
  Coding DNA Sequence Number=SeqID_78030
  Gene Ontology: Mol. function=ribonuclease H activity
  Homolog annotation: Hit_ID=Q1RYI2; Match level="QueryCoverage=76%, HitCoverage=37%, E-value=2e-12, Identity=23%"; Hit description =Ribonuclease H
MMRASWRFCGESPPIWASMIHNKYGCGSEAFPMNIIWRVRDGSRSIVNIMPPSREPEKDSLAWSKPSDGKFSMKTAYEAVASLSLSHHQGIFKCLHKWKGPERSRSFLWKLFHEKELSSAVLELAKFGRCSVVGAGLRDCIYPCFNLVKEIHARQGNVTWNHIFREANQVADVLAKQAVTPFNTFQVFEVPPECSINPIRSDEGHVCFPRGF

SEQ ID NO: 194809 - protein, 85 aa, Glycine max
  Coding DNA Sequence Number=SeqID_78031
MERFSLVSIHIRDLSLNVALTSMIMGLKSGPFSDNLCKRFLVTLEELRAKVVGFIYMEDVTTFREQMHEESSKRHPEKKEKIDNG

SEQ ID NO: 194810 - protein, 120 aa, Glycine max
  Coding DNA Sequence Number=SeqID_78032
MEIYVVFRADFLCQALTREVRGQAEIPQVVIRINILWLSIYVVFRADYLWQALTHEVRGQAEIPQVIYVVFYANYLFQALTRESLTTSSAPFVNMRQASPLTRGDLRRLQRRLPLGSTNS

SEQ ID NO: 194811 - protein, 84 aa, Glycine max
  Coding DNA Sequence Number=SeqID_78033
MLVSAHQWARLPLVNERCRRRKSPRVNGLGPQLTKGVEDDVSLYVLSCSRSDGQQKHVYTDNHLGISACPLTIRVRTKEIDGAR

SEQ ID NO: 194812 - protein, 255 aa, Glycine max
  Coding DNA Sequence Number=SeqID_78034
MVLARTFSTETEKVDFEVQGDSSSIGSEESSDFSTYLNQLLERVADNIGKRPPSSEAAKTTVDSPNPSMKVMRQKCQHVLTEKKHTRLPFDDFTMDVLCALNVALFELHPNKWAAIQAFQALCLYTFVKATLGMFLHYFCRLSHKKARWGNRCSLFINNSVPIDMASRDEGVGEKALNVEASNKLNKEEMARLEVALDIVEREINARKKERLWIEHKAYNDVYEAHEFDFNHCLRQVLFHYEAPDESIFDINKDV

SEQ ID NO: 194813 - protein, 197 aa, Glycine max
  Coding DNA Sequence Number=SeqID_78035
  Gene Ontology: Mol. function=RNA-directed DNA polymerase activity; Biological process=RNA-dependent DNA replication
MASAQKRNLQQIQSDDAVVISVEITNCIVRKTLVDQGSLVDILFWNTFRQLDIPDSELLPHDDPLFDFTREIVGTKECTWLYTKFNHEQPQQRGLKTQYVIVHAYTSYNILLGCLSLNALGVIVSTPHLAMKFPSNTRSIITIHADQRITRECYMESLKLSPLMNDESCQAMHYVEIMAGVERSEELKQDLRTNDDN

SEQ ID NO: 194814 - protein, 147 aa, Glycine max
  Coding DNA Sequence Number=SeqID_78036
  Gene Ontology: Mol. function=RNA-directed DNA polymerase activity; Biological process=RNA-dependent DNA replication
MDILGPFPKAPGQRNFLPVSIDYFTKLVEAKPLARITTQNVQSLWLTNKKLNEFMDGLDIKYRVISIEHTQANDHAKMANKIPFRLMYGTNAMVPTEVGEISLRRQNFIEVENNEALQEDLDLVEQVRENTIIIVKACKQYMAWRFN

SEQ ID NO: 194815 - protein, 81 aa, Glycine max
  Coding DNA Sequence Number=SeqID_78037
MQRKSKAERVGSKTKTQTEKGKQRMSNVQIDNSEAILRVVSIIFVKGMNMEYLPKKWFVENKCCSDTVVSENVEVAEYGGV

SEQ ID NO: 194816 - protein, 43 aa, Glycine max
  Coding DNA Sequence Number=SeqID_78038
MEKSKTRGKREGSRTLPDSTGARKEGRMKDWRVLTLRKREVVC

SEQ ID NO: 194817 - protein, 76 aa, Glycine max
  Coding DNA Sequence Number=SeqID_78039
  Homolog annotation: Hit_ID=Q60DJ5; Match level="QueryCoverage=92%, HitCoverage=22%, E-value=5e-10, Identity=44%"; Hit description =Expressed protein
MALPDGVERDAVLGEESKVGIRRVIDERDGKEAVNGKDKGWGGTKGGKRASEVVEGVCVDVNVEEVGRGGREEFVP

SEQ ID NO: 194818 - protein, 613 aa, Glycine max
  Coding DNA Sequence Number=SeqID_78040
  Gene Ontology: Mol. function=protein binding; Cellular component =cytoplasm
  Homolog annotation: Hit_ID=Q10CW7; Match level="QueryCoverage=93%, HitCoverage=82%, E-value=1e-110, Identity=42%"; Hit description =YT521-B-like family protein, expressed
  Pfam annotation: Domain name=YTH; Domain location=432-522; Score =204.6; E_value=2.4e-58; Accession=PF04146.6; Description=YT521-B -like family
MDLLFPMGQLKGGPSHSIQIHALFQMDTHLRIIMEVRYMNLDGGMAQGVYGDSCSYMYHQGYGYTPYGTYAPPNSSSPMIQQDGQHYGLQQYQYPCSYYKSPASADVSFTPNKISVPQGEISTAVDADRVASSNVMNKGHTVNMANSDFTNKNGFNPFLTSSQHTSLNTNDSYQGTSLPAYASLSGYQGPRSTHGTQLPVPSDVSLVSDRQSKHGAKVGLSSSVVPVKDFTSQRNQRLPQPLPQYVSMSGSRHPSGLDLVSGFMNGMYPSNRMYSQYGNTFRPDSRFGSAGYGSRMGSFDSKFNGTGYGCGLKKSMDGFSELNKGPRAAKSSDNKNIKSLGPVTLLLKGQNLPVKSDNKEVPPVPDKEQYNGKDFAENYSDAKFFVIKSYSEDDIHKSIKYSAWASTPNGNKKLDAAYQEAKEKPGGCPIFLLFSVNTSGQFVGLAEMLGPVDFGKTVDYWQQDRWTGCFSVKWHVIKDIPNSVLRHITLENNENKPVTNSRDTQEVKFEKGVQIAKIFKEHSSQTCILDDFGFYEAREKATQEKKSKEQQLPKQVSKPSDFTFGTVTFPKSLDATLMNEAATANAAEGRMNAEGLVEGNGSTPTLGDSSKSC

SEQ ID NO: 194819 - protein, 107 aa, Glycine max
  Coding DNA Sequence Number=SeqID_78041
MPFTTYDKGWVVLERKTNDQSEQRAISRSFLPLPCFLGCDGLCCLNVYYLDVGEAWEDDGDQVLRETRIWATWEYVSSVGGGQQGMVGLCAICGCGKLVVHHRLTAT

SEQ ID NO: 194820 - protein, 54 aa, Glycine max
  Coding DNA Sequence Number=SeqID_78042
MYGGSLEKGEMSGSLEVQRARTMMLVSLTRESCDLDLNVLTAATIRLKLRASPM

SEQ ID NO: 194821 - protein, 588 aa, Glycine max
  Coding DNA Sequence Number=SeqID_78043
  Gene Ontology: Biological process=nuclear mRNA splicing, via spliceosome
  Homolog annotation: Hit_ID=Q2R240; Match level="QueryCoverage=99%, HitCoverage=100%, E-value=1e-114, Identity=42%"; Hit description =Expressed protein
MGRSLSPLVRQELANLEKDEDSRKSAMKALKSYVKDLDYKAIPFFLAKVSESKENCSGEFTISIYEVLARVHGVKIVPLIDSIMRTIVKTLASSAGSFPLQQACSKVVPAIARYGIDPSTPEDKKRHIIQSLCTPLSDSLSSSQESLTSGAALCLKALVDSENWRFASDELVNRVCQNVAVALDGKSGQTNSHMGLVMSLAKRNALIIEAYARLLVQSGIRILNAGLVEGNSQKRLSSIQMINYLMRSLDSRSIFSEIELIIEEMDKCQSDKMAFVQGAALEALQTAKRIASDKKPRYAKSPASVTGSNFSRREEDYMEGENTSSGEGEHTPSSLTPESSTFDFFSGYESVGSPISSNLDYGQRSVTRKLWSNENGGVDVSLKDGLFSQVGKEGALLEHSLIHEFSNGEGDYTEEFAGFMGRNTRHGVSKSTTTSPLRSHTQATVDSIKIFETPRKLIHSLQDSSDVSLGCSRKQNRRYRSLSSDNIEWSPASKYDQNGFADDTNKCDSEVIEGCAEVEFQGSSESVSSTDDIPADADKQMHTEVVPVNRNAKTTYKLVCGLSCVLLAVATPLLWINSQDEGHYLVPT

SEQ ID NO: 194822 - protein, 174 aa, Glycine max
  Coding DNA Sequence Number=SeqID_78044
  Gene Ontology: Mol. function=DNA binding; Cellular component =mitochondrion; Biological process=DNA integration
  Homolog annotation: Hit_ID=Q1SJY5; Match level="QueryCoverage=89%, HitCoverage=16%, E-value=2e-38, Identity=50%"; Hit description =Integrase, catalytic region
MYVRQPPSFEDHTLPDHAFEISKGYVWSKTGTPCLFYERQSRHNSFQKRSCQGCVIVQIYVDDIIFGATNESSCKDFSDLMKSEFEVSMMRELKFFLGLQIKQDNKGIYIHQQKYTKELLKKFKMENAKPMKTPSHASNPLSKDESGDRVERKSTSGGCHYIGPCRVVVHNCYG

SEQ ID NO: 194823 - protein, 188 aa, Glycine max
  Coding DNA Sequence Number=SeqID_78045
  Gene Ontology: Mol. function=DNA binding; Cellular component=proton -transporting two-sector ATPase complex; Biological process=DNA integration
MNGSKREFLRYIRGTINYGISTAKYHHEFKHGNWVGYTDSAWKRDNDDRKSTAGYIFLLGDALVSWSSKKQDSVALSTCEAEYIAASMCSCQGLWLRKLLKEMKIQKTEVINILVDNKSAISLAKNPIHHGGSKHIETRYHFIRDKVSKGKVKLLYCKSEDNLADLLTKPLKKNRFEDLRNKMMIMIE

SEQ ID NO: 194824 - protein, 51 aa, Glycine max
  Coding DNA Sequence Number=SeqID_78046
MKVKVAVFSVAVIVIGIRVDRADQVALRINLIRRRFAEKKKRLGVGCRVFK

SEQ ID NO: 194825 - protein, 243 aa, Glycine max
  Coding DNA Sequence Number=SeqID_78047
  Gene Ontology: Mol. function=binding; Cellular component =intracellular; Biological process=protein kinase C activation
  Homolog annotation: Hit_ID=Q1SLC5; Match level="QueryCoverage=93%, HitCoverage=67%, E-value=5e-40, Identity=30%"; Hit description =Tetratricopeptide-like helical
  Pfam annotation: Domain name=PPR; Domain location=118-152; Score=5.6; E_value=1.6; Accession=PF01535.11; Description=PPR repeat
  Pfam annotation: Domain name=PPR; Domain location=154-188; Score=4.3; E_value=2.3; Accession=PF01535.11; Description=PPR repeat
  Pfam annotation: Domain name=PPR; Domain location=21-55; Score=38.5; E_value=2.3e-08; Accession=PF01535.11; Description=PPR repeat
  Pfam annotation: Domain name=PPR; Domain location=82-116; Score=29.1; E_value=1.6e-05; Accession=PF01535.11; Description=PPR repeat
  Pfam module annotation: Pfam domain module=PPR::PPR::PPR::PPR; Domain location=118-152::154-188::21-55::82-116
MVKDIETAHHLFEEIPNEDLVAWNSIIDCHMHCGNYKQAHHLFCRMVQNGLQPNDATLVVTLSAVVQGKKPTISSMKGKNLISWNVMIIRLASHGNGEEALAIFAKMLQQNVERPNDVTFLGMLSACSHGGLVDKSRRCIDIMGIDYNIQSTIKHYGCVVDLLGRAGLIEDAYNLIMNMPVECNAVVRKYLLELEPEHNSNYVLVANMYASTGQWKEMSKERRSMQQRRVQKPEPANSFIGVT

SEQ ID NO: 194826 - protein, 451 aa, Glycine max
  Coding DNA Sequence Number=SeqID_78048
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=100%, HitCoverage=32%, E-value=2e-98, Identity=40%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=zf-CCHC; Domain location=285-302; Score =24.9; E_value=7.7e-05; Accession=PF00098.13; Description=Zinc knuckle
MASNGPFPSNLPILTGKNFNRWSVQMKALLGFQDLTDVIENGIEIPKEGASDSQKTEFKDLKKKDCKALVILHQCVDDSHFEKIANAKSAKEAWDILNKAYAGADKIKKVRLQTLQRQFELLQIEETESIGDNFGRLQVLANSITSCGDTITNLTLVEKVLRTLNPRFNHIMVAIEESKDLESLSVDELQGSLEAHEQRLQERANDKATEQALQAHHHSRNGGSDNHRGKKGRGRFQNTRGRGGYSKDKGKPQPDQRSGDNCSKRSGGSGTCGRGGKKKWDKRNVECFNCGKRGHYAEECWYKEKNVDDEAQLATGVVSDTKPMLLMVTTKTRADAEDQWYLGTGCSTHMTSHKDWFVSLDESINHKVKFAYENTIRVEGHGKVVIKRRDGTVSYIEDVLYVPNMRCNLLSLGQLLEKKYRMVMEDKEMKIYDKDRRLIIKAPLNRNRTFK

SEQ ID NO: 194827 - protein, 152 aa, Glycine max
  Coding DNA Sequence Number=SeqID_78049
  Homolog annotation: Hit_ID=Q8H6Q8; Match level="QueryCoverage=69%, HitCoverage=3%, E-value=9e-15, Identity=37%"; Hit description=CTV.20
MEPEFWDKNPFKATAKAFPQGFHFRPTSISKTRKFYEFILIDTNSVSIKHFKDPKDPNLNTHSTIQIMKVLQPRHFGSNLNQPKKFSAPFDPVGYTYWDYNDAWTNIWEDRMQQAFPTITETCIHQMVESILTPLKQRQTKLKSGSKLTHNF

SEQ ID NO: 194828 - protein, 253 aa, Glycine max
  Coding DNA Sequence Number=SeqID_78050
  Homolog annotation: Hit_ID=Q8TGM6; Match level="QueryCoverage=47%, HitCoverage=97%, E-value=5e-09, Identity=43%"; Hit description =Protein TAR1
  Subcellular localization annotation: CTP_CleavageSite=79; ConfidenceScore=5.43e-01
MTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGARGRSAYTPRSNIVTCLRWETMCDTQAGVPSA

SEQ ID NO: 194829 - protein, 37 aa, Glycine max
  Coding DNA Sequence Number=SeqID_78051
MLDTLVLLAKPMLNDGYELHSLKGEDSGKIDIIVNTV

SEQ ID NO: 194830 - protein, 67 aa, Glycine max
  Coding DNA Sequence Number=SeqID_78052
MFISVAIKQYRSDDESGEASQAEDGEDEDMGYSPELERMVAQEDREMKSHREETKIINLGVGKERKQ

SEQ ID NO: 194831 - protein, 66 aa, Glycine max
  Coding DNA Sequence Number=SeqID_78053
MWDRYRLKGALKSGVFTPKAYTPKIPSRPLPPDSALVIKLIGSPQRIPSQYLSRKNSSPLKGLTIV

SEQ ID NO: 194832 - protein, 239 aa, Glycine max
  Coding DNA Sequence Number=SeqID_78054
  Gene Ontology: Mol. function=zinc ion binding
  Homolog annotation: Hit_ID=Q10CW4; Match level="QueryCoverage=81%, HitCoverage=82%, E-value=3e-51, Identity=50%"; Hit description=PHD -finger family protein, expressed
MAIARTGVYVDDYLEYASTLPAELQRLLNTVRELDDRSQSMITQTRQQTKYTMGFSSHGSKKGNHSYNNNYGNEDDDAAIEKMRKEIEVNQDSALSLCTEKVLLARQAYDLGKIAPDEPAILPPLPIVPKAEKRKPIYITPQSKRIDYRERDWDRERDRDFELMPPPGSHKKEYATPMDVDQPIDPNEPTYCVCHQWNDGCGNNNVVGWNNGNNDDNNDGGRDNGGGIATMGCGGNGDG

SEQ ID NO: 194833 - protein, 113 aa, Glycine max
  Coding DNA Sequence Number=SeqID_78055
MVEIGAGKMKPEDLRKVIENKNRNSAGTSAPAQGLFLVDVAFLFCYGFYIALTNPGSLQDNDYTGYSLVNVISWLCAIVVVWGIYQFLEKKFTKETIHKPSLEIEEIGSKENA

SEQ ID NO: 194834 - protein, 297 aa, Glycine max
  Coding DNA Sequence Number=SeqID_78056
  Gene Ontology: Mol. function=endonuclease activity
MAQFTTQGRLKLLLNGEGVSSVLEHKDPFLYKCRSVQTHKRRTRYAGSSARIYYASTSSLSSKSHRCNAEARHTSGNGSVHDEYDDIDDDEDEDDEEEEEEDVFDRDGLSCFRGLVLDIAYRLADWVNPITPADPVFAKAESQSHVHCSSDLALFAVSPGNLWPTFEVSSPEFIFVVFFVPKSFVEALFTVLAFDHIASNPSVFSNFSSTKSPHFITLGDGSKAKAIGIDQAVTACAKCNCKKGRKTLEEAKMKLIKPPKVPKDYDILAIPLTAAALRMLTIRKGTPEEWRQYLRSP

SEQ ID NO: 194835 - protein, 187 aa, Glycine max
  Coding DNA Sequence Number=SeqID_78057
MEAGSLSFNEEEGASPPRIALDKKLEEDALMEEKKERRGEHEIEGIKEGEKWNFKVASLRSFLEKTSLRSFFEKTSLRSFLDTHDTLVVSSNAKSINKESNDPKMPISTLEVRKATKKNDEEEKDDAQSHNESSPSKQQSQQEPIIEENNALTIWDEHRLKGALKSGVFNPKAYTPKSPSRPLPPDS

SEQ ID NO: 194836 - protein, 255 aa, Glycine max
  Coding DNA Sequence Number=SeqID_78058
MEGNLYSIVNGAEMIIDTEVWKKVAGINMDGVCKFEESMDGYNKMKTNRGMLLDLLRILRNQLGVGGLIAEDRILVYSIHIFYHQGPAIMLRLKPGIQRNWILLIKDIMLKSHQLVDYEFPYAILASRFINYFNIDVDNEIEKFTKASNEITERHLKNLGMTYVDHEQIIARKPPTEANENQMEEEAKGEAQRNPAHQWNPFESLMIHKLNVILHQHQEHQAEVHSSLENITTRSGNIETRLSLSNLLNPDEDEA

SEQ ID NO: 194837 - protein, 79 aa, Glycine max
  Coding DNA Sequence Number=SeqID_78059
  Subcellular localization annotation: CTP_CleavageSite=60; ConfidenceScore=5.40e-01
MASYGGELVLNSSSPSSGVSNHLSSFSISLPIIFKKQRTPLMKKIQGLQALLGATSCGIRASSSRFYHFFSHNLLVLNL

SEQ ID NO: 194838 - protein, 70 aa, Glycine max
  Coding DNA Sequence Number=SeqID_78060
  Gene Ontology: Mol. function=hydrolase activity, hydrolyzing O -glycosyl compounds; Cellular component=cell wall; Biological process= carbohydrate metabolic process
  Homolog annotation: Hit_ID=Q8L9A9; Match level="QueryCoverage=74%, HitCoverage=18%, E-value=2e-20, Identity=79%"; Hit description =Probable xyloglucan endotransglucosylase/hydrolase protein 8 precursor
MIMQNPSFRKWCGAERDELDFEFLGNKTGEPYLIQTNVYKNGTRGRNMRHMLWFDPAEDYHTYSIQQELE

SEQ ID NO: 194839 - protein, 107 aa, Glycine max
  Coding DNA Sequence Number=SeqID_78061
MVGEVRLRRPPEALRCWLANFSSCGSGRVLVAGFQRRDALEEFIQFCGGVKLIGGKLGYGFLHMFQLSSLVPSWLRNPLGVEDECSTFCSSGECSFPLGLAGLVADS

SEQ ID NO: 194840 - protein, 421 aa, Glycine max
  Coding DNA Sequence Number=SeqID_78062
  Homolog annotation: Hit_ID=Q5VQM7; Match level="QueryCoverage=30%, HitCoverage=11%, E-value=2e-16, Identity=39%"; Hit description =Putative receptor-like protein kinase INRPK1
MKLPNKIKLDDFLERYNHQSREQGHISQRSQRKPPISRGPAKSRGAEHLVQQIHGTRSGHAVLREATAERAGGEPGAVLLRQQVRRQREVGAVGEGGARGNGGSALHSVHAANGDAVYGGGNKTTRGPPKRRGGGWKGQQRGHGSTLGKNPPEARVTYRGECSSERKRKTKNSAMWSKRTRTREIVCHKWAENNDVFTYKPVVALKLSFRACSRVIEPLRMIHALLPFTLDVVNVEAPPVWGLLGVMEYATSEVDGELNYLDIGRIVNLEYGCAFVGEHVVFSDFSEYFFQVYNMLGYAMRVCILGAHPVQIDVVDAYLPFSIGLFYHDDIGKSGVIPNFFDEVGFEELDISYASVLMAGEVLAELRALLGFGFELQLDEFFNRLWASIRSVVAWIYIEYVVQACLVDNQGTNLSFLLSAL

SEQ ID NO: 194841 - protein, 143 aa, Glycine max
  Coding DNA Sequence Number=SeqID_78063
  Homolog annotation: Hit_ID=Q9FLA9; Match level="QueryCoverage=50%, HitCoverage=11%, E-value=2e-29, Identity=76%"; Hit description =Similarity to endo-beta-N-acetylglucosaminidase
  Pfam annotation: Domain name=Glyco_hydro_85; Domain location=2-131; Score=-128.8; E_value=0.00064; Accession=PF03644.4; Description =Glycosyl hydrolase family 85
MHSSMPGSLVIWYDSVTLDGKLNWQDQVNEHNKPFFDICDGIFVNYTWKEDYPRLSVAVAGDWKFDVYMGIDYSRHFNHQNIGFILVIAEHICTLMFKWPSEKFLTTCRTRSLGEASNLPVTRYTFTKKIIITWSRKLCSTSQ

SEQ ID NO: 194842 - protein, 192 aa, Glycine max
  Coding DNA Sequence Number=SeqID_78064
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q6TQD7; Match level="QueryCoverage=99%, HitCoverage=44%, E-value=4e-77, Identity=67%"; Hit description=Beta -1,3-glucanase, acidic
MNIYPFLSLYGNDDFPFNYAFFDGVDNPENDNVGFGDLPILVGEVGWPTEGDKNANTGNALRFYNGLLPRLAANRGTPRRPGYIEVYLFGFIDEDAKSIAPGNLERHWGTFRYDGQPKFPMDLSGQNQNKFLVGTQNVNYLAHRWCMFNPDAKDLSKLPDNTNYACTFGLHGAWIRLFLQQFGFEWERLLCV

SEQ ID NO: 194843 - protein, 151 aa, Glycine max
  Coding DNA Sequence Number=SeqID_78065
MTRRRDFVKDIDNSNDTLKLAVRIIDLWFVETKDKSEQDATGVVHELTSQHVLSSPKRVLFTMKDLRYKLEVMVYRKEQSSNFVLWDHECIELLGKSAQELNNMMFVGGDKSVNVFLDPLDNLLGCTLAFKIKVQSKYKVHLWKKYLMILH

SEQ ID NO: 194844 - protein, 204 aa, Glycine max
  Coding DNA Sequence Number=SeqID_78066
MERRHKEELRKLKADHNQLEAHVKCPQGDEHSTHTLLERTQGESHPRRKRFNAQYTTSRSHRMTFVALANLRQKDDESLLKFMDRFGRIIVQIQNLDLKVTLHSMLLTLRHERAKNYIQMEEMSRFRNEVWLAEQKLDKREGNTKNDSYKSDKTHKPYKHQLSRKGPVTSVTYPQRPIALQSLRRLSSWRYLSSYLRRFLLGQG

SEQ ID NO: 194845 - protein, 107 aa, Glycine max
  Coding DNA Sequence Number=SeqID_78067
MFKSLKTSTNRMENEEQLKNGRRMVKNDHRIDHENVSEAPWPRFFFIFLLHLTNFTENLLIYDADPFSSAPSRLFIGNEEGRWHNSSPRRAGYFSPKLSGGLGELGA

SEQ ID NO: 194846 - protein, 264 aa, Glycine max
  Coding DNA Sequence Number=SeqID_78068
MEGAPSEESITPFIAQGFSDPNARVLQGVRMAWGAVQSKDKELRGSSNGIVGGYHKWLRVRTQELDWLPKLKAAREEEAETSKESEEVQTLNAELERAQVVKEKFKSTAIKVRKEYNELRDINMTTTEALERETKRGSVAGRRHDLERRVKGLPKVEKKLVQAYKEKLSLAATHEQRLEDEYAKVSVLQAEREARERVIDSLHREAMMWMDRFTFTLNGSQELPRLLAEVKAMADVYSAPEEVHGLLDYYQHMIDLMAHIIRSR

SEQ ID NO: 194847 - protein, 72 aa, Glycine max
  Coding DNA Sequence Number=SeqID_78069
  Gene Ontology: Mol. function=transferase activity; Biological process= metabolic process
MFGITLFGKRAIGQFQQINIVVAIEQLPHQFYFFHQTGAMIFDIPDVLQRGVTFSQRGDTIAQQGIAFSQVG

SEQ ID NO: 194848 - protein, 265 aa, Glycine max
  Coding DNA Sequence Number=SeqID_78070
  Gene Ontology: Mol. function=inorganic phosphate transporter activity; Cellular component=integral to membrane; Biological process=phosphate transport
  Homolog annotation: Hit_ID=Q6ADG6; Match level="QueryCoverage=55%, HitCoverage=46%, E-value=5e-54, Identity=73%"; Hit description=ABC transporter, permease protein
  Subcellular localization annotation: CTP_CleavageSite=59; ConfidenceScore=5.47e-01
MPLATTVHSSETSGSSAIRKAVATRAVMSRSTALRRLSAIEEITVTITMYSRMPTMTVPAMLKSASGVSEPAAATPKTAAETTKETPSRAQGAHFGRRPEVRAVVLALDGAVVRAVMSVRSRELGAAGDDPARQRVDREGHDEEDEAGRDEGVHAGAVRLGEGEGDVRGDGGRVRGREDEEADHRRGGEHHRHGHRLAERAAQGQHRCRHHAAAREGEHGHADHLPARRTECQGGLLVELRRLQEDLAADGGHDRDAHDGEDERR

SEQ ID NO: 194849 - protein, 94 aa, Glycine max
  Coding DNA Sequence Number=SeqID_78071
MKSLNGFDGSVGSSQGCMLEREIQLIGDSSSSMSSSKSLSSSKVRVLDKVTYVVEDEDGIKAKVVAVRERCEILPSIVLSNCRSLSHDGTAKTK

SEQ ID NO: 194850 - protein, 246 aa, Glycine max
  Coding DNA Sequence Number=SeqID_78072
  Homolog annotation: Hit_ID=Q1S7C5; Match level="QueryCoverage=36%, HitCoverage=9%, E-value=1e-17, Identity=44%"; Hit description =Integrase, catalytic region
LLLAHEACLNKFNKQSLSYSPSINYMQAHNKSFSSHGSDGYMVPNKSFLHSDPESFSNSRGGGFNNRGGGWCDGTGGGGRGRGWFANFQCQVCLKYGHTTSVCHYRHEQHYQPNSTLVLQDPTTMRVRLRILVIGKLILILGSRMVIIVLLMFEASFHVTGESQNIQQIEPFEGLDQIFIGNGQGLKITSSNSSSFISPYTSPKDNAVFFEFYSNYCVVKSQFTNEVLLQGTVGPDGLYSFSNIQF

SEQ ID NO: 194851 - protein, 68 aa, Glycine max
  Coding DNA Sequence Number=SeqID_78073
MGLSRGITSYNKDDLVAVAGDKCMKVVENQKEAIGYEHAFVRAKAIKGLIELVDGNVDSCCTKGLFVH

SEQ ID NO: 194852 - protein, 205 aa, Glycine max
  Coding DNA Sequence Number=SeqID_78074
  Homolog annotation: Hit_ID=Q1S7C5; Match level="QueryCoverage=19%, HitCoverage=3%, E-value=7e-14, Identity=82%"; Hit description =Integrase, catalytic region
MNWILDLISVFSWDILPLIRDINVCLLLAEFIFLKVFFLMSLKFPCADLFESSPSLSQSSSSPTNFNFSSIPIIATNQPPVSPLHTKTSIGSSSSSFQSATLVQSPIPPIQSPIPSVQSDSDLPQSDPVQLSNSVQSDLPQSVSVPSSNSEQTNQPIVSNTESSSSTTNSSPPPRSYPIFTLCKPDLNLVFTYPGLILHFCWQLS

SEQ ID NO: 194853 - protein, 144 aa, Glycine max
  Coding DNA Sequence Number=SeqID_78075
  Gene Ontology: Mol. function=nucleic acid binding; Biological process= DNA integration
  Homolog annotation: Hit_ID=Q1S7C5; Match level="QueryCoverage=95%, HitCoverage=14%, E-value=1e-20, Identity=34%"; Hit description =Integrase, catalytic region
MVAQSNASLTPFPHSIAHKLDDLTFLLWCQQAEPVTKSHRLQRFVVNPQIPLHFLSKEDREAGIENPAYKAWEQLDQVLLTWLQACQLQTQLRATNLVGKSMGEFLSQIKALSDALASIGSLIMLQEHIDSIFEGHPSDITPSL

SEQ ID NO: 194854 - protein, 75 aa, Glycine max
  Coding DNA Sequence Number=SeqID_78076
MAMVVMLVPATAVEIPVVVEMVVAMPMVVASGGSSDSDSNVDGDGSSNAGGGSNKWWRCGVVGGGGCDDTGGGYG

SEQ ID NO: 194855 - protein, 182 aa, Glycine max
  Coding DNA Sequence Number=SeqID_78077
MGVELNNSDVDGGGIVVVGGGSNVNGGGDVDGNDGGSDNGGFCSGDYEGSGVGGENDGGSGIGIGGNNVDGDLVSDGGGGRSGGGDNDDNIDGCDGNLVGDGGGAMLVAMVVVVETTNYDGGNNNGDGDGAVVVTMTEVVVVVVAKSVIIKYGKCVFLTKNQIHKTFFLGFENECKIVSKMI

SEQ ID NO: 194856 - protein, 121 aa, Glycine max
  Coding DNA Sequence Number=SeqID_78078
MVEIAEAMRESVEAKRVNQVANLRRLERETTNKLPHDFQPSSKAIEVEPFQPYFLVPKIEDFHGSKDQRRRVPDPFNNAIIQVEDLNNYMFVATFTKGLRPGEFNESLIYKKITNMDKIQS

SEQ ID NO: 194857 - protein, 75 aa, Glycine max
  Coding DNA Sequence Number=SeqID_78079
MWAMFGCERSDRENPWKVGSLERFSEMVISMPRSGVVLCCGYGDVVKSIKGLTVVKIQHVGCVSENLMNLGENWT

SEQ ID NO: 194858 - protein, 134 aa, Glycine max
  Coding DNA Sequence Number=SeqID_78080
MTPSLFRLLDTSRQRSHIWFRGLFPHDFLPRFIGVLVDCMVLVLVVFDNEGLIIVCLHGYGSSLLFDKMSFAVRWKDELEPTWHLLHFSGNMHSVTYNQNLVSQALLVGWIKLREFYGLTENHQVTFEPKAYPK

SEQ ID NO: 194859 - protein, 246 aa, Glycine max
  Coding DNA Sequence Number=SeqID_78081
  Gene Ontology: Mol. function=ribonuclease H activity; Biological process=RNA-dependent DNA replication
  Homolog annotation: Hit_ID=Q1T293; Match level="QueryCoverage=85%, HitCoverage=53%, E-value=1e-16, Identity=25%"; Hit description =Ribonuclease H
MASLSRGGDDVTVERGGWQRVRVVRERTIVRTNDPNIANEIENMFIPLFEEEDRPVWEGTFIGTLKLKEDYSFLNGPSHDISWAKMIWIGTAVCWLKPWCDLWYCSIGNADHLMLQCSFASKVRDWLEIKLQHKLDQNSMLNILGVLNFDYSPQLHDVRLVTINYIVWSIWDYRHQQVRWQPPIMGWVKCNTDEATKGSLGIAGCGEISAVITTIEIAHEKGWRNLWLECDSLMVVQDFKDVNLVP

SEQ ID NO: 194860 - protein, 91 aa, Glycine max
  Coding DNA Sequence Number=SeqID_78082
MMLVPAPADRLLVTSPCYRCWIYEHFLSIAECNADLEYDEASPRVSQPTLRREGDAGLMGASSMGGKCAESPPTFIRGKRRKNRKGVVYEL

SEQ ID NO: 194861 - protein, 84 aa, Glycine max
  Coding DNA Sequence Number=SeqID_78083
MGAKHLEVVKRGSHPNNGWSPNEIRNDHNLSLRFVGHDRAWAARHRMTIICLCVPPDTIASGWQKGARNDHNFSPLTSRLTVPE

SEQ ID NO: 194862 - protein, 77 aa, Glycine max
  Coding DNA Sequence Number=SeqID_78084
MDDLQNHCITVGLNNLSHATSFEAAKSIGKPIEVVCFRMIYCIIRSTRQKHTKGGWETNIRSKYILVKEVPENARIQ

SEQ ID NO: 194863 - protein, 127 aa, Glycine max
  Coding DNA Sequence Number=SeqID_78085
MGKLDHLEERLRAIEGGKDYAYANLEELFLVPNIITPPKFKVSNFDKDKGTTFPKNHLKMYCRKMGAYAKDEKLLIHFFQESLTGGQSGLKRGKFNHHAWTNEKPGANEEGEDEGETHAVTAITIRP

SEQ ID NO: 194864 - protein, 237 aa, Glycine max
  Coding DNA Sequence Number=SeqID_78086
  Gene Ontology: Mol. function=protein binding; Biological process =defense response
  Homolog annotation: Hit_ID=Q1S6X1; Match level="QueryCoverage=91%, HitCoverage=25%, E-value=2e-17, Identity=33%"; Hit description =Disease resistance protein; Short-chain dehydrogenase/reductase SDR
MSKMNNVNYVYEECYDSGVVFMALESLILVELPSLIRLSREDGKTCSECAEFSAGLHEALQHTTAPKPSKKKKHDNPEAYQEKTLTAPKLLKLQDLPNLESEFSASSHEALQHMTTLKLLKLQDLPNLESEFSAGSHEALQHITTFKSLKLQDVPNVESKCSAGFHEVLQQITALESLTSQGLSILESLPDYFGNLPLLHQLTIVGCSKLRCLPKSLIHSKVEIQIITLRRKRERTF

SEQ ID NO: 194865 - protein, 405 aa, Glycine max
  Coding DNA Sequence Number=SeqID_78087
  Gene Ontology: Mol. function=DNA binding; Cellular component=nucleus; Biological process=regulation of transcription
  Homolog annotation: Hit_ID=Q9SQQ6; Match level="QueryCoverage=89%, HitCoverage=89%, E-value=4e-76, Identity=48%"; Hit description=NAM -like protein
  Pfam annotation: Domain name=NAM; Domain location=16-143; Score =307.2; E_value=3e-89; Accession=PF02365.6; Description=No apical meristem (NAM) protein
MEEPIVVNKGEEPLDLPPGFRFHPTDEEIITYYLTEKVRNSSFSAIAIGEADLNKCEPWDLPKKAKIGEKEWYFFCQKDRKYPTGMRTNRATESGYWKATGKDKEIYKGKGNLVGMKKTLVFYRGRAPKGEKTNWVMHEFRLEGKFASYNLPKAAKDEWVVSRVFHKNTDVKKSSTPGLLRINSIGDDLLDYSSLPPLMDPPYGNTNTTNNTNPLSSSTKSQSEGYYLPSFSINNHQQQLLIKPEDHHHHRSYNEIPTINYTSNQANLSNNVNAMGNNTLSQPLNMFSADYYVHQNRIKSSIMPSVAGSDFVNNNNNHHEAILRAFAAKNNEHIQCKMEQFSSNHSQDTGLSNDRNTTDTSSVVSKQQDNNMGRNNNRALYEDLEGPSSVAPLSDLECLQWDDDY

SEQ ID NO: 194866 - protein, 423 aa, Glycine max
  Coding DNA Sequence Number=SeqID_78088
  Gene Ontology: Mol. function=nucleic acid binding
  Homolog annotation: Hit_ID=Q10M15; Match level="QueryCoverage=84%, HitCoverage=83%, E-value=1e-80, Identity=45%"; Hit description=RNA recognition motif family protein, expressed
  Pfam annotation: Domain name=RRM_1; Domain location=336-411; Score =7.5; E_value=0.029; Accession=PF00076.12; Description=RNA recognition motif. (a.k.a. RRM, R
MASNPSPHGHMHQHQFALQGTESKPCDAESLVPATLLIKHLPEAIPDVTLSRILANFGASSVRPCSTGRLRFLGKVLSAERASNPTENGEKSSGDQLGKDSKTSMLKNANVTKPIDGDTKSGALPIPEPIADRLGVNYPFPPHLEYAASSHFAVVLHLMNKMNIPAPFRMALPTPPLPPEVPAPPPPLPAPTVTVNPWSADLSSGESEMESSDEDEARIRKSGQKRARRETIVGPAIDKGVAHESVGVKPATLVPKEIPVIKKNHVLKINIVPKATVKEHKDDDTTQELQEPEKDVPDPNKFLTPDELERGKLPPEEILSLPMFKNYTAGNPAPVLYIKNLAKDVIADDFYFIFGSLFGSIDAAKSGLQVKLMQEGRMRGQAFITFPSIELAHHALTTATTTFWNVSDMDAGMYILLGFMDEK

SEQ ID NO: 194867 - protein, 269 aa, Glycine max
  Coding DNA Sequence Number=SeqID_78089
  Gene Ontology: Mol. function=protein binding; Cellular component =membrane; Biological process=defense response
  Homolog annotation: Hit_ID=Q1T032; Match level="QueryCoverage=97%, HitCoverage=32%, E-value=4e-66, Identity=49%"; Hit description =Disease resistance protein
  Pfam annotation: Domain name=NB-ARC; Domain location=1-134; Score= -125.9; E_value=0.029; Accession=PF00931.13; Description=NB-ARC domain
MPCHELSKLSHNDCWELFKHPAFGPNEEEQPELVAIGKEIVKCGGVPLAAITVGDLLRLKREEREWLYIKESNLWSLPPSENSIMPALRLSYLNLPMKLKQCFAYCAIFPKDDRIEKEHLIELWMANGFISSNEDVEDVGDGVWRELYWRSFFQDLDSDEFDKVTSFKMHDLIHGLAQFVVEETLKLDYCESLQKLLQKLPNSLVRLKALQQLSLNKCFSLSSLPPQMGKLTSLRSLTMYIVGKERGFLLEELGPLKLKGDFHIKHWSE

SEQ ID NO: 194868 - protein, 47 aa, Glycine max
  Coding DNA Sequence Number=SeqID_78090
MKVWLPIGGSQHTSNERRFCYKNLKAMKMSRNVSKNFSSKFVVTNSQ

SEQ ID NO: 194869 - protein, 113 aa, Glycine max
  Coding DNA Sequence Number=SeqID_78091
MEFMSPPARYRVTHIKTRAHRHHLGSPIRMGHWAWSGIYSIWFASRRPTTMDSLSQQGQGFAPFVCPTPEQFGAEVAWPGDWPDAQAGEEPAESPGEAEESRMDEDMIDLLVS

SEQ ID NO: 194870 - protein, 75 aa, Glycine max
  Coding DNA Sequence Number=SeqID_78092
  Gene Ontology: Cellular component=chloroplast
MSPHGGDMDGGGKRKERDGVSLAFGIVSLGGRLARWAISSVVEALSHMDSLICSLAPDPEMWIIQGTLAWCTSPV

SEQ ID NO: 194871 - protein, 108 aa, Glycine max
  Coding DNA Sequence Number=SeqID_78093
MPPFDFRCVTETYGLCINIFLVFRHVLEFHKLPNDGCQAPHKDQRMVACHQAKRPNSLLSYPNFVRGLLFDGMQPLVDRFEVLGTLCCTIREVPRRAGNQKEALLRIP

SEQ ID NO: 194872 - protein, 162 aa, Glycine max
  Coding DNA Sequence Number=SeqID_78094
  Subcellular localization annotation: CTP_CleavageSite=23; ConfidenceScore=5.04e-01
MVERPGGSFGPADHPFLEPMNCAFVHVSSTFEFGAMRSDCLVQFSILTLFRSPMNCVFVHVSSTFEFGAMRSDCLVQFSILNLFRSPMNCIFVHVSSTFEFGARRSDCLVQFSILNLFRSPMNCVFVHVSSTFEFGAMRSDCLVQFSILNLFHSPMNCISVH

SEQ ID NO: 194873 - protein, 258 aa, Glycine max
  Coding DNA Sequence Number=SeqID_78095
  Gene Ontology: Mol. function=nucleoside-triphosphatase activity; Cellular component=chloroplast
  Homolog annotation: Hit_ID=Q2PMM5; Match level="QueryCoverage=97%, HitCoverage=11%, E-value=1e-138, Identity=94%"; Hit description =Protein ycf2
MCRLFMEREKQMNNHLLPQEIEEFLGNPARATRSFFSDRWSELHLSSNPTERSTRDQKLLKKEQKKHLVLSRRSENKEIVNLFKIIMYLQNTVSIHPISSYPGCDMVPKGELDSSNKISFLNKNPFWGLFHLFHDRNSGRYTLHHDFESEEIFQEMADLFTLSITEPDLVYHKGFAFSIDSSGLGQKHFLNELFNSRDESKNHSLLVLPPLFYEENESFYRRIIKKWVQTSCGNNLEDPKPKIVVFTSNNIMEGSQSI

SEQ ID NO: 194874 - protein, 43 aa, Glycine max
  Coding DNA Sequence Number=SeqID_78096
MALKSPMYNKGPWWLRKGIKKGPRLGQEEQVDFVGYITPLRHA

SEQ ID NO: 194875 - protein, 237 aa, Glycine max
  Coding DNA Sequence Number=SeqID_78097
  Homolog annotation: Hit_ID=Q6Z6Q1; Match level="QueryCoverage=36%, HitCoverage=49%, E-value=7e-30, Identity=77%"; Hit description =Putative dentritic cell 2 protein<DC2 protein
MGGKIQFRNQEESVMRLSPSISQALRSEFSSISSDISAQFVLTVQKMIVINSMVSNYQHDGGNAGGGVGNLDGFRAVAIEGEVEENDADATEDEHESGGEALDDVLAVDAAGHEDDGADGAGVGVLSGADAGGLDDDVVNNAGDDHEVGEEEEGEDGVRGGEGEGGKLEAEARGAEEAEGEDAEEVEDRIDGCAGGGVASAGGGGRGHRGIRFGSHFRVGFRRGREKSSEFIMCVNW

SEQ ID NO: 194876 - protein, 285 aa, Glycine max
  Coding DNA Sequence Number=SeqID_78098
  Gene Ontology: Mol. function=protein binding; Cellular component =intracellular; Biological process=small GTPase mediated signal transduction
  Homolog annotation: Hit_ID=O64566; Match level="QueryCoverage=96%, HitCoverage=73%, E-value=1e-101, Identity=68%"; Hit description =Putative leucine-rich-repeat protein
  Pfam annotation: Domain name=LRR_1; Domain location=105-126; Score =9.2; E_value=5.3; Accession=PF00560.23; Description=Leucine Rich Repeat
  Pfam annotation: Domain name=LRR_1; Domain location=12-33; Score =14.9; E_value=0.29; Accession=PF00560.23; Description=Leucine Rich Repeat
  Pfam annotation: Domain name=LRR_1; Domain location=128-151; Score =4.1; E_value=49; Accession=PF00560.23; Description=Leucine Rich Repeat
  Pfam annotation: Domain name=LRR_1; Domain location=153-174; Score =16.0; E_value=0.14; Accession=PF00560.23; Description=Leucine Rich Repeat
  Pfam annotation: Domain name=LRR_1; Domain location=176-202; Score =6.2; E_value=20; Accession=PF00560.23; Description=Leucine Rich Repeat
  Pfam annotation: Domain name=LRR_1; Domain location=35-56; Score =15.4; E_value=0.2; Accession=PF00560.23; Description=Leucine Rich Repeat
  Pfam annotation: Domain name=LRR_1; Domain location=58-78; Score=7.2; E_value=13; Accession=PF00560.23; Description=Leucine Rich Repeat
  Pfam annotation: Domain name=LRR_1; Domain location=82-103; Score =10.9; E_value=2.6; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=105-126::12-33::128 -151::153-174::176-202::35-56::58-78::82-103
EIPESLTARLLNVEVLDVRSNQLKSLPNSIGCLSKLKVLNVSGNFIESLPKTIENCRALEELNANFNKLSKLPDTIGFELVNLKKLSVNSNKLVFLPSSTSHLTALKVLDARLNCLRALPEDLENLINLETLNVSQNFQYLDTLPYSIGLLLSLIELDVSYNNIKTLPESIGCLKNLQKLSVEGNPLTCPPMEVVEQGLHVVMEYMHHKMNSSDQNKTKKRWWIGKIVKCGTFNKQMRGGKRPENEGYNMLKHQNINGLASPGLMGMLSPLRLFSPRHSPRRSFG

SEQ ID NO: 194877 - protein, 71 aa, Glycine max
  Coding DNA Sequence Number=SeqID_78099
MEHTENEDAQPSKGEGVQPSAGEGVQSSDGEDIWSSKGDRLTVIIHATSSYLLVNLSGNFLRVYVLFDLVT

SEQ ID NO: 194878 - protein, 446 aa, Glycine max
  Coding DNA Sequence Number=SeqID_78100
  Gene Ontology: Mol. function=oxidoreductase activity, acting on the CH-OH group of donors, NAD or NADP as acceptor; Cellular component =glycerol-3-phosphate dehydrogenase complex; Biological process =electron transport
  Homolog annotation: Hit_ID=Q4GY29; Match level="QueryCoverage=99%, HitCoverage=99%, E-value=0.0, Identity=91%"; Hit description=UDP -glucose dehydrogenase
  Pfam annotation: Domain name=3HCDH_N; Domain location=2-121; Score= -106.6; E_value=0.021; Accession=PF02737.8; Description=3-hydroxyacyl- CoA dehydrogenase, NAD binding domain
  Pfam annotation: Domain name=ApbA; Domain location=3-178; Score= -32.2; E_value=0.093; Accession=PF02558.6; Description=Ketopantoate reductase PanEApbA
  Pfam annotation: Domain name=NAD_Gly3P_dh_N; Domain location=1-182; Score=-55.5; E_value=0.043; Accession=PF01210.13; Description=NAD -dependent glycerol-3-phosphate deh
  Pfam annotation: Domain name=UDPG_MGDP_dh; Domain location=203-298; Score=182.6; E_value=9.8e-52; Accession=PF00984.10; Description=UDP -glucoseGDP-mannose dehydrogenase family, central domain
  Pfam annotation: Domain name=UDPG_MGDP_dh_C; Domain location=320-424; Score=115.4; E_value=1.6e-31; Accession=PF03720.5; Description=UDP -glucoseGDP-mannose dehydrogenase family, UDP binding domain
  Pfam annotation: Domain name=UDPG_MGDP_dh_N; Domain location=1-193; Score=283.2; E_value=4.9e-82; Accession=PF03721.5; Description=UDP -glucoseGDP-mannose dehydrogenase family, NAD binding domain
  Pfam module annotation: Pfam domain module=3HCDH_N::ApbA::NAD_Gly3P _dh_N::UDPG_MGDP_dh::UDPG_MGDP_dh_C::UDPG_MGDP_dh_N; Domain location =2-121::3-178::1-182::203-298::320-424::1-193
MKVTVFGIGYVGLVQAAVLAEVGHDVLCIDVDEKKVESLKKGIIPIFEPGLTPLVMSNYEAGRLKFSTNAEEGVNHGVMQFIAVGTPPDEDGSADLKYVTAVARTIAQHMNDHKVVIDKSTVPVGTADRVRAVMSETLKQRDANIAFDVVSNPEFLKEGAAVNDCMRPERIVVGTDNDEVVELLRELYEPFNRNHDRMILMDIRSAELTKYAANCMLATKISFMNEISNLAERLGADVEKVRQGIGSDSRIGYHFIYPGCGYGGSCFPKDVQALIRTAESIGYTPRLLQAVEDVNDSQKNKLPTFIKRHFGDDLRGKTFALWGLAFKPNTDDMREASSRVLMEALWQAGATVQAFDPEAMEEAQRIYGHRDDLKLCGTKEAALQGADGLVICTEWQNFRAPDFDVIKSSLKQPVIFDGRNLYDPERISKRGFVYYAIGRGASIQIV

SEQ ID NO: 194879 - protein, 63 aa, Glycine max
  Coding DNA Sequence Number=SeqID_78101
MGGKCAESPSTFIRGKRRKNRKRRGLQTISVKGSGVVFTHGEGFQKCTFNQIKAKRTIQGVGP

SEQ ID NO: 194880 - protein, 327 aa, Glycine max
  Coding DNA Sequence Number=SeqID_78102
MSVESKVPQGYSLNIKSFVSLNVLNLVGLKSHDCHVLMQQLLAIAICGILPDKVRVAITCLCFVSNAICSKVIDPRQLDDLENEAVIVLFERYMKVLKGYTKNQYRLEASNVERVMGTPPRFPPHSDGQSEATFRRSRQPTRLRRLTLRTLDKPRPSVNINPITGRGPYPHKEKFHSYLGAKIDIPEAPNAKNKVMSIMATRCRQFKSSLTMKFVYGNTEGQDKQDPSIKYDLDPQTWEEFAATHKTPNWQDSLQEQKTQGSFVSHGHKDILNTSIGQPEHGGRVRAVGSGVTISQYYGRTSHGSNNSSTSITQQQLAEIIGSLKEE

SEQ ID NO: 194881 - protein, 66 aa, Glycine max
  Coding DNA Sequence Number=SeqID_78103
MKQKLKEAIKIELSLRGSQYSPPIEVEIQVLSAHVSTKGSNAETAVTPSGEEHVAHVIPIMGVYVQ

SEQ ID NO: 194882 - protein, 167 aa, Glycine max
  Coding DNA Sequence Number=SeqID_78104
MVEVAVLLLVASDGGGDSDNSGMVVVASGSGSDSNSSGVVVVTTLVLTASGDDIGGGCGAGDNDEGGIGSSDNDSDSNIDDGGGGDSNADGNGNVNGDDDDIDGGCDDVGGSDRDNDNGDGDDSDIDDSDGSNGDGDGDVIDNSDSSNADSQDGAIGGAVVMVVAAT

SEQ ID NO: 194883 - protein, 386 aa, Glycine max
  Coding DNA Sequence Number=SeqID_78105
MAKDSTLSDLGMLETMDYRRNTFMGPRWRCCKEMLEEDQEEPSEDSVDEAEEVIMEVSIEKGKEPFDEVAVMDGRHDVIATYSRDHENGVVIGGSFLNFNGPKPKYNCKGKKREKVVTGAKKQQIHAVNTKAHVANDELFSWVLEVVREGINVQGLRSKVKLKELRKFILKENPDFVCLQERKWRISMTSFVEKFGGMFMWNGGEGNLASDFNVVRKKEERMVYGGVSQQRGRKIEEFNSFIDGMELVETSIVGKRFTWVHIGDKLSRVVGDGNHVSFWKAKWVGEENLCKSFNHVYLNSQEVVCHMWNAIECHGPKLTALDGWDWSTNSGKSKWKLLDTNFSNASSRITYGIIATHGMVTQGCCQMKALLTFGNTKGHSKGSMRG

SEQ ID NO: 194884 - protein, 107 aa, Glycine max
  Coding DNA Sequence Number=SeqID_78106
  Gene Ontology: Mol. function=protein dimerization activity; Cellular component=nucleus; Biological process=regulation of transcription, DNA-dependent
  Homolog annotation: Hit_ID=Q0GPD6; Match level="QueryCoverage=47%, HitCoverage=22%, E-value=1e-18, Identity=88%"; Hit description=BZIP transcription factor bZIP77
MDEFSPGKVLYLHGSTLHPYPLAYWLCPVEVSIHKRNQLLDAFFLEDQGKLGFVEPGTPVSIQTPPKSYGNTDQGLMKKLKDFDGLAMSIGNGHAESAERRGENRLS

SEQ ID NO: 194885 - protein, 319 aa, Glycine max
  Coding DNA Sequence Number=SeqID_78107
  Gene Ontology: Mol. function=protein serine/threonine kinase activity; Cellular component=cytoplasm; Biological process=protein amino acid phosphorylation
  Homolog annotation: Hit_ID=Q6ZLP5; Match level="QueryCoverage=51%, HitCoverage=40%, E-value=1e-31, Identity=43%"; Hit description =Putative CBL-interacting protein kinase 23
  Pfam annotation: Domain name=Pkinase; Domain location=4-185; Score= -55.8; E_value=3.1e-05; Accession=PF00069.15; Description=Protein kinase domain
MSLLHQNYKSQWEGGAEIMANKTEEGQSVMFENHVYEPDKQQVTYKNGSTEYFQRLICKVAFCQSKGVSHGNLKPQNLLLDAKGVLKLSDFGMRPLSEQVSVASITGYEGAHADILSCGVILFVLLASYLPFNDKDIKTLYIKYKNANLISLVLQFFSPSVTRLIKTILDPCPATIDEMLEDEWFKNEHQPFRSFQQNISSDKDLKNVIGEGQHAGPSTSVTRNAFKKSLRLRLVCNLFRKVMITFGYHKKGSKTLLTSTALSSMIRKRTNWFTEVFSPKVKVELVEGGTFWLFKSPSLPGSMSWGSEVLCIATWAISL

SEQ ID NO: 194886 - protein, 116 aa, Glycine max
  Coding DNA Sequence Number=SeqID_78108
MHVIVERDYILSTMQKVQLSAHHALNAHARDSWLPMWLLALSEAIVLSSPHALNQGAMMVVMGGRVHDGGSRAGGGCTWKGLQCWWHEGGVMTMVAQGRGHNGGLRGNNGCARESP

SEQ ID NO: 194887 - protein, 81 aa, Glycine max
  Coding DNA Sequence Number=SeqID_78109
MREVKSEGDRVEKRKERGVWRSGELVWERGILNVGKWGKALEICREVVYREDQPKFNVDTTEKRPFYDDGNRPSTMVLSHL

SEQ ID NO: 194888 - protein, 49 aa, Glycine max
  Coding DNA Sequence Number=SeqID_78110
MEFMKSHPTVHCDTVTSKSIRNPAENGPLCLNHVQDKSFIASKAMSGLT

SEQ ID NO: 194889 - protein, 175 aa, Glycine max
  Coding DNA Sequence Number=SeqID_78111
MVKRDNMLKMGGALRKMGDESTKQLGGYAELCGATKATNGKHDFGAINKTHLLVAIAALVRPRAKCIGVGTFTFVSLDRSSHVPESMMTPSFPTALRQKCKAGRPCIDMPLTLIQAATERAPIEDSDVASRFGGGEMRELLLGQVLKRVWIRAMKAWVGGGGSGGASFGFGVGMQ

SEQ ID NO: 194890 - protein, 319 aa, Glycine max
  Coding DNA Sequence Number=SeqID_78112
  Gene Ontology: Mol. function=RNA-directed DNA polymerase activity; Biological process=RNA-dependent DNA replication
MVKIAGVPEDAIRLYFFPFYLAGEAKKLLHLFKGNSLRTWEEVVEKFLNKYFPESKIFEGKAEICSFHQFHNESLHEALDHFRGLLRRTPTHGFSEPIQLNIFIDDLQPHSKQLLDAFASGKIKLKTSNEAIELIENMVASDHVILRYRAYTPTKKSLLELICNLCGGTHELGMCTAQEDASKEVNYMANPNCQGMTVQSGPNFYERTTKLEDTLTQFIQVFISNHKSIGSTIKNLEVQVGQLAKQLAEKSIGNFMANSKKNPKEECTMVLTRRKRKENLEKTRVEGKMEDVSEEEVEDERREKEADNKETELRDEKSE

SEQ ID NO: 194891 - protein, 78 aa, Glycine max
  Coding DNA Sequence Number=SeqID_78113
  Homolog annotation: Hit_ID=Q8LLX4; Match level="QueryCoverage=46%, HitCoverage=3%, E-value=5e-07, Identity=72%"; Hit description =Putative retroelement
MKEEVRKEVLKLLKARLIYPNFVSAWVSPTQVVPKKGEHCVPTSFSTRFLKALNLAICSSEYKVQDHHRIQTQTTHRK

SEQ ID NO: 194892 - protein, 237 aa, Glycine max
  Coding DNA Sequence Number=SeqID_78114
  Homolog annotation: Hit_ID=Q8LGD5; Match level="QueryCoverage=28%, HitCoverage=34%, E-value=3e-10, Identity=48%"; Hit description =Protein MKS1
  Pfam annotation: Domain name=VQ; Domain location=54-84; Score=50.7; E_ value=4.9e-12; Accession=PF05678.4; Description=VQ motif
MNSQDIPSGRSPKRELQGPRPTPLRINKDSHKIKRTPVALPQPQPPPRQPVIIYTVSPKVIHTTPSDFMSLVQRLTGSSSSSSSSSTNKVSTEPLNGNKGCNGGSGSDAILPVAHFATIEMARTATQSTKQHPIENSDDVVGGIDDVVGHGALERPNMFHGILSPGPSSLSPIPSNFFSPPSIDPSMVSLFHDLSPVLRSSRNFMEGTTATFIMPSPSSFVSPRTPSIDLFNNFSDN

SEQ ID NO: 194893 - protein, 243 aa, Glycine max
  Coding DNA Sequence Number=SeqID_78115
  Gene Ontology: Mol. function=RNA-directed DNA polymerase activity; Biological process=RNA-dependent DNA replication
  Homolog annotation: Hit_ID=Q1RSE2; Match level="QueryCoverage=73%, HitCoverage=41%, E-value=1e-11, Identity=29%"; Hit description=RNA -directed DNA polymerase
MEGKSSFKSRKRGSHKVCGSGDSLIHHGMFHWMEWRRLTRSKKKGGLRFRVGYGRCILVFKDKRVSTLSGARIARGKDVGVNEEMQDDCVYWSFSTNRVYSVISGYQLAKNKFHVAGTSSNSNSNGFWKRVWFGATLPKCKNHIWRACSDTLLRVWFASPLSLRATEGVLTDFWRLHRWKRRDKGTSLGFIAQEPEGKVLASATKLIETNLQPREAEAFALRWAIILCARLLLPEVAFETDCL

SEQ ID NO: 194894 - protein, 273 aa, Glycine max
  Coding DNA Sequence Number=SeqID_78116
  Gene Ontology: Mol. function=binding; Cellular component=thylakoid; Biological process=photosynthesis
  Homolog annotation: Hit_ID=Q6K378; Match level="QueryCoverage=52%, HitCoverage=17%, E-value=4e-34, Identity=48%"; Hit description =Tetratricopeptide repeat protein-like
  Pfam annotation: Domain name=PB1; Domain location=214-273; Score =15.2; E_value=0.0069; Accession=PF00564.15; Description=PB1 domain
  Pfam annotation: Domain name=TPR_2; Domain location=1-32; Score=12.7; E_value=1.1; Accession=PF07719.7; Description=Tetratricopeptide repeat
  Pfam annotation: Domain name=TPR_2; Domain location=37-72; Score=4.6; E_value=9.6; Accession=PF07719.7; Description=Tetratricopeptide repeat
  Pfam annotation: Domain name=TPR_2; Domain location=73-106; Score =8.4; E_value=3.5; Accession=PF07719.7; Description=Tetratricopeptide repeat
  Pfam module annotation: Pfam domain module=PB1::TPR_2::TPR_2::TPR_2; Domain location=214-273::1-32::37-72::73-106
ELREEGNRLFQKKDHEGAMLKYEKALKLLPKSHIDVAHLHTSMAVRYMQLGVGEYPRAISECNMALQVSPRYTKALLKRVKCYEALNRVDLAMRDVRVVLNLEPNNSMALEVLDSLRMTMEEKGIVVDETEIALAALEKIKNKKEHTGGEDEGKAKKVIIEEKVKVENVEKKDNYKDKDHKFHKDHKDKEKKVVKKVKENEKLGEKDKEKGVVTRTVKLIHGEDIRWAQLPVNCGMRLVRDVIRDRFPGLKGVLVKYRDREGDLVTITNIAEL

SEQ ID NO: 194895 - protein, 52 aa, Glycine max
  Coding DNA Sequence Number=SeqID_78117
MEMRNQSCMKRVCDLNQERTEVVAIVRVCNLNEVYSKDESPLPPIAPQWNTF

SEQ ID NO: 194896 - protein, 158 aa, Glycine max
  Coding DNA Sequence Number=SeqID_78118
  Subcellular localization annotation: CTP_CleavageSite=69; ConfidenceScore=5.11e-01
MMRETCLQIARHRNIQGAKFSKGTNDAVLGPRKSALTGQREKKLSSSAETSRTRNCAKKSSRREEALIRSRRRGRSRVRFDRTRFEPGSRCCGVRRRRRRRLTRGGSGTVGLRSVGRGRGIAICYSHPTLFEKTFYTPDLDSPIGGCWRGVSPRLKPK

SEQ ID NO: 194897 - protein, 268 aa, Glycine max
  Coding DNA Sequence Number=SeqID_78119
  Gene Ontology: Mol. function=calcium ion binding; Cellular component =integral to membrane; Biological process=defense response
  Homolog annotation: Hit_ID=Q1SH11; Match level="QueryCoverage=92%, HitCoverage=66%, E-value=1e-74, Identity=49%"; Hit description =Calcium-binding EF-hand
  Pfam annotation: Domain name=efhand; Domain location=227-255; Score =29.2; E_value=1.5e-05; Accession=PF00036.22; Description=EF hand
MSTTLLIKVFEYFASDRSSEGEVLMKPADLMRAVVPVFPPSESHLVRDGYLEVAKDIYDLLWEGGDKGVHHRDGLRTGLKASDSVEDGGLVEYFFDKDGNGCLQHDKFVNFLRGLHDEILRLEFAHYDYQSCQTISAKDFALSMVASADMSHLGRLLERVDGLNDDPRLKDARITFEDFKNFAELRKKLLPFSLALFSFGEVNGLLTRDDFQRAASHVCGISLSDTVVEIVFHLFDANRDGNLSFDEFVRVLHKRERDIAQPVETGIR

SEQ ID NO: 194898 - protein, 42 aa, Glycine max
  Coding DNA Sequence Number=SeqID_78120
MNLLSAPAVLKELAKRAYRAKRVLLSKMNTHPPIEKPVAKRG

SEQ ID NO: 194899 - protein, 338 aa, Glycine max
  Coding DNA Sequence Number=SeqID_78121
  Gene Ontology: Mol. function=RNA-directed DNA polymerase activity; Biological process=RNA-dependent DNA replication
  Subcellular localization annotation: CTP_CleavageSite=52; ConfidenceScore=5.12e-01
MGFNAKSTMPMKTTSPNMGAWGQSSMRQVCDIVNLHYPSLFLVFESHGLFSRVEDFWNRLGYIPLFVQEVVGHSGHLGLVLYSEYYMFVDSFHEPSNNLFNQKKEYIVWYCTTVYVSLVPSNRHHLWDHLGDIRNQIRGSWLLIRDFDDIILPSKVSGGQFNSSRACLMADMMNACGVMDLEKIRGWFTWQKNIQADGHKRQIEARVKGMHKQLDTFPYSHFIILEKQLQVQYDQVSMEDVRHVIFSEFIQSSWTIAFATGTFDTSLTKTIIVSILKVYVPMTFKDFRHISLCNVLFKAIPKVLITQEIVHQMHKKKKGKKGFVMFKIDFEKAYDKVD

SEQ ID NO: 194900 - protein, 202 aa, Glycine max
  Coding DNA Sequence Number=SeqID_78122
  Homolog annotation: Hit_ID=Q10M13; Match level="QueryCoverage=29%, HitCoverage=17%, E-value=2e-10, Identity=55%"; Hit description =Expressed protein
MDEEGYPAFSLVNKATKHSIADYHPLTQFGWCRTIQIIWMSPLCGPRAGTSVIAIGLLGWQTKASGIGSLYWVPSLRYSFVKKLSSVERFHGKTGSLRRNAFYIRNIVIRTMFISETFFQRGMWSWLTYNTTSSWRSLRRGNGTRGSPNCRRKNIDMALVKEFYANIYDQKDDSPKQFKDHGKLIQFDVQMLNAFLETPIIL

SEQ ID NO: 194901 - protein, 116 aa, Glycine max
  Coding DNA Sequence Number=SeqID_78123
MGIPTKRLRMTNEKINRLLSKISCWRTRCQSGKFARVCVQIDLDKPVVGKVWLKGHWFYGHLAHNYPKVVLVDDHNIAQSHVPINKGKEKQFATTSTMVRVGSTSHAVTNLNIYIQ

SEQ ID NO: 194902 - protein, 86 aa, Glycine max
  Coding DNA Sequence Number=SeqID_78124
MGAKHLTRTKEKSHVIKQRSPDEIRISLSKLVSLSELVSLSKSPLFVLSATIRAPSALSLAQRANSRSAQFPLELELRLARPSRLV

SEQ ID NO: 194903 - protein, 284 aa, Glycine max
  Coding DNA Sequence Number=SeqID_78125
  Homolog annotation: Hit_ID=Q8L8M8; Match level="QueryCoverage=56%, HitCoverage=76%, E-value=4e-47, Identity=59%"; Hit description =Serine-rich protein
  Subcellular localization annotation: CTP_CleavageSite=78; ConfidenceScore=5.84e-01
MASSSRTKSSGPVLRSSSSSSSLSHSNSFCSYSTSNAPFHSPSSSFFRKPHSHVPPRSTSPTRVNLFSAAPLPSHSVRFALDRSISPNRTVSSHVIAKHRHVTAQKKSCMCSPTTHPGSFRCSLHKNSHSAQTGSFPSNRLNMRRSAMKNSLVRIGGVEGEWVKRALTALIRPSSHQQRRRTAFEPRQSRLSIMLFLNRRNIRISAAGDGFSPIASPENLEDFVGVDLRGWTLDSENSFFSEYAFMSLLFLPLAFRHSFVTLCGGFVAAVEPPLSFVHCFAFGA

SEQ ID NO: 194904 - protein, 41 aa, Glycine max
  Coding DNA Sequence Number=SeqID_78126
MEAQSLTPQGHDDGSGDITAQRDIVELAKRKEYSGKEKDND

SEQ ID NO: 194905 - protein, 177 aa, Glycine max
  Coding DNA Sequence Number=SeqID_78127
  Homolog annotation: Hit_ID=Q9AVH2; Match level="QueryCoverage=99%, HitCoverage=79%, E-value=3e-60, Identity=56%"; Hit description =Putative senescence-associated protein
GKTNLSHDGLNPAHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGRSSFPADSAKPVPLAVVSLDSRQGQWESR

SEQ ID NO: 194906 - protein, 98 aa, Glycine max
  Coding DNA Sequence Number=SeqID_78128
LPPAIVKKEKLDYIEERLRAIEGGKHYAFADMVELCLVPDVVIPPKFKVPDFDKHKGTTCPKNHLKMYNRKMGAYSRNEKLLMHFFQESLTGAAVVGS

SEQ ID NO: 194907 - protein, 459 aa, Glycine max
  Coding DNA Sequence Number=SeqID_78129
  Homolog annotation: Hit_ID=O22159; Match level="QueryCoverage=77%, HitCoverage=71%, E-value=8e-21, Identity=23%"; Hit description =Expressed protein
  Pfam annotation: Domain name=DUF247; Domain location=23-448; Score =188.1; E_value=2.1e-53; Accession=PF03140.6; Description=Plant protein of unknown function
MTQQPDFSWMVPIEVMLGSLYHGQVQACSISSVTDELRGPNKAAFKPKEVSIGPLHRATTRHVQLMEETKWRYMREFLDRKGTQEQNRRSEQRLRECGTDILKLDKIIMASYGGNIESEPRELAKIMIVDGCFLLELLIRLGDFICNSSNSTNSYANDPILKNKEKVVSVLNDITMLENQIPFIVLKKLYRKVFPDSSDINNDHRVADIVRKAFGYDEVKNPVHILHLMHLSTVQQSQQEGKRVKQELLRCAKRLQAAGVTIEAVNTTSGHELVDWFNFELNFSDSVLRIPRLYVKDTTEVRWRNLIAWEQSRIWITCKYTSYALFFQGLVCCKHDIELLEKNGVIVNKAGKSKDELLNLFHTITKGAEHMDSSYSEICERLNEYKGGKVTTAFQGLPVVTWHKCRHVFQIIAYYWGNWYKILKRDHFPTVWKSIGVLAAAALLVLTIMQTYYSSRNND

SEQ ID NO: 194908 - protein, 205 aa, Glycine max
  Coding DNA Sequence Number=SeqID_78130
GGGPDDMRRQNLVIPHPFAIQTRSCPMARRDKLWSFCTLLSSRGGGPDDMRRQNLVIPHPFAIQTQSCPMARRDKLWSFCTLLSSRGGGPDDMRRQNLVIPHPFAIQTQSCPMARRDKLWSFCTLLSSRGGEPDDMRRQNLVIPHPFAIQTQSCPMERRDKLWSFCTLLSSRGGGPDDMRRQNLVIPHPFAIQTQSCPMARRDKL

SEQ ID NO: 194909 - protein, 99 aa, Glycine max
  Coding DNA Sequence Number=SeqID_78131
  Homolog annotation: Hit_ID=Q6Z5L0; Match level="QueryCoverage=98%, HitCoverage=19%, E-value=6e-35, Identity=68%"; Hit description =Glucose-6-phosphate/phosphate-tranlocator-like
MWKTTPITLIFLAAMLPCLDPPGVLSFDWNFSNSMVIFASAILGFLLQWSGALALGATSAISHVVLGQFKTCVLLLGNYYLFGSNPGKISICGAFTAIA

SEQ ID NO: 194910 - protein, 188 aa, Glycine max
  Coding DNA Sequence Number=SeqID_78132
  Gene Ontology: Cellular component=integral to membrane
  Homolog annotation: Hit_ID=Q84YG8; Match level="QueryCoverage=79%, HitCoverage=34%, E-value=7e-18, Identity=35%"; Hit description=Auxin efflux carrier protein
  Subcellular localization annotation: CTP_CleavageSite=56; ConfidenceScore=5.27e-01
MLNNNKHEKSFSRSKSVSDDLVIFPSLKPSNNDKGLHMFVWSSTSSPTSDVNMKHRVNTVGSADFEIIGSSKFVDFSHETVASKAVHEREIEEGDKLPVKEVSIEEGNANKKQKMQRASVMIKLILTMVYLWHYNPRSLLVEKTRAGISMVIKFLVGPAVILATSKAMGIHGVLLHVTIIQVKQIIPL

SEQ ID NO: 194911 - protein, 170 aa, Glycine max
  Coding DNA Sequence Number=SeqID_78133
  Gene Ontology: Cellular component=integral to membrane; Biological process=auxin mediated signaling pathway
  Homolog annotation: Hit_ID=Q84YG8; Match level="QueryCoverage=53%, HitCoverage=16%, E-value=4e-12, Identity=51%"; Hit description=Auxin efflux carrier protein
MEVTNIRYYGLICREEQHTYSFASLFSLSEKSERKKDFIHLEDHKINLDPHLPFIIPLWLIEVLSYSFQTNSLRLAGAISTLSVDSNVGSLNGREPLQTDVEIGENGQLHVLVRTMQSRSMSMASPRASNLTRVEIYSVPSSRDSGSSFRGTNLQPPTSTTLQGGGGFEE

SEQ ID NO: 194912 - protein, 536 aa, Glycine max
  Coding DNA Sequence Number=SeqID_78134
  Gene Ontology: Mol. function=transporter activity; Cellular component= integral to membrane; Biological process=auxin mediated signaling pathway
  Homolog annotation: Hit_ID=Q84YG8; Match level="QueryCoverage=99%, HitCoverage=100%, E-value=1e-153, Identity=51%"; Hit description =Auxin efflux carrier protein
  Pfam annotation: Domain name=Mem_trans; Domain location=9-530; Score =484.9; E_value=9.4e-143; Accession=PF03547.8; Description=Membrane transport protein
MIKGKDIYEVVAALVPLYLALFLAYGSVRWLKIFTQEQCSGISRFVSVFAVPFLSFDFISSNNPYTMNLRFLAADSLQKIVVLLALFLFNTFTKWGSIDWSITLFSLITLPNTLVMGDPLLKAMYGEFTHALMTQIVVLQSVIWYTLLLVLFEYRGAKLLISEQFPETAGSIATLRVDSSVSSLNGREPLHADAEVGENGQLHVVVRSMSRSVSMASSFHKSYSTGVEIYPFPSSREQTSLQSFGVHESRFWRSKSDGDAVFNSGLVSSFPSIKPVFQGSRSGGQTNRDMSSSDGATSNMGLHMFGWSRRESSTSEVNMKHAVNRVAPSDQLAVHELEEIREGIEHPVMGRRRELSIEEDDGNKRQQMPRVSVMIKLILTMVWRNLLRNPNAWASVFGLVWSLIFFRWNIAMPKIVRKCIDIISHTGLGMAMFSLGLFMALQPKIITCGKTRATISLVIRFLIGPAVILATSKAMSIHGVLLNVAIVQAALPQGIVPFVFAKEYNLHPDILSTAVIFGMVVALPVTIIYYVVLGVL

SEQ ID NO: 194913 - protein, 1029 aa, Glycine max
  Coding DNA Sequence Number=SeqID_78135
  Gene Ontology: Mol. function=protein binding; Cellular component =membrane; Biological process=defense response
  Homolog annotation: Hit_ID=Q1SPY2; Match level="QueryCoverage=81%, HitCoverage=44%, E-value=2e-89, Identity=30%"; Hit description =Disease resistance protein; AAA ATPase; Zinc finger, C2H2-type
  Pfam annotation: Domain name=ABC_tran; Domain location=173-305; Score= -60.5; E_value=0.039; Accession=PF00005.17; Description=ABC transporter
  Pfam annotation: Domain name=LRR_1; Domain location=563-583; Score =2.9; E_value=81; Accession=PF00560.23; Description=Leucine Rich Repeat
  Pfam annotation: Domain name=LRR_1; Domain location=585-606; Score =11.1; E_value=2.4; Accession=PF00560.23; Description=Leucine Rich Repeat
  Pfam annotation: Domain name=LRR_1; Domain location=608-631; Score =4.0; E_value=50; Accession=PF00560.23; Description=Leucine Rich Repeat
  Pfam annotation: Domain name=LRR_1; Domain location=766-790; Score =2.5; E_value=97; Accession=PF00560.23; Description=Leucine Rich Repeat
  Pfam annotation: Domain name=NB-ARC; Domain location=141-422; Score =60.3; E_value=6.4e-15; Accession=PF00931.13; Description=NB-ARC domain
  Pfam module annotation: Pfam domain module=ABC_tran::LRR_1::LRR _1::LRR_1::LRR_1::NB-ARC; Domain location=173-305::563-583::585 -606::608-631::766-790::141-422
TVSFQMEDSVLSIRAKIVEYIVGPILHHAKYLCCFNNFAVNLPNAKRELELTLEQVKLRVREATIRIEKIEPTVEEWLEEVEKVLAEVQILEGRVLKVTKSSFIRQCRYFLAKEMVRKIGQMNQLKCNKLEPFSRSINLPDMKYYSSKDFVLSNSTESTYNKLLETLKDKNVSIIGLVGIEGSGRTTLANEVGKKAEKLKLFEKVVMTTVSQNLNIISIQEQIADKLGFKLEEESEESRAKTLSQSLREGTTLLILDDVWEKLNFEDVGIPLNENNKSCVILLTTQSREICTSMQCQSIIELNRLTNEESWILFKLYANITDDSADALKSVAKNIVDECEGFLISIVTLGSTLKKKSLGDWKSALKRLQDSKPLVITKGLKIPHDHEIDLEDLFRFGRGLGLTKTSETMEKSRREIEIAVNILKDSCLLLKVSNKERVKMHDMVRDVALLMASERGQAMLASTAMDLRMLVEDETLKDKRAISLWDLKNGQLPSDNQLNCPTLEILLLHSPKAGFEVSNLCLERLKVLKILSFLTCGYTWKLPQFSPSQYILSLPQSIESLKNLHTLCLRGYKLGDISILESLQALEILDLRGSYLEELPNGIVELKKLKLLDLYNCWIEKNNAYEVVGRLQLEELYFHLFSYKEDIPHNVSFSRLQRYVIVLDHRPYSFHLKTEIMEEHRPSRALYINGLNASTQRFISLPIMDLFLRAEYLHLKHLKGGYKNLIPSMDQQGMNQLIALVLEYSLDIEYLFDSTMITTKDVFLSKLVTLRLNGMHGLQEHILSKVLKSMQYQGLKNIQLPSPNFSLHAIHCQNSSAAGELVSLQRMSIRKCSELMYVFGNEKEHDLSAYQHQSTYHCLYPNLLNLDTFKLDSLPNLVDFWPDYYRPRLLNLKEGRCTECPGLSNSARKVDKVGKVSSHRTQQDTTIGKTIRRLKGILDRAEMTSSTQESIAPSSSNNAYEDIARAQQQVAEAQRDASIARQETTVVSHLLEQMMEKLAVNEQIGLQKRAHEHVGLQRGTQQEPGAESK

SEQ ID NO: 194914 - protein, 32 aa, Glycine max
  Coding DNA Sequence Number=SeqID_78136
MTDRKLVKDKPSADSGSKSRGSVKQHSFKYTY

SEQ ID NO: 194915 - protein, 86 aa, Glycine max
  Coding DNA Sequence Number=SeqID_78137
MGNYVVAQKGTDTPRKYTQDPKCKRLRKDSTKVIFVGPKIQTKYPNPQGKNLDIARKDDKSKAIPPNGFLLVSTTKPEKDISMLPK

SEQ ID NO: 194916 - protein, 83 aa, Glycine max
  Coding DNA Sequence Number=SeqID_78138
  Subcellular localization annotation: CTP_CleavageSite=25; ConfidenceScore=5.01e-01
MKFSDSNFPAPSSSNSTLSLSQIVSGNLTTGEKEVRRVIDGEDARIDREYNFKEREMHLVNNVSVNRNNLYPNKHRPTAASWV

SEQ ID NO: 194917 - protein, 33 aa, Glycine max
  Coding DNA Sequence Number=SeqID_78139
MPMDSPPYWTMHVGDTQIIYSVACKVWADFSSP

SEQ ID NO: 194918 - protein, 88 aa, Glycine max
  Coding DNA Sequence Number=SeqID_78140
MKSTKLDISTKETPRPTSTSQIRGTCQKSASLSPKGPGVDPENIKKINTGTKKQTKEKQKTEADKDNSNNGVSDLLHQNRNPPSTLEV

SEQ ID NO: 194919 - protein, 94 aa, Glycine max
  Coding DNA Sequence Number=SeqID_78141
MKEEVPGHIKHRDPILSQIFRTVVYEGGSHLHCTPVNPRDPCALRKIRGLLKFFSSAGPTVQSRARGEACEKKGPTCDAKVKRGTNGKERWVYG

SEQ ID NO: 194920 - protein, 73 aa, Glycine max
  Coding DNA Sequence Number=SeqID_78142
MVICQHTFAIQRPESPIACRDALRLSTPHHAKTPSPIDKQHLLILTHGSGGRRTYPAVVRTNTTSADPDPRVR

SEQ ID NO: 194921 - protein, 141 aa, Glycine max
  Coding DNA Sequence Number=SeqID_78143
MLEVFGLLKVVGYLAPSPLLKSINKLFPSNSDMGRKSGCVRDYMDFDEIIYPTEQCGGFFPNARANVFGSMIDDEVFSPRVVAMATSSLVKDIHCAYHIPRKWVLLVWLGIISVIESMALLVMFMGKKLFWVSLWESSGVF

SEQ ID NO: 194922 - protein, 173 aa, Glycine max
  Coding DNA Sequence Number=SeqID_78144
  Gene Ontology: Mol. function=nucleic acid binding
  Homolog annotation: Hit_ID=Q1T6D0; Match level="QueryCoverage=54%, HitCoverage=18%, E-value=2e-33, Identity=68%"; Hit description=Zinc finger, CCHC-type; Lipocalin
MVWVRFPNLNIVYYDESFLLALRSVIGSPIMVDTNTLTVTRGRFARVCVEIDLNKPVIGKVQVDGLWMKMVYEGLHIISSKCGCYGHATRDYKQPDVSSPQKQTLLRRWNKRKMQLEQEDKIGSTVIETPQSNSKTRSQDAKVWTKKKRPRVNDQKGKAAYILSLANVTKEAI

SEQ ID NO: 194923 - protein, 256 aa, Glycine max
  Coding DNA Sequence Number=SeqID_78145
MAPKKLSTKRSRKDATEEGPSTAPERVQLRDDEYPDFQEEVAHRRWAPLMTPMAKFDQEIVMEFYANAWPTEEGVCYMRSWIRGRKDQADGFDKEAISQLLCTLGQDFARTHMTTLTQIWMTLLLSNVLPSDHNSDLTLPKCQLVYAILTRMNVHVAQLIVDTVYMFAAMAPTRHPLDPEKSNRALGFPALITGLCQFYGVPVAPSKVIRPPITKAFVEKYYTPKQAQGEAPQQQPITEDWYCCMSTSTSRPSASR

SEQ ID NO: 194924 - protein, 186 aa, Glycine max
  Coding DNA Sequence Number=SeqID_78146
MWQRQRPTCTKVIDSLLNWYDLHQLLFLILVYTLAELIGQSADEVNRLKIEDGDVDLNASLQVLDRLLDCFLAFKVKVQPRFRNAVVLRYSDESNLINVVLDMLPDTEQSMFITSDDDRSMLDSTEPTELESQFVSVTADNDPLLRIPLTPTKRASFDELDDGPKNFEISHAKVSSNKLAKLCQPE

SEQ ID NO: 194925 - protein, 148 aa, Glycine max
  Coding DNA Sequence Number=SeqID_78147
  Gene Ontology: Mol. function=ribonuclease H activity; Cellular component=mitochondrion; Biological process=DNA integration
MKEICEELKIQHHNSTPYRPKMNGAVEAANKDVKKIIQKMTVSYEDWHEMLPFALHGYQTSIRTSTGATPFSLVYGMEFVLPFEVEVPSLRIMVESGPPYRGQAIDGYEPWTFLLEMGEECFRQKGAPAQVQRGRPGVEEGVPGPNGQ

SEQ ID NO: 194926 - protein, 83 aa, Glycine max
  Coding DNA Sequence Number=SeqID_78148
MLDTPEPLKLPRFLRRSGPPLEWKVETLNPAIGGKGVVQPWYDFLEEMDFDDGDEVSIYYRYYEKNWDIIIRRREDWEDNDNN

SEQ ID NO: 194927 - protein, 71 aa, Glycine max
  Coding DNA Sequence Number=SeqID_78149
MQSQFQSQMQSQGLALPPEPMAGPSGRFYEGSTVHNIPLLPGQVKVGVEEVKDALAPVPVPTDELHYWGRH

SEQ ID NO: 194928 - protein, 124 aa, Glycine max
  Coding DNA Sequence Number=SeqID_78150
MDFFSDESFECIQAFQNSNLIPFMSIKLPVYSELVKAFYSNLEIQESTLISEVYGINMVIDQSLFYDLTQLTSDGDAIPPPRALDRRLQEDWAKDAREGPRVLMSLRVALGPWAKYVPTYLCTY

SEQ ID NO: 194929 - protein, 147 aa, Glycine max
  Coding DNA Sequence Number=SeqID_78151
MDDQTKSIQTLSIEGSIEYRKHNQLDIKYLHQLFIRNPQLGCLASHYRRKPNNNNKLTKPRHCGVLWNLCKSSTYPNSAQNRLYIGSKFMTLCLAPPSHLARLKTTATLSALILCLARGLDIDDLPDSSVALSALKLHLAVDACLAY

SEQ ID NO: 194930 - protein, 111 aa, Glycine max
  Coding DNA Sequence Number=SeqID_78152
  Homolog annotation: Hit_ID=Q10D72; Match level="QueryCoverage=71%, HitCoverage=2%, E-value=1e-10, Identity=44%"; Hit description =Phosphatidylinositol 3-and 4-kinase family protein, expressed
MYSTVLLIGTKQEWKLAQCTVEVASNGLYTATNELCIACLKAKSASGDLQSTVLSMRDCAYEASVALSTFAQVSRIHTALTSKSGSMLEESCPSSYNPKHYHELYNFRTRG

SEQ ID NO: 194931 - protein, 84 aa, Glycine max
  Coding DNA Sequence Number=SeqID_78153
  Gene Ontology: Mol. function=cysteine-type endopeptidase activity; Biological process=proteolysis
  Homolog annotation: Hit_ID=Q1SLM3; Match level="QueryCoverage=94%, HitCoverage=43%, E-value=4e-10, Identity=66%"; Hit description =Peptidase C1A, papain
MMTITILTYTIFNLLILCNTWISASECPPIHKNNSSNLEAMKVRLIPHTGFMYHEHGDLPESKDWRKEGEVTDIKDQGNCGKVS

SEQ ID NO: 194932 - protein, 35 aa, Glycine max
  Coding DNA Sequence Number=SeqID_78154
MVELKSVWFRSLIQKSKRASSVRLPEGRVPRKGDT

SEQ ID NO: 194933 - protein, 42 aa, Glycine max
  Coding DNA Sequence Number=SeqID_78155
ASFDANVIPPHVQILQHAEFDIRKEAAWVIYYYVTSRGSRTI

SEQ ID NO: 194934 - protein, 42 aa, Glycine max
  Coding DNA Sequence Number=SeqID_78156
MAIMVSVLITANELKSEKWIFCLARRIEEAGIEMMMSCVSNA

SEQ ID NO: 194935 - protein, 73 aa, Glycine max
  Coding DNA Sequence Number=SeqID_78157
MKGKSQHLHKRLIGLTRKTQSPVESPTVATYPSVGGRCEAHGCVFQGRKARRVATNVYSRKTLEKPKCVVYKL

SEQ ID NO: 194936 - protein, 153 aa, Glycine max
  Coding DNA Sequence Number=SeqID_78158
MMITKDDDKGDDKKLKGRSKNEFKMFKMESRTIQDSRGKVEEHFKIQEIKIQDSRIKRRLNQDKYEKIKSLEVSRLRELGQLMGQLQRQAFRKAYSKIWDLTTAELVDDYAKAYAKKEARGEGGRFIAQRGGDMDGPFRPYFGWESRASLTTS

SEQ ID NO: 194937 - protein, 35 aa, Glycine max
  Coding DNA Sequence Number=SeqID_78159
MYRFFKDCSIHIPCGQFWMLQWVWKIYPLEGDASF

SEQ ID NO: 194938 - protein, 667 aa, Glycine max
  Coding DNA Sequence Number=SeqID_78160
MERDLMEPIFIVVERDYWSLFIGIVVAFADNSRLRVTSLLSPQVWMSVVRCPRQYISPPSSEPACRQKRLSSAEGVCPVSRGDKFIKPLIMDECCPVSGVVTSMSVRDLQDDVPVVRDGCVFSVSGVCGACIILLHACHSRSMHILELWMSSFLFDYAIGLGDSDSKGLIEQPIIDREVISIGGSSSEDTRRGAFDSESSSSERALPSAPTGEPVPVTVILPPCAYEGVRRGNGGRDSRTSPHVLDLILPFTTFQCALLEHLNVAPSQLHTKNWAMIQAFESLCPFFNIQPSVSDYCFKVLAIGVMIDGMPLMFNKDRESCFPFYWQSDPIKFKSYDEDLLTFVERVDKAILEQLSASLDARAILALPLASDPLTVLDSGIVPPSIVAPSVGEVGQPVGKVGPVAVVAEVTPSAPSSVLAKRMMDDVARSSSRKKSKAHLSLHALRLAVGLMASVGCFSTMQDMPSAPQEVTPAIVEVTVPATQADFVMAPSSTVATPLLSVGVATTGASTVLLPFSTTPVASPFVVLAMVASPFLSSHPLVSLDHLYTSSDTDSLMLLILPKFFSKGVCQFKRSMDAEAVRLNHQLSFKAEKKDLGGKVESMEAEKDGFSKVIDDLEVRLKDSKSKLQVGKEKETSMELEDLDLGLFDPFKDVKDDVLLDEEDIAA

SEQ ID NO: 194939 - protein, 94 aa, Glycine max
  Coding DNA Sequence Number=SeqID_78161
MACFIWITSLNSYVVVVCQMYQGIGFILLIFAFNGPSLCHPTITLRCPWLRCLFHPSRFCRLVKLQCLLLIPAPHPSKSLGTTWGRYGGSCVGG

SEQ ID NO: 194940 - protein, 120 aa, Glycine max
  Coding DNA Sequence Number=SeqID_78162
  Subcellular localization annotation: CTP_CleavageSite=59; ConfidenceScore=5.68e-01
MRSDCLVQFSILNLFRSPMNCVFVHVSSTFVFGAMRSDCLVQFSILTLFRSPMNCVFVPGSSTFEFEAMRSDCLVQFSILNLFRSPLIGVSVHVSSSFELGAMRSDGLVQFSILNLFGAP

SEQ ID NO: 194941 - protein, 1064 aa, Glycine max
  Coding DNA Sequence Number=SeqID_78163
  Gene Ontology: Mol. function=DNA binding; Cellular component=beta -galactosidase complex; Biological process=DNA integration
  Homolog annotation: Hit_ID=Q1SS72; Match level="QueryCoverage=98%, HitCoverage=73%, E-value=0.0, Identity=44%"; Hit description =Integrase, catalytic region
  Pfam annotation: Domain name=rve; Domain location=582-742; Score =145.5; E_value=1.4e-40; Accession=PF00665.16; Description=Integrase core domain
  Pfam annotation: Domain name=zf-CCHC; Domain location=246-263; Score =5.0; E_value=0.15; Accession=PF00098.13; Description=Zinc knuckle
  Pfam annotation: Domain name=zf-CCHC; Domain location=282-299; Score =12.1; E_value=0.01; Accession=PF00098.13; Description=Zinc knuckle
  Pfam module annotation: Pfam domain module=RVT_2::Retrotrans _gag::rve::zf-CCHC::zf-CCHC; Domain location=944-1063::77-192::582 -742::246-263::282-299
MNEASINNTESYLYLHPSENPTIALVSPVLDSTNYHSWSRSMVTALSAKNKVEFIDGSAPESLKTDRMYGAWRRCNNMVVSWIVHSVATSIRQSILWMDKAEEIWRDLKSRYSQGYLLRISDLHQEASTMKQGSLSVTEYFTRLRMIWDEIENFRPNPICSCNIRCSCTAFTIIAQRKLEDRAMQFQRGLNEQYANIRSHVLLMDPIPAISKIFSYVAQQERQLLGNTRQSINFEPKDISINAAKTICDFCERTGHVESVCYKKHGLPSSYDARNKSNNGRKTCTHCGKLGHTVDVCYRKHGYPPGYKPYDGRTTVNNVVAVESKATDDQAQPHESHEFVRFSPEQYKALLTLIQEPSAGNTTPNQPKQVASISSCTANTPLNPGMSPSTSTHLTSWILDSGATDHVTCSLHNLHSHKQINPITVKLPNGHHVHATYSGTMQLSPNIILHNVLYIPTFTFNLISISKLVSSTNCELIFSSTLCVLQETNNHMKIGIVEAKHGLYHLIPNQIITKAVNSTITHPRCNVIPIDLWHFRMGHPSTERLQCMKTYYPLLRNDKNFMCNTCHYAKHKKMPFSSSNSHASHVFDLLHMDIWGPCSKLSMHGHKYFLTIVDDCSRFTWIHLMKTKVETRHIIMNFIAFIETQYNGKVKIIRSDNGVEFFMHHYYASKGIIHQTTCVETPEQNGVAERKHQHLLNITRALLFQASLPPNFWCYALPHAAYLINCIPTPYLHGISPYEKLHKHPCDISNLRVFGCLCYINTLKANRQKLDARAHPCIFIGFKTHTKGYLVYDLHSHDITVSRNVTFYEDHFPYLSEIQQPNPDNSDPSSGSFSGKNLDPPIESYPSRPMMTIPSCNEPSNEQSPSHLRCSTRARHAPTYLQDYHRDLASSTSNASTIVRYPLSSVLSYSRLSPAHRNFFITISSTKEPSSYAEASRHDCWIKVMKVELQALQSNNTWRLTPLPPHKTAIRCRWIYKIKYCADGSIERHKARLVAKGYTQMEGLDYLDTFSSVAKLTTIRVFLALAALNQWHLRQLDVNNAFLHGELEEEVYMQIPPGLLVENP
